United States Patent 10,407,724 (METHODS AND COMPOSITIONS FOR SCREENING AND TREATING DEVELOPMENTAL DISORDERS) - sequence listing, part 17

SEQ ID NO: 264 - DNA, 3322338 bp, Homo sapiens (residues 1,661,170-3,322,338 of 3,322,338)
ttggtgctgaggacgaggggcctcgctttactaggaggccctgccctgagccggggtcggcctcccttgtggctgccttcctgaggcaccctctctcctgcaccccagacatggtcctggcctccaggagggataggtgagcagggagcccagggagctggtcaatcctgggaacgtgtggggagtgtcccgaggcctccttgaggagaagggttttttccatccccctcaactcttggagaggatgagggtctgtctgatgccaggtgtgatcctagggccatgggccttgtataattttattgtggacagtttaggccctgtaacccttccttatctctttattaaatgctaaacaggatggttaaaaaccccacaaaagtcaaaaccgtgcagaggggtgtaaaatggaagtgaaacctctcccgaaccccactcctactctctctccagaggcaacaatcgttacctgttgcttgtgtctgtcccaggaaaggtccccgccttcataagcataaaccttctctgcaaaggccaacggggctgtgccgcacactgcgtgcccgtccctgtcccgggtccacctgccgtccatccactgtcgccaaggatgaagagacgattggccattcctacccagccggtttccactactaaagacacctctggcaagtgttcagtttccgtgggagcgtgtctggggtgcctcccagctcttgccctgcacactgaagggacgtggatgggggtggggtgggctctggagggactggtctgcctccgggtaccgtccacctcgtcacacatgaagacacgaaggtgcggagaggtggggggcggggctcttgaccagcaccagcaggctggggagagatggcggtatggagggccctgggctccaagcacccagggaaggaatctgagcactcaagccccatgtcctcctccctccctgaaacattgctgcgtgtggtctgaatggaagccgagttccggcaattaatcccatcagaggggccctgctgaatggtaggaggtttttttctgttttgctcccttggtctagatttccctggggacagctctgaccagccgccgcgtgcctggtaaattaaatgttaaaaaaaatccccacaatgactttaatcaatccactgacatggcgggtggcctcccagaagcccttggtccgctgaagggagcccccccctccccgccccaggctcagggtcttggatgagacaggatgggggaagaggacagtcttccccagtccccttcctgtgggggagggaggagggtgggtggtccccagagtgtcctcctggagagggacagagagaaaggggggactctggccccctttataacttgccctgatcccaggccaggagtgatggtggacgcagggagggggcagctcttccccgcctctctcctgaccagaagcctgggtgagtacagagcaggtggtcacgatcggccatgtggtcagcaaatccagcgtttatggtgattctgttggagacaaatggcagtgctgggctctgggttggagtcaggttgagacaacgtccttcagcctccactggggggagtcaggggaaggaccgggggagcaggacggccttgcggcgccgccggagcagtggggttgtggggcgtggccatggtccttcccaggggagagtagaggagtgcagggggcagagagcacagaaagtctagcccagccttagcaccccagccaggccataggtgcgcgctggcgccgctgaaaacgttctccttccctcgcctgtccaccttccaggtcctgctcaaggcgcctaatatcccctgggcagggtccctgacacttccttaactcccaaagaccttccgcgtgggcctagcgcatttaggcgaacctctctgcctgcttgatcctctcccttcctccctcaagccaggcatctcacccacttgcgcgcgaggctggggcagcccacaggaggagcgcgggacccgggcttgagtttgcacccaggcagagcgcccacccccgcccctagcttcggaccctgaaagtaaagtcgtcgtgcccggcagccagcccgaatcttccagccctcagggagtcggggtcggggcagggaaggccacgggtggcggcacaatcgggatcctggagtggaggcgcagactgcgggtcccgctgcgcacgctccgtggtccggttggggtgggccttggaggtccataggccaaggttgaacgggggctctggagcgtgggcggggtggagtgcacaggtcactgggctctgagcgtttccatgggccaggaccccaacgcgccgtgtcctcaggacagattggagggggaaggggctgcgattatgccccagtcggaagggttttacagcagccgcgctgccctctccctgccggatacccggcagtagacaccgacgtctgggggctagcgaggcaggtgggcgcggaccgcgacccgattctggcttccaacctccgcccagtggcgcgcggggccgtcgccccacacctccagtccgcgtggctggtgtctggctcgccgccggggcggaaggggcgctgtcggcgcaggcgggcggggccggagcgcgggggcgcgcggcgcggagcgagcgcagggctcgggggcgcggggcgcggaggaccgggggcttgacgggcggccctgcgcggtgcggggcgcggcggcggcgggcgcgcggccagtgaacgcgcgggcggggcggcggtggcgggaggcactaggggccgctccccgcgcttccctcttccatggcgctgccccagccgcccgagccgccccgcggcgcgccccgcaaggctcccagcctgctggagatgggggcgctctgcctggactcggagatcatcctgggcttcaccagccacctcctgcggcgacgaggcaaggtgagggctgtcgggaggggggcgggcggcgtaggcgccgtcccgttactttgccgcgcggctcgcgcggccgggggtgctgcgccgggaaggagacggcaggtccggagccgcgtcccgcagcccgggctgggactcgctgccgcactttcccccattagcgttgtccaagtctccctctgccttcaaggctgtgtcccaaccggacccacccggaggctgtggctagggcggagagcgcagcgcagggattctcgggctcaccttgcgccttgctaggatgggcgaagtagggggtcggggcccctgactgatcgtgagcccccgaggtgactccagccttgtgcaccccgtgttctgcggatatgggatgtgagcttgtgcttcccgaagcgccgcggcggtagaagcgctgaagttgcgggtgtggctggccaggggcgcaggaccggtgctcccgaccgctgcgtgcttctgtgttgcgtgtgtgggtggggggacgggatatagagagtgtgtgtcccggagcagtggagcggcgggaggcggtgctgtctgccggcagtgcggggtggggtttgggtgttgtcctcagtacccagatccagatgtgggctgacgcccgttttcattctccaggctgcgaagagacgggtaggggaagcgcttccggccccccaggctgggtggaaagcgactgcaggcttacggatctcagaaagagtggagagcccctgccactttattccatacccccttgcgttttcgaacccctaaggtcatcaacgacccggaaagccgggaggggatcacccaccccactttctggggagtgcgtgcgtgggcggggaggcttatccaagtaaaagggggtgggcaaaacggaaagggtcactttgacgtactgagtctctgcgaaggcctcaccgtatgtgccggcagccgcgtgtcctggtctccgccgggtcacgaccttcggagtttccgagtgcgcctcaggcctgggacgcgcggcgctgtctccccagtctcggagccgtgtgcgcagcggccggcagggggcactcgcgtcacggggagcccgcccgccgcgcccgcctggcttgacccgggctttggggctgacccggagcctggcccggagctgcctgcggccgcggatgccggcgacatttggggcccggctaggcacagagcaactggtcgccagggaagggcgggggggcggcctcccagccggagacaaacaagcaattaattccggagctgagttcccatctgccaggcctgctgacaacaggtccggcgcacgcccgcaggacctcccgcttcccgggcggcacggcgcgcacacccacttgcgggcacacgcgcggctgtaaagacacgtgccgttcgcagacgcgccgaggcacagatacgccggcgcggtcgctgcccggctcgaggcgcacaccgcggcgacactaacccacgcgcgacagttagacctaaagtggcccgcgacacgcagagtacgctgggcttgctggaaaggcgcctgggagtctcggggccggggtcccgccccttcctcggcccacctcgccgtgggccttgggcaagagcgtcccctccgcagcctcagttttcccgcctgtagagggaggggcgtcggcgcctcctgggagacgcgcagccctggtgtcccgggagaggggcgggaggcgcatgcgcgcgcgcaactagatcctcgccgccgcccccagcgcccctccccggggcagggactcacctaacaggttggggtccttggagtgcgcggggccgcgtggggaagcggggaccctaccccccccacgcgccgcccagcactgggcaagggcggggcactctctgggctcccgcccctcgccgcccgccccgggagcccgagccccgcccttccccggccccgccctcgcctcccgagcgcgcccaccggagccaccgcgctcctcgcgacactcgcaggctctgcgaacttccgagcggctgggccgggccatgggggcgcctcggggccggatcacgtagccgcggcgcccccggagagccagcgtggccgggagcgcctgccgggctcttcccgcgccccggccatggtcggccgcggcgtccctctgtgcgctgcgcagcccgcggtacgcgcggcccggcctggagagggaggcgggcggcgggggcccgggacggcgaagatactcgcggtgtgcgctggatccctgggggccgggcctcctgctgagggtagcggacccgcaggcgggacctccggggatggagggagtgggtgagcgccagggtcgtgcccagggctcctaactttggcaagagcgtcacgctggggcagggcgcgcaggggtctggatccgacggacgtcccaggctcactgtccgcttccgcccccacaccctgcaggtggccgagggcggcccggcccgcgagccgccgccgctgctggaggtgtccccccgaaagaggctacccgccgggcccgaccaggacccatgcggcagccgccctgctcccgaaggcgccggggccggcccagagcagggccactcggccggcggaggcggctggtgccgccactgccacacgaagctggtggagctcaagcgacaggcgtggaagctggtcagcgggcccgggaccaccctccgggtaagtgacacttccttaggccgacccctccgagcagggccacgccgaacttgggtagaacttggggcttggagggaagcagggttccactccttccctgctgctgtttccacaaagagttatcagccaggacttcccttctgcgggcctcagtttcccggtctgtaacaccatgtgtgagctagggagctcagcccgaggggccctgctgcctcggatgggaggggcctgggctggcgttcctcccccagcccagatgtcccacagctggaacgcaggtttgtgtgggaggaggaggggagagagcggatggcagggactccacccagggcgggacagctccagccctaccagcagggagaggttatttggtgcattgtggcccttggggcacctgggcccccagccaggtgtctggaaattacatacctggggccggggggcctggcaggtgaaagggtgggccacagcagctggggggtccctgcctactcctctcccagcctcaaggataagaactgttgtcccatacctcctgggatagactgaggcagtggccgcccatggggaattgagtcggggccctctgggttccccaggctccagccccaggggcaggtgcttgcaggggaggggttctcctggatttccagccagtgggcctgccggctttggagggagcagggaccattgttccaggaacaatgcatgctggaagtttgcaaaggctgggggcgggtgggggtctccagaggaagcccgctgccgggccttcagcctttatgaaagagttcctgggaagtccgcataatccccattgaatctaaatatagttctctaagggctgtgggggttggagtgagctgagaccctgactgccctgtctggggcagggcagggtggggcagggtaccagtctggtttctgtcctgggcaccgtctccgggctctctggagtctcggcgagggataggattgctgtagcctctctctggctcaggccaggcgcctgtgggcctgtcctggggtggggctggacccgccctgtcctctgctctggacaggctgcagccttggccatactctgtgccccagtggcctgtatctagtttaaaaggtagcaggagacccttgagggccccctggagagggccagccagagctaaaggcccatcttgctgccccattaggggaaacacgccagagacaggaggggcattaagattgagctggtctcctcattcttggagtgggcttggactgctgatgctgcctggccctggggccatggtcctggcatggactcgtggaggggagggggctcctggtcacgggcaggccaggggtcctagtggagagggctgcaggtgatactagtccctggtggattctaggttcctcatctaggggggtgtcttggtctcttctggcagacaggtcttcaggggagccccagaccacccatctccagcctcccctgagcttggcctttgacactggaaactcctcttgagtgccagctgggggctcccccttccctagctggcgctggcactcagcacaccggggtcccgggctggtctcagccagggctttgttctgctctgggcccccttcttctgctttgtggtctcctctgtcacctggggcctgttgtgaagtgctgtcccacctgcagggtgctgtgcccccgggagagaagaccccatcctccactgtctctccacagggcatggggggctgcacctgccatcctggggccttacgggtgtcattgtcctgtcccctgtgcgggcctgggctgtccccagagtcccagcaaaattgcagcctgcagccctggcctggcccgctgggcccagatgtgtggacatggctgcttctgtgtttgggttgggagggaaatctctggggtggccagggagaccccagtgtgctccccggagtctggtgcactgtccagtgggccctggcctctgctctgtaaggccaacgtggcaaggggtatttagggttggtgttctaggatttccccaggggcccgtttcgtattttttaggggagagatgagcttccttgaggatagctgtttacagggaacttcacaatcatccatctgtctcatgcttggatcttcagaagcccagagaagtggagagacttgctgggacccggcctggctattagaggccctcgcctccgggcttcctgcctgtctccgttgtagagggaggcgtagagggtcggggcccagcctgccagggtctccctgcctgtctccgttgtagagggaggcgtagagggtcggggcccagcctgccagggtctccctgcctgtctccgttgtagagggaggcgtagagggtcggggcccagcctgccggggtctccctgcctgtctccgttgtagagggaggcgtagagggtcgggcccagcctgccagggtctccttgaatgtgttgctctttagcaacacccgatgcctgcatggtcctgcctatgctcatcccctgctgggcccttgcccaccctcctgccaggaggcagctcccctgagcaggttcccgagagttcttggccactgtttcctgctctgcgacatgggaccgtctttgtgcccattgcataggtacgtagagcagtgcccggaagggatgcactctcaccttggcagctgctgctgctgtttgctgagttagggactccgagtccctggggctgttggagcccaggttcccggcctacctctcccttgctgtgtgctcttgtctgcctgagcctgtctcagttcccttgtctgggcagtgagggtgaccatggtcccctatctggggacctcatccctgtggcatggataagactgtgccctccccacctttctgagctctggtgccccgtctggggccgtaggggagggggacattgtcttcctgcccctgttggagccccaggggattgtctttcctgatctgagaagggtgcttggccctgggtgtggaggggaagccccatgatgggactctggccgtggctcctgctcctcactgtgtccccacactgtgccctctgctctcaccagggtcctcaggccttgtctccgggctgactacttcaggacccccatggcctggagcggccccctgtggcctggcctcctgtggcctccagggacctttctctaatgggctgctctgtctgccctgccatagatgctgtcctcatcccaagaccccctggcctccctgggctggaggcccctcagtgtccctgctctggcctcaggggccccttctcaggtgcccccaactctgagatgtccctgtgggaggttgcagcctggtgcctcccattcagcaggcaaagctggggcctccctctttctccacatctaaggcccccctcgcttccccatgctcacccaccaccgcaaactgttgtggcagacctcttccctctccctgaccccagtcctggtttcccccacaagcaggagctctgccaggtcaggcatggggtccgggtcacctggaggtgtttgttgaatgactgaatgaccaggcttttcctcccacaccccacttgctggtggtcacccccgggactgctggggctggattccggctatccgcccctcaaaatgacagttcccatggaggatgaccatccccctcccccacaaaggatggttccctgcttcaaggagagggtccctgcttggggatccattccagctgctgacagacacgtcatgtgaggtgttgactcctcctgagaccccgtgacatttgaagcgtcagtaccggtgctgaattgattatcgcccccgatggggaaaatgatcaattctcatttagctcccgtgcatctcttgcttatccaggcaggggcctcatccttatgcccccaagagctccagaaccactgttggtgccgcctgctggtgccacgcagctgaacagtgagggaagctgcccatcgaggctgtggctctggactctcctcccggcgaagctccgggtggcccctgtgtacagggaatcagttgtcatggtctgaggctgggagccctcctaccgctctgtgtggcttggcgagtcctgtttctccttggacgctgctcatgggcttctgtttgcttctcctgttgcctctctggtttgactggaggtgactcctgccagcttttcgttcctcctgccagcttttcgttcctcctctgtcacttgtccgaggaagccctcttagccccctggatggatgggggcatctctgtctccacagcccccaggcctgtgatttgggggtcccaggtctgttgcccccaaataggcaatggtcctgggagggtaggagctgcgcccgagtggtcccatgacggatgctcgccacttgtggtcagagcccctgggcccccagacttggggctgccaccttccctcgctgcttggagcctggcccggcttccactgctgccagggccacctttgtgcctggcagtggcacccgcctcggggatccgcagggtggggtgcctggcatcagcagcattcccagctgagcccaggtgtcacaggctttggtggcagcctggggaggtgtgagggggcacggctccctggctggcaggcggggcactggctaactctaccaggaagggctctgctcgggaggccgtggagctcggagctcccagttactgttggggagggagcctggggaagggccgggagggaggaagcctgggtgggcccagcctcgctgtgcagcctctgtgggacctgggctttctcttccctggacaggcggtgctgcctccgggattccctgtggttcagcatgtgatgggtggagggcacgtccttgtgctcgtcttgtctctcttgcttctttggggtcccaggggttgaggatgggcatttgggggaggacttgagcttgagggatgtgaaccattgtcctctgaacaccagccagaagcagagatggagccctagcggcttccggggtacaagctttatgtcggggcagggacgtgctctgggggagtctggccgtggtcacatgtgggctgggtggggatgggattgtggccgctggcctcactgcctctctgctgccaggtagaggacagggaaggagggggactgcaggctacccccaaaccttcagctgctcagagtcctgctggaggggcttgtgagggtttggagtgggctaagggaatgggactggggccttcccaaagctcccttaagtaccctggaaggatctcttatttgggaatcagaagagctggtttttcccttaagtaacaaagaaagtctagttcttctcttcctttgcctgctaggaagctcacagcaaatgtgctgctcagctctgggccgcgtgggacttttcttctgctctaatgggaacgggtcattctttttgttccagttatgactgactgtagttgcatggttttgtttttagcttatattttgtagttcctgcgagccaccgcacaatctttgtgcaagacagtgtgggctatgagtaaataagtaagagtaaaagtggactgaccgtgccttggtcgtgtctgcttcagcctgttcatctggtccatggaagcggagcttgtgctgttggggggagtggctgtcagctgggctttccctggttcctggtggcagccaggctgggtggtctggcctctggaagtcctggcccaggaatgggcagccctcgtcagcctctgagctctgcacccacgctgctcccttcctgctggggtgaacactgtgcttggtgagactttctcagggcaggctctggaggctgccacccccaccacggtgtgtccttgtcctgcggggcctcagtttcccgcctgtgaacagtccttgggctgcgtcgtcactgttgcttcttccggcgctcagggtcacttttccttccagtgtcacagtgtctccgtttcgttcacgggcgtgccctggccatagctgcctctccaggatggagtcttctaggcaggacccgtgggctggggtggcccgaggccctccgcagggctgcactgtgctccgtggagactccccagcccacctgtccccgaccccagcagcatcccaggcctcagctgtagggctggggatgggtgggtggcccagcccggtgcccggggctgatggcaatgtgtagtcccgcctggcccggcgccaggtcactcagctcagcgcgctgcattggacctgggatggtcgtgcttgcgtccctcctgcgctggcctctgaccccatgtgatgggtgttgcctgagctttggcctctgtttctggcggaggtgccgcatgctggcccttgcctggtgccctcagggagctcttcctaaatgtcctgtccccatcttccctccccagctcatagcttcggttcacggctgtagcccggctctgccctcaaaaccctcacccctgccgccaacgtggcctccacaaagccctcgtcctccagccgcttgacctagcctgtgggggctgccctgagcaaggctgaaaggcccctcctgctctcgtccctagggccccctctccccgacccccgcaaatttgccttcaccaggaagaagtgtcaggcgacctggctccaagctttatcttccacgcctggctctccatctttttctcctgagggtgggactggggccaccccatcagcccagaggctccccaagatggggccagcagggcagtggcaagggtgcgtctctgggccctggagtcacccaggtctgagttggaaccccagctctgcgaccctggtggtgtggcctgaggcaggtgtctcagtctctctgagcctcagtctataaaggggtcacagactcctggtagccagtgaacagggtggttgtttttgggggtgggtggcccctagggctgtgcagggaggcctggggtacctggcaggggagtgtctgggtgttgggatggtgccaggggcccagcttgcctgctgggtgattgggagaaggctcgtcctggtcctgcccaacttcctggctgcatttggtgttgtgggaggggctgtagcttgtggggcatggggtccctgccctctatagatgccctagaggcctgtggggagagggtcctgagggcggaggccaggaggtctgaactcatccctgtgcctaccgagtggtgggaagagcatggagggcttgggcctgaggagccgggcagcgggtatgcagagggtggcgaccaccgcagatcctctgtgcctgctgctgccccacgtggtggggaagaagtgggggcagccacagagccaggctgtccctggcttctccttctccactgtgtttccataagcaaactgctgtgaccatggggagggccctgggaaggtgcagtcccggcatccggacggctcctggggcggcagtgtttgatctcagagttaaaccaaggagacggggtgagggtctccaaggggtgggcatgtgaaaagccccgagatgggcctggctggagctcacgtggagaccgccacggggcaggccaggtgacaggaggcgggcgctctgggggctgtgtttggagtggagctgtgctccagccctgggatcctgggcactcttggcagcctcgtaggaggggctggtggtgtggacagtcctgtggcccctcacatgcagaggtttccgggtttctgcccagggatgcctggggccgctgggaggcaggggcctgatttgaaaccgagtccacggggccccttggttcacccggtgactgcagcctacatggagttggattgagtgtgcaggtgacccccaggcccctgcagtgcactgagcatgcctctgagcattggggctcctgatgagcctgcccctctgccaccccacctcgccggggccatccttgcctgtctggcctttaaccacccataaccccagatcccagtcatggcatgcgatggaggacaggggaggccattgaggggatgagggtctcaatgagcttgtctgtgccccgagctgcccagctggactggcgcctggcacaggcccttggggatggcgtgccggccagtgctgggtggactgggttgtgtccccgctccctcccctcccagcagaggaggaagggggtaggaggccttcagagctgcagacccacaggatgggaatggtccctggagtcctggctggcagaccagggagggtctgggcctttggagaggtgcccagctgggcaggaggggcaccggggcagccaggtgtggccagccagtttccagactggagcaccgagcccgctccttgccccccgccctgatgggctgcaccagacgtggaaatgtcctggacagcaggacctgcgagggctgctgcctggccgggggtcccttcctggacctgttgtcagctccggaaacagcggctgctcggggttgcagcccagcacgctttgtttgggaaggaaagggagggcaagatctggaggtcatggcccatggggtccttttgagggctgcccgcacacgcatgcctcactgcgtgggtcggggaggggcttcggggcctagttaccctcccagcggccctgccagtgggtgccagagctcctttgtggagacgggtgatggggactcagggagggccccgtatggctgaggtctgggggtctgatggcgtggcgtctctgaactgggagcaggactcccctcgctgtcccagggtggccttacctggcggggaggtttgatcagctgttctttcccatgggcagtggcttggctggagtggggagacttctctcctgcagtgacggggagcggggagtccccggtaaagtcccccgggcctcacacgcaggagaaaatggaaggattacttaaagcaactcggagaccccagaaacaaaataaagaacaaagtcatgatttgtaagtaggggggagactccctaaaacccaggcgcgcaatgggtgggctatgtttgatgctaaattgaatcaaatgaagaaaaacattttccaaatgcaagtaaagtatctgtgtaattagaccataaagagaaaattaaaagtcatatttcgcagtggagtaattactgtcttcctcaagacaccaggctgtggaggcctgggtgacaggcgggcctgctggctggggctttgaggagttcagattcctgaaattggggggcagtaacccgttgggggcttgggccagaggaccccgtgagctgccgggatggctgggagaggaggcctggtcccactgcccagcctgtgcagaggttggaaggtgcaggaagtggccacagagcaggatttgttgttgttggcggtgggggctgtgcgtggccggggagggggagggggaggggaggggcagggctgcagggctgggcggcttttgtctctctgagggctgcgtctggggtctgctgtgcggggagcagtcagtggtgtgggagaccctcgccttcaccttctggggcccaagatgcccatccctgggagccacccatgtcagcagcggcctccctgagcccctccctggagccctgagtgctggtcccgtgtgctgagtggggtgccgagttctcctcttgtcttagctggacagtgtgctgggccccaggctggtcctgcaaataggaggtctcgggtcctctgggctgggctgtgtggctctgagtggccccggcaagcagccctgtggttctgttctacccgagcagtctgtgccctggcccctatgctgtgccagcctggtgcagcctggctggtgtgatggctcagtggtgggggcgatggcgcctggtcccatccagtgtcttgctgtgttgccctaggccggtctcgcataagtgactagggttggagagatggcccctgccctgtgccttgaattcctggggccttgggtgggcctctcagtgccccccatggagcctgctgggtcggggttgggtggtgagagtccctgagaggagggcctcgtggcccgtcctggggaggggtgcgtggcccactcgtgggctttcgctgtggggcccggcctccaggatgctggctggcacctgggctgctgggggaaggtaccctggcccagatgcctgggccgccgctgttgctgagcaggtgaccagcagcctcggcttgtccccagtgggggcttcagcttgatgggcccccctccagcactggcccccaacacctgggacttggatgcccggagctccgaggcctggatagggctggggcctccctggcagctgctgtctgaattcctgatggcaaagctgggtgggggcttgggtgggggccactttggcttcctgtccccttttccctgttgcccctctgcctggccagcccgtggtgggtggtgcattctcaggtcgatccgggcttcctccctcccctgccctccactctccttcctgcctcctgctgtgcagccctggagagaagggcagggtgggcttcccaaggcctgaggtcgctggacgggcagaggctgcctggcctgtctggaggctccagaacggcgagctgggggccgggctgcctgtcaggttgggttaatagctccagcaggcggggacttccttccccttcacacggggccaccagggcagcctcctgctgagtggaaaatcagcataatctgagcctgactggaaaacaggccctgtctgccctcagcctgtgcaggggccagttctgggttctacatgtagacctgtgtgcccactggccgcatcagcagagctaagcggggctcctgcagtgtctgctctggtagggccctccccctcctggtccccctccccgtccccctccccctcctcctcctcccccttccccttctcctccttcccctcctcatccccctcccccaccccctcctcctcctcctcctccccctcctccttctctgcagggctccttgtggctgacctcagcgaatctccgaagcagcaggagggaggggcattggctaatcgggaccagacgcgccaggcacttcagaggctctgcaggccctgggttggaggaaatccaggcctctggagtggcccataaatcaggcagctgggcctgatgggggtcgccttttcatgcgacctgcctgggactgtggggagtgtgaggtggtcctgggggaacatgattgccgcacatgcttggctggcaccggccaccctggaccacagctgttaccactgtgagcctccagggcatctgtggacaagggcccagccagccaagggcaggctcaaggaatgtgggtggggtgactaagacaccccctccccgggataatgggcctcagcttcctcatctgagaaatgggcacgtttgagaaggctgcagtgccttttgtggccaacagggtggctgcattggagtccggtcttgcctggaatcccttgaggcaacatggccagccatcgagccagggactgcctggggccaggtttcgggtggtgggaaagttgggggctggtggaggacccctgtcgggtggtgttcggaaagccctaggtggtcacagccacagcagcgctgggctggtgctgtcctgggggttgcccgggctgggtgccctatagctgagacaccccttggggagggggtgcagacgcagagggcctggccccctccccagagagcaggacagacactggtcctgactctggccctgactgttgcagagtggtcccaaggaggggcaaggccagagcctggtggggtggtgagggacacgggtgggccccagagaggagtaagcctcttggtcgattccctcccagtgagctttgctctgtggcttgtctccttcttgctcctcctcctcttcctggaagatgtcactgcctccaggaagccttccctgactctgaggctgggtgaggcgcatcctcctctgggttcttctggctcttgtttttagccgtttctagaacccagtctcagggttctagagaaacctgtgtgtccccccagttcagggaagggggcagtcaccaaacagggtgcatcccagcgtacagctcagacctgggtgggggagctggtggagtgtgcggcggggggtggggccctgggctgtacccgatcctgcggctcttgcgccccttcggtgagctcatgtgccctctaggagcgtctccgagggaggccttcgcttctgttgacacctttacagcagcactgatttgattttccacctgccccaccggggctggagacctgaagaggaagggagagggtctcctgcccctggctctgccttgagtgagtgtgggtgagggaggccctcgtggctctgaagagacgttgcttttaaggggccctgcttcttgccagtctcctgcgtgtccccggccaggcggccttagctgacagtggtccggttgtccgggagccgcaaacctgccttgttagccgcaggccggggcgcttaatgacggctggggaaggtggacagttaacaaggacattgtgagcctcacgatgaagcccgatcattattttcctgctgggcttgtgtgggtgaaagtgtttgggcttattaatctgttacggatggtgcggtggccaggcgggagctcgcagcgtcatggacggtgagagtgctggtgggctctgggtgccggccctccctccccaggcactgaccctgcctttgtcccttgctgtcctcaggatccttgcctctctgccctgcttctcgacaagctaccagcacctggggccctgccagcctgtcgcccagaggccgagcgccgctgtgacgtctgcgccacacacctgcagcagctcacacgggaggccatgcacctgctgcaggcccctgccagccatgaggaccttgacgccccccatggaggccccagcctcgcaccccccagcaccacgaccagctcgagggacacgccaggaccagcgggtcctgcagggaggcagccaggacgagctgggccagacaggaccaaggggctggcctggtcccccgggcccagtgtccaggtgtctgtagcacctgcgggtcttggaggggcgctgagcacggtcaccatccaggcccagcagtgcctggagggcatgtggagtgtctcgcgggtcaacagcttcctcccgccggcgtgcctggtgagtgtcttgctcagcggatgggagctgctggcctccttgtcagaactgggcttccttcgggggtctctgtccacgttgagtgccctgcagtaaggcttccctgaagggaggggacggcgggcatgggggttcctgacactcctgaggccccacatcagatgcacccttgatggtgcacagcagctgttctcaggtccctgcctgactcagggaataccttctctgggagcacgtgcccctccctgtctgtcttttgagactggggctgagggcccaccagtgcccagcacagggcttggcgatgcacagggcaccgtgtgtagatcggggctcacgaggcagatggagtaggagggcccttgtggcagagcgagggcctgtgtggaggcctgggggtgtgaggcgtccatggacgtcgggcgggggaccggcagttgcaattgctggagatgcgttgcctgcccctgtggcaccctgggggcagagggacatgtgggtggctgtgaagagccgtgtttctgcctggtacactgtctagtcaccacacagcgaccagcacaagctcgcccttctcccttggtctccaggcctggtggtgtttccaggggcagacagaggtgcagagaccccgtagtctctggggcaacattggccactgatcctaaggccaggcagaccctgcccttgccttctgggctttcggcctccctgtgactggtgaggtggcctgtctggacatcaagatcctgccccagctgggggctggccttggcactagctgccctggcagtggctgctgggctggtccttctgaggctgctgggctgccctaggggtcgaggtacgccgaggctcactggaggaacttctggacaccccccgggtcccagctggtgtgatggttcccctgtggccttggcacctacacccttccacctgtgaactctgtggtgaggccgaggagagggagccccacccttgccacgaggtgcctcctggccccagagctgaaccccacccttgccatgaggtgcctcctggccccagagccgaaccccacccttgccatgaggtgcctcctggccccagagccgaaccccacccttgccacgaggtgcctcctggccccagagccgaaccccacccttgccatgaggtgcctcctggccccagagctgggcatcctgggaggggtgggcggggatggtgctgggggctgcagcaggtgagctgggcagcatcctggaggaggtctcattgagctgggcctgtgtggaagcatcaggggctgggcctgaaacccaggatggtgggcacaggcacctccgtctcctgctgtctccctgggccacttggcctcactgcaccctgcccgtggctgagggtcccagcgggtgggggtggagaagatcgcaggccccttgctgggcagccctgctggtggatggcacaccatgaacatttaggcaccctctcccagcgttatgtgcacattgatcgtggccagggtgggtgggaatggatttataattagacagcagtccgggcgatcgatagggagattattagaaccataaatagaactttaggattcagatgaggtaatttcccctgaaccagggcatcgatcattagcgtggccctggaatgttaatggtgcctgttagactctagagttaaatacttgtggagagatgcgctgcaaatctccaccacagaccgtcaaccacccctgggtcgaatgagattgttccaaggcaaacactgatctggggccagcgggtgggacgggggtgctgcagccccctctgttacacgatgtggagaggaggggcagggaccagccatggcactttggcctcggccgaggcttggcaggggatgctgaacgttactgggtctggccagaaggctggtccttggaggggtggtgggtggcccagggctcccagggcctcctgcggccacaggtggggcctggaacatcccacatcttgagcatccagagactcctgggctatggagccgccgggcagggctgtccagcggttcttcccggactgttgggccggggcagcgctgccgttgcagagggcagaagctgcccacggagcctggccctgtgcctgtgccccacgcctcctgccctgagagctctggacagtggtcatggggcccaccccagtgccctgcctgcaccaccagaggctgccatggtctgggacatgctgcgaaccgtggcccatttcacgctatgaactgagctgcgagaccgaggctctggccttcagagcccacagtgggttgcaagtggcaccgtggccctccacagaggggcggcccggtgggcagtgtggggtgctggaggtgttgacggtggccctgaggagcgggggtgcctccatacatggagattgggtggcaccggcttgggggctcctgccaccgctgtgctgggctgcaggggccctggagggtgtcccgtggtcctcacggctgagatgggccaggcaggggcagatctttgaactcagggctgtccaggccctagggccctttgagtgacgaggctggagcttcgcgtgggtgggcgagtccgccccatggggctctgcagggtggcgcacatccacacccgtgcaggggtgacactggtgacagagttcggctctgagcctccctggccgctcctcagcccctcctcctccctttctcccccacttctcagcacaaaatagcacccagtgaggtgtttatctggggggctggtgtctttcacgggccagaaccttacagatgcgtttgggcctggagggctcctaagaagagagttagcttggcatttcctaaactgtgctccacggaaccctggtgttccccgaggttgcaggtgctctctgctggccgcctggtgcctgctgtggttaggaagctccccgtggggtgggtcccgtgcggctatgcttggggcccttggctctgcgcccctcggcctcacgctcccctctctcctgcctttccttccgtttgctgctgtggcacctccatcacatgctctgtctggccgcccgccccccctctcttctgcccccgtgttgtggtcttccctctcgccgtcctcccctgcccccggctctcgctttgccagacggcttcttttggcatgcccgggctctgcttccggcaggaattggcagtggccgtcccggcggatggggcggtgtcccggcagcgcgtgggacggtggagccgaggcgcgtgccggactcctgagacaggtcagtgtggggaggcccagctggccgcaggcctgtaccgttgctgggcggggccggaaccttctggccggaggtggagtggctggcctgagatgggggagggctcgggccctgtgggaagagggtggaggggccgggtgggctgtggtgtagcagctctgtccctgctgcagcccctccagcctcggtgcccctgtccagtgggggaggcagggtgtcctggtgcctcactggacactgtgattgggcctggcccaggatgccaaatgtggccccacggtggtgccatcgcgacgagccacctgtgggtgccacgctggctgtgggtggtgcggccccggcccccaggagaactggccctgggtgctgactgccatgcccaggggtgctcaaccagacccggctctgctccaggggctcaggacctgctgttaatgttgtaactttaaagatcactctttcctgtctgctcagcaaaggagtttaggcttttgatagggagcacatacattaagtgataaaatagaattcacacttgaggtgagggagtggctgggagaaggagagggctggccgggctgggttcagagggatgtacaggagttcctggcctgcaggctgctggtggggtgtggtgtgctggcgcaatgtccagtgagctgttccaggtcccaggttcgcccttttctgctactgggcattccttctggaagccccggaggagtggctggtgcctagggcccagggggcacccagcttccatccagcctaagtcttggggctccctgtgaacttcctttcgcagacatggttctgttccaggtcccgggaggggcctggaagctggtaccggccatgggttgggcagggtgagccggccatgggttgggcagggtgagccctccatggtggtgaggagggatactgtctgggatggcagggcctctgtctggagtgtccctcctgggtcccggggcggcttgttctgctgacgtgccgtgcctggcctctggcctgtgccacttgggacaccctgaggacgctgggccttccagaccagcccacgtcccctcagcacggggaccccagtcctctgctagcctgggtacaaaggacgcctcgggcagtggttatcgactggacacttggggccgaatgacgcttggcacctgggtgaccgtgacctgaccaggccacggtgcccaagggggtccttggagagcttggggcactgggcccttggggaaggggccggggcgaggggtggccaggctgaagcaggctgccttccctgccttgcctggggttgcatccccccacgccgcccaggaccaggtttggcctgagggttcggggtcccacgtgtctgggaatggaacgtgcggaggtggagctcacgtttgctgggctgtcccgggcgtttaattacgtttgtgcttcattatgaggaggcctccctttctgggatttatttgagctaatgagttggaaatgccagggtagtatttcagatgagggagcgccacacatcaccgtacgtggggcaattagtgttcctgccaaatagttatcgtggtttcttctctaattacgccgctgggtgctcccaggaggctcaggggtgagagggtggggggtctgtgtccatcggtcttgaccagtgtggtcgctgcgattctggagtttgatgggggagaggcggaaagtctggcttctggaccaccatctgcctccctctctgcctccaaggagtcctgctggggcagaccgcccacacaccccgagctgggaacgtgacctcacggcccaggcaggccttccccactggcctctctgccagccctgatttctggggccttcccggcttcacaggctgggccctgggggtgcagagcccccaggaatgtgctgggctctggggtgcccaggcctgtctctcccactccgggtgccagggggcagtggtgtctctgcccttgcgttccttatacgcactctctccttccctccaggccgaggcagcggtggcggccgtggcggtggcagacacggtccgagaatgcccccccgtggccggccctgatggcttgtcgaaggcctggggccgtggtggagtctgcacgtcagccctggtcacccccaccccgggctcggtggggggctccacaggcccctcagctgcagcctccttcttcataaggtatgtcctggggcttcctgggcagccttgtgggcagggccccatggccccggctgtgggcccctggggacctatgggccgttcttgggggacctcgggcatgcttgctgctgagacgagtggatggggagctgctccgaccacagctgctgagccgctcacagcctgccggcctctcgggccccatgcccgatgttggggggcatctcatcctcgggggagcactgccaaggaggggctctgtggccaggaccctgcctgagttggagcctggtccctgcctcttctgagctgtgcaatcttgggcaaatcaactaacctctctgtgcctcagtttcctcccgtcagctgggctcttcctcataggagtcgctgtgactgcagcaagaaaatgtctgtgaagcctggagaatgtggcccggagtggggcagctcagctgtggacattgggggctgcccgggggaggcgcaggctggggccacggagaggacaaggctggccttcaggcagcacaaggggaggggcagcagggcttgagcgggtgcccacggtgccagccgggcttgtggttggcaggtccagctccaccaggagcatcccacattgggggaccatgtctgacatcacttggttgctttcccaggccccgagctcggggtgcctggtttctctgctctcccccctgctgatccccaccactgccagaatgccaggcctgaggccctgcaggcaccaggtccttgccgactggtggtgtggatggggtgggccaggcagagggaacaggagagcagaggtggggagggggagttggcatggaggggcgtggtgtgggagcctccactgggcccttcccggcagggcctttggtcctgggacccgtggcagagcctcctctcatcctgatggtgtaaggatgcggattacaggatgtaattgccataatgcctggtaatggcaggcccagccgcgggtcagtgtcccattagcagccccacgcgggtgctgataagcttgaacatgcatcacacccagcggccagagacgagggcgtcttatcagcgccggccctggggaccgtgtggtctgattgcagagtgacggggcatatgattagggcattgtcgcacgccgtgtgccgggctgagggctgatgagcacaccatcgcgttggagcacagccagaccgcgcacgtgaccagtgtggcctcagcgccaccccaattaggtgccgagagcacggctggctgggaccctggtgggagcagatgggggtcttgcccatcctgctctggggtcccccgtgtgtgggacagcccaccccgtcacaaccggcctagtcctgaattaaagggcctgtgcggctgttctgggcacagccctgtggccgtgctcctttgggtcctgtttggcaggaggatttgaaacgtggagacttccagaaaagaaagaatagctccagtgctcagagctcccccggtccctgatgctaagccccctggtgccaaggagggttcctgacactgggaagtaagggtagggtgtcggcccccaggccggtgcgttggtgacctggagcccagcagagcggccctggctgccttttgtttgggagccgaggccggtgccgcttgccagccgcgctgcctgctgaccttgggaagttaccatagaaaccagcgcatcgggctggggacccagaggcggttctcccaaggcgggggcgctgccggctgccattacttccagcctgttaggcaccctgggtctcagcggcttctgcgaggccactgcaggtggcaggtcgtggttcaggttgtggcgggggacatcctggcaggtgggccctgtcggtggatgcctgacgtgggctggggtcggtggtgggtgacctcctctgtggggctgcagtaccctgaaccctcaggggtgagatcagagggggtgtccactcctgggttttgtgggtgtggggctgtggctctgagtggggacgagtccaccaggagacagtggagcttcagcccccgccccaggggtcttgggcacgtgctgagggtaccttctgtgctcccacctccaccctcgaagaggacctgggagggagtggcactgaccccagcccctgctctgcccttgggaagtttccagtctggagggaccgaggggcacctctgtggaggcagccttagatggcagcacgggacccgtgtagcagtcagggcagagtggcctctcagggagcgggctttgagggttgagtaggagtctggcaggcagcattgccaagtggagacggaatggggtggaggtcaggagtttgagtttttgaatcccgtgggcctggggagtctcagctctgctgctgcccacaagcaccccccagccggattagggcaccagcctcaggctgccccctgatcctttcagtggcctctgggctccttatgtccacacagggaagctgggatgtggagtgatcccatgggtgcccgggtacccgagtttcgttaatgctaacaggggcatagatagagcaggggctgagccccatgccctcaccccctgggtggggcctggggaagctgcagggattgaggcagcgcagctgtgacagagcttggcatgctggcccagcaagtgttcgggagggtggggcgcgtgggccgggtggccccggggttaggagttctccgaaggctctggtgacccccagggttaggagttccctgaaggttctggcaactctgatgacgctgtctgaggccccgctggtttgtgccggcgctgggagcctctgcagtgcctcctctgaggtacttccgtcatcatactctcacctgctcgctgccatgctggtatgggggtcccctccaagaccccaaatcaaatgtctttgagaaaactgctaagggaggttgcttccattgggtggggagcacctcatggcacttgcaggtacccaggccccccactccccaccccactgtggcctcagcagagcccccgtgtcagcctggatgcccaggcccatggacggtcaggctggcacccagcagaagtgcagcgcctgcggggagagtgcgctgcccgaggcttagctggggacccacatggaaggcactgtctggagaggtgtccccacctgtcttctggcctgtgggtgaaaatccaggacacaggaagtgtggaccacagcagggctgggagttggaggggctgatgcctcagtctccagctgcctccagctggggtccagggtccccttcgcaggtctgcaggacccagctggggtcccccgatgcctgccctggttccttggtggggcaggtccggcaggtggcaggtgcccctggggtgaggtgggggtagggagggtggggctccgtccaccagcctcgcacggcccagtgtggaagctctgggttggccataagtgattcctgcacgcgacagaacaggctcgtgtgtctccttggggtaattaagggcctcaccatcaaggccaactgcctgtgaaattaccctcttgtttggaagcggtgatttttctctgtaaaaaggaaaatatttccttttctgttgacatgaatcgatggccagggccaatgagcccaggcaaggctgtgggattgcagcaagacacctggtggctctgggggccgttcaggtgcccgctgtctcgttcatcctcgctcacgcgtgttctgagcttcttctgtgagcatctgcccccagaccccctgctggcagggacatagctgtgtaaactggtgtctcacggcagggggtagttgctatagaagcaggaggcgcaggggctggggacacccatctcagggcatcagggcaggcttcctggaggaggtgtcctgtgaggatgggggctgtttatgcaggtgaagttcctgcttttctgagtcttcccttcagagtcaaacccctcagacttgcccactgagggccgccgctccctggcagtgttgggtgtgggcagtgtctgctgtggcctgggggagacaaaccccactgctcagaaagtaagttcctgcctccacagggccgtgggccctcaagggctgttgaacccaagcgtggtagccagatgggggctgctgtgtctgatggtcgtttccatgggggcctgaatttcatcaaaggagaaagtgctcgttctggggcctcgttaatgcagtggcaggtctttgagtcataccagtgaggtaagcccgtaaaagcaggcaccgggagggcccagcaggctggggtgcagcctgttggcgatgggccccaggaggaggaggcgcctcaagttaggtcagattgtggggtggagatgtggggcgaacaaccttccagacttccagggctgatggaaccacagaggacgcccggtcccagcctctgtctaggcggcctgggccctgggtgtgcccgctgtggcccaggcatacctgagatctgtgctgcggacgctgctcctgggagggtcactggaggggcagagcccttgtgtggccgacggggcaaagggccagcctggttttggcctctgcagacctaaggctccagcctcaatctccctctggcctctccaagtgctgctccagtctccagtgcttgcccggcctccgcgtcccctggaagcttgggggtgtgggtgccgatgccctattgcccacagccttgggttgcagctggtaccttgaccctgcccagccttgggaggggctgcaggggagggtggaggagctggctctgggtgggcgtgacctctccccatccacttgaggccgagccaacaccctccagtgagggctggtgctgggcgtcccccacatccatttccagaggaggaaaggggtccagggaggctccctgtcccttataggggccaccgtggggaccgtcctcagccctgcctgtccaggtagggtggggggcttcccacctgcacctgcagggccctgcccttccccccgccccgccccaagaaacctggggtcccagccttggagcagcaccaggcagcagggtggggtagccctgtcccagtcctgcctgctagatgcggatgttttccaaagcggggccgcagcttcttcccttgcaggcagctggcgggaagctgaggtgtaacccaaggtcgtggggtggggggtctggaacaggaggctgaggctggggtggtgggcaggcaggaagaaccccaagagcagacactggtgaaatccaagcctcctcccacctgtgcccccaaatgggcagatgcagccctgcctgcctgcctctggcctcgcccaggcccctgcccagtctccctgcccgctatgggggctcactttgaggtttgggttgtggctctgccctctgcgcttcccagcgttcccctctgcccgggcttcttgccctgtggacagacgcacagacacacagacagcgtgggcgagtgtgtcggcctccatcctgtccctgatctgctgtgtgagtgatctttgggcgacgagggcacaagggcctcttccttgcagggcagttgtgaggtttacagagacgaggcttaggcacggtattgggtaaatgctggcgatgctgggtgaggtccaggggtctcaggcacacaggcccgggccccacgatgcaggtgccattgcctccccttgcaggcctccctgccgcgttgggccccaccctgtgtggctcagctaccagagggtcacgaacctgggaccccagtgaccccggaaccccgagcatgcgcggcacggggcggccatgggccccgacccctgctctgactcacacctgcatcctggggcccaggcccgtgtgcctgagacccctggacctcacccggcatcgccagcatttacccaataccgtgccagctgtgggcaaggaacccaagtccccgaggcggcgggtgggcttcccacacctggaactaccggggcttctcctgggtagccgtgggtttggttcctgggattcttcctcctggcatcccccggctccacgtcttgcctgggtggctgcaggcaccgcccaccactgccctactaaggactccaccatgtgtcatagattacttttactttccacgatgacacctcactaggaggaaagccgtccctggggtctcttaagagacagctcctattcaaaatgaaagaaattaagcaaaacgccagcgctgcagccgccgcagtgggggcagcgagaggccgggcccggctctggggtgcaggtccttccacactggggtcagttttagggagtcaagatagacgtgagaggccgagggctgtggggggggcgtggggcatgttaggggacagaggagcccagggtgggtcgggggagcgccggtggtcagcgttcaccacacccttcgccgggtggcatcctggcctctggcccgcgtgggagcgcctcctgttgggaggtggtgacacccagtgtgtgtgttcgttcacccctgtggcgtcctggtgtccctgtgctggtgggtccatgatccggggtaggggctctgggtgcctgcagcacaaaatgtgctgggagggtgtggggccctgcagaggtggggtgggtgggccacagagaagccaccccagggaatgagtaggtgtggcccagtgatgggacctgggaacacatccccagcagcagggttagcacagccagggctcagaggcgcggcgggcctgtactctgtgtgtgtgcctgtctgcgtgtgtatgtgtgtgctctgtgtgtgtatgtgtgtgagtgtgtgtgcgtgtctgtgtgtgtgcgcgtgtctgtgtgtgtgcgcgtgtctgtgtgtgcatctctgtgtgtgtgtctgcatttctctttctctgtgtatccttgtctctgtgtgagtgtctgagtatgtgtgtgtgtctctgagtgtctgtgtgcctgtgtctctctgtatatgtgtctctgtgtctttatgtgtctgtctctgtgtgtgtctctatgtctctccgtgtttctgtatgcatatgtgtctctatgtgtgcgtctctgtgtgtgtttctgtatgcgtgcacgtgtctctgggtgtgcctctgtgtgtgtctgtatgtgtatgtgtgtctgtgtgtctctgtgtttctgtatgcatgtgtgtgtttctatgtgtgtgtgtctctgtgtgtgtgtctctgcatgtatatgtctctgtgtgtttctgtatgcatgtgtgtatctctatgcatgtgtctgtgtttctgtatgcatgtgtgtgtctgtgtctctgcatgtgtttctgtgtgcatgtgtgtctctgtctccatatgcatgtgtgtgtctgtatctctatgcatgtgtgtgtctctgtatgcatgtgtgtctgtgtgtctctatgcatgtgtgcgtctgtgtgtctgtatcatgtgtgcgtctgtgtgtccctgtgtgcatgtgtctctgtgtctgtatgcatatgtgttctgtgtgtctctgtatgcgtgtgtgtctgtctctgtgtgtgtttctgtatgcgtgtgtgtgtgggcctctgtgtatgtttccatgtgcatgtgtgtctgtgtgtctctgtatgcatgtgtgtatctttgtgtctatgcgtgtgtgtgtgtctgtgtgtttctgtatgcatgtgtgtgtctgtgtgtctatgcatgtgtgtgtctctgtctctgtatgcatgtgtgtgtctgtgtttctgtatgcatgtgtgtgtatctgtgtttctgtatgcatatgtgtgactgtgtgtctctgtctctgtgcatatgtgtgtctgtgtgtttctgtatgcatatgtgtgtctgtgtttctgtatgcatgtgtgtgactgtgtctctgtgtctctgtgtgcatatgtgtgtctgtgtgtttctgtgtgcatgtgtgtgtttctgtgtgtgtctgtgtgtgtctctgtagggtgtgcgtgtcgaggtcccctgggagtccaccccagtggctcccaagcatgcactggcctcccctggagggtgtgttaaacccaagcgtcagcctctcccctggaggtcctgtggtccgggggctttgggagactctgcaccttctgggagttccctgggggcactgtgggtgcaggaatcccccacccctggcggtgctggggcaaggctgagcctcagggtgggctttggggtggggaggcgctcgccctggctgaggggcagggtggcagcgggggcacttcccagcagccctgagtgacgagggtggcaggggcccaggagctgggcagtggctccaggatggctctagggccttggtgatcggcaaggggcaaggcagcctcacctggggcctggggcttggggtgtggtaatctcgacagcaggattaattgagcccttcctgtatgtggtcactgtgctgggtgccttgagtgtgtcagtccattagggccacacagaggcctccattgtcacctcatccgactttggagatgtagaaactgaggcataggcaggccaggtggatgtgcccaggtcacagctgtgcatggctgcccacagcctgggcatcgggtgggagcagctttcactgtccgacccccggcagcggctgcaggtgggggatgagggcacaccccttggtggggggatggcattcagtgcagagcacagggaggggcgctcagcctgtgtgggtctggaccctgtcacaagcttggtgtgaatgctgggcagagtccctggggcagggacgccatggaggccccagcctgaaccgtccactgtagaaatgaagtgcaggcctcccagccacattttggactgggtttcctgggatggtggctgatgaagtcccagggtgggatcgcctggtgactcgcaggcgggtgacaggaacagctgctgtcacccaccactgatcctgcctctgcctctcctccccagggctatgcagaagctcagcctggcctccaagaggaagaagccccacccgccaccgcctccagccacccgcggcacctccacctaccccaccgacttcagcggggtcctgcagctgtggccgcccccggcgcccccctgcctgctcagggccgcctccaagaccaaggacaaccctggcagcatcgggaaggtagacgcagccccgagttcggggccctgggtggggaggccagaggcgtctgagaagacgcaggaggggtgagggagtggaggggctgccacttccttctctgggttggataagggtggtcagtggggtgccatggggagactgaggcccaggtggcagcagggagcctgggagcctgtgctgggctgggactgccgggatgggaggggagtggcgtgtcctaggggtcccaggggcatgtactaggttcagcgtggggcgggacagccaggtcacggggctcccagggactaaggttgggtttgatccagggaagccccttgcgtaggctccactgagacgcagccctgagggggctgggggcaggaggggactctctgctctccagagtcaccgtgtgcaggcgggcccctgccatgggaaagcgggatgcgtgatgggttgattctggcgccgcgctccacatgggaagactgccgcctgtggagggcacagggcctccatcagtgatgggacaggctggctcctggctgtccctggagctctgagcctggggcctgtggcttgctggttgtgccatccgagtctcggagaaatacctgccctggctggacgtggccctgccttgtgctgggagctggcagtgcctggttcgtgggcccattgagtcaggtgggctctttgtgcccatggagggtgggaagccagtcacacagctctgtgtgtgcccccggtggctttttcctgcccctcggcctgctctgcagccagccccctcccgcccagcaccccgaaagcactgcctggtgcctccaggcccgggaggctctgtgccccacatgggccatcaggctccgtgcccctctggacttggaccacgattcccaggggttcagctctccaggggacaaggtctggaggggacgctgtgcccacgttggagaccccctggcagaaggcccctgtccctgggcctgggggtgccacaggcctctcccactgccctagctgtactgggtctagggtgccaggagcacccctcgcagtcctggtgagagcctgcttgacctttacagctctgtagtcctggaggggcctcctgggcagccacaccttgggattttgttagagctcgggaggtgccaggctcgtgggagggtttggaacatgctggctacggggaagggctgtaagtgactgtgtgtctggccacgccctcagtggtgcagttgctgggggctgtgccccctgcccgcccggtgatgtagcgagcattgtacttgcagcccctggaacgctaatttcgtgacttgagccctccaacctctccagggcagccctggcctgaattgacggtggctactggtctggggcagtggtgggtccctagggagggccgccgtggggcataggggctctggggcggcctgtggggcagacctgacagctcttaccatcttcataggccatggcgggtccgggtgggggcatcaggcagttggcaccttggagctgcatgggtgtccagaggggagtgtgtggtgagaccaccaggagcctcccgatctccctgactctgggtctccaccccgagcaccccaccagttgccagggtttgaatggatcgcttgtccctctgggcactggtttccgtttgtggtaaggagggcttggcgggcatctggcatctctgtcctccggaggcgacattctgcatccaaggcccgggggcaggggaagctgtgtggcctggatcagggacttgtcattgctccgctggggttggggcaaggcccctgcctggggtgaggcgggggtggtgggtgaagcagagttgggggactaggccgggggtcactgcctccctggaaatctctttgcctagcactgctgggggtctgcggggaacaagggggctcctgatctctgtgcgtgtgcccggcacgggctgtttctccacagtcccctgggatgcgaggccagtggcatcagcctgtgttttgggcccaggcctggctggctggggcaccctgggtcctccccaccctcaacagtctccttgagacagggcaggtgggtgctggggccaggctgccgctgccctggccacgtgggctgcagagctgtgccgagagctcaggaggacgccgaggtcaggtgtgggcggtggtgggcaggcagcatccaggttccccgcccagcctgggatcggggccctggctctggcctgggcctggcactcagcctgtttgtgccatccagttggggcggggggcagaggagtcagcagctccttcaggagcccgcaacacttttcccagcgccccgcgtttcttaggggacagcttctgccccacttcctcctgggggcagccttggccgggcttctcccttctctccatggcagtcacacccccaccctgctccggagtgctcagtgcttccccagcaacaaggagccctgggtcaccagccttccagcccctccaccctgcacaccccccagctccccgggtgttattagcactaatgtcacatagtcagaaatgccgcctgaaaggcgtttaatattgtcacagaaaagaagttagattacgttcaatttctgacattaatgtgctacttaagataattcatcacagtgtggtataaaaaagacatccctgtctgggtgggtgctgagcagcgcccttccccctccctgcctgggctacctcttcagagctggaagcccttttttaatgcaaaatgtgttttttctctcccaggcagctattccgtggggctttgtaatatctgaacatttaggggagaggcttgctgtgccttttcctgcaaagaccctgtcatttccctgcagtaatgacagggttctctttcggcagacaatggcctgcgctgggaccagggcagtgtggggcaggctagatgggcggtgcccccactgtgggctgctccatcccctccctggggaggcccacaccccccttcctcctggttgtgagcccgctctgcgattaatgccgctggtggaaagggtggccggcagacgtagagagccaaaccgtgagcctctccacgccactccttcccgctaggaagtctctcaaatctgcagagcccatttggctcctgaagtggtgaggagttcacactggaaaaaaaattgccaaaaattaccgggaagtgcacgttttcgtctgctttgtggtggcgtctggaaatgaaatagttttgatcacgtcgtcgggggaataaaagaatcgattcttgcctaatggagcccaggttctgagtagtacaatagaaaagtgtttcttcatgctgctccccggagagcgggcactcccgactccagcggcttgcatatcaatgtgccccatgcccagggggagtaggtgccgcctggtgcgaactacccatggtaaaccaattttgccggcgttatgtatctgtcacttacaattaaatccgtgaaaaatattggctctgaaatgagtctcgggtaatttgatttacgctgtagtggagaaatcagagatttcagcgcagagtggactgtggtgtcctccagcaggaaatggggcctgtctctggctctgcgttggagccctggttcagggtggccctcgtgtgcgcagcctctgccgggtcagagccgccgcctcctggcatcgacgcaccagacccacctgtgtggggtgtccctgctgtggatgggtttcggagtgtttgcagtgattgctctgggctccggcatcctgggtcctgcccctccccggcgtctgccccctctcagggtactggggctggtgtcagggtcttcccgagtccggtgcctgtatgtggcccagtttgagatctgtgtgtgtgctttggagacgccattgcttctgcccagcaccagggctgcctggttccctgctggctcgggaggtcagtctggaagcccaacccaccctcagcctgccccccagcctcagtctccccaagcctgcagtggggccggtgaggccgaggcgtcagaatttgtatcttcccctggatgggatccttcttatcttgcccgtccccgtttgcattcgaatgggcttccccctgctttctgctgactctagtccggcaggccacagggtgccagggttcggttccctcagctggccagggtcggaggcagccatgcccctggatggctcccctgacagcgccagccctctgcggctctcacacctctgtggggcagttcattcccttatcttgcaagtgctccccctcagcctggggagcagcctgcgagggctgggccagggggccatgctcctccctcctgccctctcctggactgagctgctctgcaggacctgagcggctgtcctcttctcacggaggcgcccggagcccgccgccccctcattctctgtgccgcacattcggtgctgacaggctgtgcaccggccttgcctctccctggccctcaccttctccctgctctgctgacctcatatgggatctgctctcgcctggagcaggggcgcggtgtccacattcctgcggtgggggtgccagtgtgaggcctggcccgctgtccccacctgagctgggcccctcctgccctgtaattagtggccggctgggcggaggcagcttctcaggtgccgcccacctctgccccaggtgaaggttatgctgcggatctggcccgcacagggggcccagcgctcggccgaggccatgtccttcctgaaggtggaccctcggaagaagcaggtgatcctctacgatcccgccgccggtcccccaggcagcgcaggcccccggcgagccgccactgctgcagttcccaagatgtttgccttcgatgccgtcttcccccaggactccgagcaggtacgggcaggcggactgggcgtcctcccggagacccggagccgggctgctggctcagcacatgggtccgatctgcgcccgcttctccgtgcagggcgcagaggaagcgtgagcgaggggcccgctgcctgcggcgcctgcctgcttacctccctcatcgtcctggccagcgtccttgggtgtctccatccgcccctgccgaggctctgggccaagtccacagggaaaggcctggttttccggagcccgccctcccgggaagctttccgagcagctgttgggctctgggctctgggggcgcccggtgctccctgcccatgctgagccgtgcaccgtgtggctgcgtgtgcgtctctctgcgcgtggtggtctgcccctgcgcccggcggctggacttctgggctttgcgggtgtgtgtctgcacgtgtctggccagtccctcctacgtgtgtcctgggtcctgttcatgtgtgttctgtgctttccgtgtgcacatgggatctgtccttggtcccaggtgtgcagcccaatctccttgtgggtcgactgcctgcatgtgccaggacagaccggcctcaggcccacagacgtggcagaaggaaggggccacagccctgcctgattctcttgcccccctaggccgaagtctgctcggggaccgtggccgacgtgctccagtcggtggtcagtggggctgatggctgcattttttcctttggccacatgagcctgggtaagcacccttgccccaccctagatgggtcctgctggccaccccctcccatcctcatcacggtggttgctggcagcttctgatgggaaaggaggctggtcctacacatgggccgtggtgggcatatggggtgaggggcttgtggagaggaagctgaacccctgccgaactgaaaggcagagggcttaggatggatccaaagaggcccctgagatctcggtgcccctggttggcccccggggacgccagtagccataaaggctccttgcgtggtgtgtggtggggcctgacgcctgcgtggcccccaggcaagtcgtacaccatgatcgggaaggacagctcaccccagagcctgggcatcgtgccctgcgccatctcctggctcttcaggctcatcgaggagcgcagggagaggacgggcacccgcttctccgtccgggtctcagccgtggaggtgtgcgggcgcgaccagagcctgcgggacctgctggccgaggtggcccctggcagcctccaggacacccagtctccgggagtgtacctgcgggaggaccccgtgtgtggggcgcaggtgcgcctgcctactgtcccaccttgggggaggggggctgcacttggccctgagccactgaagacgccgctgcctctgcctttcctgcagctccagaaccaaagcgagctgcgggcacccacggccgagaaggcggctttctacctggatgcggccctggcggcccgcagcaccagccgagcgggctgtggcgaggacgcccgacgcagctcccacatgttgttcacgctgcacgtctaccagtaccgcatggagaagtgcggccggggaggaagtaggtgccacacccgcactcccgggcccctgtgggatgcgtgtcagcagagacccaggcacaggggcctgtcatccagtggctcctggggatgtccctggggttgtccccagcttgggcctggggtggggatgtggagcaggatctgggggcccctggctacaccatcatttgcttgccttgtggttccagtgtccggaggccgcagccgcctgcacctcatcgacctgggcagctgtgaggcggcggctggcagggccggggaggctgctgggggtcccctgtgtctgtccctgtcggccctgggcagcgtcatcttggccctggtcaacggagccaagcatgtgccgtatcggtgagtgtagggcctgggcaggtgccgaccagggtggccccttggtgacctggtaaatccgtgtctggtgtgcccggtgctgctgtggcccccagctcctcagggctttgctcctccaccacctgacaggcctcgctgcccgtgggctgcctggggccccacgctgggctggtgccggagctgggtgggaaccagactgatcccagggctgcccttggccagcctgtccccgaagctcccttcccaaggccttggcatctgaaccgcctcgacccgcagggaccacaggctcaccatgctgctgcgtgaatccctggccaccgctggctgccgcaccaccatgatcgcccacgtgtcggatgcgccagcccagcacgcagagacactcagcaccgtgcagctcgccgcccgcatccaccgcctgcgcaggaagaaggccaaggtgctccccacctcctgcccgccccatctcggggccgtctcggctcctgtgtccactgcaggcctctgctggcctggttggggtgggggtcagcaggtggcctggagcctgggtagatgtcctatgtgttctgatgtcatgaggctatgcccatgtggccctccctggggggtggggagcccagcctgaggtccctggctgcagtgggcagaatcggggcttgctgtatgtggcttgtggtggcctcactccagcctgctgcccccgcacaggccctggggtgctcaggagagccgcaccacctctgcaggggcttcctagggacccctctctggggctggagggtggagtttggggcactctggggttacacggcccttggtgtgagtcctggccactggcctgggcacacatgcttgtcttttgagcttcccgttccctcccagcgcggggtgacaccgttttccttgtaaagttgctaagaatggtcacttaagttcttcccctgagactcagttccgctcccagcgtttggtgggacatggttggtggtgcctgctgtagttttcatcacagtgaccgcagcattggccctgtgctctggggagggtcggggaagcgggggcgtgtaggggagactgggctcggcagctccacttttcttcccccagtacgcctccagctcctctggcggggagagctcctgtgaggaaggccgggcccgtcggcccccgcacctgcggcccttccacccacgcactgtggccctggaccccgaccgcacgcctccctgcctgcccggtgaccccgattactcctccagcagcgagcagtcctgtgacacggtcatctacgtggggcccggtggggcggcgctgtcagaccgggagctcaccgacaacgaaggtccgcctgacttcgtgcccatcatccctgccctgagccgccaccggccctccaagggtccccgagacgcagaccacttccgctgcagcaccttcgcggagctgcaggagcggctggaatgcatggacggcaacgagggtccctcaggaggtccaggtggcaccgacggagctcaggccagccccgcccgagggggccggaagccctcgccaccagaggctgcatcccccaggaaggccgtgggcaccccgatggctgccagcacccctcgaggcagttctggtccagacacccaccagggtacccctgagccctgcaaggccattgtctggggtgaccagagagaggacagcagcgcttggcctgagctgctggtcccggaaaaggctgcagtgagtggaggcaggaggccactgcccagcccggctcccccacctcctcagttgctggaagcctgcagagccccagaagagcctgggggagggggcactgatggagtggcacggacccctcccgtgggcatgagtgggcaggtggctgggtccccgatgcttcctggggccacctgcccccgcctggctgctggcagtcgctgtccggagcggggcctgctcaccaccacagtgaccctgcagcggccagtggagctcaacggcgaggacgagctggtgttcacggtggtggaggagctgtccctgggggcgcttgccggagctgggcggcccaccagcctggctagcttcgacagtgactgctccctgcgggccctggcctcggggtcccggccagtcagcatcatcagcagcatcaatgatgagtttgacgcctacacctctcaggcccctgagggggggcccctggagggggcagcctgggccggcagcagtcacggctcctccatcagctcctggctcagcgaggtcagcgtctgcactgccgacagccgtgaccccacgccgcagccccgcttcagccccgactcgctggcagggcttgaccctgggggcccccctgccctggatggttccctgggggatggaagctctgggttcctggggccagacagacctgacagtcctgggccaacctggggtccgtgccctggggaagtggctgcagtggccccatcccgacccggcagggagccccaggccgggccctcgcggtgggcatccgcagcccagaccatccactccagcctcccccggaaaccgaggactgcctctgccaccacccgtgtgggctgtgctcgcctgggccagagcccacctggccgtggaggcctgtttgaggacccatggctgctccgggtaggggagtgtgatacccaggcagcttctgctggcagggcccccagccccacacttggctccccccggctgcctgaggcccaggtgatgctagcctgtgcccagagagtggtggacgggtgtgaggtggcagccagggcggcccgcaggccagaggctgtggctcggatcccaccgctgcggaggggtgccaccacgctgggtgtgacaacgccagctgtgtcctggggagatgctcccacggaggtggtggcctgctcggggagcctgaaggcctcccccaccagcaagaagggtctggctcccaaggcgggcttcctcccgaggcccagtggggcggcccccccggccccacccacgcggaagtccagcctggagcagaggagcagcccggcctcggcccctccgcatgctgtgaacccggcgcgggtcggggctgctgctgtccttcgaggggaggaggagcccagacccagcagccgggctgaccactctgtccccagggccacgtccagcctgaaggcccgggccagcaaggtagaagcagcacaccgtcttgccggacacgcgtctctggagcggtacgaaggcctggcgcacagcagcagcaagggccgggaagcccctgggcggcctccccgggctgtacccaagctgggtgtgccaccctccagccccacacacggtccagctcccgcctgtaggagcggcgcagccaaggctgtgggggcccccaagccccctgttggtggaggcaagggccgtggcctagtggctggtgggtcgcgggctctggggccttcggtgaagctgtctacggcctctgtgacgggcaggagccctggcggccctgtggccggtcccagagcagccccacgggccgggcccagtgtcggggcgaaggctggccggggtaccgtcatgggcacaaagcaggcgctccgggctgctcacagccgcgtccatgagctgtcagccagtggagccccgggccgaggtggctcctcgtggggctcggcggactcagacagcggccatgacagcggcgtgaacgtgggggaggagcggccacccacgggcccggccctgccctccccctacagcaaggtgaccgccccacggcggccccagcgctacagcagcggccatggcagcgacaacagcagcgtgctgagtggagagctgccgcccgccatgggccgcaccgcccttttccaccacagcggtggcagcagtggctatgagagcctgcggcgcgacagcgaggccaccggcagcgcctcctccgcccctgactccatgagcgagagtggggctgcctccccaggcgcccgcacccgcagcctcaagtcccccaagaagagggccacaggtgggtgcagaggtgcacagccctctacagtttacgggctttctgtgtgtagatgtgcacagccctctacagtttacagggccaggagatgctggacagatgggcacagccttcaaggtcccagacccacacagccgtggacggtttacagactcgcctggggctttttgtgtgtggaggtgcacggccctctgcagtttataaaccccctgtacttgcccttctctggccccaccctgccctggggggctgatcctggtctgtgtctgggtgagcacaagggcagccctgcacaggtcgccaggctggggcactggactcgggtttgggtcccgggcctcgtgcctccctggcgagtgtcgagctgcctggaaggcccccgccagggctgccccaagggacagaactgctcaggtcatggcagggaaagtgggaggccctggtggtggtgggggcgcccttgagagctgtgggcctggcttggggtcggcttcctccctgccctgggcagagcgccagcctgaggattcctggactggatcccgaaggcctccctgtcaggactcgggccggctccgcagcgtccccgcaggggctgtgcttgggctgggccccgcctctgttcaccctgtgcccggctctccgttccaggtctgcagcggcggcgcctgattcccgccccactgcccgacaccactgccctgggccgtaagcccagcctccccgggcagtgggtggacctgcccccgcccctggctggctccctgaaggagccgttcgagatcaaggtgtacgagatcgatgacgtggagcgccttcagcggccccgccccaccccgagggaggcccccacccaggtagggcctttggtgggctggggtctatgacccctggtggggagcctgccgcggatggcagagtgagccatttgatgggctcgccaggcctctgggggtgtggctgggcagcccctgacctcactttctgtccacgttcctcccaggacgcaaaggtaggagcggccctgcccagcccaagcctgttgcagctccgacactccccttgggcagtgggtgggtggctggggggtcctgaggccactgctgctgtccgctggaattctcccctgtcgtggggagggtggtcctagagccgagccaggacccagacgggcatgggtgggctgccccaggtccgccccctgcccgcccttggagccccactgtgtgcctgccaaggcctggcaggtgaagggaggcgggggccacatcagggctgcttgggggtctctggggagagggtcccatgcctgagcccccgcccgccctgcctcccagggtctggcgtgcgtcagtacaaggctgcggctggcggagcgcaggcagcagcggctgcgggaggtgcaggccaagcacaagcacctgtgtgaggagctggccgagacccagggccggctgatgctggagcctggccgctggctggagcagtgtgagtcccgcccgcccacggacccagcccggcccaccgtgtgccctgacagctgccctcccctcccagagccctgttgctctcctgtacctcgtggtgggaaggctggaaggcagggtcggccgggccaagatgcctttcctggggcctctggggggccaggtggctgcccccagcctcgggcctgacgcaggtgcccctcccctctcctcccctccccagttgaggtggacccggagctggagcccgagtcggccgagtacctggcggccctggagcgagccacggcggccctggagcagtgcgtgaacctgtgcaaggcgcacgtcatgatggtcacctgcttcgacatcagcgttgcagccagtgctgccatcccggggccgcaggaggtggacgtctgaggctgggcgccggacaagaggagggggcgtgcagcgggctggaggacgggacgtgggacggagcgaggatgtggtgggggctgcggggggaggatgcggaggggtttctgtgcaggacgggagtctcagagaggagacggagtgtgggggagggagggccggccacgcggtggacagagcgagggtgccagggtgaccagaagaccgtcaccacccgacagcaacgcaagtgcctttgaccttgatttggacttttctcccttttgcatttggtgctacagacttgagacaccagcagaagttgtgttcagcccggccccgctgcgcctgtccgggccggggctggcgccggttgtgtttgtgtccaccttgccttctttgcagccaagcagtttttgtggagtggagtgggacttacctgcacgccccaggggtctttcaggattcaggatgacttttcttttacaatggtttcctctcggcagagcccgggttgtgggggatctgtgtggggttctcaacgcagatccatcctggggtctcccgggcagggatggctgacctcgagtcccctcccttcccgagaacccgctctgtcccgagggcagctaacaagggctgagccccaggtacaggttgcctcttccacggcaggaatttttaccaaaaccacaagcaaaaaacaaaacagaccaccacgaccaacaacaaagatggggggtagggttttgtaaaggttctgttaggttcatatttttatatcattttgcccataaatgcggaatttgccgtgggaatttgaagacaaatgatctatgtttttatggttttctagggaaggtgttctgggggccgggctctctccagctgtgggaggcctgctccctctggggggcaccctgggcagggtgggggggccttgggaggcgcttcttgccaaatgcagacgaggggtgagcctgccagcgtttgcgacgtccccgcacgacaggctcatactttctgaggatcgtgcatagcataggacgtctgaacctttgtacaaatgtgtagatgacatcttgctacagcttttatttgtgaattaaagatgcatcgatggttcccacggctgccgagttcactgggcgtcggcagactcctcacgccctggtgtgccgccctctgagggtccctggggtgacgggcagtaagcgtgggaaggacacatccacggggacccagggcttcgggtgctgtgccagggcctgccttgcagcccctgtggggcccacggtgccatgagggcccttcagagaaggtggaacacgacagagctgggattcaagcccacgcttcctttctgatctgctttcttgttgactctgctgagatcttagggtcccgaggctggggcagggagccaggcttgggggctgggctggcgggaaacagccctgtgtaagcggcccctggctcccttgtctctgggttatgctgtgtggggaagtcgaggcaggagtgatggcagcatttccctcccagagtcttcttgccatcctctgccctctgcctacctttgctcatgggctcaggacccccgaaccacaagagccccctcccggggcagcctggatggaggctcttccctggaggactcaggcctgggtctgtcttgaccccagtttgctgggctttcccgtggtcagaggccccagaccctttgggggatccccagccctttgactgctgtgagctcatggcctcacctgacctgtacatgtgccctctggggccaccttagctgttgctctggttgcctcctggcctcttcggagtcctatctgcttctcatttggtaggtccccagcggaactagtttgcttccttaagcctgttactctgtccccatgccagtaccccccgcctgcctggcctgcgaaggttgtgtctgggcacctgcccctttctgcggctttgcactggcttccagctgctccactccaccttcaacccgaggtcctggccatgaggccccaccatcccccgtgctgtgatcccctgcccagaggctggctgtgcagcccctccctcccttggggactccccctgtccccggctaggtgcccctccctggctccaggcgggggatggtggggcccctccttggtggaggctcctaggcctctctgccatggcacgtcacaccttgtgcggtctctgcctgtctcccggcctggcggggtctgagtcatcaccttccccgatcctgggcacagggataggcccagcagggctgaggagacactggctgaagaaggaataaaagaatacgtgaatgacagcatccccttaaagaggctccggctgcggtggaagcaggtccaggacagctctgagccgtctgcagagagcctcccgccggccctgcactgtggtcccacacagacacagtccttcgtgtggccacagggccccccaggtcaggccacagggtcacccgcacccaggcccctagtgtccatcgcaggtggcccttgggactccagcctctgggattggggttgcaggccagcctgggaggctgctggggcccctgatcctccagccccagccctgcttttgttggaggccagcgctgcgtcccagcagaaactcagactaatgtggagggcagggttgttcccgagaagccgagggccacgcatgccggctctgtgctgggtttggagaacttggcgagggggtcgggtccgggtggggtgtgatggagcttggggtgtggaggggtgatcctctcaggaccctgctctcaggagagcctgagaagcccaccaggcctgtgtcctggaaacctggtgcagctggctgtgacccctgacctgcacagaggcactggccaggcactctgtccatgggatccaggacagtgctggggtctgagtggggttgggtgggtcagggtacctcattctcagggaccggggtgatgctggtcccaggagggaggctggggagctgccctagagcccagaccactgcggggtgccggctcttgctcccttcttgccctgtacctgctcacctgcaggggatgggtgggtgctgaggcgtgtctgggtgggtccctttctttcatagagcacaccctgccccctccccatccctctgtcattggaggggtccagagcctgcttcttgctggggagcctggtcctccctccctggacctgggtcctccctgcctggaccccggtcctcgctgcctggaccccggtcctccctgcctggacccccgtcctccctgtctggaccccggtcctcctgcctgccgggctggcgtggctggggccttggggatggtggcctttgggcaggccaggccgggcccatttcccacagttcaggcctggctctcagagggcagtgcctgttttacaggacgtggaatccactgtcttggggccagcccaggagctggggcggcctttcatctgggacatcaaagccctcagccctgtcattaggggctggaaagctggctggggagcggcccaagtaggagtcacccattttatggatgggaaagcggcagccgccccggacccagctctttgactgaaactgaagctaaggcagcggcaccaatgcagcctgcagggagcctccacctcctgcttccgggacatttggggaaactgaggccctgagagggcaaaggagcctccacctcctgcttccgggacacttggggaaactgaggccctgagagggcaagggagcctctgcctcctgcttccgggacatttggggaaactgcggccctgagagggcaagggctgcttgagcctccagcaggtgttccttgaggattaggggggcggatttggagtgtgcaggggcaggatgggaggggctcacaggggagggtcagggtcagctgaggtggggagaaatggcagcctacggggagccacgcagctgctgatggtggatggccagggctgaggtgggtttggggttaggggagtgggcgcaggaaaggatcttgctgggctgtgccgggcactggcaaggtcctcccaggtggtgtctcttgtagcctctgaggctggcctggcacctggccagcctgcccctgccatggagtgaggtgcccacctgactcacccagtaagtccaggcctgccctgacggccctgcccacaccagccctagcacgggaggccacgttgtggggtggggtgaccaggggcagggggtcatgaggtggctaagaggaggccagagctgggtgggctgggcaggccagtgggacaggagctgagctacatggcctggggggcccgcagagccgctccacagtccgccctgctcgcagagtggcggagggtccgtgagccacggtctgatttcccggggccccgccaggctgtctgccccgctccttgctggagggcgggggggttccctattccaaggactgggatccgcaggaggcggaagagcagaggcccctcatccctggactctagggtcctcctatctggctgggcgtggtaggcgtctgggaaactgactgcagcttcagtagcaggcgctgggctcagaggttccctgtgagcctcctcctgttcaccatcccagggaccacaagtgcaacccatagcgatggccatggggatgtgacactagggtgggatgggaacagtggcagcaatgacagtgggagtgctggcagaggagcgttggtggcagggaggctggtggctgtggctggggtggggccattggcagagcagcagcagtactagggatggtggcagcagagatccaaccagcctggctgatggggcagtgtcgcccctcctggcctgctggtcgcttggctgccctcgggcctgtgtgttcctcatgaggccagcaggacgtggcccgagcctggtcctttcctgacacccttttccctgggaactgggagtgaggtcacagcagcctccacagggttctcactgggtcctgagccccagcagctgaaggggggaatgggggccgcctggagtgcccaagatgggggccctaaataaccagcagcggggtcattgccggatgatgccacgttctcccggggtcccgggccgggaggggaggctctgccagtccccctgtgtctcgagcctcagtctccctctctgccgaggttcctgttcacgtgtgcggtcatgtgtgtgaacatggctcagcacctgtcctcatctgcttccccccaccagggccgcccccggctaccgtgaaatggacggtgctctgggctctccagaaggggaccagtctcggcccccacaccctggttccctgggaatccgaggaggcccctgccctgtgactgcgccccacgccccagggcctgtctgcagccctggcgggagggtgattcctggggtggaggccccctgtctgctcctctcctgggaacgagccccgccccacggtgcctgggggctgggatgtgctcccagcaaacaggaagcccagggtgacttctccctcctgacattgtgtttaccaaggcgggatccaggcccgtttccacacaggaaacccaggaggctggaagaggctgggaaggaattccctgggccagctaagacgctccggcttcctgtaggacaggcaggcagtgtggggtgggggtggagtggggtgggggtagaggtgtggggtgggtgggtttggggttgagggatgggtagaggtgggagtgggggtagaggtgtggggtgggtgtgggtggtatgaatagagagatggggtggggataggagtggggtgggggtaggggtgggttgggggagtaaagggatggggtggggtgagggtaggtgtggggggatggggttggggtacggatggggtgggagggtagagagatggggtggggtgagggtgggtgtggggagattgggtgggggtagagatgggggtagatggatggggtggggtagagggatggggtgggtgtggaggatggggtggggtggggtgggtgttgggggtacaggtgaagggatggggtggggtggggtgggtgtggaggatggggttgggtggggtgggtgttgggggtacaggtgataagcagctaggagtccagggaggctcctggggctccgggtggccgtggtggaacccccttcagagctctggatttggtggcagccttgaacgtccctgtgtccccatgttgtcaccgggacctgcaggcccaggcccaggtctgtctcccttcagacaggccaaggctgaggggcacagtgtctccctctgcagagtccctgtggccggcacaggggacgcgtgagcctggacatttgtgatttcagggcagaggcttccaggagggctgggagcagagtggggccctgaaggtgctcgctccacacctgggcctggggcagccagaaggtcccccctaaactccctcctggccaccttgtcaggaggaggtgtcatgtcccaaatgtgggtcccccccaccttcccccgtctgcctgcgcccagctgcaccagaccttggccttcgggggtgctgtttgtttcagaatcatcttttaaaactcagccttcttttgggtttgcagaaaaaccctgaggctcacacagagcccccacacccgaccgcaggctccagtgccccctcccacgggcatgcagcgaggcggtggcgacggccccaactcaggtcgcccgagttcctgtccgctgccccttccgggctccgcctctggaggcagagacgtaaagcacctggaattctgcacgggagatttgtctcctctctcatttattaatttatccaaatactttcggcagcgtggacttagagatgtttgttttgtactttgggttacattcaatactgttagtttcatgactaaagctgttccagctctggccagtgggagcctttcagctgggtggcgtcggttttgagtcctcaaccattgcccccaggtccccatggcccccagacgtgagctggtgctgcctggttcctaggcctgcgggcatgtgcgtccccttcccccgccccccacacgcgtggctgacatgtccctgccaggatgtgtgattatatatatatagaaattagaaattactagaaagggtctcactgtcttccaggctggagtgcagtggtgcgatcatagctcactgcagtctcaagctcccaggttcaaatgatcctccagcctcagcctcccacgtagctgggaccacaggtgtgccaccatgcttggctagttttgtatttttttgcaaagagggggtctcattttgtttcccaggctggtctggaactcttgggctcaagcaatcctcctgcctcggcctcccgaagtgctgagaatacaggcatgagccattgccccggcccttggataacgcttcacaccagttgcttcgcacagtccttagctctctgcttgacagcccccgagcccacaggcctgggagtctccacccctctgaagccgcagaagtgaggggatgtaatggctgaggcccgggcgtggtggggggtcgaggtctccaagcacccgggtggaaggaagtgtatctgggccccgtgagcagacgggagctcctgctgggaggaactgtacctgggaagagggaccccacccctgcccaggcccctgagcagcccaggaccctcccccaaggaggtctgaggtgagatgaggcccctggagatgccccaggagggtgctgtccagggtcacagccccgtgccaggctggggcctccctggtgaactcggtggcccggagtggatgaatggcatgcgggaggcgcctgctggctgccagggcgggcgatgctgggctagttgccactgtggcacagcctggccctggggtaatgacattcctgagaaccctcagggtgacatcactgcgtagctgccttcacactgttgtcaccatcacgggagtgtgaggtcagatggacgtgctgtccctggggtgtcaggccccctgccagtgctggccagtctgccctgcctgccatacggggcttcagccggctttctgaagcatcccgtggacctggcgggggcggcctgggggtggggagggctgagactgctgccacttccttgccattcctggggggccgcagggtcaccatttgctcccactgctgacctggaggaaggcagcctctctcctcggtgggctcctggttatctcagccctttggggaaacacttggtccaggttcgggaaacggctctgctgccctcaaggggaagcccatgtgcctcaccgaggaaactcccaggcggggccgttggtaacactggaaccctgaagggaccttgcatagctgggcaggaagggaccaggggcttgaggggcgcaggggtggggcctggccggccactgcacttcaggtcctgggcaggcgcctcctttctgtgccttgatttcccctcctgtagcaggagcagctgtctgctgcgtctgagctggctgatttggaataaatctctgccgtttctccagccccaggggcggcgggccatatttctcgcagcctcagcggctgtcccgcaaagctaatctgcctggcagaggggtgacactctaaatcctgtgcccaggctgatttgtgggcctgcctgtgctggtgcagggctcgctggcatctttatgaggcaggatgagcctcgctgagagccagggcaggctgggtgtgatctacagcctgggcggcccccgcctgccagcagccgccgctcacgcccactgggcagggtgctctggcccaggctgagggcagccaggtgtctgactcctgttgttcctgctccgggagccttggaattcacctgcaggaaggaggtttcacagcacacagctatccagggggcgcttcctgagcatcgtggcctgggctctgggccgggctgagctgagagggccagatgagggagacccaggtcctgcctgtagggaacccaggcttcctgggccatgggcaggcgacacctctctgccaaggcaggagggatcagtccattctggcctggaggtggctgagccaggagggcatctgcctctgagacagcctgcaaagcatcggtgctggaaatcgcctgggttccaaccccagctctgccacttcccacctgggctgccggaggagttccctgagatgggcagggatggggcctggctggcctggcgggggcctggagagcaagggggccatgcactctgtctcaggggggaccccagtgaggcccccctgcacctgtgttcgttgtttcctcctcagcagcgcagaaggctcctgttagctttacccaacgggctggctgagcacctgggagggcagttcctcagggctggctgctgtgtgaggggagccagggtccctgggacagtacagggggtgaggaggcaggtagcaggccccctacagcctcacagtgccacggggctggcggcatggccagggctctgagccgttggtgcaggagggcgcccaggcccagttagtccgaggtgggacctggaggctggtgcaggccactgtttacttacttcccgttatgctgatctgcctgagagattcagtccccggctgcgcgtgtcaggccatgcagtttgttaataaggcacagaggagagtaaaacacctcctctaggtggccagatttatcacttggtgtgtgcacacatgagcaggtgcacacatacatgagcacacacatacatgagcacacacacacacacatgggcacatgcacgtagggacacatgtacacacatgcacacatgggcacacatgcacgtagaggcacacccgtacacatacatgcacacacgggcgcacatgcacctagggacacacacgtgcacacacgtgcacacacgggtgcacatgcacataggggcgcacatgcacacacgggcacacatgcacctagggacacacatgtacacacatacatgcacacgggcacacaggcacgtaggggcacacccgcacacacgcatgcacacgggcacacatgcacttagggacacacatgtacacacacatgcgcacatgggcgcatgcatgcacacacacacacgtgcactcaggagtcatgggacccgatgccctgctcttatgtccatcttcttggagccctggcatgggggctcccccaccagtccccacctccagctcttcctggcaagcccgtggggaggggaggaacttggcctgcgttcccacagactggcacagggagcaaatctgcccagcaaaggttgggtggcctgcagacccaagcccactctgctggacacctgggctcaggtgctagaccgggggctgctcttgcgggcagaggaggcctctgagctgctgccgggagaaggaggctgggctccagggtcgggggttcagggctgtgggtttggggatctgggggtcctgggtctgaggatctgaggtgggaggacctgggaatctgtgagtttggggattgaagcttcagctcagagcccagtgctgctttggagtgtcccctgaaggaacctggagtagagcaccagcattttcttccagaagcttcttttgggccactattgtctcagactggtacccggccaggacatgcatgggaaggtggcctctggtggcctgtggccagctgtgcttggtgacttccaggccagagcctaggtagactggcccaaaccctcagagggtccccccagggcagatgggcttcccggtgtaggctgtatctgtggagcccagggaagggggcgtgcgggagggcaagggggctgctgagggtgggatgtgggtggaggaggcaggatggaaggcaggggcagggctgagacctggcagtaatggggccacactcagaaggacccacactgttatgcccagtcgtcgccaccttgaagttcataacgactcttggataaggtgcccagggtttctgttacgctgtgggccccacccaaaattatgtggctggttctgaagaggggactctgggagcgggaaaggcaggcacagaggctgaggtgggagtgctggggaggccgggggtccacgctagctgtctccattcctgattcctgccctgggggcagagggtggggctggtcgggcctgcagctcactgtcctgaaccccagttgcctccatcccgtgcctcctccctgctccccgccatgagccaggctgcagaggtgggctgtactcccagactcagcatcaaaaactgccctgtgacctaggaaagccccttggcctcgcactggtgaaatgacactgacctttgatttttgcactttaaagggtggaggttggaaaggtctggcgagagccacagcctggccttgcaggagccagctccgacctgtgacctcagccccctgggcctcagtttccccattatggaaatgggaacttggaggcttagggctccctgcacagtggaggtgggtgggtccctgaatggggagagcagaggctttggggcaagaagttttggtgggtgagaggcagaggtggggaatgcaggcaggggcctccccttgcacctgcattcaggggaacagaggacgtgtgggccaagaccctaggaggtctgaggactggtcccaggttggggtgggcatggtggctcggccaccgtggggaggcagagggctgctcgtaaatccacgctgctgtcagctgaacggcaattgcggattgaggcggccatcggggctgacctcctgggtctgacgggtccatcacagagcagcaccgcagggagaggcggctctgcctgggaacccacctgcacggaccacacggcccagggcctgccagttcctgcctcccgttcctgggtggggctcacctagtgtcacagagacacggagtgtcgggcagtgactggcctcagtgcccagaccagctgggctatctgagtgcaaattctgcctgctgtgtgaccccaggtgtgctactgaacctctctgtgctcctctgaaactggagatccgtattcacccctacctcactggggctcagttagatgatttgacccggagtatgcagcttagtggtgcctggcacataaggaacgccaatggatttggctccaatggggatggcacggacaggggtaggatgatgtgtgcacagtgcagcctcccgtcgggtccacggccaggctctgctcccaccagctgtgtggactcaacatggagcctgggaaatagaaaaaggcctgtgaagtgcccggagccagcggcacagggtgggggcaccaggagctgctgcctggtcctctctagggcagtgactatttgctgccattgccacggggatttatcggggcccctccatgtccaggcgtgggcaggtatccgtgtcaccccgtgttacagaccaggaaggccaggtccagggcaggccggcctgtgcaaggctgacgggaggaaggagagccaggcctctccctgcctcgcctcgcagcagagccctgggtctgggcaggaggacgggcggccacaaggagggccagacccaccctggggccacactgggttgcgtctgcccctggggtgagcctggtggagccggaggggcactgcagaggggcagaggggtctcctcgcactcggcatggactctgcccctgctcctgagactggttggccttgagggctcctccgggagcctggtgccctcactcttcagaacagctcagcacccacagcctggccagctggagcagctgggtggtggttcagatgggatggtggggtcagtgggacaggctctggcttctgggggcaaggaatgagctggaggcaggggaaaaggaaggggctgggcgttgggcgggctggcacatgggatgtgcctgctgaggcctgtgggcaggtcttggtctggggacagccctgcccctgtgtgtacctggctccctgctccaggcagctccccaatctcaggctcagctacccggggccctctgccctcgtctttctgcccagctcttgggggctgtcctgcttctgtctcccaagggcctcacccagagctgaggcaggggtggggatgccccctgcctgtggctggttggcctgctctctctcctgctccctttgctgtgagttgggtgaggagggggctccgccgcacttgagagcttctagcagcagcgcaccaggcacaggcatcgtggcgtcgggtggcaatacatggggtgtgaacatagagccggggcaggttgagcagactcgcaaatgagctcccagcccccagggaggccttgtgggagaccccagcccactcccagggacctaccccagtgcacccctggggaaatcaaggctggggtggtctcctctcgcaaggctgctcagccctctcctccccaaccaccgaggcctctgctgggcgagatctcacagccttcaaaggcagagccctggtgcccttctcttggcatctgtgcccacttctcggcccccaccccggccactcccccccaccctgtggatgtgtctttcatctgtccctttgtggccctcagccctgtcctcctccctgcactctccctgggccacctgcccctgccctggggcttcacgtccccctgggccaccttggcccccagaccccatccctgtgccccacatctgcagttccatcgtttctctggtatctgccccatgtccctccggcccccagatctctcagacttgttctcccctgtgcacccctcctgggggccctgtttcatcctcttccggaaccggggcatcaacttgggttccctcctcaccctcagtgcctccacccagccccagtgccatggcagggtcgggaccctcaagctctcagggctggtccaggaagagcctctgtccaggtgacctgggcacagggggagcatggcagtggcgggggcaggtgggaagggattggcttaaaatgcagcattcacttaaaaacacaaagaacatttgttcaccatgaagtcaggtcctgctctggttggtctgtttttggtttttacctggttttttggtaattacctggtttgctttgagctgcttccaggcatcagccagccccatatcctggtggggtttcctggggccccatttatgctcccttggaagtaccagagggtcttcttttctcttaaagaaacaaatatttgcacagttcagcgctgggaaggcctctggccgaggtggcccgcgcaccctgagccatgaggggtcagggctgggcagaggggagggggtggatgaacggcttctgcagagacagtcttggctccacaatctcctcagctcaggagtgtggatgtgccatcctggagcaggtgcctgtctctccatggtcctggctgggtgccgtgggttccggacggcagggcacctgcccatccagggctccggagcagcgaggctaggctgggccttcagctctgtccttgctgggcagcgatttcctcttctggacaatggggagagctgtccctcgtcctggagggtgaagtgggtggtgtgcgtgatgatccccggtgcccagcacatggtgggctcagtgaagccagacttttctagttcttctttagttccctagacctaagctctcagctcgtgctgtgtcagggctgtgttgagggagggaagtcaggtgtagactgaagctcttaagactcttaagagcttctacggtccagggtgtcacctacggtccagcaggtgactgatggtctagcagacgattaggccagtagagaggcagagaaagtgcgggggactcagaggaagggaagtgcttccatctgggccaggggtggttagggaagacttcccggaagaggaggtgcttaggggaacctggaagggcagagagaaccagagatgcaggggtgagggtccttctggcaggtgtctgtttcaggggatgtctgtgttcggtgaggccagggctgagctctactgttggctgagctgtgggggcggccaggcagggcccagcatgccaggctgaggatggggccaaggggggcacggcatgctggcccccctgcttggtgttcactcttggggactggacagtggtcctttcaacgagccccctcgcagtccctgccctggggtctctccatagaccactctgcacacgcagaccctcctgctagcggaccgggccacagcgaggagtgaagaccctgtgcagagttctcgtgcggccaaggacagcagcccacctgagacaggtgccctgtagtagtggcgggagtcagagacaccccagggacagcagcaggggctgcttgcggtttggaagtcccacctgtgcccagaccaccagcagggtctctccttcccaaaccaccccctttccaattctgggggcgtcagagactgctgggggcatggggtgaggcagggaagggtggtgcgggaggctgagtgggagggagagggtgggatgaggccctgcatgctggacaggactctgatgcatcacccatcccagggaatctgagtctgaaacacagaaaggacccacagccattgggtgtccccgggccttagcttgctgggcccagggcaggccgggctgcttcttgcccggggaactcagcagacccctggatcgctccggggtgggtgagaggctgtggagggaaccctgtcctggccggctgacctcacagccctctcctgcagacggggcagtcgaggagtaaaagaatgaaaagcagtcaaacagccccaggagacgcaggtgaggctgggcgacgagcggaagctggagatggggccgcatggtgggcagcagcagggcaggcttgtggggtgaaggaggctggggcatccggcatggcagaggcagcttgagtttggcggaagggtgaggcgtggggcctgggcccacaggaggccagcgtggtttgggggcctggttgggtctgagatgctttgggtggtccgggggacgtgtcccataggcagctccaggtggaagctttgggctgaggcagaggctgcctatgcactcaccagctcgttaattcatccttcattcttgccgggagctgttggggaggccatgctgggggccggctcctgctggctgacaggagccagttgttccacagatttgtcattcaatagtgtagaatcagatcatgtcctcgttctcgccacggcgcggaaagctaacaagagtcagcccggctgcaatctgcagtgctggcggttcccgttgaatgagtgaaattggtgtgagggtgagataggcggtcgttgaacagagagcacacatcagacctcacgacaatgagcttcttgggaaaagagacctggcttcctttgttgactcgcgggagtggcagctgcggggctggctggaaatgagagcagagccaaggagccttcagggctcagacttcaccagggagagttgtgtatctgtttgtgttatttctaaactgtgtgtacaggtctttcatggcggtaacatgtataatcaacgtgcattcgcatacacaagcatctgttcttttctctgagccagttgttaaaacatttaccagcaccgctgtgggggctggggagaaggtgctttggaggggggtgggtgggacaccttagggtggggagagggtgtgtaggatgagcccaggtagagaaagagaaggcaagggcaggggaggtggtgtctaaattagggcagagcttaccaaggacaggccaaggcaaggaagggggaaggtggccgtggtcatggctgggcgggaaggagggtgcaggaggcggggccgtggtgccgggctagaaggaggcagccacggggttctggtctactgactttcatttccttttctttcttgaagcgtgttccgggcagtccatccaccccccatttctgcctttgcttgtcccgtgcccacaggtgcccctgacaagaacctggtgtgagtggggtgtctgcagttagcttgcagccaggacgaaacatgaatgcacttgtgggtctgcgagcgaagctggtgatgttctctgccaggcagcggctccctggtctccttccaaggttgggcagacatcgcctgcctggagctgggccagaggctgagaaaggcaagggagggtctcagcccccagctcactgcaggaacttgttgcacccatggggactgagaggcagggctgggtcaaggaccagggcctggtggagaggtgggggcctggctgccccagccctgctcagacatgctgttaggccttgggagagccccttcccctctctgggcctcaccatccccactggatgaagtgggggctgggatgctggccttgaggttgatcccagtggtgagatggggtggaattgctgtcctcacgactccaccaacccaccattccctgtccactgttttattattcacttgataaatatctattcagtgcccacttgatgacaggaagtagtacaagtatagtccttgctgtcctggggccaaccccctctcccatatgcccatctatctacctatctctctgttcatcctttctctcagtctgtcagtcattcgccaatctatttttcatactcccatctattgcctcagcccttctctcatctacccatccatccatccatccatcatctatccatatatccactcattatccatccatccacccatcatccatcatccaggcatcatccatcatccattcattcatcatccattcatttatcatcattcattcatccatctattatccattcatccatgattcatccatctatcatccatctagcatccctccatcattcatccattcatcatccatctttcatctatccatccatctattcatcgtctagctattatctttctatccatcatccatcctctattcatcagttcatcccatcgtctacccatccttctatccatatgtcgtccatctatccgccatccatccacctattcatccattcatccatctatccatcatctgtccatccatctacccatccatcaaccagctatcctctattccttcatccactcacccattcatacactcacccttcctctctccctccattcacccacccagttacccattccttcctttctttctctctccttctacccatccatctatccacccacttatccacctacctgctcatccatccatccatctatctgtccatccatccatccatccatccctctttccattcatccttccatttctccctccctttctctctccatccatccatttactcacccacctatccacccacttatccaatggcaatcaagacttgcttcgtgctggactcagggctgggaatgggggtgatagaaatgaggtagacctggttcctgcccttgtagaccttttagcctttgggagaggcatctgtggacttccttactgcttacagcatgggagatatgcttgtgatgtctgcacaggtttggaggcattcaggccacttgggtctcaacggagcctgagctgggctgggcttggccaggctgctctgcaggggaggataccctgatggacagggctcccctcagtggcagtgactctctagtttgctgtattgtctgttggggctgcatttgagaaggtgtgtcctggaacgtgacccatctccccggagcccagcctaggttaggcttaggtgaccccgagggcttggagaggccctgagaaatgactccgtgggtcaggtgagtatggagagaactgtacccaaggttgcccagggagtccagccactggccccatcctctcccctgggaggccgatagctgcctgctgctttccatttggggcagatggactctgtccccaaaggaccctttgccaggtcaccagagctatggcggcatctgcctcctgcctgctgcagagccctgcgtagagctgtccccataagtggcatctggagggccatgtctgttgagagggtgggatattggcatctggcagatccgagtctggctctgacatctttgccggcaaggccctcagccttccttagcctcatttttcacatccataaagtgggaatggctgtgctggagtctgtgtttaagcagccccaggcggcctggagcacatggcgcatgtgtgcgtcagaagggctgcctggggggctcagggaggctctggtgctggggtgcaggaagcttggggacttgggcttagcaagtcactcttgggggtgcctcaggcaactctgttgctctcctagacctgtgggatggatccgtggtgtctgcacctgcacctacatacaaggatggcatagtcctccggaccaaacacattcgatgaggacacgcttttcagtgagagaacagcagcagcaggaacaagcatccgttatgcagacctgcctgtccccgattctcccagacacggagcggcagaggtgtccttctctttctggcaaggtttcagggtagaggcacggtgctcggggtcccacggctggtgggtggcccctgtgcttctcgctttgggatttgctgtccccgagctgcccatcatcgttttctgggtacctgagatgcagtgtggtgagttgggcgtggcctggacacaggctgagcaggtcagggcactgggagctggcctggcaccggctgctgggctggtgaccaaccaacgcagaaccctcaggaaagaggtggggagctgtgcaccagctgtctcggggtgatttgtggggaagccgatgtgtggctgcgtcctgaatcacactgggggtgttgcacacgcccaccaacagccttgttcctaaattatcttttatgatcgccagcaaatctgcgggtagggggcatttgtacccaaacgaagccgttatttgtggtggcagacatggcattaattattgacgcgcccggccacctccagttaaaattcatggtccagccactctgcaaatattgattctgtcccaagttgatgttttccccttaacattattataatgagggataaaaatcaaattgccttcactgaaactcaatcattcttccgtgccattcctcattgatctttctttccccaggttttaccataaattattctattcaattaagtaaactcacacataatggcattctgcaaactgaataatttattgactatgtttggcaaaaggctggtttggagtgggctggggaagggagggggcttggtcctccatgttcccagggctggtggggctgggcaggagctgcggtgggggtgagggtaggggtgggggtggggctggaggccgtgggggtgtctgggcctggggtcctggcggccacagtcaggagctaagtgtcgtccccctgcccatctgcctactgtgcagcctgggccttggcctcatgcctgataccaaaatctgccttcgtctgcttgggccttcgtaacaaatgcgcagacggggcagctgaaacagcggacctttgtggctcacagttctggaaactggaagtctgagctcaaagtgctggcgggttgctgtctgctgaggcctgtcttctgggtgtgccgacggttcctccgtgctgtgtcctcacggggccttccctctgtgcactcatgtgaccctggtgtccaaatatcttcttcgaaggacaccagccagatttgattggggcccatgaacagcctcattttaatttagtcacctttttttttgagatggagtcttgctctgtcgcccaggctggagtgcagtggtgtgatctcggctcacagatgccggtgcccccacttctgggacaacaggaaggctttgagggtctgaaggtcacaggtgcaggctccagagcaggggcgatgggccccacccgtaatgcacccttcccccacctgctctgggccctccacacccttgggagagacccctgggcctgcccggttctggacgtgccaattagagcctcttagcagaggcctggccaggctcgggcacctgggcaccctctgtggatggggacgtggattagggcctgtgtccagcctgatcttggtgggggcatcagccgggaggtgttctgtgtcctggcagcagggcctgtctgtgcctggggcctccaagtacagacccctcaggaaggaggcagagggagtgtggggcgccccaggcctttgtctcagaaaagcgccccagctccgcggctgcattccagttgagtctgagcctgagtcccactccggcagccacagtgcacccagtgggtgggaggcgtggccggggctcggtgcggccccgtgtgtgactggccgtggtggctgtggcttccttgctgccacaaggcctgggctagagctggcccctcctggctggtgctgccgaggagctgcgctgggtgcttcatggatggttacctccagctggtcatgccaggcagggtgtccctcatggggttccggcacgtgagtggcaccctgggggactgctgcaaccaaggctgttggcactgcaggcagctgggcctgtctgtgcgctggccaggccctccctggaagacccaggagcgggttcatctcagccttcaccttgggctgcagagatgagcactccagggaggggaaactgaggccaaggggcccagcaagtgcagagagggggccttctccagccatgggccctgccaccccccacaggtgctgccagagacaaggtgtggagcacccccgccacaccccttttctgcctcagtccacgtgccgccgatacaggactctgcaggacaggccccaactgaggccccggctggtctgtggttcctgcctggccttgggtgtcactgagcttcaggggtgcatctgtcctcagagaagcaggaggggagccacaggaggtgaaggtggagaaagggtgccgaggcggtggagactgtggatggtccgtctcctgccctggacagagggttctgggggcctcgctgacaccagccctgcagcccccagccccacctggcccaccacctctttgcactagggatctctgagtgatttttctccccagtgaagagtggaaaccagctgctgttcagatttcttctctgaaccgattccgtcactgcttcctcccagagcccaggccctctccctggctgttacatatttagtttggacagagtctgggatgtgtgtagctggtagaggggacacggatgcagcttcctctgagctggctttgaggcttcctgggtgagttcagcgggcttctggggtccccaaggcagagacgcctgcctgccttctgccaggctggtggcacagctggccctcacccagcgggcagcacgtgcgtggtttcagacagaagcatggcaggtgtggggttttatggggagcacttccgtatcctcttcctgctgtgcttgagctgtggggagctgctgctggcccttcacgagtctctgggctaagccgggcagttcctccgccagcatggagccgtgctggcgacagcctggtgaatgccaagcagcttggcgcccagcccaactgttaagggtctcatttgcatcaggcagcccagcgccggcttgtccagccctcccgatggccgtcctgggggtgcttggcgtcacccgcgtggaggcagattgtcacgctcggcagctccccagctccgggggcttttacgactggcatcaggtcctgctaattacagggacacatgtgtgccgggtgtgcgtgggagtgtgtgtgggagcatgcgtgggatcgtttatttgagctggatgaggactgaccgacagctgatggttagagggggcagatgggtcaccttccagcttagggtactcctctctgtaggacacgcctggagacagagatgggcaaggtgcttgcgggctgctccctgggtgagtgttagcaagacaggaaaccggggatgcccgggcttcagggagcacatggggtggggatggggttacaagatgctgcacagatgatgctggcaaaaaggcaagagtaacacatggcatgagagagggcagagaaagttctagaaagagaaagcagaggttactttcagctaggagaaccagagaaagcctggaagagacgtgctatggctttgcaaacccacccttggcccctttgtgcccaggaggctgtaggaggcagaggtgctaacagggtcagaggccagaggaggacaggggtgtgttcctgtctccgcctccttggctccctccctggcctccacggtcctggctctccagccctcccgactcctgcaggctcatccatggggtgcgggcccctttcccgtctgtgcctgggtcacagcccaccagagagctcccatgtctaaagccagcagcaggagtttggggctgcaggaagcgcagctgtttttagggattagcgagcattgccagcacctgcttgggttgtgcttcctggccatgccacacctggtggtggcagtgggtgctggggcctttccatgggcccctttgttctatcccacagggctgtgggcaggagagtagccaggacgatgcagtttggtgcattgaagctgccatcagaggagagctcctgatggaaagtgctggggatgcctcgcaggctggcctcacggggccgcagcagggagatcatgagggagaagctctctgtcgtagtggggagttctctggttagtctctttcctcctttcatgcccatcctttctccctcccttccttgctgccttcctttattccactgagctatcctatcttacattattcatctacccatccatccattcatccattcatccatgcatccatccatccatccatgcatccatccatctatccatccatccatccatccatccatccatccatccatccatgcatccacccacctatctgttcatccatccatccatccatccatccatccatccatccatccatgcatccatccacttatctcttcatccatctatccatgcatccatccatccatgcatccatccacctgtctgttcatccatccttccatgcaaccatccatccatgcatccatccatccatgcatcatccatccatccatccatccatccatccatccatgcatccacccacctatctgttcatccatccatccatccatacatacatacatacatccacctatctcttcatccatctgtccatgcatctatccatccatgcatcctccatccatccacccatgcatccacccatccatccatccatccatccatccatccatccatccatctgtctatccatccatccatccatctatccattcatccatccatctatccattcatccatccatgcatccatccacctatctgttcatccatccatccatccatccatccatccatccatccatccatccatctatccatccatccatgcatccacccacctatctgttcatccatccatccatccatccatccatccacttatctcttcatccatctatccatgcatccatccatccatgcatccatccacctgtctgttcatccatccttccatgcaaccatccatccatgcatccatccatccatgcatcctccatccatccatgcatcatccatccatccatccatccgtccatccatccatccatccatccatccatacatacatacatgcatacatccacctatctcttcatccatctgtccatgcatccatccatccatgcatcctccatccatccacccatgcatccacctatccatccatccatccatccatccatccatccatccatctgtccatccatccatccatctatccattcatccatccatgcatccatccacctatctgttcatccatcctttcatgcatccatccatccatgcatccatccatccatgcatccatccacctatctgttcatccatccttccatgcatccatccatccatgcatccatccatccacctatctgttcatccatctttccatgcacccatccatccatgcatccatccacccatctgttcatccatccatccttgtatccatccatccatgcatccatccacctatctgttcatccatccatccatccatccatccatccatccatccatccatctttccttcctttcgtatccatccacctagtcatccttcttttcacccgttacctctttcaacagaaccatgcccagtttagggcctagcccactggtcactagcccatgtaggccattatggtccagagtgctgtgggcccttagggagaacaggaactggaaaggtccagagggtgccccaatgcagctcggaacccgggtgtctgccctgggaggacacaggaaggactgggtctggtgttttgagggttgacaggcagtgagccaggcaggggcagggcatcctggggtgagggcttcgggggaggagagtggcagtgtagggggcaagggacaggtgacctgagggacgttgccccatgctgagatgtcctctgcttacggggaaggccaagccacggacgcagcaccttggtccaagcacacaccttagatcctggagggtcctggatgcatctggtcatggactcaccttgctgcttgctggcaccctccccaggtgtcatgtcgcatctgccctatgtttgtgggtgattgtgaccctttcatgggtggggcagcatgatcggggcagatctctcagctcccttccccggcgtgaccctccgtctttctctttgtcagttctgacatttactcattttttgtctacagagagtggatgagagctctctgccactgtccgggagggctggggctgggtgaggtctgggggctgggtgaggtctgagggctggctggcagctaggaggagggagacatgacgctgacggccctgcattgctgcttcctccagctgaatctaccaccctgacttgtgagtgtcgagggctttctggggagctgctgggactagagaggcgagatcagcaggtgggtgggcctggcctctcagctggcccaggcccttcctctgctcaagcccccggtgagtggagtccctgagctgggtgaccatgagcttgcctgcccggcatggtgtgtgtgcagggctgggagctgggggtagaaacttgagctctgtgccttggtctgcagtggcctgcaaggcctggtgcctccaggccccgactgcgactgcacagcctgagcctgggacaccatctggggccttgcagggctgggccactgctggtcaccacacactgtcctggtcagagtgacccccaggtgatctctgtcctcttcacagaagggtctcctggagaaagccctggagcagacaccagccctggctcgctgcagccttcgagccccactctctcctctggacctcagtttcgccatccatccaatggtgaccactcagtcactgccagatcctgagcagatccgtcctggccctggggagtggaccatcagggggcagggctggccagtgagcagagagctggcggtgacatgggctcagcacagagcaccacgtggggcctgggaggagccatgagagccggcagccctgcctgtcctccagatgaaagcgaggcccgcagcctgagagggagggaggagacgctaattacgcccagcgcggggctccccaggcagcctcagccacaggatcaaacaccgccttcctcagccacgcgcccggtagtgccaagtccaattacaagtctaaccagggctggtgtgggcctcatggaaattcagcaattagacccacctccagcagctcctgatgggcctgctgtgtgtgcatgtgtgtgcccctgtgcctgtgtgcaagtgtgcatgcacatgcccatggatggacacacacagtgtgtgtgtgtgtgtgtgtgtgaagggaagcagggtgaggggactgctcatttaggaggagaggccaaaggaggccaggccccagtcaggccaggagaaggggtccacatgcttgggagatggtgagccagcagggctgctgcctgctgtactggatggaacacgaggccctttgcaggggaggagactgcagctcaggaacagagaaacccccttccccagctctagtggctgagctgctggctcaggcccttggggcttcctggtggaccctcagaagaggggcgcctgggtgctggccttgggtgcagtgtcagcctggatcagggagggaagatggctctgggcatggatggggatggctgggcctggcaggggctctttcatgggtgcatcccaggctcccagcctgtaccctatcctttctagatggtagtctcagccctgcccaagcctgcccctgagatccatcttctcccagccctgagacaaccccttgtgggcctccgtgtctgcccgactggccatatcacagtggtaatgagggcaggtaacgagggcccacagcgtcctgcgccatccacgtggtacagctggtctgcctccctgctgcctcggcaccccggaagccagggcgagcagcttgggtgtctgtgggtgtggggttcggttagagaagctcctaagttctcaggagttctgctggccactgtggcacctggggagtccgcaggacagcccagccctcagcacacagccccagccatttggggggatgctgtgagggtggaccttcccctcctttcccgcctgcccacccttcacctggccaggcctcctccccatgtgcgatgtcctcccagcagtcgcccctcctgctcctcggtcctcacgtccccaggctcccctgcacccctgacaccctctcccctccccctacctccgcagggaggaggtgagactccactccaggggaggggctcggacactggaccagattgaggactagctaaaacagggccgaggtgaaagcagctttcagtcagacctgcccaccagtgtgccatgtcagtttaccattgccatggcaacaccctggagttaccacccctttccgtggcaacgacccaatgactattaccccatccctagaaattcctgcacaaaccaccccttaatctgcatgccattaaaaatgggtaaaaacatgacggcagaactgtcctgagctgctgttccctgcctatggggaagccctgccctgcaggagcagtcacggagctgcgacaccaccagagctgggacaccaccagagctgcgagaccaccagagctgtgacaccaccagagccgggacaccaccagagccgggacaccaccagagccgggacaccaccagagctccgagaccaccagagctgccacaccaccagagctgtgacaccaccagagccgtgacaccaccagagccgggacaccaccagagccgggacaccaccagagccgcgagaccaccagagccgtgacaccaccagagccgggacaccaccagagctgggacaccaccagagctgcgagaccaccagagctgggacaccaccagagctgccacaccaccagagctgcgacagcaccagagccgggacaccagcagagccgggacaccaccagagccgcaacaccaccagagctgcgacaccagcagagccgcgacaccagcagagccgggacaccaccagagccgtgacaccagcagagccgggacaccaccagagctgcgagaccaccagggccgggacaccaccagggccgggacaccaccagagctgcgagaccaccagggccgggacaccaccagagccgggacaccaccagagctgcgagaccaccagggccgtgacaccaccagagccgggacaccaccagagctgggacaccaccagagctgcgagaccaccagagctgggacaccaccagagctgccacaccaccagagctgcgacaccagcagagccgcgacaccagcagagccgggacaccagcagagccgggacaccaccagagccgtgacaccagcagagccgggacaccaccagggccgggacaccagcagagccgggacaccaccagagccgtgacaccagcagagccgggacaccaccagggccgggacaccaccagagctgcgagaccaccagggccgggacaccaccagagccgggacaccaccagagctgggacaccaccagagctgcgagaccaccagagccgtgacaccaccagagccgtgacaccagcagagctgggacaccaccagagctgtgagaccaccagagccgggacaccaccagagccgggacaccaccagagctgcgagaccaccagagccgtgacaccagcagagccgggacaccaccagagccgggacaccaccagagccgggacaccaccagagctccgagaccaccagagctgccacaccaccagagctgtgacaccaccagagctgtgacaccaccagagccgggacaccaccagagccgggacaccaccagagctgcgagaccaccagagctgggacaccaccagagctgggacaccaccagagccgggacaccaccagagctccgagaccaccagagctgccacaccaccagagctgtgacaccaccagagccgggacaccaccagagccgggacaccaccagagccgggacaccaccagagctgtgacactgtggcttcagtaaagctgtttcttctaccactggcttgcccttgcattctttcctgggtgaagccaaaaacccagagggctaaactccactttcgggctcgcctgcctgcatcataaccatcaggcctggagagccgggtctcttgagagtaaactgccgtgagattctacaggaactctgcctctcctctgggctgagctgttctgcctcagtttcctcactaacaaaatggggtgacatcttgaggtggcccctctcggtgctgccagcctctctgctccccactctttttgggcagccctcaaggccctcgtacagcatctggggggcgggtcacactgcatacggcaggggtggggggggtcacagacagaggtgctaaatcgatgcaggacgtccgccccaaagacacgcttgtgctccctttggagagtcctgcatccttcgccctctgttcatctgtctgtttgggtcctggggatgagtctaggtggcggccatctccggatgtccccaggttgctctgtgtggggaagggtggggaggctgctgggaactggactctcctggagagaggcagggccagtgggctgtgggtgctggggcttggcacggtgctccccagcctggtggccccctctgcagtggatggagtcgggatcctgggggcagtgagtctgggaccccgtcttgggaagtcagccagccccaggagctgatttggccaacctggcctcaattgagcaccaagggggcctgagggagcaccgagggggcctcctgggagtttgtcacatgatggaggcctcgagccgtggcccggctctgtctgctcgcgccccctcacccacggctggctattgtggatggtgatgttcctgttacaactgagggatctccatagaaacccaacaaggtctaattagacacaagtaagtgcttcccaaatgcattttaattacagctctgctgaaatgaacgtcaaactgaggtttcagttgctgcgtgtgtgaaccgaattggcgccttctccttttccagccatcagtatgccttttgtgcgattttgtgttagcacccagcaggatggggtgtcagagcctcagagtccccagggagtgtccccgtcccagcccagaggggaagcggcactggggcccaggggcagtggtggggaccctgggatgcagagggaagaacctggggttccggggggcagggctgggggagggattgagggagtgcccggcattgctgctggcaccaggggggtgtctgtgcatgaggaggggctgagaagagtcagctggtccttgcagaagggggcccctgggaggggcccacccagacaggccaggtgccaagtagcatggggagtccttgtggcgtgggtcttggggggcgaggcctgggccacattgctgggtgggccttcagcagggaggagctcagggggtctcctgaggggatttccttcctcccttacaagagacctggggccagggtatgactggccacccaaattcgcacccagggtcccttcagcgcgggctgggcgggcagccgagagctgggctcaatctctccgtcacacctgcctctcagacgcgcatcatgggattctgatccccaccagaagctcagaatgtgacaaatgagcagaaagaagatcccggggtgttgaaggcagaatttattgtggagaaattgctctgcaactctactattgtaggctttagaaatagacttttcagtacataaatcccgtggctccagcctcacagataagcccggcccatccgtctggaagaattcacagatgacaaatggagggtggtggctggtgtgcatttgtgccgtaggcgggagctcaggacaggccgagagcccacagccccacctacggtctcaagccagctgggtcttccactcgctgcccagcagcacctgagcccatccagcgctctgctgcttctaaggaaatggacatctggggtcagcccaggcctcaccagggaggaggcagagcccagggaggaggaaggatgcaaagcaggaggaagaggccggatgcggtggctcacgcctgtaatcccagcactgtgggaggccgaggtgggtggatcacctgaggtcaggagttcaagagcagcctggccaacatggagaaaccctgtctctactatgtctctactaaaaatagaaaaattagccaggcgtggtggtggatgcctgtaatcccagctactctggaggctgaggcaggagaattgcttgaaccaggagacagagcagaggttgtggtgagccaagctcctgccactgcactccagcctgggccacaagagcaagactccatctcaaaaatcaaacaaacaaaacaaaacaaaatcataaaaacccaaggtgggaggaagagccggctggccggggtggccctggaggctgagccggagccgcactgctctcgcaggtgactagttctgtgatcgtgggcgggatattttgcttctctttgccctggtttcttcatctgtaaaggggctgcatctctccctgtccaagttcaacgttaggtagcgttctcctagaagtgcaccctgggaccaggattcaagggcaagcagttaatttggagggtgatttggggtcaccggcagatagaagggtgcaggatgtggaaggggccagcgatgatgggggcttagccagcaggtccctgggcaggcaatagcgcagcccctttgggggcctctgggagagaccgagaaacatggcggagtcgtcccacccgagggagggagtgagtgacatcctttatccctgccctcatgggctgggggctgcccctggagggcgagtgcctgaggcagggcaaggtcatcacagcacatgggaaaggcagggctgagagattagcatcggcaccacctgtgttggccactgaagctgctccacaccacggcggctggagagcgcaggtccatgcaccctggggtacctgagggcaggcctggcacacacagcccctggcacagcgggcgctcccccagccagccagacccagctgggacagatctaggccctcaggtttccaggcctcacctgtggccagacgtttagctcaggctcagggtggccctgggactgggctgagaagggaatggtgagaggtaggactggaggcccagagaggacccggggtggggacggcgcagctgtgtgcatgcagctgtgtgttgtgagaggtagggttggagaccgagagaggacccaggagtggggatggcacagctgcgtgttcagggcagcaaggtggctgcagggacgcggccccatccacaggcggccaaggggatgcttctcatgaagttccaaggtgggcaaaaggcatgaggctggaacccctcccagggaaccccctccagaggcccaggcaggtgaggagatggcaccccatgccggcacctaggctcccagggccaccccatcccgcccgcctggctctgctctgggccagctcgggttgggcacagaatgggaggccccggtgttctgagagattcgactctgtttctatgaatattgtcatcagcaccatgctgccaagggtaggcggagtccccagatggccccacagtctccatcatgaactcctgaagggatgctctgctctgtgggacaaggacatttgcagatgtggtaaagggagatggtctgggcggcccgacctcgtcacaccagcctgttgaagccagtgttttctctggctggtgggagagcagaagtcagagatttgaagcagaaggattccaggtaccattgctggctgcagttgtgtgtgtagggggatgcgacaggcagtccccagctgctgagcccctaatagccagtgagaaagcaggacctccccgatccccccgcagctcaagaaacggaactctaccaatcacctggaggatcctggatcaagtggagccccatggagcctccggtgagaactcaccgcagctgacacccgattctgggctacgcagagaacccggccgtgcgggaagtccggcctgcaggtggggagctcatccatgccctggtttaagacgctaagtgtatggcttaagacgctaagtgtatgacagttgtcacacagcacaggaaatgaatacatgtccccgatgtgtttttctggaaaacacgccttgcatttggcgtcctgtggccgctgcaaccagtgatcgcaaacgatgagcagggggcatcctctcaacgccccagggtccagaggtctgaaatccgtgtccctgggccacagccaaggtgcctgcaggcattgccccctctgggtgctgctgccgggacccttccctgcctctcccggcccgtggtggccccaggcgtccttggcgtgtggccccatccccccatctctgcctctgtcttctcacagcctcctcctctatgtgcatgaaacctccctctgcctcctttgcatacgatacacacagttgcgtttcgggttcaccaggatcacccaggctaatccagaataaccgccccatcccaggatccttagcattatgcaaaccctctttaccaaataaggccacactcacaggtcctaaggataagatctggtacctttgggattaccattcagcctcaaaaatgatggaattcctgctgggtgcagtggcttatgcctgtcatcccatcactttgggaggccaatgtgggtggaccacctaaggttagaagtttaagaccagcctggccaacatggtgaaatcccgtctctactaaaaacacaaaaattagctgggcgtgatagcgggtacctatagtcccagctactagggaggctgaggcaggagaatcacttgaacctgagaggcagaggttgcagtgagctgagattgtgccactgcactcctgcctgggcaacaaagtgacactccatctcaaaaaaaaaaaaaagaaaaaatggaattccttcaatgattttctttgcagaatagttaaatctcttctagttttctttttaaacattcacttcccgccacagccttcctcaagtatgattttcccagcatgctctgcagtgagtgattggtggacacgcccgcccattctgcaggagctagactttcgcctgtgaacctgaaccgctcaagaagacacccgtcaggttgtattcaggagcagctttttccaggaaagtttccattgctgtcagttttattttgtgttaattatttccaccataagagtcactgtgattgggatgaaggctgggcgtgtggttcttagttctggcacagagacatagatgctgcctgggtcagctgggtgagtagggaggtgagtgtgtagggaggtgagtgtgcagggaggtgagtgtgtaggaaggtcagtgtgtagggaggtgtgtgtgtagggaggtcagcatgtagggaggtgagtgtgtggggaggtgtgtgtagggagatgagtgtgtagggaggtgagtgtgtaggaaggtcagtgtgtagggaggtgagtgtgtaggaaggtcagcatgtagggaggtgattgtgtagggaggtgagtgtgtggggaggtgagtgtgtagggaggtgtgtagggaggtgagtgtgtagggaggtgtgtgtgtaggaggtgttttgggagttgtgtgtgtggggaggtgagtgtgtagggaggtgagtgtgtagggaggtgagtgtgtaggggaggttagtgtatagggaggtgagtgtgtaggggaggtgagtgtgtaggggaggtcagtgtatagggaggtcagtgtgtagggaagtgagtgtgtaggggggtgtgtggggagatgaatgtgtagggaggtgagtgtgtaggggaggttagtgtatagggaggtcagtgtgtagggaggtgagtgtgtagggaggtcagtgtgtagggaagtgtgtagggggtgagtgtgtggggagatgaatgtgtgggaggtgagtgtgtagggaggtgagtgtgtggggagatgaatgtgtggggaggtgagtgtagggaggtgagcgtgtagggggtgagtgtgtggggggatgaatgtgtggggaggtgagtgtgtagggaggcgagtgtgtagggaggtgagtgtgtagggaagtgtgtggggagatgaatgtgtggggaggtgagtgtgtagggaggtgagtgtgtagggaggtgagtgtgtgggaaggttaatgtggagcggaagttagtgggaattgctgtgttttatgcccctcacacctcatgcctgcctgctgtctgcctcttaacaccttcgaatgaactggaaagaatggctggcaaggcctgcaggacactgaccctaccggccacatgctccggtgcacagtggatggcgggtatggcagatggtgggcggtcctcttggtagcccctgctctcctacctcctcatgtggctccagcccctccccagcaagtcccccaacccctccgactgtgggtatcataggaaggggccgtgctgggctgaggatctgctgggtctgtaatgacttgggagagacactgacatcagctggcaggacccaagtccacaggccaggaggggtgagaggggggcatgggtcatccacagatgctgcaggccgtcacacaggcactggagcctcaggtcggggtggacacgaagggcttccgtggactcaagtcgctgccccttggggtgcctggggctcggagccctgccgtgagcacgcacactatgccccagtgaatttctgattgcaaaagacatcgggcatcgggcgggggcactcggctcccatctgcagccgccccttttgtcaggggcgatcagggaggggctgggctttccttcccccaggacttggaagaaagacggagctttagtcctttcagccacaaaatccccctcctcaacagatgtggaggagaggaaaatgctagtagccctggggagttggcaggggtggagaggacacgggggagcgggcctttcccaggtcacctcaccctggctggaggcagcttctcgctttagagcctccctcgtgtggggcagtcgtggcccacgagccaattcccccggctgccctctccccgcttaactactctctggctctggaggaccccgggaggtgcgggatgcccactggggacaactgtacatggaaggtgacagattccaccccaaggcctctcccagtctaggctgcccccatcacaacagcggccccagccgggcagtgtctgcatcccggcctcttcctaagccttttacaaacatcaactcttttgagcctcgttgagaaatagatactaatattatccccattttgtattagagaaacaggcacgggagactgaatagctcagtatcttgactaaatatctgaagcttctggaagctgggatttgagcaaagacttgaggctgcagagccgctccctgcctggcatgtgcggcaccggcacggtgaggtggccctggtccgggtggcactgcagcagcgtggtgaggtggccctggtccgggtggcactgcagcagcgtggtgaggtggccctggtccgggtggcactgcagcagcgtggtgaggtggccctggtccgggtggcactgcagcagcgtggtgaggtggccctggtccgggtggcactgcagcagcgtggtgaggtggccctggtccgggtggcactgcagcagcgtggtgaggtggccctggtccgggtggcactgcagcagcgtggtgaggtggccctggtccgggtggcactgcagcagcgtggtgaggtggccctggtccgggtggcactgcagcagcgtggtgaggtggccctggtccgggtggcactgcagcagtgtggtgaggtggccctggtccgggtggcactgcagcagtgtggtgaggtgattccggtccgggtggcactgcagcagtgtggtgaggtggccctggtccgggtggcactgcagcagcgtggtgaggtggccctggtccgggtggcactgcagcagtgtggtgaggtggccctggtccgggtggcactgcagcagtgtggtgaggtgattccggtccgggtggcactgcagcagtgtggtgaggtgattccggtccgggtggcactgcagcagtgtggcgaggtggccctggtccgggtggcactgtgctggcacagtgaggcagccctcgtccaggtggttgcaggctgcccgccccaaggtggacgagggaatgtgacaggagctgcccagggctcccagtgcccccaggctgtgtatacagtgacctcactggtctgaggcatcatccaggccggggttgcatattatttgcatattatttgcatctccgttggtttcttggggaagccaagtctgctgctggtctggtgcctgcacctcatgacaggttgggtctggaacccaggcctttggctccaagttctctgtgatctgccaggatgtgggtggcactgagcggtccctggggagggagtcaggaggcaggagcagaagccagaccaggtacagatgaggcagagacagtcccctctgtggggctggggtgagcagctgacagaggtgtctgctggcctgaactctcatcctccagactgggtgagggagtggagagtgctctcggggcccactgaggacgacagcctgaactcccagccctgggccccctgaagtgaagtggcggctggtatgctcccatgtcgggggctcttcccaagtagggagtggtcatgaaggggcccccctgggtcctgggggctgtggatggacagaccagagcccacatggtggcagcggtgatgattttgctcagccgttcctcctcaccttgggctctcttgggggattagcctcgtaaacaagcagttctcaccctctcagggctcagggcccttccctgtcgttcctgatttccgctcagccccggggaggcctgtctgggccagtggcaggtcccctggagcccgcgccttggagggcagtgcagaggcctggactgcgcctgtggggaggggagtgcagggaaccgcgccttcggctgagggttggaggccccgcgttgtcctgctggctgggggacctggggcacgtcctggctcctccctgggcctcagttttcacattttgttcaatgcagggctgggtggtgaagtcctggctgagggaatgtgacaggtgcctacccgggcccctcatctcccaggacttgggggactgaggagcaagcatcctccgtgtagacacgtgaggccaggagacacccgcaaggtcaggtctggaatatggaggtttctggatgaccaagcagctgcttcttaaaaactctacttttgaaagggactgctttgcatcagaatctctccagagtgaagggtggacccgctggtttctgaagccgctgcagacgtgggtttgcagattggcccaatctcagccccgctggtgagttggggctaacagggcctggtacaggctgcaaggctaatttaggatccaatgagatgagacgtgtagggtgcccagtgccacctgtgaggcattgctgttgggagagcagaatgttctggagccattaggctccaccaggcagggaggacacctcctggaagcctctgacctgcctcatgggtccagcctggtctttcacagctggaagcaggggctggctgtgccttttcactgaaaagggcggcatttttgttctttcttgaaaatataagcattactgttctttaaagtagatgtagaattcaggtcttcgagattttttacagagggattttcataatatacatgtgaccaccaattcttaaacatttactatgcaaactgttttaaagttaaaaaaaaaaaaaaaaagcaaatggttctgttaaaaaaaaaaaaaggtaccaaaaacccgtaagcagcaaagctggaattcgggcccaggtgtgtgggacactgcctctctgtctgctccggtccttccatgagtccctgctgagctggcaccaagagtcccttcccagccccccaaccccccaggcccccagcccctcactgtcctctggcctctcattatctcagttccgcacatggaaaatcaataaatagtttgcatagtgttctcccctcctgccttttatcaatatttaatgacaggctgcgggatgcttttggtgtgcatccttctggggcccctcctaatgggatagcgacagaggtctctgcaggtgcccgggctcacagatcgcctcctggatgaggcccgggtggccgcgattggctgcgcgggcagcaggcttggagtcgggggaactcggtgatgaattttaacaacctgggaagactctggcaccggccgctgtgcaattagcggcctgcggatgtcagggtgggttccagatgggaggcgcgggggagggggctcctctttgccagcttggctgggagggtgcacgtggggtaggctggagtcagacatggtgcggggcggggggctcttcccagccgtgtgtcctctctcacagactcagagggaggtggtatttaatttggctcagcagctgcccagaaaccctgaccccttcagggctgcacatcctatgtgaagcggggtccacccggccccctcccccaatgacgtagaagctgatcatcccctttcagagttcaagcctctctgagagaagctgaccctgatccgcatccattagggcggtggctttgggctgaagtccacattggctggtaacagggtcagtaaataaggcggctcggtgacagttccggaggtacagatgaatacataacgtcagcttcctgcctgtccccataaccaggaggggtggcaaggctagccgtgtgtggggggctcactcaatgctgctgtgagtctctgggtctggattccacatctatacgtatttcgcccccgccccgcaggaggcccagcctgcggcggtggctgcttccccgagacttgagcacgagtgtgtgtggggccaacactggccaggaaggaggtggctactgaactgatgacagctggtccctctgatatacggaggctctgggcttggggattattccgcctgtggatttatcgcccttccggaaggcagcccaatgggcctgtgggcttggcctcaaggaatgtttggctttggggtgagagggcttggagggggatgggcttgctcctttgggggccaggctcattccctcggaagcaggacagccccgaggcctccccagggtcctcttctgggacaagctccctttgtctttgaggacatgggaagaccccgagagggagctgtcgtgggccgccgacaaaagcccactttacactcaccagcttggcgggagctctgcgtgtggtccaaagccgtgtcccctctgtggcgggcggcatggcgggggcagctggggcccctctatcctcccgcggctgcacgtgcttccctgcgaaaagcagggtgaagcgacgtctcggggccaggaccctgctctgtagcggggcggggggtcctccagagggagaggaggaaggaaagggcgttgggctgaggggattggaatctggggtcacagggctctgccagggctcctttgccagccacctgccccggctgggaactcagccaccctgtgtctctgttcccatctgtatctggggactgcagaaactgcctcctaggaagtcaggaacatggggcacactgggggccctttgagttcccctctgccctgctggctctcggcccatcctgactctccccaccggagctcctggagccgaccctgcatgggccccacccaactctctcaggctcggacctgctggtgactctccacgctcaggacccactgtctccgcaggccatctgtgtaccctgcatccgcacaggtgccctccccaggtccccagaactcctgcctctcaggccgggctgccccagggaagggagcacagccaggaacccggtctgcaaatgaaacgctggtcagagcctccccaccaggccacgtggtgggtggcatgcaggctccctgggctcttaggcacccccggtggcattgacagctggggagagaggtggtctcaaggactatggagtccttcctgaaagtctctgctcctacgcagcggaaacgagtgagactgggagtcagcccatggcgaggagctggggtgggggaacatggggacccgagacccaggcaaaggccaccagtgctccccaggcgtgtagcctgagcctttggcccccagaagggggtgcggtgggggcaccccctgggcaaacctgcagcatagaacagcacagagggccggggcccgggtaggtggatgtggagaggtgttccggagggtctcggatgctatgaagagatgagaggtgttcagacgccatgaagaggggggatgccgccctgtgggtggagggtggtctggaaggccccaggctgaggggcagccctggtgggtgtgggctggggaagcctccgggcagtggctggcctggtgcccttgagctgctctacccctcatggtaccaggacccttggcgcccagatgtgctgggagcctgcaccctgcggaggggggccaggcccctcctccccgctttgtcctctgcagccaccttgggccgccaccctctgacctgctggggggttgtctctgtgcgtcatctgggtggcctgagcccggctctgatgacttcacatggagccacctgccaacagagacgctggcaaagcagctgctctgggacctgacagaaaagataaaaatgatggaatgtttgttctctgacatggaaaaccaggctcccacatttagggcaattggagaaagatcttcctgctcacctcggagcacaggtgaaagacctgctctcttgcacacctgctgctccctgggccaggcacagccgcctcccgtcttctgatggtgctgtggctgtggcctggctctgcctgcatggagcgttgtgccagttagggggtctctatggtgtcagggagcttcgggctcccctgggctctgtgcacaggcctcttggtggggctggcaggacaaaaggagaggaagaaatcgaagttagtctcaaactgctagaccacagatcccatgggcgggtcattcaatgtggtgggggacagtaggtggtgtgaccaaggccatcacacaggggcacctgagggtgggaacatgcggccagcctgtccctcaggcctgcctggggtcctcaacccagcatgggtcagggagtgctggcctgcagcccaagagacggggactccactcctggccttctgcgtctttgcttggaaggctcttatggctttgtggcccatccccaagtgccagctccttgggtacagcctcctgtgtcagggtcagtgcggggtcatggcacagggctgccctgaagggtgcagaggagaccaaagccacaagctaggtctcttgagggcagctgcctctcggacccttcaaaatgggttgggccctgaccctggtctcggaccaaccctgcccctccctgctgaggtatagatggagctgtcagggacttggaggccagcgtcttctcccccactccccactgttggaggcccccagcagactccctcagttttcttgctaaggcctctgccacgcggggtggtggctgtgcaccctacggcacgtgccctgtacaagcccctctgggcccctgctgtggccttcaccgttggccaagttcccgctctgggtcactctgctgatggctgagggggcagggtgtgagggcgtggtccactcccagactcctactctccccaaagcccctccccgaccctgccctcccgcctctgcaggcagcctgccgcccccgcccccaccccagctgcctcctcctttctctgacaacctcctgcctggggtgtcctggaactgcgccagggggaccaggtgaccttggacacggcgtagctgcctgggccaccccctttccttggtaatttgcgcagactccggagggagcatgagcagctgagtgctgggggaggggctttcctcttcctgtctgtcatgtccagcctgtgaagagcacgctggctgagctggcgagaggggtgggggcgtcctggggctgcttctgctctgatgaaggcacccactgtcactgtcccggccctcgctgagtgttcccggacccgtgggcccgcgtctgtgccaggccttggggagctccagcctcggagcctcttcccgttctcagacctcagtgcgaggaggaaatcgggtgagttgaggttaatgtttccattaaacctggatggattttccctgcgtggaaggagctgttacgcgccagggctctgagcagcatggacggggccccagcgcagccacgctcccgaacgaatgccctcctgggagggcccggctgcctgcctgccccctgtgcctctgccgccaggcctcgccctccctcctctcctctcttgtgaataaagggcctcaaccccacctacccggtgtgctgagggtcctgctatacttaaactgtagttaaagcaaaaacaaacaaacaaaaacaaaaaaaacatgcaaaacccctgtggcaacagcttgtcccgtggatatcatctccactaatccatgtctcctgctcggggtcctgcggtttccaggcctgtatctgcgggtacttattttccatttcctcccgagagtttagcctgctaatgagattttggtgtctggtatcttggcacatgtctccaaagagatttatggggcttccctctcctggcccctcacttgtccttggcaggaagctcaaggggttcgatgtaatctgctccagggccctggggagggggcagaatgtgctggaaggcagatctgggtggggtctgcggccagaagctggatgtctgctctggaggagccaggctggtggcgtgtagtctgtggtggccctgggataaccagagaggggtgtgggtggggggtcccctagaccaccggccacctcggagccagtctacagacttggtgtctccgccagcgccagtgatctgagccgagcgccccctgctggtgtttgggcttcccagtcccacttcacagtgggggctcccggctcagacccacccatccatgccacagcactcagcctctgctcaggggctggatctggccgggaccttgggtgctcgggggccccatgctctccagggacagggaccttcggctccacctgctgcctcaggtggtctcatccatgtggcttcagcccattttccaggcaggggacagagcagcagtgaccacagggctgtacagacacctggggcagaaggagctgtgggcccctgcctggtccagaggtttccaggccgcaagcctgtccctggctgctgaacgccggctgggctcggcctgggtggaggagaggccacaaggcttgggtcagggagggcctgaccttgctgtgaccttgggcacgtctccctactctcaacagagtggggctaagagcagtgctgtcgttggtgggatggagggaagatgcctcccagggggcgttgctgacccatggtgggtagatgcccaccatcaccccagctgcatttcctcctgggatctggagactgctcagagtgaaggtgggtgtgactccccggggctgctcggagtgaaggtgggtgtggctccctggggctgctctgagtgaaggcaggtgtggctccctggggctgctctgagtgaaggcaggtgtggctccctggggcagctcagagtgaaggcggttgtgactccccggggctgctcggagtgaaggcggttgtgactcccgggggcagctcagagtgaaggtgggtgtggctccctggggctgctctgagtgaaagcaggtgtggctccctggggctgctcggagtgaaggcaggtgtggctccccggggctgctctgagtgaaggcaggtgtgactccccggggctgctctgagtgaaggcaggtgtggctccctggggctgctctgagtgaaggcaggtgtggctccctggggcagctcagagtgaaggcggttgtgactccccggggctgctcggagtgaaggcggttgtgactcccgggggcagctcagagtgaaggcgggtgtggctccctggggctgctctgagtgaaagcaggtgtggctccctggggctgctcggagtgaaggcaggtgtggctccccggggctgctcggagtgaaggcaggtgtgactccccggggcagctcagagtgaaggcaggtgtggctccctggggctgctctgagtgaaggcaggtgtggctcccgcgggctgctcagagtgaaggtgggtgtggctcccaggggcagctcagagtgaaggcaggtgtggctcccgagggctgctcagagtgaaggcgggtgtggctcccgcgggctgctcagagtgaaggtgggtgtggctcccaggggcagctcagagtgaaggcaggtgtggctcccgcgggctgcttagagtgaaggcaggtgtggctccctggggctgctctgagtgaaggcaggtgtggctcccggggctgctctgagtgaaggtgggtgtgacttgcttcagatctcattgacgtggatcttgggcaagtggttttcactctctggagccagttttcttacctgggaattgggttaaatcccggtggccttgggctgtggtggaagttagacaggacagccacatgccacacacctgacagcctgacagatgtgtcactgatggtcactggtgggttatgtggggctactcctctgcctctgactctaggatcccattagttgtttaccaaagtagcatgtccaccagggtccttctgggtatacggcttgcttccaactctctcactgatattttaggtccgctaacacttggagaaatcttttggtgtgaattattctcagcagctgcagggcaccctggttcactttcccgtttctcaagctccaatggtgcccgacactgtttcctggggaggaagctgatgtgcctttaggtggacgcctgtgtgaggctagcccgggccgagctggagctaccagccttctgcgggcatgcatgcctggcctgcctcagcaaacacacgataaatccatttccccaggccgcctgctcccacttcccagatagccgggctcatactcacatttatgtttcattttgtctggctaatattgtcttagataaattagggggagcagattagtgtttgatttagtggtaggaactccgatgagcctaacgtttcgttttagtggtgccggggatgggatgagggtccctggttcctcatagcccttgtggtggtggctcctgaaccaggaggggtcatttgcatgggcccaggctctcagtgcagacccagcaggtctctctggccgctgggacagtggtcagatgaggtggcccctgtggggcctgggggcacagaggtgccacagtgagccagcctggccccttgctagcaataggcttgtgctagaagaaagacagaactgacctgcaggtgtcagcagctgagcctccttgtcctccctcctctgcacgctttcctgtgcctgtgttattaagggggccaggccaggaagtgctaaattagttatgagatgcagggctccagggattcaatggggttgtgtcctcgcttcctgtgcatttcctgtgtgctgggcatggcccagagagactcacagacagaggcctgccctggagactcccaggctgcagtggccagagaaggatcccaggggtcttatgcttgtgcaactttggggggtcttctttaagaaagaaaatttaaaagtagaaatatctaattggttctaggccttgcaagaacccgtgtcagtgggggctttgcggctgagctttcattaggggctgaatgaattgccccatgtagggccgtcagcctgatgagaccatcactgtctccagggatggggactcacaggttaacagtgacagaaactctcacagtagctggggctgaaggatttgctggatgagacctgggcatcctgtggaatctaaggatggttgaatccccaggatgggaggcagctgggatttaggggccaccagggccaaggcccagaggtctccttcccaggtcaggcctcagctctctcactggtttgttccacgtgtggcaaatgtgtggctggaggctccccaattttgcaccttacacctctggccaccagagataaattgacttttgtttcctagttcaagttccagtaaccctggaaaagtgctctgattggcccagcctgaatcaggtggctcccttaggatcactcagctggggccagggcagtggggtcacagtgcactaacctagcaggtttgcaatagctgtggggtggagaacaggaagtagttcctggaaaggggtaagtcatactgatctcctttctgactaagccaaggctactgtgggggctcagaggaaggtgtgacttaactctgctttgagaacaatggacagtttcgtagaggttgggccatttgggctgagtcttgcagtatcaataggaattcactaggcagagctggagactaaggtgactctagggggaggcatggagaggtagaattgcttgggaagagtaacttgttcaaggtgattggagcgtagactttggtggtggcaggagggtggagtgaatgggcaggaagctgggtacgaggtggaaaggccttggacttgactctagaaatactaggaagccaccagagggcttgagcagaggtgacgtgaccagatccttcctgtgttcctgtgaggatgggtagacagggccccctgggagctcacagaggtggagtactttgcccaaggtggcgagaggggacgcccgcagcctgggtcccagtgcagcccttgttcccatgggtccagattcctgagcctcacccacccctccctcaccactgccacctggccagtagccacaggtggcttccagagcactctcttaccgtcccccagggttttctgggtactgaccttctctctctcacttgggatacccacccctatcagggaaatcaggggaggcactattgtctcctttacagaggagtaaactgaggctgggttaacattacttgttcaagtcactcagctaagacgggcagtgctgggatttgaacccagctctgcctggcttctgagcctgagctgacttcagtgcccggcccccagatctgcacaccagtgtgccccaactgcctggtgagtggccaggccagagggaagcagggagcagggtgggcccaaggcgaggctcagcgagaaggcaggagcagtagccgtggggcagcacttggggtatgtgggccatggggaaatgggcaccaggggtagagcccctttggggggctgtggagggggagcagcggggagtgcaaggggatgtgacacaagccccttctgagggaggacttggtggccggttgctcttgagtggtgcctgcctcaaggcctgggctgtgtcctgccctcctgctgccccggccacctctgacagaccctgctaactgtggtcagcctggcagggctggcatggcagagcaggcctgtggtgccaccctgacctggccactgtggtccttatcctgggtcaggagccgtccccgccccaggcccatgttttccatctgccggggaccctgcccaggaggggcacatgtaatgctagcctcgttgtgcagggcggctcctggctgaggccttgactgaacttgcatctacatttagactgaaatgcaccgagaggctgggcctgctgtgtcccaggggctgcggacggggtgtccatcctgcctgggtaggatgcatctgcagggtgcctcccaccacacgctaaagtggggtcatcacccctgggtggcctgggtcaccaagatgctaccccacccagcctgatgggatgcctgagctccaagcctgccccctcacaggggagatgatggccccacgaaggcccccctgggtgcttgtggtggccgctcactcagtctctctctctccaaagcggcctgcccgtccgcgaagtcacttagctgggatctaatcgggtttcacaggggcataaattacttggctagaggttgttcccgggtgtttccaccccgggcctgttatttacacaccgtgcggtaatgtagtcacggccttgggtgcgcagtatttatggtgtttgatcggcttccagcccaggccgcctgtccaggaacatttgttgagatgttgtgcagagccgctggggacctctgccacaggcgggcatcaatctacctggagctcctgcggcagccctgcagagcctcaaaagggcagggcgggcctgtggtgccaccctgagctggtcactgtctgcagatggcagctctaggagtgatggctgaggacgaacaagggtgcgaactgtcactgacatttccgtggggcgtggacgtgacacatcccgaatgccatacctggctgtggacagtcgcaccgttaaaggcagcagcgctaactgccgttcacggagcacccactgtctgctaagctcagtggaagatcctttgttttattctctccgtgagtgcttgtcgcagccctgcaaggtaggtgtccctgatgggaaactgaggctcagtcactgcaggtgacttcccaaaggaacacagcctgggagctccatgtggcagcttcctctggctcttacaaggggaaggatgagctcccgttggttgctggggtcccgcccctttgccttcatgtctgtgatggtggaaatgcttcataaggagtgtaaagtggtttttgttcccgacccagagagatctggtcacggtaattctgtatctgcttgcctatatttatcccccaagtccggctggtgacagggaagcagatgatcagtgccaggcctgataaattggacccagggctgaggcgggagagaaaccctgttttattgttgaagacaaagccgtcgggcaggaggcatatgttgtgttggagccctcgctgcgacggaggccctgggcctcagagcaatcagggctttcacgagcaccccccacccactacctacgtgggaggcaaggacccccattagcccggctggctgtgggggaggggctgacagaatgtcagtggggtggaggggagaggaggtgatcaatgaggacttattgacttgcatctttccccacgacttgattaagaccactatggagatgaggcctgaggagggggctagggccagagccccgggccagtgtggcttaggggatcttttatgtttggagggcaggaagggaacagagagctgccggctttgtcagatgcctgaagagtattgatccatattagaaatgataatgagccaattctgctgggctgggaggccttaaccatttcattgcttacaaggctgtcctggtggggatgttggaggaggctcagcctctagctgctcctcaccatgtttctcctcgctcaggtctgcagcttcccaggccacgacctgagtccactgatggtcctggaggtctggccagaggggcaagggcagcaaaggagaggagcacaggactgggagctggagcctggttctgggattggctagaccctgcggggtttgccaagcacctggtgggtgcctgacattctgtgcatctcctcgggcacctctaaggtggtcaggatgacccttactgctataatgacagatgagatgaaggcatggaggctcatagttgccaagaggccaggcctctgcctgcccctccagcactctgggacgtgatgctgcccctcagacctgccacttgctgatggagctttgacttttgttgagtcatttaccccatctgggacccactttcctcatctgtaaaatgacaaccacagcaggcttgctgagataattcagagaacaatgacaagggctcatacagtccagccctgcaccagcacttggtggtggggcctggcctgagcctaaagcttgactctagctctgtgtccactttagtgaacatttaaagttgaggagtctgagtttgctcctccatggagggaggacatgccattcatctttctaaatggttgtgagaatcaaatgagtctatgcatggggagtacctaacatgtagttggtggttaacagaagatggctgtcatcattgtcattgtcaccatcaccataatcatcatatcaccatcacaacaccctcaccaccatcatcattaccatcatgatcatcactgtcacatcatcaccatcattaccatcatcattaccatcaccataacactccatcaacatcaccaccatcatcaccatcgccattacactccatcatcaacatcaccaccatcaccatcaccaccaccatcatcaccatcaccattacactccatcaacatcatcaacaccatcatcatcaccatgaccatcaccccatcatcatcatcaccatcatcaccgtcaccgtcatcatcaccatcaccattacactccgtcatcaccaccaccatcatcatcaccatcaccattacactccatcatcaccaccatcattaccatcaccatcatcaccatcatcatcataatcaatattatcaccatcacatcactctcaccaccatcatcaccattaccatcatcaccaccatcaccatcatcatcactattgcatcatcgtcaccaccaccatccttaccattacacaccaccatgagcatatcaccaccatcattaccatcatcttcatcaccattatcatcaccatcacatcatcatcattatagctataccatcactgtcatcagcattactatcacatcatcatcaccatcattgccatcatcatcaccatcatcattgccatcattatcatcaccatcatcaccatcactatcatatcaccatcattataatcactatcactgtcatcatcatcgttatcaccatcacatcattaccatcacatcaccatcatcaccatcatcatcatggtcattgtcatcattattatcatccctgtcattgtcatcatctcttcattatcatcaacttggcagagattgtggttttgttcccatcccagagagatctgaagatgctaattccatccttgcctctatttatcccccaagtccggcctgcaagggaggctgctaatctggctgctgagtatgccagatccatgggatccagggatcaagtggctcaaccccctgggatccatgcactggcatttgtctgtggagtccagtggtaggtcttcccactaccaggacaccaggctgggtaggcaggcagcatggggaaagcttgagggtcaaggctgtgaagctgtggtgactgatgtggggtctgctgatggggagggggtgcttgtgcaggtggtatggggcttactctactgctgctccccaggagtaggaggaggggctccagcttaggatgacatatttggctgctttctacacaaagaagatgcctttgttcaagctcaggctggtgctggagagagcatcatcctgacctgggcacagctagggaacatctcttctggggtatcatcttatgaaccattagaggctttggcttgggcagaactgggttttagttccatcctgaccctgacttgctgatatggtttggctgtgtccccacccaagtctcatcttgaattgtagttcccataatccccacacgggaggtaattgaatcataggggtgatgattttataagggtcttccccccttttcttggctctcattatctctcctgctgccctatgaagaggtgccttttgccataattataagtttcctgagggctccccagccctgcagaactgtgagtccattaaacctctttcttttataagttacccagtcttgggcagttctttatagcagtatgagaatggactaatacaataaatttgtagcaagagtggggtgctgctataaagatatccaaaaatgtggtaacaggcagaactgggtaacaggcagaggttggaacagtttggaggtctcagaagaagacaggaagatgtgggaaagtttagaacttcctagagacttgttgaatggctttgaccaagttgctaatagtgatatggacaataaagtccagatgatggtctcagatggagacgagaaacttgttggtaactggagtaaaagtcactcttgctatgttttagcaaagaaactggaagctttttgctcctgccctagagatctgtggaactttgaacttgagagagatgatttagggtatctgacagaagaaatttctaagcaacaaagcattcgagaggtgacagagcataaaagtttggaaaatttgcagcctgatgatgcagcagaaaagaaaaacccatgttctggggagaaattcaagctgcagaaatttacataagtaatgaggagccaaatgttaatcacaaagacaatggggaaaatgtctccaggtcatgtcagaagtcttcacagcagcccctcccatcacaggcctggaggctttggaggaaaaaatggtctttttggccaggtgcagggccttgctgcttcatgtagttttgggacttgatgccctgcattccagccatggctaaaaggggacaacatacagctcaggctgttgcttcagagggtgcaagctccaagccttggcagcttccgtgtggtgttgagcctgcaggtgcacaaaagtcaataattgaggtttgggaacctctgcctagatttcagaggatgtatggaaatgcctgaatgtccagacataagtctgttgcaggggtggagcccttgcagagaacctctgctagggcagtgtggaagggaaatgtggggttggagccctcacacagagtccccactggggcactgcccagtggagctgtgagaagaggaccactgtcctccagaccccagaatggtagatccaccaacagctcagcttgcactgtgcctggaaaagctgcacagcccatgaaagcagccagtatgggggctgtaccctgcaaagcagcagaggtggagctgctcaaggctgtgggagcccacttcttgcatcagcgtgacctggatgtgagacgtagagtcaaaggagactgttttggaactttaagatttaatgactgccctattggatttcagacttcatggggcctgtagtcccttccttttggccaatttctcccatttggaatgggtgtatttacccaatgcctgtagccccattgtatttaggaagtaactaacttgcttttcattttacaggctaacaggtagaagggacttgccttgtctcagatgagactttggacttggacttttgggttaatgctggaatgagctaagactttgggggactgttgagaaggcatgattgctttttaaatgtgaggacatgagttttggaaggggccagggcagaatgatatggtttggctgtgtccccacccaaatctcaccttgaattatatttcccataatccccacatgttgtgagaaggacctggtgggaggtaattgaatcatgggggtgatggttttataaggggattttcccccctttgctcagcattcattctctctccttccaccctgtgaagaggtgccttccaccatgattgtaaatttcctgaggcctccccagccctgtggaactgcaagtcaattaaacctctataaattacccagtcttgggtatttcttaatagcaacgtgagagtggactaatacacttgccctcactccacatcttgccattcagcaagtccctaggatgtcgacacagcactgcaccttctctgttgcagggcctgccctcccttcctgcctgcctgcctgcctgcctgcctgcctgcctgccttccttccttccttccttccttccttccttccttccttccttccttccttccttccttccttccttctttcctctttctgtgttaggtttgcagctcctgttagcccttaagtggagacattgaatggaaggtggatttctcaagtctgaagctcagggagaggcccttgctagaggtgtgtacttttagagtcctcagtatgcagctgaagtttgagccacagtcttggtgagacctcaagggaggatgtagacagacaggcgaggaagccaagtctaggagctggaaggagatgagagggcaacaaaaggcctcagaaagagtggctgctgaggtgggggtgagccaggtgagtgtgggggacacctgcaggaggtggtgctgcaaggagaagagaccacccacgtcacaggctacccatgtcacaggctgtgagagatcaggagggtggggcctaagactgctggctggcttggtggccctcactgatgtgagccactggggtcttggtgaccagtggggtggggcagggaggaaacaggctggtgacagtggctgaaggacatgggaggagtagctgggactgcgatgatggaccattctttccagaagaagagcaaagaaatgcgggtagtagctgaagagagatgtgggtgaggaagaatagcataaagaaacaactggacatcaatagtgggaacaagtagagggggagaaactgaagtgcaggagagggaggctaattgctggaggaataagtgggttttcccttctcttgtttcttctcaaaatgttcttttcactcttggttttcagtcttttgactataatgagctcagttgtgtgtgtgtgtgtgtgtgtgtgtgtgtgtgtttatatattcattctttttggggtttgctgatattctaggatctgtaactgacattttcttcaatactttgaaaaatacttggccatcatatctctgaatatttttttctgctcttttacattctcttttcttttttgattccgctaacacatatcccaggccatctgagaccactgaggcactgttctgaagtgtaggttttgtaattattcagatacaacaagggcaatagaccaggggatgaccgccattgaaatggtttgttactcacagctcccaagaggaggggtcatgccacaccatgcagggccacacagggcagcaccaggagtggccaagggggaagaaggagtgacggaaaagcacgggaaggtccggccaggcaagcaggctgacgattggctcatttcagtcattttggtgggctctggggtacaggtgctgtctctagtggtctggtacctgccctggggtaatcagggtgggacttgtggccaccctgctgagtgtgaaagcccatagaggaggtggcatgggtgcaggttctggattagctggtttgcgtatggaagttgtgccccagtgtttacactctctaggaactgactaggcctgggaggtggcggagagcagtttctccagggtcagcagggtcctgggtgtcaaaaagatatgtttaacacacttatttttcatgttctagaaatcttcaatctctttgttcttcagatgacatagaaatttctgtctttaagcttgctgactctcctatctccaatctgttgttaaacctatccagtgttttaaaaaaaattcagctattatatttttcagctctggaattaccctttaaacctgggacgtatttataattgctgacataaagcaatttttctgtttctttgtttggctagtcattttttattgtaaattagacattgtaaatggtaccttgtggaaactctggattctgttatcttcctctgagaagtgctgatttttgtcccagtagcctgtgcagatctcgattttatgctttgttgaaacaggtcctggaggcccatggcgtttacccagcctctaccttggtgacgcaaagtccccacactctgtctcccctgtggacctgggggctcagtgttggcgttttgaggatgtgtctggagcagggctctgagcatggttgtgtctcagctgcctgctccacctgccaagctcgcctcctgacttgggttggtcctgagccccaccaccttccagtgctgctaactgctacgctctctgtcctgcctttgccctggagaagggcacttggtcctgccctctgaatgcaaggccccaccagggaccgtgaaccctacactcccctccggaccctctctctggaatcctgccccccacagtcctgtcccctcagtgcctgagctctggtttctgcctcctgggctcagcttgctgccacaccctgcctgggctccactcctgcatgagtggtggggaaattgtcctgggtggagggctgggccaacgtggcgctcatctcacaggctttccttttctccaggatcacagtcacatgctgcctgcaccaacacccgaagaccatcacctagtatattcccccagcgctggggttgcttatggtgggaggaaatgcacgggcggcagagggcaagggcgtggtcattctgatagaccacgggtgccgaggtgggcacaggaggaagggcgggcaggagaggaagtgtaaagtgtcactggctcaatgaggacacgcggtcctggtcgggaggaaggctgggggctggaagttgcggagggtgggagtgcggagcatggcagggcagcggccgtggagcggatgctggaggtgggtttgtgggtgatgacagcccaggctgcagcctcaggaggagaggacggtcactgggtcagggggcagatggactggccgtcccatgatgctcagaggctgtgagtacgttggctggctggggttgccatagccagtaccacagaccggtggggcaaaagcagaaatgaactttctcacgatgttggaggccggaactctgaggccctggaattgcagggctggtttcctctctggccccgtcctgggcttacagatgccacctcctccctgttcctccgggtggtgtgcctatgtcctaatctactatcaggacacccctcggatgcaaacagggccaccctcatgacctccctttaatggaatcagctctttaaagagcctatccccaaatacagtcccattctgaggtcctggagtttagggctctgatatctgaattttgggaggtggataccatcctgtccctcccagcgagtggcccaaagctgaagccattgatgagtgactgacaagcagcagccatggcggagggaccaatcctgagctggagttggggctgtgggggcctgaaggactgtaggggttctggggagagccagatgtcagctgtagcgagaagagaaagactgccagacgtgcggctgaggaggagccaggctacgcctgccctcaggcccccgagagtgtggaggcccctggccatgcaccggaggagcctctgatggatgcttcataagagtggtgcccacactgcagccacctccgctgccagggacccctccggtgaacacgttggctcctcctcagggaaggggcaagtttcgtggcttgaccggagggccctaggtgagcagtgccgcgttgtctttggaggaggtttctcctttggcctcggtttgtcctctgtgtcatgggggtgattgtccctgaactttctggctgctcagggctggatttaggctctggggaggccatgggggtgtttcttgaagaccgaagccatgctcgaggctgtgactcctgcgagacagggcctgaggggaagccccggggtgagtgggtctgtttgaggctggctgggtgtatgggccactgtctcaatccctttggctcaagctggtgatcatgaagtgacctcccatgcctaacttattttggatgggtctgaaggccacagcacaagcatcagggtgctggaggcactgccaggaggggtgggagaacaaggctgccctgggagtcctggagaggggccccaaacatgggtggaggtggcctctgggctggccctgaaggctgcaggggtgggggtgtagttggcctatgccctgtgggggagggagctggtgagtcctgggccagggcagggcagggggcagagctatgagaaaggacggcagaaggggtgtgaagagaaagtgaggggctcaggtgccaaggccttggaggtggtggggctgggggcaggcgctgcagttctcagcatgagacggggggcagcaaggaccccacctgcgctggcaggccctgctgcccctctagccaggaggagaatgctttttcatagggggaggaaggagaaaaatgacttcgggctcctggcaacttcagcaatcagctccttgtcaagcaaataaaatgcttttgaatgtccagattaatgattgatcagcacaacgcgagcctgttggaagcttccagttggcccacgtgggggtccccgctgcaggcgctggtaaagtgacaccccgttagtcacttctctgcgtgtgcttgggagaagcccacacacacatgctggtgcctgacgtggggttatttctgtgctgaggaggcaggaaacggcagaggaggcagcttccagggcagggagcactggggcggcctggcccaggagggtgcttcatggccatgggacaaggcccacaccaggccctggtgacgctgggcgagagcctctgtgtgggcgaggaggctggggctggccggtccactcgcccagaaatgccagaggtgcccaatgccatgcggcctgggggatgcttggacccggagtgatgacagtggctggtcatttgcaccttgaattaagcagaataaatcaaataagagaacaaagccgattcttgttttgatgcttattttatttttgaatgcaacacccatatagaaaaggacatgcatcataaatgtacaacaggatgtgtaacttcagagcccgcatctgtgtgactgccatccagatcacccggtagagttccccagcctcattcccctccccctgcacccttccagcagagcccctgcacctgcggtcactcttgcctcctccttatatgggcaacacttctgtcctagcaaccctaaacaagctggtgtggctttccccgtcggggccagggtgggggtttatgtaaatagaataaagctaggtgattgctttgttccttgtttctttcacctgctgttttgtctgatgtgcagccaaccttgataacattgcatcttcctgtataggggtgtgaaataatctcagtgtgttgagttcttggtttctctagctatagtccgttggcttccatggctccaccatgttccatcatgcgaacatacaacaggcttctcatccattctgctgttgatgaacacttgggtggtatctgaattggctgagtggcccatgctactgtgaacactctcgcccatgtgcccacttgtcctagggtccctccccaggagtggaattgccaggtcatgagatgtgcgcctcttcaacccttttagataatgccaatctgttattgtttctaattaatagactatttttttagtctggacgcggtggctcacgcctgtaatctcagcactttgagacaccaagctgggcagatcacctggggtcaggagttcaagaccagcctggccaacatggcgaaacccaatctctactaaaaacaaaacaaaaattagctgggcatagtggcacatgcctgtaatcccagctacttgggaggctgaggcaggagaatagcttgaacctgggaggtggaggttgcagtgagccaagattgcgccactgcactccagcctgggtgacagagtgagactccatctcaaaaaaaaaaaaaaaaaaaaaagaaaagaaaaaaagactattttttgagcagttataggtttacaaaaaaaaaaaaaattcttccttgagggtatccgggcagctctaggctctttatgctactattcacattatacagtcagtttgttaagcttcccatagacacagaaccaagtgctgttggggttttgggtggaatattattgaaccaaagcaattcaggaagaactggcatcttcacaggttgtatcttccaatacaggagcatgttttatcttgttatttggtgttccttatttctgtcaatacaatttttagtctcagataaatttgttagatatattcctagatgcccaatattctttgatgcttttaaattacatttttttacttgtttgttgatgtagaaatacaatttgaatttgtttttcctgtttttgtttgtttgtttggttggttttgtctcctgttgcattttggacactgtctttagattggttttctagtttattcatctttctttagctgtataaaatctgctgttaaaacttatgcattggccgggcatggtggctcacacctgtaatcccagcactttgggaggctgaggcgggcggatcatgaggtcaggagatcaagaccatcctggccaacacggtgaaaccccgtctctactaaaaaaaaaaaaaaaaaaaaaaaaaaaaaaaaattagccgggcgtggtggcgggtgcctgtagtcccagctactcgggaggctgaggcaggagaatggcgcgaacccgggaggcggagcttgcagtgagctgagatcgcgccactgcactccagcttgggcgacagagccagactctgtctcaaacaacaacaacaacaaaaaaaaaaacaacttaggcattgagttctaatttttggttaattttcagttttaaatatttttatttggttcttttccaaatcttctctgacatgttttatagttttcagtctcctgtgatatgtttgaatttttgaatcttttaaacttagcaagcatcgttatttgatgtgatctgatcttctgcttataattccaaaacctgaagtctttgtgcatctgtttctattgtcttttgtttttgctggctcttgattgtgaatttaatttcattttgtgtgtggttatctttgtgtgctagagattgtattgaaaaattgcttgtaagaataatttgagccttaggatgatagttcctctcctttcctctcctctcctctcctctcctctcctgtcccctcctctcctctcctctcctctcctcccctctcctcttctgtcccctcccctcctctcctctcctctcccctcctctcctctcccctcccctcccctcccctctgctcccctcccctcccctcccctcccctcttcttttcttttcttttcttgatgagtttcactttgttgcccaggctggagtgtagtggtgtgagctcagctaactgtaacctccacctcccgggttcaagcgattctcctgcctcagcctcctgagtagctgggattacaggcatgtgccaccatacccggctaatttttgtatttttagtagaggcagagtttcaccatgttggccaggctggtctccaactcctgacctcaagtataccaaagtcctgggattacaggcatgagccacggcacctggccaatagtacctttctttaaggatggtgttggtttgctttttgcaggtgcctagtggggcactacctgtctggaagtattttacacgaagtttaagccttgagatttcctggagcaggacctctgaagtcaccatcacaaatggcaggcccacacaaggactgatttacttctgactcacccatggccttcaggcttagagttggggccttgtcggattcctctctcttaccaactctgggctttgactctgttgtccctaatgccatgctgataaataattaataactggctcttcataaaaaaaaacagttttgatctgtagcacctgccaattcccatggtgtaaacactcctgccatggctgacttcaagttaccaacacaacatcactgagtgtgggattggaaaaagatgcccatggctggctcttaagagtcctctgagccttgctggttctccctcacctgccattgagggggctgatgggtgcaacagtcattcctgaggctgcaaagttctttaaagcagaagcagctgactcttgcttatgttttgcagtacttgctgggctctcaactcctccaaggttttggcctggtagtgcattctttgctacctgatttgctcttttctgctttaaagaagattggaaaaaaattttttttttgagacagggtctcactctgtcacctaggctgatcgtggctcactgcatcctccacctctcaggctcaagggatcctcctacctcagccccccaagtagctaagaccacaggtgtgcgccaccacattaggctaggttattattattttttttttgtatttttggtagtagagacggggtttctctatattgtccaggctggtcctgagctcctggccacgagtgagccacccaccttgacctcccaaagtgctgggattataggcatgggccaccatgcctggccaattgaaatattttaatccagcttttctagttgtgttcagtggaagagttggtcctagtcactaatctgctacttatggacagagacatctcctattttctgttgtaaggacaggaaaaagcagaaaatatagaaaaggaaataaagagcaaccatctctcaatagtactgctgcccaacaagaacactgctgacatttggaaactgttttccaatttgattcttattggaaagcataacaaccagccagggcctgtgctgctggagcgggcagttatgtgcagggagacagctggttacggctggctcctggcctcgacggagcttctcagcctcttggagcctctgtcccctcagctgctgaaggaacacatctcctgcacttctcaagttgctgccggtgcgaaggtgactccagattctgcagtttgggctccgtagctgctcagcaaatgtcagcaggtccagaagcaaggctcctcagctgcagagtgaatgcaaatgtccccattgtaaatggccgtggggcccagggctctgcaaccttggatgcccaggatcagaccagctgtccgccgctttggaatctgggtttatgggggacccgggcctcataaatgtcaaagcgtgcattctcggcagtccaggagtcggaaaacgtgtctctgaggggagcattccttccatgcacacagctgcctggctcacgtttttatcctcgagccataattagtcctttcccctgaccctgaattcctgccccggccagaagcatgctgtggccctggggcccgcggctcctggtggtcggtgccccttctgctctcctgcagctgcggcaggtggaagagctgtcgggggtgggaagggggcttggagggataaggatgggctggggagggctcccaaggcagtggacactgtgggctctggggactgcatggctgtggagggggcatgtgctgttgggctcccagcctcttggggtcctctctgtgccaagatagagcctgttaccctccctgagcaggtgtgagcagacacctgtcccctgccctgcatgggaagtgaacgatccactaagtggggaggtcagggtcagatccccggccttcccatgcaggatgactgctcaggcccaggacagtgggtggtcaacagaaaccccatccctgcccatagagggtgcttcccagttcacagtgacacagcctggcctgctcctcttccagccacccaaggcaagacacagagcaggaggctgaggctggtgtgagggaaagggggatgcagcaaggggatacctcaaccttgcccgagctacagacaggtgaggacttctccctcacctggtgttttccactgcattctgaagagcaggtgacacccaccccagggtggatccaggatggatctctgggtttcctgccatctacaatgaccctcctcatttcccctggctagctgccccctaggatggagaatgcatcatggtcactgacacttggcgcccttttccagcctcaatggcctggcagagccagtggggacacagcaataatgtgggtggcagtaataacagcagctgaaccacctgagcaccatcctgacgaggcatagcctgagctctgtgaacagtgaagtccatctggtctctcagtggcctgagagtgactctaactattatcctcattctctgaaggaggaaaacaaggcaaggggatttaaataatttttaaaggtcagataccttcacaaaggctgaagtgggagtcagatgatagtgtctgggtggagaccccatactcttaccctcaactctgagccatctgctatacaacatctatttgctgagtggaaggtgtgtagcctgaaccatgctcacttctggtccagagctctttcctcagggccctgggacattcacgtttagtgtacagtggtatatgtatgctgaattcctacattaggccagccacatagtcagcactgattgctaaaagaataactgaataaggataaatgcttgaggggatggataccccattctccatgatgcgattatttcacattccctgcttgtatcaaaacatctcatgtaccccataaatatatacacctactatgtactcacaaaaattaaaaattaaaaaagatacaagttaaacatctggccagttataatgatatgaaaagtaataaggacaaaatataaataaaagattataagcaacaatagcaaaaagcataattggataaaaggaaaaaaaaatcccattccatgatgaagaaactaaggttctagggagccaggaagtggggtccgggctcctggctgagctcttaacccagagccctagcagttacattttccacagaaggacagaatgagcacatgggagaggcttacttgaagtccccttgccatcaaggggcaagggtggcacctacctctctttgggcagggccctgatcctgctggatgggggctgccagggctgctgctgagcagactcctaggctgattcctggacctgattttcattgacgctgcaaagacctcagcagagcgcctttgcgccctgatgagattgacacacagctcaaacacactgcatccttgtgggggtggaggagatgcacagaccctggcagaatgcaagagaagcctgtttaatgtgtcgacaggaagtatcaacctgcagcagaattgcaatgcagtctgtcctgggaggccaggggctgggcaggcggggcaggcgtttgccttgcctcgtgggccactcccaggatgactcctagcctggccaggatgaaggctttggccagcgttgacgctgtttcccaatgcagagatcactctgacacaggccagcattgcctcggaggtggcccagagctgggcgggagggagacaggcagatagcagggaagaatgagccatctctgtcccctcagctggggtgcccagattcagaggtctcatggtgatggctgccttcctggacctactcctggttgggctcagagactggtccagggaagggcctacacagcactctacagtgcaagagatgccgtcttggccctggggcctttgagagtccgcccctccagaggagctggggccacagggtgccctggccggggagtcaggaggcctgcagtgccagggccctcttgctggccgtggggtgtgtgccactgtgagcgagcggaagtgtgtgcatgtgtgagtgggtgagagtgtgtgtgttgtgcattgatgtgagtgtgagagtgtgtgtgtccccgaggaggggacagatgtctatgggagggctccgctctggactgagagcacaagtctgtgagtcaggacctcccggagccgtggtccggggctgtgtgcttggggtggtgagaggcccctggcacctccagcggctcccagtcctgtgtgggtcctgcagcctgtggtgcacagggcagtggggaatggtcctgggggccacacgaagccttggggaagtgctgcatttccaggctgcagagggctttggggtgccgactgctgaacgaggggctccctgcactgcggtcaccctgtggcagtgtcgggatgggaggacagggcctttgggggctgctgggccctgctcaccctccctgggcagcctgagccgggaggtcaggttgggggtgctgggctcccagattcagccccaggaggcgtccgggctgccatgctcaccccggccccgcccggaacaagggctcagagggagaatgaacggcagccgcctggtttgcacataatttgttctggggcagagttgcggctgttaaaagcctcggtgaaaaagcctctgggaatgtgacagcctgagacagggaaaatcagcccagggtccctcctcgggttcacactgctggaacctctgcaacctgcctggcaatttggatgtcaccaaaatctgccctgcggttggacgctggtggctgagggtgagtccaccgggcctgctgaggaggagagcggagcagggcatcatgggcaggggggtgctggagagggctggggggcatgtggggagcagctggcccctctggtggcccagggcacctctggagagggagaggcctgaatgggggctcctgtctccacccaaggctgtggggagaccaggactccccaccagtgaggaggggccatttttggagctgcctgctctgccgagtgagcttgtggcaggcacaaagtggacaaacagacaagcatctgagtggtggctgcccaggcctccaggccctgggggacagcagctcctcgctcaggaggaaatgctgtcccctctgggcaggggtgtctgtatctaaaggagttgggacacctgggctctgccggggctggtggctgggctggtccgtgcccctcttgggggtcagacagtggcagggcctgcagagcctgggtgtccttgtggtgctggcaggttgcagagggtggtgcatgagtttgcgggaggaccacagccggcgcccacacggcagacgtgggttctctcatgtcatggcttgaagacggctcaaggcgtgggcagggctgctttctcctgaggcctctctccttggcctacggatggccaccttccctctgtgtgcgtcccagtctcctcttcttacaaggaccccagtcagactgtatcagaccccaccccagtgacctcattccaccttaataacctcgataaagacccaatctctaaaggcagtcgcaccccgagggccgccttcagcataggaagttgggaaaacgtaattcagcccaggagaggtgggaagtgggccaggcactcaggggcggggatatccaggaggcctggcttgacctggccttgccgcaggcatcgctggtgggccctcctcaacctctgcctgcaggctcaggaagtttgttgtgaagcaaacaatccctgcgctccgaaggcgcttcttcaggccgagatccaaaaatctgacccccagaacctccaatgaccaactctttttcctcatgatgccaccaccgtcctcaccattattgtcatcggcgtcattgtcacctccattgattgagcccctaccagctgccagggctgggcaggttccttctcacaggtggcctcatacaatgcgccagcagccctggaggtggggcagctgtgccactgccccatgagagaacaatctgtcatgagtgggttctgcccatgaggacccagccaaagggaggtggccaggatcaggcagggccagcaccagagcctcaggcttgggcctaagcctaccacggggacccaggccgccctctccacagctcagggtgaggctggatcttcctcgctggtgggcacgcacgcaggcgggcaggctgagaggtgggtgctggcctggtctgccaggaagggtggcctcagctgcccgccccaaccctcaccagtggaagagaggaacgaggagaggtcatgaatgactggaactgccctcccgtgacctgccagatgaccatccaggttaaattgagatctgagtttcataaaagcaaattaaatagacatacatgtatattttgataattaaaagttttgaaccagccattcactcaagggtagttctggggaatttgtgcccatgagaccctccccctggtgggacagaaggagctaggagtgggaggccaggggaggcctgtctccctcatcccccatgtccagggaaagctgtgtgggcctgggccagctctctggccccatgggcactctgtgcctggtgacagcagaggtcctgctcttgggaggctctgaccccccacagcggggctgctctgggggagtgctggggagctgcggtgtccggggagggagctgggacctgctcccttgtgctggtggtgtacctgcctggcacctccctggcaccaagcgtctcataggaccctgcaacagtcccggctggggatgctgcctgcaggtttcaatggggaaactgaggctcagaggtgggatgggacctgccaccctgtgtgactggcaggacagagatggggctggattgggccccagcatggctggccctaaagtcccctgctttcatgctctgaccataaggctttcctcgtggaggttgctggggagatgagtggggttgttgcacaggcctcccgggtttaggccgcacctgggcagggacctcccagcagagatggtccccccatttggtgtggagggaccacatgagcaaggcagagtaggaggtgcattggggatctcgcggtgtagggggtggggcctgcagggggcggctgggatggggaatggggccgaggccggggggtgatggtgagggtgggagtgtgaaatggcagtgcccccacctgggcagctggagtgcatggccctgagcattgggtcctgcatggtcctgcggtggcctggtgggcccaggagaccagaaggcctgggctgatccctgagggtctgtctggtgggggtggccaagggcactcagggtcatggtgctgcagagggggtgtcagagggcagtgttggcaggagttctgagtgaggaggtgagaatgcctggtaaaggtggagggggagggaggggagggagaaagagggggtgaaaagggggaaggagggagggaggagggagaggggaggcccagtagacatcctcacccggggggcagtgagggttagggaccctgccctgcgtgagtgattgggcaggggatcctgagggcgcttccagcccctgcatggtcaggaggtcacacgcccactcacccgctcattcattcattgcgtggtcgggagctcacacgcccactcacccgctcattcattcattgcgtggtcaggaggtcacacgcccactcacccgctcattcattcattgcgaggtcgggagctcacacgcccactcacccgctcattcattcattgcgtggtcgggagctcacgcgcccactcacccgctcattcattcattgcgtggtcgggagctcacgcgcccactcacccgctcattcattcattgcgaggtcgggagctcacgcgcccactcacccgctcattcattcattgcgtggtcgggaggtcacgcgcccactcacccgctcattcattcattgcgtggtcgggagctcacgcgcccactcacccgctcattcattcattgcgtggtcgggagctcacgcgcccactcaccccctcattcattcattgcgtggtcgggagctcacgcgcccactcacccgctcattcattcattgcgaggtcgggagctcacgcgcccactcacccgctcattcattcattgcgtggtcgggagctcacgcgcccactcacccgctcattcattcattgcgtggtcgggagctcacgcgcccactcacccgctcattcattcattgcgaggtcgggagctcacgcgcccactcacccgctcattcattcattgcgtggtcgggagctcacgcgcccactcacccgctcattcattcattgcgaggtcgggagctcacgcgcccactcacccgctcattcattcattgcgtggtcgggagctcacgcgcccactcacccgctcattcattcattgcgtggtcgggagctcacgcgcccactcacccgctcattcattcattgcgtggtcgggaggtcacgcgcccactcacccgctcattcattcattgcgaggtcgggagctcacgcgcccactcacccgctcattcattcattgcgaggtcgggagctcacgcgcccactcacccgctcattcattcattgcgaggtcgggagctcacgcgcccactcacccgctcattcattcattgcgtggtcgggagctcacgcgcccactcacccgctcattcattcattgcgaggtcgggagctcacgcgcccactcacccgctcattcattcattgcgtggtcgggaggtcacgcgcccactcacccgctcattcattcattgcgtggtcgggagctcacaggcccactcacctgctcattcattcattgcgaggtcgggagctcacacgcccactcacccgctcattcattcattcctccgcgcatcatccattcatccacagtgctcactgtggcctctgggaggatgctcccactctgttgggggggcctgtggctgaggagccccctcctcagacttcgtcttgcttcccccaaacagctgccctggggcctgctgggctggagcctgcagatgggtgtgtggggagggtgcgggtgggcgggatctctcacgcctattgaggcccccatgcagggggtgccgactcccgcctgccacccaccctttgtccacggcgttcctggctgctttggctccctcagcctccagtcctttcttctcttttcacctccttttccaattaagagcccaccctgcctgccccacagacaccgtcaagcctggccccattatccagtcccctggcgggtggtctctgcaccgtgctgccctccatacgcagcagcctctgtctcaggggtctcactgccccattgggtgctgcatcctggggagcgagaggggctggtgtgactgtgcctgggccccacacctgggctccagcaaccctcgcaacacctatcctggctctgtttggcaacctaagggtggtgggccacgagcgtcccaggacctcagaattccagctcttggaaaagtgcccagggcatgaaattccctttagaacacaccctgggcccactgtccctcttgggcactctcagccctcaaggctggtggcactcactccctgccctcacaaaggctgctgctcccacctcctggccatgcctggggccagcagcaagtacattgtggccacagagccgggcagtcaggagaggccagagtgcggtagcacctgtcccacccgctattccacagtaggggacaaacggagcttggaggggttcagacggtgtcttgaaggatagagcaggttcctatctttgaggactcctcctcctgcttcctgacttctgggtggacctgaccatctcctcgtgttgcagaaaagggctctaaagcccagttgtaccacctaccagccagggaacctggtgaaatagacactgtacaatgtcttccagccttgtgcttctattctacagacgggcaccattacatcactaggaggagtgaacctgcctctggcaaacaggtccggcctgcagcacccacggcgggtggtttcctttcctaccccacagcctcccctggggccactgtgtgccctgtaaccccctccttccagcggccccacagctccagctgtctgggcaggctctcctctgactcaggtcgagagctgcagccaggccaggccctctgctgtgggcacacccgctggcatcacccctctcactgggcccagccacccctaggcctggtgcctccttggacagtgggcatggctgcccctggctgcagctggtgtcctggggctggcatcccaaagctcccgcgttctccagcaccggtggagagaaagccccgctgtccagccgagttctgatggagatggtgccaggcggcttgtgccctcctccgccctggtcctggggtctcgtggtgaagtcagctgctttagaaatcaggcgggagctgagggagtggagggctgggggccacgccctgagcttccctgggtaccccctgacggctgctctttaggagccaggctgggacttccaatataccacgagaagccagcaacctgggcttcgatctgagatctgtttagaaatgttggcaatgaattcaatattttaaaaaccaagatgtagtgagggaggctatggaaaggctaccagcaggggttaactggctgcctggcgtgagatggggtccaggtggagggggtgagaagggaggggagcaggggcaggatggaaaggactgcggtgaggcacgcgggtccatctgtgcagagctgctcgtggaggggtgtggaagcccaccccatccaccgccccactgggcctgcgcagtcaggcggtccccgggagctgagtaagggggctctgaggagagggtcctcatgacggttggggtcaccaagcccagaggaggcttccaggcagccaatttcagacttaattcaggcagccctctggggctgaccgagtgcccttctcgcccgcgttggcgagcaagaggcaggccctggtgtgctggtgcatctcctggcgggcttatgaggggctggagccctgggggactctggagcagcccctccaaaggatgccatgggcacagatgctgtgtctggctacaagaggcacttggatccccaggtttgctgctgtgtgtgcgtgcatgcagatgtgtgcatatgtgtgtatctttgtgtgcgtgtttctgtatctctgtgtgggtatgtgtgcgtctatgtatatctctgtgtatgcctgcatgtgtgtctacgtgtgtgtgtgtatctttgtaactgtgtgtgggcacacagacatatgaacgtgtgtatccgtgtctgtgtatctgcccacatgtgtctgtatgtgcgtgggtgagtgtgtgtctgtatctgtgcatgtgtgagtgtgtgtctgtatctgtgcatgtgtgagtgtgtgtctgtatctgtgtgtgtgtgtgtgtgtctgtgttggttccttcagcagggatgtcagctgtggccagggggcccgcaagccagccctaaatttgggcaaatttggcctgacctagggaagaaggaagctgtgttcactgccgctgagggtgggtgggagaagggctgagagggtgagaactgaggggccccagggggcaacagttaccctcagtggtgcaggtggggaactgaggcagagccagaggctgggagacaggaagaggtgggaagtgaccggagtgaggctgagcagagggagcgtcttcgtttcataaaaagccataaatccagccgaagctaactgtggaggaaagggtactgggcccctcctgtcttccccgaccccgtacactgacccgaggctggacgaaccctcagttcctgcccaccgagagcacgcatctgttcatgcccctaaaatatgggtgctcaggacactatcagccttggacagctgctgtttccacttgatctgtgaaatttatgccgttgggaagacaaatgttcttagccagggctgagggaaggtatgagcagccccccttccctcctgtccaattttggaggctgggaatattggcttcactctgacagctccctgactgggtggcccagaaacgacatatggctggagaattcccagcctgtaggctgaacacctccagcctttttttcctattgtattaaaatatacataatctttatcgctgtaaacatttgtaagtctgtaattcagtggccctgaatacactctcagtgttgtgcaaccatcacctctatctatacccaaagcttctcatcttcccccaacaactctgtccccattaaataataaccctctcccccaacacctctacccccattaaataacaaccccctcccccaacacctctgcccccattaaataacaaccccctcccccaacacctctgcccccattaaataacaaccccctcccccaacaactctatccccattaagtaacaatcccctcacccaacaattctgtccccattaaataacaaccctcttccccaacaactctatccccattaaataacaaccccctcccccaacacctctacccccattaaataacaacccccttccccaacaactctatcctcattaaataacaaccctctccctcaacaactctatcctcattaaataacaaccctctcccccaacaactctattcccattaaataacaactctccccccagtgactctctccccattaaataacaactctcccctctcaagacaattctgtccccatctaataacaactctctcccctgacaactctatcctcattaaataacaactctgtcttctttcttccctcagcccctgatcacctttattgtactttctgtctttatgactttgcctactctagacacctcacatgagtggaatcatgcagtatttgtccttttatatctgacttatttaactcagcataatgtcttcaaggctcagctctgtctcagcacatgtcagaatttccttccttttcggggctgaatagtattccacagtatgagtggaccacactgtgtttgtccttcatctgttgatgaacacttgggttgcttctactttctggctgttgtgacgaatgctgctacatgcatgggtgtataaatatctctccaagaccctgctttcttgtcttttgggtgtatgactaggagtagaattgctgggtcatgtggcatattcaaccttttgaagaactgccaaactgttttccacggtgaccacgccactttatatccctaccagcaatgcgcaagagttgcaatttctccacatcctcatccccagttcttttcttttctttatagctgtagccatcctagtgggtatgaagtgttttggtttgcatttccctaatgaccagtgctgttgagcatcttttcatgtgcttattggccatttgtatatcttctttggagaaatgtccattcaagttcttttttcatttttaaattgggacctctagccttattgaggtctttcttcctagatcataaagggtaggaacactgctaggctgggtcacactggtatgggtttaaaatgcaggggtcctggatccaagcatggtgagggattctggagtctgggctctgggaggctggggagcattaggacatgagagatctcttgggaggggcagtgatgggaggtgggggtgccaaggggtggcagagcctccctggctgcaagggaccatgggcagccccaggttttggagaactcccctaataggagggagcatggcatcaaggaccctggctgtaatgcttggaaggggaggactttggggacaacttttctggagctctcttatcctcccccaggcccagggcttatgctcactacacttttcctgtgcacattcactaaacaaacattcttgagcacccaggctgtgccggtggctggggcacctggagggaaccaggccaacatggctcctgtccccacagaacccacagtcttgagctgtgctgctcagtttggcagcactagccacttagttactgaaattaaagttaaatacagttaaataaagttgaggcttctgctaccagccaagatggagtaatgtgaattggatttatccttccacctgcaataagcaagaaatggacaaaaatacatgaaaaatcagttctcaaggcactgtagacaatggagtagagtaagaggctagaaacaaatcagatgaactccacagctgtcatatcttactgctggagagaatgtccatgccgtgaagcaggaagcaggaatccaggcagagccaggtggactccctgagttaaggaggagaccaaggtggtgagaattggcaggacagaggtgctgcagaggggagagcagaacacagagagaactctgagatccatagagggcccctttcaggattcagttgaggactgagcatcctctgagtatgaggaaactacctgagttgggaaaggctcagaactaaggcctggtgttcacacagggccaggaatagtgcctgttcctaacagtggggctggaaaacctcataatttctggggcattggtagaatgccttgcttcagtcgtgggatataatttgccctaggctgagcactgctccaattcttcctaaactatcttaaaagcaagaccctgaagaatcaaactgtttccaaatgacttaactgaatctcaggaaaagctcaagaatccaacacctaacaatataaaattcacaatgtctggagtccagtaaaaattaacaagtatgcaaagaagcaagaaaatgcaacccctaataaggagataaatcagcaaagacagcccaagactgacacagatgttagaatgagcaggcaagagcatgaaaatagttatgatgactgtgttccatatgatgaaaaagttaagtagagacatggaagatataacaaagacccacatcatatttctagagataaaaactgcaatgtgtaagataaaaaatacactggacggatggaattattgtcagattagatgttgaagaagaaaagatgatcacacttgaagacatagcaatagaaataatccaaaatgaaacacagaaagacaatattattttaaaagttaacagaatatcattgaactttgggaaaatgtcaagtggtctaatctgtttaattgaattatgtgaaagagaagagagagatgggaacagaaaaaaaaatacttgaaataatggccaaatattttccacatatgaaaactataaacccatagattcgagaagctcaaaaaaggcaaagtacaagaaacatagaaaaaactacaccaaggagcattataagcaaattgctcaaaagtagtgataaaatttcttgcttgcagccagaaaataaaaggcaagatttgtatagtgcaacaaaagtgagaataacagcagatttcttgtgggacacaacgtaagccagaagaaggtggatgaacatctttaaagttctgaaggaaaaaatatctttcaacctagaattctgtgaccattagaaatatctttcaaaagcaaaggcacaataatgacttttacaagtatacaaaagctgaaagaatgtctcaacagaggacctgcattgcaagaaattttaaagaaattccttcaggtggaaggaaaatgatactagttggaattatggctctacagaaaggaatgaaaagtcctgggactgacactttataggtaaatatataagatttatttttattatttaaatttatttaaatgataattaattgtttaaacaagaacaataatgtagtatgaggtttatggcatatataaagttaaaatgcatgacaacaatagcacaaagttttgaaagggaggaatgaaaatatgctattaaaatgttcttatcttgcatgtgaagtagtataatagcacctgaaggcagcctacgataagttaaaaatatatgctatgagccataaagcaaccaataaattacaaaacaaagggaaatagctaataaaacaacaaaacacataaaatggaattgtaagaaatatttcattaatcctaaagaaggcagaaaaagatgaaaaagggaaaaacaagtgggacaaatagaaaataaagagcaaaataatagacttaagcctaccaataatacattaaatgtaaacagtccaaatattccaattaagagacagagtgactaacagaattaaaaagcaagacccaactatatgctgcctataagaaacacacattaaatatgaagatacagaactcttggtttctggcctggcatgtggcatgtaaacagcttggaagtcatcactccattctcattacaagtataaagctgaacaaaccacaaaagcaactcttcttagatccttaagagaagcgaggtcacagggcaaactgctgtccctcaaattggatggacagacagacaaatacagagaattacaacttactggagcagaaacctctgcaggaaccagtgctggaacaagaaaacctaaagtgtaatcaacaaattgccagaggctcagtgtggataagcctgggagttaaaaactccagagagacccagtcacagtcccccttcccccagcttttgtgaatttttcctcctcggtctttcctccaggttcacacagtgaataccaaaggaaaatccctttgttctttccagcagggagaaggggaaaaagagccattttgagatataccagactatctgttcttaataatggtctaccttccagagaaactaaccagatcctagccttctggagttttatccatgcttaattgacctgacagaaaggaaacacccacctccagccccctccagccatcctgtcccacctaaggagggggatctgagatgcactggtgagtttcacagtccagaggcacaggctcactaaaggtaaagatacaaataagctgcaagaaagggaatgggaaaagatataccacactaacattaattaaaagaactctggagaggctgtattaacatcaacaaagtagatgtacagaatattaccagaaataaataaaatcactttgtaatgatacagaaatcaattcatcagaatgtaacaattccaaagatgtatgcacctaatgacagagcttcaaaataaatgaaacaaacactaatagaactacaaggagaattaggcacatacaattacagccagaaattttaatacccctttttcaataactgttaggacaaattgacagaaaatcaataagggcgtataagacttgaagagcagattcaactgacatttataaaatactccactcaacaacagaatacccattcttttcaagtgcacatggaacacatttactaagatagacaatattctgggccataaaacaagtccaaaaaatataaagggatccaagtcataaaaagttttatctgatcacaatgggattagattagaattgaaaaatggaaatatttctggaaaattcccccaaatttggaaatgaagtaacatatttcttggtaacttatgggtcaaaggaggaattaaaagggaaattagaaagtattttgaactaaataaaaaggaaaacacagcctataaaatgtgtgggatttagttaaatcccactatttagggggaaatttgtagcattaaatgcctatgttagaaaagaagaaatatcttaaatcaatgaccttaagaaactagaaaagagcaaatgaaacccaaagtaagaaaaaaggaagtagtgaagatcagagtgaaaaatcaatgaaatcataaacagaaagacagtagagaaaatcaatgaaaccaaaagctggttcttcgagatgattgaaaagatgaacaaacctttaggtaggctggtcagtaaaaagagagagaagacacaaatgaccagtatcgggaatgaaggaggttacataagaactgattctactgatattaagggatgataaggggatattatcaacaactctatgtcaataaattcaactactcaaaatggacaaattccctgaaagacacaaattaccaaggatgtgcaggatgaagtggataaccacacagccctgtaactattaaagaaactgggtttgtagttaaaaacctttctacaaagaaaactccacggtcaggtggctttactgatgaattctaccaaatgcaaggaagaaaataccacttaaccaataataatatgcggagtgcaaataagcatgtgaaactgctcaatatagttagtcaatcaagtggaaactaacccatagtgtgagaacaccacacacctagtagaatggctagcattaaaaagactgacataccaagtattggagatgatacggaggaactggaactcttctgtgctgctgggggaggcagggtatgtaaaatggtacaactgctttataaagcaatttgtcagtctcttaaatcattaaacatatacctaccatataatccagtcatcccacttcaagagaaatgaaaacagtccatacagagttgtatgtgaatattcacagcagctttatttgtaacaccccaaaactaggcagaacccaaacgtccatcaacagttgagtggataaataaaaggtggtgtgtccgcacaatggctgctacttggcgatagaaagtgatgaattattgatgtgcacgatgacgtggataaatggcaggtaatatactgagtaagggggacagataaaaaggaaatgtaattcacgattttataaagaatatgtatgtaattcttgaaaatgcaaactaatctataatgacagaaaatagatcaatggttgcttggggcctggagaagcgggcagggaagatggagggcaggatctccaaggggcacgaagaaggtttttggtgtgatgggaatgttctttacttttgtgatggttttgctggtgtatacatgtgttaaaacctatccaattgtatactttaattatgtgtagcttattctatgttagttatacttcagtaaagctacagagtacaatttttaaaacccaggtctgtggttacaataacatttcgagtgctcagtaaccacagtagctagtggctgccacactggacagtgcagatacagaacgtttttattactgtggacagtgctggtctcgagggaaagacacacatgacctggaccatggcgtgggctttgtctttgcaatgggaggaaaacatcagcggagtaacaagaaggaagggactcgagggccttggcagatgttggttgggctgaccaggtctgcacccaggccctgggggacctggtggggaaaaggtccttcctccccagtggggtgaggggagaggtgttggccccaagcaggatggtggcgatgccaggtggctatggtggtgagcggcccacactgctgtggaccaaagccagaggggagggtgtgaggcttgaggtggggagctcagatgctgctgaaagaaggcaggctcagggcagcccaggcaagaggggttgagccagtgatgctctctgccctgctgggatgctctccccgtcccctgctgctctgccttggggagcagagagaggaggcagaaaggggtctctggggaaggtgcgcccaccccagccagtgtactttggaagggaagtggcatcccgggtgtcagggccccccaccctggggcagaggaggagctgacctggggagcaagcagatgagagcccagggctcactaaggctttggggagcccctggttctgagccctgccttccccctccctctgccctgggctgggactctgagctcctgcttcctgcacccccatcactgtctcctttggggacagggaccagctctgggggtcaagtgctagggtgaggttgacagaggtcccgcttagctgcacggcccccacatgtagacagtgagggggagtattaactggcaggggaggcacaccccagccccctggggagggggccagctgcatgccggggacaggctgcagctggggtgacggggctgggctcattccggttggggacaacatggctcagatgggtcccacctgcaggcaagcctgtcctgagggccttggttccagtgcaggggtggcagagcctcctgctgcaccagacagggctggggcaggcggggtggctgggcggggctggggcaggcggggctggccatgtccactgcagggcctggaggacgggtcttggctcgttccccacctgaaggacagggtgggggggggggactctctcctttcgttgtcccatctgtcccttgggcaaaattgaacaaacccataaaagccaaataactctcattgtagaggacggtccaccgcccaggtctgcacagtggctcctgaggccgagttgatcaaaatgtaatcagttctaacgcaagacctatttgatgacaggtatggtgtggccgtgtgtaactatccttacaattaattaacttttcatgtcgttcattaagctccataacttatgaggccgggcactgtacagttggaagtcacagaagggaagactggagttaaaccgtgctagggtgtccctggcatgaggggcaccctgcgtggcagctcccagagctggtgtctgtgcacaagcatggtggggcttacccgacccctgcccctggctcagctggggactcatggtggagcagctgcagtcgctgtaggatcattccctttgtgactggaaataattgtatttgtgatttgcacaatgctgcaacatattgatttttcaattacgccgggaagaaatcgagaatgagatggaagggagtggcggctcctcgaggggctctgagttggggtctgcagcattgcagcgggtgaccctcagcagggggccttgggccagcgacccccagggtcttagagctacaagtgacctcagacatacgttctttgtccagctggggaaactgaggcccagggtggggacaggcctcgcccgagggctggcagtgagggtggcaccagagcttggtccctgcccctgactttagtatgtgaggccctcaccttgccctggcatgaataaatgaagttgggactagcaggaaccttctgagagggtccactgggcctgagccgtcagggaaatgcgaagttggcatacaaacttggcaaatctgttcctcatgccaacactccccctggggcttgccttcgggccttgcctctctatctccgttttaaaatgttagtcttggttgaagcgtcccttcctctggatcttctcagggcctctctgtcctggctgcccccgccccagtattggcatcttgtgggtctggccggcctgggctgctgggaggacgggtgagcccccgaggcagagcctactgtctgccttctccgcccccaagggcaaggaccgggtaaggcgtgggagctgcagagcaggaagtggctagagcttgctcacaggcagtgctgggtgccgggcttggggatgagctccggacagggggcttttggagcgctggcccaggcagtggtgctgacgcaggggtctggtatcccaggcaagaagggtggctggaggtgtctgtgggtcaccccctttctgcccttccctgtcatctgctcctatccctgggatggggttctgggcctccccagccttgggtaaggacgctggtgttggcatgagccgaactggtacttgggagaaagggctccagagcccccagcttgggggaggctgggcaagccagggcaacaagcccagggaactgagcccaccagggcagtgcagccccggggtgggggtgcttcctggagggaggctcccagcgaggcctggggttgggccagccctcccagctgcctgtggcctctgtggcacatgcccaaagacataattctgcagcacctctatgggcggcagctggggatgatggtgccaccgagcccgtgacaaagccaatgtctttttgagggtcaggcgcagtccataccaggctttaatttaaaaatcaaattcagccaggcgtggtggcgcaggcctgtaatcccagcgctttgggaggctgaggcaggcggatcacaaggtttggagttcaagaccagcctgaccaacatggtgaaaccccatctcaactaaaaatacaaaaattagccgggtgtggtggcaggcgcctgtagtcccagctactcaggaggctgagacaggagaatcgtttgaacccgggaggcggaggttgcagcgagctgagatcacgccactgcactccagcctgggtgacagagcaagactccgtctaaaaaaataaaaaataaaaatattaaaaaaataaaaatcaaattcagcctggcatggtgggtcaagcctgtaatcccagtactctgggaggctgaggtgggtggatcactggaagccaggagttcaagaccatcctggccaacatggtgaaaccccgtctctactaaaaatacaaaaattagtcgggcgtggtggcgggcgcctgtagtcccaatcactcgggaggctgaggcaggaaaattgcttgaaggtgggaggtggagcttgcagtgagccgagagcgcgccactgcactccagcctggtgaaagagcgagactccgtctcaaaaaaaaaaaaaatcaattttttttttctcagaacctgccctgctcatttataagctcatagaaagctctataggcaattgcatttcctggtgcgtgtgtgtgtgttttaaagaagtggaaaccacatgggagggaacacacgggctgccgcctgctggcttctgttccaaggaagctcctggtttctcctaagatgaaggagccactttcctgggctcaggccctctgggatctgacggccaaatttgggcctacagagtagggagtgcgggtgagggcagggaccaggaggcagaggcagtgcttctggggtctggggcgctcactcgggtacaggacatctggcttctgggtgtggctggggaggtgggaagtgagggcacttgcagggcctgttctgggagacctgccccctctcccaccctgaggtccgtagactctgcactcctcctgccttccctcccaccctagggtccagagcctctccactccactcctcccgccttcccttccaccctaggggagcacgagacagaacttaacacgcacctcaggccaacacctaccgtcatggccctgcgagggagccgagttcgtaaatgaccgcacaggtgaaggatttaattttctctcatttgtccccgtattccggctgtctcataaatcacagctgtttatgactctcttcggcacttttgtgatggctgataatggctgagtaagtggcagagaggatgaattctgcagcggattttaaacaaacgtgcacattggagccacagataatgtgaagcatcgcagcagtggggggcacctcgcaggtcacccccagagcgcagccctggcctgctgggaagggcctgctctctgggggcctggcctccctcccagaggtgggcaggggccaggggcagcttcttcccagggatattttagtcacaaggagcaagccccaccaaggctagtgggcacctgtgtgtttgagagtgtgtgcaaatatgtgcctgagtgtgtgcgtgtgggtatgactatgtgtgcacgtgtgtgtgcgcacgtgtgtgtgtgtgtgcacgtgtgtgtgcgcatgtgcacgcagtcagagtgcgcaggctcctcacctgtccagggcgcacggcccagaaagaccactgcttcttaggtcatagtgcacctatctggaggatggggcggtaccagagccccaggtcagagttctcagcagctgcagggccttgttcaatggctgagggtcaggctctggcctggagccggctcccggagaagtgccaccctctgtcccctgctgggggctggtggctgctctccctttccaagggtccctcccaaactcaccttccctcaccccagacctcctctgtgaggaactgataaagccatagtggaggtgcacacacacttcacacgtgcacacacacgcacatgcccacacacgcccacacatgcacacaccccccacacgcatacacatgcacaaacacgcccacacacacgtgcactcacacacacacgcatgcacacacatgcccatgcccacacacacgtgcacacacactcccacgcccacacatgcccacatgcccacaagcccacttccccgagacggtagccatgggttcatctggagcccattcctcaatcaccatccggtctcacagcccccgggcactgggggtggtgcccaccactgtttattttctgctaagatgcactttgccatcctaggggttgcagcatctcctcgtaaagccataaatgtaattgatattctcagcatttcgagaaaaaatacgagtattaaagatatacagtacacctcataaaattctctcatatttcttctttatggtgggttctaaaattggcaaaataaattccctaaaacccattatgctcaacgtacagtgtgttttggaggctgggagaggctgggctgggggctgcacgctcctctcctaacatggcctcagtccccgcttggccacgaggcctgttttcctagaaacctggtaaaaatgggaatggtaattgcccagctcatggtctgtgaccgcggccgggtgctgggaagcttaatctcaatgcttcctccaagaaaataaatgcttttatgatgctccccacgcaggttctgcctgactccgggatgctgccgtcccagctctgggctgagccccttttgtaattacatggggaccctgtccccatgggcgcaaacactgaggccttagctagcagagagcacaggcttcagagcggccgctcccagattcctgcactgcccccctctgcagcttcacaaacctccgcttccgcttccgcttccgcatccgcatcccggctccttccttcgtagtgatagtcacgactcctgattgcagatgcacgttttttctttattatctttctatttcaggagatgaaagctccaaagaacaggctaccacattaaaaaaaccatttacagccaactttatcgaggtatcatttccatgtaataaaatgcatacctttttttttttaaagtaggctttattttttagagcagttttagattcacagagaaattgtgcagattgtacagaaaagcgccacctacgccaagccccatcgtgaacacctcccagagtctgatgcgtttgatacattaatgaatcaacagggatacgctggtaccagctaaagctcacacataacgcagatttcctgagttttttatttatttttatttttttttaattttaattttttttttttttatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgacctcgaggccttcccctgcctcagggccgcgtctgggacacaccatgccttttggtggttgcggctcctcctcagggccccctcagctgccacagtttctcagactttgttttgatgaccttgacagttttggggagaacgggtcaggtattttgtgaacctttattggaatttgtctgctgttcttctcatggttagactggagttacaggtttttgaaggaagaccacaggggcagggcagagggccactgacgccacacccttcccagggtgcctgctctcaacacggctgtccccgttggcgctgaccttggtccctggctgaggtcgtgctgtcagctttctcctaggtgaagttaccgcccacccagcagcccgccacgacctccagcactctttggaggaaggtcacggtgcacagcccacaccgcggggtggggagtcacggtcgcctccttgggggcagaggatctgcatgaatccttccgaatccttctgcttggagactcgtcccttctcccgtgtttgctcatttgctcagtttttgggttccatcagcaacgactcacggacactcttgtcagatttcgggtgtcccagtcctcctccattttgttgctcaagctgtcctgtctttggcggtggcagctcttcagtcggcctgtgacccgtccctttggttttaacgcgtccttattttctgggatgagaagaagctccaggctcatcctgtatgtttcctgcctcagccccacatcagctgttcctccaaggagcccggtgccttttgttggaaggtcccattagacaccaagacctgggcaccgggcctgcttgctgcttgggtgtggttgcttccaggccctctcggccagcggagcagggaagtgtctgtgcgtgtactaacctgggcatgagcccatgtctaacgtgcttctgtgtgtgaccctccgtgtgagtaggggtcatcagagaaacggatgcagtgggacgttcacacccactcctgttggagattgcctggaagcctgggcgcaggtgaccacgcaggccgagaggtcccacgcccgcggagacccagggaagctggtggtgcagtgcggtctgagtccgaagccctgaaagccggagggctaatggcgttaatctcagtgtcagggccagagaaggtgagtgtcccagctcaagcagcgtggcaggaagaggggggcaaattcacctttctctgccttccgcgctattcgggtcctcagcggattgggtgacgccacccaccctggggagggcggcctgctttacagagcccactgattcaaatgctaatctcatccagaacaccctcggacatccccagaaataacgttcaacccggcaccccacggccaggggagctgacacataaagttaaccgtcacaccgcccgcgtggagagggagcccacaggaaggagctggtgctgctgtctcgaccctgaccctgggccgtgtgggtcgttctggcccctgcccctgcttgtctgtagctcccaccccacagtgaggaacctgccccaccacccaccatccatggacctaatcgctaagctgcagtgtgcagggggagcggtgtagggactgctcacctgtaccccgcggcagaagcgtgtgtctgccagggtacagggctcacgtgcgggtccatttgcttttggcttcacagactttgtcgtttgtgagggtacccaggtcagccccatcccccagcccctccctacgtctgtaatacagctgctccctgggtctgtgatacagccagaggctctcgccacacatggcccgccttccgtcctagacccccagcctcttgactgagctttaaaatttgcatacattaaggctcactcttgctgtgaagttctgtgggttttgacagatgcacagtgtcgtgtctctgccattacaatgtcgttcacgttagtttcacagccctaaaaaccccctgtgcggccgggcgcggtggctcaagcctgtaatcccagcactttgggaggccaaggtgggcggatcacgaggtcaggagatcgagaccaccctggctaacacggtgaaaccccgtctctactaaaaatacaaaaaaattagccgggcgaggtggccggtgcctgttgtcccagctgctcgggaggccgaggcaggagaatggcgtgaacccgggaggtggagcttgcagtgagctgagatcgcgccactgcactccagcctgggcgacagagcgagactccgtctcaaaaacaaaacaaaacaaaacaaacaaacaaaaccctgtgctccacctatccaaccatctcctctcacctggaacccctggccaacactgatcttactgtctccacagttttgccttttccagaaagtcatacagttggaaccatacagcactgtagtcttttctgattggcttctctcacttagcaatattcgtctaaggttcatgcctgtcttttggtggctcgatatctcactgctttttatcagtgtataatatcccattgtatggatggatctgccagaatttgtgtatccattcacccaggacatcttggttacttctaggttttggtaattatgaataaagctgctataaacatttgcatacaggcttttgtgtggacctaagtttttcaggccagttgggtaaatacttaggaatgcaactgctagatcatatggtgagactatgtttagctttgtaagaaactgccagactgttttccaaagtggctgtgccattttgtcttcccaccagcagtgaatgggagtttctgttgctgtgtattctcatagcaattggtattgtcactttttggaatttagccattctaatagggatagtggtgtctcgttgttttaatttgcatttccctcatgaaaaatgatatcaagcatccttttatatgcttatttgacatttgtcttttttgagtgaggtgtttgttcggacctttcccccattttaaaattgcgctgttcgttttctagttgttaagttttaggaagttctttgtgtgatttggatacaggtcctttaatctgacttacattttacaaaggttttctcccagcctgtgacttgtgttttcattcttttaatggtttcttttgccgggcagaagtttttaatgaaaaacacatcttaacaattttttctttcataggttgggctttgggtgttgcaatcaaaaactcatcgtcagactcaaggtcacgtaggtcccctgctttcttctagttttatggtttacatttaggcctctgatccctgttgaggtgacttttgtgaaaagcgccctcagtgtgtgtctagatttatttacttattctgcatatggatgtctaaatattacagcaccatttgttgacgagactttctctgttagagacacattttctcctttgtcaaagatcattggcatttgtgtgggtctactagtggatctctgttctattccactgatctgtttatccattcattcatcaatatttcctgtcttgatgccatcatcttataggaagttttgaaattgcgaagcgtgagtcccctagctttgtccttcaccgttgtgttggccattctatgtcttttggctttgtgtataaactctagaatcagtgtgttgatatctacaggagagtttgctgggatattgattagggttgattagatctattgattctatagcccacatttggaaaagtagacaccttaacaatattgagtcttcctatgtgaacatggactatctcttcattcatttagattttttggatatctttcgtcagaggtttgcagttttcagcatacagagcctgtacatgttttgttagatttgtgcctaggtattccacttttgggggttctgctataactagtattgttctttaaatttcaaatcctgattgtttattgctggcatataggaaaggatctgactttcatatatcaaccatgtatcttgcaaccttgctgtgtttgcttatttctttcaggagatagattcatccattcatccatttaatcatttacatgttgctatggtttggctgtgtccccacccaaatctcatcttgaattgtagctcccataattcccatgtgttgtgggagagacccggtgggagataattgaatcatcgtggcagtttcccccatactcttctcaaggtagtgaatacgtctcacgaaatctgatggttttataaggggaaaccccttttgctttttttcctcattctctcttgcatgctgccaagactgtgagggctccccagccatgtggaactgagagtcaattaagcctctttcctttataaattacccagtcgtgggtatgtctttattagcagcgtgagagcagattaatacacacatcttagattgattttccaatgtgaaaatcatacctcaaataagtccctcgtggtcatgctgtgtaattgtggttatacattgttagatttgatttgataatattttgttgattattttcatatctacattcatgagagttattggtttgtagtctcaagtttcttttcttgtaatttctttatctgttttggtattagggtaatgctgacctcttacaatgagttaggaagcatttcctctgcttctatttttcagaagaaaaattaaatcacttaacataatgatctccagttccatctgtgttattgcatataaagacagactgtagagaattggtatttattccttacatagttggtagagttcaccagtgaaaccatctgggcctagtgctttcttttttgaagataatgaagtattatttaaatttccttaacagatatagacctattaaggctttttaaaatttttaaattattttaaaaagtatttgtgggtacatagtagttgtatatacttatgaggtacatgagatgaagatgttttgatataggcatacgatgtgaaataagcacatcatggagaatggggtatccatctcctcaaggatttatcctttgaattacaaacaatcctattacattctttattttaaaatgtaaaattaagttattattaactatagtcaccctattgtgttatcaaatactaggctttattcattgtttctacttttttttttgtactgattaaccactcccacctccctcccagcccctgagtatccttctctgtctctggtaaccattcttctatgctctatgtccttgagttaaattgttttgattttttagctctcacagataagtgagaacatgagatgttgatatttctggacctgacttatttcacttaacataataacctccagttccatctgtgttattgcaaatgactggatctcattctttttttatggctgtagagtactccgttgtggatacatactgcattttctttaaccattcatctgttgatggacacttaggttgcttccaaatcttaactcttgtaaaaagtgctgaccatcataggagtgtaggtatctcttccatatactgattccctttcttttgggtatatacccagcagtgggatgtctggactatttagctttttaatttctccttgggtagtttatgtcttttaaagaattggcccatttcatcttaaatttcaaatttgtagagatagagctgttcatggtattactttattagacttttaatgtctacggaatcagcagtgacaacctctctttcatttctgatattggcaatctatgttttctttgttttttttttccttagttagtccatttcattgatcttgttaaaaaataagcttttgatttttttctatcactttcatgttttgagtttcattgaattctgctttactttttattattccttttcttttgcttgctatagtcttaaatggttctatttctagtttcctacaatggaagcgtagatgatgtattttagacttgtcttcttttctaacatgtacattcatgctataaatttcccctgagtactgcttttgctgcagcctgcacattttgataaattgtcttttcatgtattcctaaatatttaaaatttctcttgagacttctcctttgacccatgtgttatttagaagtatgttgcttaatctccagatatttggggattttccagctgtcttttctgttcctgatttctagtttatgccattgtgtcttaagagcacgacttctcttcttttaaatttgttattgcgggtcctgcggcccagaacgcggtctgtccttggcgaatgctccacgagagcttaaaagaacgtgaacctgcacgtattctgtggttgctgggtggaatgttctagaaacatcagttgatgaagttgattgatagcattcttcatgtcacctctgtccttgctgacttctgattgcttgatctaccaatgactgaaagaggagtgttgatgtctccagctatagaggtgggtttgtctgttctccttgcagctccttgagtttttgcctccggtgttgtttggaaggacgtgtctggagctgctgcagtaaagctgaagaagtggccgcgtgcagtcctaagctcctgtggcctctcggttgccagcaagtcctttccttggctgtgggccagtgactgtttgcgagaccgcagaacggcgagctacatgtgatcagccgttggaggagcctcttctccccggctcgccagccccacacgcccaccctgtctcagagagacttatttttccttcttcaatgtcgtcaggctttgcctcctgacttaccttggccaatggaacgtaagcagaagcagaagcgcctcttcaagagagtgaaacggtcctggagggagcggctcctccagcctggatgctcaactgtggcaagcgcccggctgacctacaggaaacgcggagcccgagtggaaacacacgtgtgttgtaaactgctgagacgccgagattgctggggccacagcccggcctggcatcagctgactcgaggagaaactggcacctagaattcgttgctgtcacacacaaaacctaaaatttgtggcattggctggggtggggcaggggagggggagaaactataattagaggctgggagcagcatttttatgtggtgaaacatttggcaaaacgaattctgctttactttttattattccttttcttttgcttgctatagtcttaaatggttctatttctagtttcctacaatggaagcgtagatgatgtattttagacttgtcttcttttctaacatgtacattcatgctataaatttcccctgagtactgcttttgctgcagcctgcacattttgataaattgtcttttcatgtattcctaaatatttaaaatttctcttgagacttctcctttgacccatgtgttatttagaagtatgttgcttaatctccagatatttggggattttccagctgtcttttctgttcctgatttctagtttatgccattgtgtcttaagagcacgacttctcttcttttaaatttgttattgcgggtcctgcggcccagaacgcggtctgtccttggcgaatgctccacgagagcttaaaagaacgtgaacctgcacgtattctgtggttgctgggtggaatgttctagaaacatcagttgatgaagttgattgatagcattcttcatgtcacctctgtccttgctgacttctgattgcttgatctaccaatgactgaaagaggagtgttgatgtctccagctatagaggtgggtttgtctgttctccttgcagctccttgagtttttgcctccggtgttgtttggaaggacgtgtctggagctgctgcagtaaagctgaagaagtggccgcgtgcagtcctaagctcctgtggcctctcggttgccagcaagtcctttccttggctgtgggccagtgactgtttgcgagaccgcagaacggcgagctacatgtgatcagccgttggaggagcctcttctccccggctcgccagccccacacgcccaccctgtctcagagagacttatttttccttcttcaatgtcgtcaggctttgcctcctgacttaccttggccaatggaacgtaagcagaagcagaagcgcctcttcaagagagtgaaacggtcctggagggagcggctcctccagcctggatgctcaactgtggcaagcgcccggctgacctacaggaaacgcggagcccgagtggaaacacacgtgtgttgtaaactgctgagacgccgagattgctggggccacagcccggcctggcatcagctgactcgaggagaaactggcacctagaattcgttgctgtcacacacaaaacctaaaatttgtggcattggctggggtggggcaggggagggggagaaactataattagaggctgggagcagcatttttatgtggtgaaacatttggcaaaaccgtcatctatgttttctcgggggcggaaaacataggaggctttgggctgggcacggtgactcacacctataatcccagcacttgaggaggctgaggcgggtggatcacctgaggccaggagttcgagaccagcctggacaacattgtgaaacctcgtctctactaaaaatacaaaaattagccaggcatgatgacggacgcctgtaatcccagctacttgggaggctgaggcaggagaatcgcgtgaacctgggaggcggaggttgcagtgagccaagcttgcaccacggcactccagcctgggcgacagagtgagactccgtctcaaaacaacaacaaccatcaccaccaaacagaaaacaggagattgtggattcaagcaaagaggtttggaaaccaaatgtgactggtgtgtcttggttgctattggagatacggatgagataatacaagaaagatgtgctcagatggaaattgtctggtttgcaaacagccttgaaagaggcaactgcttcttagctccaaccagtaaaggataaatgggagacatgcttgctccacaaaagccagttaggctcaggctggtggcaaaagccaggtggagagtgtaacccccgggggttatgatctctgaatagattaaggtggcagcccagcacatttctttctctttctttcttttctttcttcctttcttttcctttcctttcttttccttccttcccttcccctcccctcccctcccctcccctccccttcccttctccttccttccttccttccttcctcccttccttccttccttccttctttctttctttctttctttgaccagttctcactctgttgctcaggctggagtgcagtggcacgaacacagctcactgcagcttcaagcttctgggctcaagctatcctcccacctcagtctccccagtagctgagactacaggcgtaattttaaaattagcccagctaatttttaaagttttgtagcgatgctgtcttggcatgttgcccacactggcctcgaactcctgggcttaagagatctgcctgcctttgcctcccaaagtgctgggattacaggcatgggtcactgtacccgaccccagcaaatcttttgagtcaggtgaaattttgtaagaagagaaattgggggcattgctctcccaaggaagccccagaagttaaaagtagctgccgtaaagtcaagacagtgagacgtatctcctcacctgccgtgaactgcccaaaacagatgtgaagccagccacgtgctgagggatctgcacacccagctttgccttgcagtgactgcgaaggtgcaagatttaaaaatcacgtctgagcctccagcgttctgtggacagaaagcaggagtggtgcgggctccctgaggacataatttccaatatcctcttcagatgtagcccagagggtgatggaaaaggaagaacctcccagaggcgagctcggtgatgggccagtaatggattaggggctcacaccacggactggagtcaggtatgttgatcagccccctggggtttgcctgggacgtcgctggcttcaacactgaaagtcccacctctcaggaaacccactcgtcctggtgaaccgggccggatggtcaccatgagagcctggtttggaaacattccccacgcccaggtatggggctctcaaaaatctctgcccagcaggagcacagggctgccatccacgagcgaacacagtgccgccctttccctctccaaaaggggtgcttcttccgtccatccggggtctgtcccgccgtggtattttgtgttgtgagtggaagctaacgttcccttttagctcctggatcgggaggagatgtgttcagatgggaggctgaggctgtttcccacatgttctgtgtgcagacgtgaggggagtgaacatgaatggtgaggtgtgtgggctgctgggttatggtcaccaacgtggactcctcttctgggactttcccgccttactcacagcagtcttaaccacgcgactcgcccagagtgagcagatgttagcagcagtgggccgggctgtgtccagcaccaacctgaagagcaccacgtggtcctgccacattctttctccctcggctgcgggagggcctggatcccaggagagagaagatgcatggggcagacccatagccacctgccgcctacacggaacaccagccagaaaaaaaccttgtgttgaaagagagatcagaggcattgctcagtgattccaatcctgaatcgctgagcttctggggatgtttgtcatggcagcagaatccagcatagctgactaacacagaccatgccactaccttctcctggagaccctcactgacttcaggctgacaagcacaggggcctcctgcctccccttgggccagtcctggccttgcaggcaccgtctataccctgactctgctaccctgcacattatcttatctgcctccttttctatcgaaatattttaagcaaggggagaaacgagggtggagcagcaaccagaggagacccttgcccaggggatgcctgcccggggtctgtcctgggcagggagcagcacagccctggtggcttgggtaatgtggcagccccctccccaggagtccctgcactggccactccaggcaccaggattctttttgccttaatgaattcccctcaagtctccggttagaagtttcctgctccaatcttgaatatgcatcttttaaaatactctgcaaatttgagggcctctcatgtatcatttcaatcctccagctattagagaaattggggtatcatatagattacggaaaaattactttgggcagagaaggaggtagaagatcaaacgcttatctgtacaaataaattcagtgcgatccacaattaagcagcatttgacatttaaaaaatatttgatccatgttttggcttccagagctgcttaagggagctgcgatgtgtaaattacattcaaatcagggttaaatatagttcccagagaaagattgtatgatttaaattgcctaattatttgggggaaaaatctgttctccaataattaagagaatgaggatgttcgacttattggggagagagatcagaagtggctattcccttctgggagaccaggagatgctggcttggggaggggatggtcacccctctggggtgggggcaggcgatagagacccagcaggcaggccccaggcagggggaagaggctgcccttatctggccccaggcagcctgctggggtctgtggccaggcaggacacccagtgctcaggaaccaaccagaaaccaactagaaactggcagtctgggtgctgagccaggggcccgcagccgcgccaggcagggagtgggcgccagctctctctggcagggctggccggcatatgggagcacccaggctggggccagatgcctcgggagggggatttggcaacactgagagccagcaattagttaattagctgatatgtcttaaaagtcagtgtggggaggggtgtggatggcagcctgccttcaggaaaaattccaaaccccagcagcccctccctccagacccaagagtgtgtgtgtgtgtgtgtgtgtgtgtgtgtgtgtgtgtgtgtgtggccctggcgcagcagacagcacgggcccagctaggcagcctctgatccctgcttgacataagtgcacatgaggcgtgcaacctgggccagcgcagaagggccctgagcccccgtttcatctgtgacatgggacaaattgccacacctttcagtccgcgctgaggattaaatgtcagcatagacgggagtgcagtggtcagaatctggaggcagacctggccctgtgccctctgctgtgtgaacttggacaggttacctacctctctgaacctcagctctcaagatagtaagaacagtgacctcccaggctgcttggggggttcatcgcaaccccattcatgagggaggtttagccaggtcagtggtcgggcaggcagcaggcctgggctcctcacgccgcagatacccactgatgacctgtgaggggcctggtgtccgtccaggttccaggacatccacaaaggggtggcgaaggctcctgctcaccttcaagtgtgaaatcgggtcattcacgaggaaacgggatctttgcagaaagctgtttggcgcgtgatctagaaccacaggttccgcgggggagcgggggcctgagtcggaagaggggctgcaggccgggaggcaaggaggagccattcccagggtgggagaagagggctccaagcagaggctggtgggggcgtttgctgtgttcccggaactgcggggggccgctgggacctggcaaatgatgggaagccatgggtgggttttgagcagggaccgctgtggtctgatcagattgaagggaatggcactggccagggaggaagcagggagcggagcagtgggctggggccagacgaggtggtcgcagtggacaagtgtgcacgtgtgtgtacgagtgtgtgcgtgcaagtgtgcatgtatgatctgaatcagtctcctgactgcagccgcccgccacacacacctgcctgtaagatagagaaggcgggtcagtgtggctgctgacttttggggatggggcctacggggcttgtggagtgattgggtggagggtgggcgttggggaagaagcccagctgcctcgtgcctgcatcactggcagcaactcagtgccctgcggggcacaacctgggtgccactgcccagtggcgggccccgggccatggggagggtgccctgcaggaagccctgtacccagtgctgtgatctgtggatgatgcacgtccaggccctgggcccagcatgcagggctgccccagtccagcacacaggcagctcccgagggtctgggccacctccactcagcaccagggatggtgtggaggctggtcctgggctagtcttggctccagaaagcttcaggggcctgaggtgacctgaggctgtgctaaaattcctaggccaacctgccccgcagggcagagctgaaggtcctgcctgtcctggatcccaggccgtggagacgcgcgggaagagaggctgtggtaggcagagttcaggtctggggacactgaccgcggtgtcaggtcacttctctgccggcctaggcaggaagggaacccagcaggcagagccagcatgggatggcggggctggacgtctcaggcacgatcaggcccacgggaaagtcggaggtcagggcgccagggcctctggttgggggcttcagaggcgttgcagtcgactcctggagcagaggtgagtaagcccctgccgccctccccctgctcacagcctgacctttgagacgttcacgctcagccacggaccccgagagccatgtaagggggtctgaagcctccacccccacccagcagagccaccctctggccccagactgagcccacccagtgggtttgcccccaggtccctgctgctgttgtgtgcccccatgtcttgaaggacacaaacagttgagtggggtgggtctacctgcaatgctccgctccctcccatctgttgagcccccaccccagcatctgtctgagtgaggagatcatccctgagcccccaagccctccctggaggccctgaagggacagcagtgcttggggggatgcaggaagcctccctctcccctctgctggtgtgcacatggcttggacatcctgcccctgcccctgggggaagcgtgtggagcctgctggtggcttttgggcgggaggagtgtgagctttcattgcccaagaatccaaagggcagagcatggagggaggcgtctcacagcgccagccctcacagagccctgtggccactaaggccagcgggggcccttgccctctgcctctgcctcaatgccagcggtccttgaggctggtttggctgcccctgctctggtcatgggggctgagggatggcagcctgtgctggggggcccatgctcacggcctccatgctgtctgctgacctacactggcagggcccaggcttcctgaggactttagacatcctctcttgtccctgtcatccatggagccaggcctgggtggggcacttgcctccaagagacgccctggagcctgctctgcaacgtgcccattctgtgtctggggaatgagaaacactgagaccagctgcctgcctgcacgcagcgaggccactgaacgccaaggccaggcctcctggggggcacctggggttcctctctcacctcttccccaagatggaccattgccaaggagctcaggtgctggggacacttcctgggggcgatgcaatgaggagagggccgtgtggctgggcctaggggacctccagctagcctgtccccgtctttctcttctgccctcgggtgggccagatctatgccctgagactcactttgccccaaagcacctgaaaccccatatgcctaagactctctgctgggggaggccccttttcttcccatcccagggagaaaccaggagccctggctggtgcgggtcatgtgtccactctgggatagcccactccggccacagggcaggatgccaaggcctgagccccaggaccgtggggcaggagtggaggcagaggcaggcagtcagggtggcgtgttggggtggctgtgtggggccgtgagcacacacaccacacgggctctccacatcacccgaggcatggtgggcatgcctccctgtgccagccctgctcctctataattccagggcacacggagtggcatgccagcatgtcctctgacccttcctgtgtgttcagaactggcttcactcactttgggcttcctggttcctaggagaaggtgcaggaggtaactttggcctctccaccctccccagcgccccttggcatttgaacgtgtacgacagagagagaaagagagagagagaggagccagctggcacggggtcacgtctctctgtcagagcgcagtgagcactgctggtcttataaaacctgcgatggtaattgaatccgggcaggagtccttgatgggggctgttaaacacaggagcagggctgggcttgggtttatgggctcccggttcccagctcctctccagaaaggccagggctgagcttctgccggggtctggacgcgatggagcagggggatggacgcgatgaccccctccccgagagcagccaggggactggcctaggagccacagtctgtgcatttccacccaggggctcaggaaggccccgggaactggctccctccgtgggcgggtggtcacccttccatctatgctcccgtggcctgggttccgccctgcagtggatgggggtcggtgctgtgcctgctgctaggctcctagaggaggagacggtgggacactgaccttgtggaacgccaggaagggagggagcccaggatgggcagctgaggcccctggggtggtcaggccagtgctgaggctgggggcagagaaactgctgcccgggagggcggagggggcgtgtgcagagcaggcgggagtgttccctgctagtccagagaggttgaccgttgtccccagggtggcctggcacacctgtggctgtgcccaggtaggaaggctactgtgccttctgggaaggctgctcctgaaaaggacacgtcaccaggcatctgcccttcgaggggcctgtgccttggaactgtggagctgtgacctccctgcagagctggtgggggtggaagcagcactggcacacctggctgggtgaggggagccggggtggtgaattatttagagtcgccaaaggtgttgagttagaagctaattaaacaagctctccgcagagcagcactgtaaaagaatcataaaattccaatctcatttgttctgctcggcttgcacaggcgtagcatccccataaaaggcagccagcgctgcacagtctgtgggcagcttgcaagtgtgcggccttcaggggtgctctgcagggcagtcctgcctggctggggctgggccaggctggagaaagcactgggcatgtgctggcagctgggaggctgcggccccccaggtagccccctggtaggggcggttctcactcagggtgaaagggggacctattgtggaaaggtgaggtggtttcgctagccagcaggtggcccagggcccctctgtggtgctgctgtcctcctgccttgggtcttggaatgaggccttctggtgcccaagctgcagtgggcaaagctgctgcacccttgagttgtcgtgggtgggggcgagaggctgggcttgcagaggaaggggaggggcttctccgtactgggctgagagaggactctggggtggcggtgtgggccggggccctgctggcctctgcggtgcacctgctgtgtgcagctctgcgccaggagcccagactgcaatgtgtgcaactcccacacatctgccatagcttgtccagcagagctcagcagggggtctgcctctctgacacctgagggaggggtgcaggcaggaggggagggggctggtgcttctaaagcccgcccactcaggcatggggaggtgccctagggctcagggtgaggtgggggctcagagctcaggcctgtgtgaggggctgcctaagcgccaggctttgctgcgagaggttcaggtgggtgtgtttaggcaaatccctttagcatcagggaacttgggctgcgtcctctgcagcagacgccgtattgcctcctggacctccctctactgtgcctccgtttcctcgtttccaccattgtcacggaggcagcatgactggtgactgcgagggtgcaaggtgctcactgcgtgctgggctccctctcggctggcagaggctccacatgcccggcaggttgcagtttgcagacagagctcacatggtttccgggacctgtgtgtccccgcagcgctccagggcgtccactcagttgaaggatgggatgggacagctggaggtaaaatgggcaccagggtcattcatgctacagccgggtctgtccttctgggtctctgaccttccagaaggacagctctgccctgtgggcccctcggcactcgcatgaagcctctggggcctggaccactcccgtcctattgagggaggatgcagggtggaaagtgctcctccagcaaggatgaaggaaaagccggtggccgtgatttgccattgtcactgtcacctggatgtcctgagaaccccctggggaccagccttggaaggcccagccttagccggagaggcagtgtctggccgtcctggtagatggcccagctcctaccctcatcggcagttgggtttcatgagcctgccatgcaccgtgcgtacagggcaggtctggtcacatctggagtttggagagcccagctgtgcccctcctgggtaggactgggggtcgcctaggcctctctagagctctggaggctgaggcagggccgtgagcagtggccagggtcctagtgcttatctgggatccacagtccagctttgagccccacacacagagcccaggagcccaggcttcatctgcaatgacaggcaacaggcggacaatgtgggcacccggagcgtgggtgtgcctgctgtgatttgttatcatctcagcacaaaacaggctgatttctccagcctgggtggcctgccgtgtggtatggggctaggggacgccatcatgcggcatgtcaggcctctttgtctcctggttggaagatgttgatggattctctattgcttgtttgatcaaattgtccagaacacaaagggggagattgcggcaaaagccacatttggaaaaacaattcctcatcctgacagcagtccctggagagagggctggtcccgctgggtccccagcacaaagaccacttggaaatctggctggcaggcgaaacctgtatttagggccagagtgggctccatggccaggagcaggacaaggagaggcagcccaccaaggaagatgccctgagaccctaccctgagattcaggatttgttgcaagtgtggcctgtcatatgggagttacctgcaagttcatgggcagaggaatgcagaataaagtggtgtgatctgccattcaggctcctgtagcaaaacaccccgagcagggggcttatacattgagattgacgtctcccaggtttggaggctggaggggcaaggccctggcagacgccttgtccgtgagggcaggctgcttttgttttccagttcacggatggccgtcttctggctgtgtcctcacatggaggacggggtgacggagctctccagggtgtctttgttaggtccttaatcccattcctgagggctccacctccatgacctaatcaactcccaaaggccctgcctcccagtagcatcacgttggacatgagaacttcaacatggaatttgggggtgactcaaacgtggagaccatagcaacgtctgccctgcaaatactacacagcagataaaaagatgagctaggtcctcagggaaagacaggcgatggccatagcatctggggcattctggccgcggtaagcatggattcaacatgctgctccttgactcaatagacattgggtcttgttggtggcacagttccaggtgggtcttcctggttgagggcccagggccttccagggctctgccaccctgttgggtctcactcctacccgaggagggtggagaatcctgacgggtggtggaaatggccacatggagctgtgaggggtggggagtgtggctgggtcatgtggacacacgcaaaggcagcctgggtgctgcaggcagtcggccctgtcctcaacagtgtgcataactgagtcactggggaagaaaagagaaaccccagagtgacatgtgccattcaatgccatctaaggaaacacacaaagcacagctgcgttcccccaaacacaaatgcatgaggtgcacagggaatgttctggaatgacacacaccagtgggagaagggctgtcaccctggggaggccacttggactgaggaaggggaacaggggatttcggtgtctataaagtttgaatttttattatacaaatttattcacaaatcatttgcataattaaaaaaccaaacttgaatacattttaagagggttggtgataagaggaatgaattcacaagtgtggtcttacggggggcattggtccagcagcctggccatctccagctctccccttcaagccacctcccaggcccccagggtgtcaggggccccaggccaggcaggtgaccggagctttccagttctgccagactgaaggggtgggcaagggggagcaggtgcctctcccatcccatggtcccagctctcaggcaccatcctccacggacagcccctgcgacacctctctgggtgtagtcccgcactgtggactgatgctggggcctggccaggtgcggaacatgggtgatggagccatattctcctctctcccaggattcaagtctgcaaaatagaggggagacccctaggagcttggggactgcggaggcccctaggcccaggtgagtcatgccaggctgcgctccagagggcagacaggaggtgatgtgggcctcagggctctgatggtagcagctgctggagaaagagtggcatcaaagtggaactgggagagggctggggccagctgcgatgcagggatgggtgaggtgctggctggctgggaaccccagcctgtgggggctttggcggtgaaggtgtcttccggtggaaatgtcttgggggaggtggcctggggcagctcagaggctggctgtgtcttcctggccctgtcatccttagcatggggcgtccagagttgttgccttgtggaccaagacagcccacagcccatggcagcttccagagccagaagaagaggagtcatctctgaagagccctggactacctccttgcggatctcattggccagaactttctggctctcatgctcaccacaaggccaatcactagcaagataaaaaaggagcaccccgaagggccgagaccagctgtgcctccgggcaggggaggggctgccccttccttacctgaactcaattcattttatttttattttttaacataaaaggcaatgggaattcagtgagtggacagctagccacctctgtggctgcctgccgtgtgagcacgggccatgttctatctttgatctcctctgtgaagcgggaataacagcaggggctaggttctgacccctcagacctcacccctgagctttccaagcctgcatccatttgctcttcatccctactctcaagactttcagcatcccatctgcagatgaggactcagaggccccaggttccgtagctgagctgaggggccagaggtccagcccagaggctgttggctccgtggaaccccgggagctcccggctcccagtagtgcatgaatgtgcatgcgtgcatgtgtgtgaatgtgtgcatgcacgtgcatgtgtgtgtgcatgcatgtgtgcatgtgtgtatgtgcatgtgtgtgcacgtatcacggacaaatacacattaaagtatgagtggcacggccgtcccccctccgtcattcactcacagccacatatgcatatgtgtgtgaatgtgtgcatcgtgcatgtgtgcatgtctgagtgtgtgcatgtctgtgaatgtgtgtgtgcacgcatatgagtgcatgtgtgcatatctgtgtgtgtgcatgtctgtgaatgtgtgcgcatgcatatatgagtgcatgtgtgcatatctgtgtgtgagtgtgtaactgtgtgcatgtctgtgaatgtgtgtacgcatgcatatatgagtgcgtgtgtgcatatctgtgtgtgtgtgcatgtctgtgaatgtgtacatgcatgtgagtgcatgtgtgcatatctgtgtgtgtgcatgcatatatgagtgcatgtgtgcatatctgtgtgtgtgtgcatgtctgtgaatgtgtgcgcatgcatatatgagtgcatgtgtgcatatctgtgtgtgtgggcacgcctgtgaatgtgcgtgtgcatgcatatatgagtgcgtgtgtgcatatctgtgcgtgagtgtgtgcatgtctgtgaatgtgtacatgcatgtgagtgcatgtgtgcatatgtgtgtgtgtgggcacgcctgtgaatgtgcgtgtgcatgcatatatgagtgtgtgtgcgcatatctgtgtgtgcgtgagtatgtgcatgtctgtgaatgtatacatgcatatgagtgcatgtgtgcatatctgtgtctgtgtgcatgtctgtgaatgtgtacatgcatgtgagtgcatgtgtgcatatctgtgtgtgtgtgcgcgcatgcctgtgaatgtgcgtgtgcatgcatatatgagagtgtgtgcatatctgtgtgtgcgtgagtgtgtgcatgtctgtgaatgtgtacatgcatgtgagtgcatgtgtgcatatctgtgagtgtgtgtgggcatgcctgtgaatgtgcgtgtgcatgcatatatgagtgcatgtgtgcatatctgtgtgcttgagtatgtgcatgtctgtgaatgtatacatgcatgtgagtgcatgtgtgcatatctgtgtgagtgtgtgtgggcatgcctgtgaatgtgcgtgtgcatgcatatatgagtgtgtgtgtgcatatgcatgcacatgtatgatgagcccagctaccaaggcacctgctaagcacagcacccgcaccctggaaaccctcccacatgccatcagtgagggtcatgagtcagcagatatgatgtgcctgacgtcagtgctcctaagagaagcctaaacaattttcataggaaatgcacctagggactgcattgtataaatgcaacactaatgacagaaaatttcaaaaatactgtgcacaaagaaaaatagtctcccctgttatcacatcccccatgtcacccaccgtaaacatgttgatgtcaaaggctttcgggttttgtctgtgcacgtgttcatgttattaggtcatttttttttctcacaggttgagactgtgctgcactgctgctttgtaaacctggaagatttttatcgtgaataaatacctgccgcaacaatgcctaatgcttttgtggggttctgttatttggatgtgccactggcggtgacggctggcccctgggtggccatgtaaggtgcttccaaatctctgcgatggagacgtcacctcagctgcctctccagccacgagtcctggcacctcccctgcctcctgcttcctgctgctgcttctcagcccccaggcacattcctgctgcagggcctttgcacatcccgggattctggggctgtgccctccccaggtcttctcacagtctgtctgtcactcccctggggcctctgctccattgtttctggtctgatgataccttccaagtcagtcctctggagtggcacattcgggccacatgacatgccggcctacactgtccccagggacggtggccacttgccctctcgctgcctctcctcccatgcccacctcccaaccctggccagtgtttgaaatctccagttctggattttttttcaccccccatggccagcttggtgagaaatgacttctcattgttggagtgtgtctggctacacgcgattgtgtgtttctgtgcctcttgtcatttgcccttgttttatgaattgccactttgacctttttgctcatttgtctatccagtgcctatctcttcccaatgattcctgtgttctcagtgtaggtggctggggatgagaacgggagcttgtcctcccccatgctgagtccagcattcaggatggagtgacatctggatggccatcagcatgcaccggggctggggcttctcgaggtcagcagggtttgagggttgtcagggctgtgtgccaccagggcttggcaggtccccaggtgtggcgtttgccatgctggtgtcccctgcgccacggcacctgttccctgtgaccttcccctgttcctgcttctcaggtgaaacgtggcctggaagcttctggttatgtggaagacaacagctatagaggcctccccgtgacctcagggaccaagggctgtggagaagggctcaccgggtgcagacaggggcaggtggcctgggggtcccgagccatgacatcggtcctctgtttagccggaagggtgcctgtcattggcaccagcaggcacaggaaggagggaccttgtgtgatggcaggtggaggggtctgcatgtgtctctccctgccatggcaacctgtctgcccccgtccaccctgccttcaagtgccagagggtcaggggacagcaagggccacggtggcagcaaggaccctgcagatgttgccctgcagtgccctggagatctgtagacctggggccccacctgcagaagccaggcctgtgtgtcaggtttcgggggctctgtggccggctccagtgccattactgaggctgataactgtgccccccttcaggggtccctggggcggccgcttactcctggctgtgcaaacaccccttctttcccgaaggccgccagcctcctctgtcttgctaatagcctgttcttttaatgatcgataatcagtgtttacccagagccttcaccagcagctcctgacgcttggcttcattatgcatgcaggctttgcggaagctgcttccagctgcctgtgtggcctgctgcaggggacgtccggctggaggtcccaccttcctcccgccttggcccagcaccctccaggcctcgctcctggcccctggggcggcttcaggacgctagggtggtgacagcatctcgagaccccgcctgggcagacctcctcctgtcagctcctcctctgtctaaagagccctgcttgctgggaggggcagcacctgcctcgctggacaatgtccaggacacaggaagcacccgatcaattacagccaataaaatgttcagtaatggccactagcatgtctgcaagccggctgtggtctgggtactgtactggacacctcatgcgtgtgtcagggacaaatatgtattaaagtgtgagtggcacaaccatccctccccacctctgcctccaccacctcattccccctccacctccgcccctccctgctccccccccgcccccccacctcccgccatcagtgggggctcttgctgctgttcggctctatggcctttgatagaacccggcgggtggtgggttttggagcagaagatgcccaagaaggaagagaaggaaaggcacacggtgtgggtgggggagggagggggctgcagtggcagcgggagaggtggggcagctgagagaggaaggtggaggggcgggcacttttggaggcagaggtcaccaagggccttcagctcctgcctggggccaggccctgcagggcctcccagcgcagccctcaccaagagtcactggaaatcaagacaggccccccccccaccttacttctgccaatttagagttagatctgtacttgtttctggaagcttcttatgtgagggactggctggaaggtacatgtctggatctcaccctcgcccagtgaccgttccaccttggccagaaggtgctgatgtcatgggccgagggcctgagcgagggcctgggagtgcccaccccaccctctgcagcctcctctttcccacagcctctctgtcctccagtatccagaggccctgagctggtcaccccattgtcactttgtgttactaaagccccgggccagccatgccaccagcgttttggctcccgcgtgttggggcggggcccggcagagctctcggggcggctgtttggagtgggcgcagggcacacaggcacgatgtctctggtcatctgttccaggtgtccacaacgttgatcagctttgagagatcacgtttctgcgtttctcagacctgccttggaaggggtcttgctggggccgggagaggggctctgctggggaggggggctctgctggggaggggggcaggggtgtgggaacgggggtgtcgacagctgggcacggagcagagtccctcagacgtgctccccgcttctccccgtgactcgccacctctttctgaaagtgggttttgttctccccagcatctgtggtttctgatggattcgaaaatatttaataaatatttggcttccattttcaaaatgttctgtgctctttttaggtttccttatggaaagagactgagatattcttatttcaactcccaggagcccatgggtgccttttacttcctcccactcttaccccagactgcctggtttgtcctggtttggaggtgaaggctctggcccggagctgcagaatcggttccccagggcttgcaggagtaggccaggggcctggagggccagggggctgcaggggccaggggactgcagggaccgggggctggagggacccgggggctggaggggccggggggctgcaggggccatctgctgccggccttttcccttgaaaacaagccagtgcttcatttcccttcttttagcagcaggtgagctggccgggggcctcagagcgctggcccaggtgtgagggtcacgcttctgcggggacgccagccaaggctcacccatccccagagatgtcctgtgaggccccagcgtgactcagagcccaaacgagattgtcttgggaggtgcagagttgggagatgcaggctgagatgaaccccgggggaggggcaaggccaggcagaggtgagtgcagagagcaacggagggagggggctgccaggaaggggccctgggcaggatggaggctgtccacagcagcagcctggttggtagctgggccctaccctcaggcctcctcctccaaggcaggacggagcagtggttaggatcaccccatcctcccaaagcaaaggcatcctctgttctgggagctgagagcaccagggagcttcctcctgctgcctggcccgggtgagtgtctgggaggggctggggcagcctggttggtcaccagagtgtggtcattgtcatctgcatcccggggtgagaaaggacaagagggctgccctctgcctccctcccgtgctccctgtcctgaggctggcggctgtgagagagaagattgtcgctcagcaaacactatttcctcatccactgtccccattgatggcaggcttggccaccgggctcgatttagccggaagtggccatgtgccagctcccagctgagggctctggtgaccctcctgtgaagagcctgccttggaggctgcagtcccaaggaggaggctagactcagccctcgtcctccaatgcagctgcaatgagcctgctcctcctgctggtggaaaatgcaggtaggcacgtaagccaccaaccctgggggctcagtcaaaatcctgaggacccccaaggggcagagccgatggggccttctgaccagggtgcccagaatggatggcactgggggacacaggctaattgcgggggaacaggtgaaggtgggtgaagcagctgcgtgtttggggcagagggagaggtattgtgagggttaattttatgtgtccacgcgactgcagacatttggtggactccgatttggggtgtgtccgtgcaggtgtttctggatgagattcaggctggaatccgtagactgagcacagcagatgtccctcccccatgcgggtgggcctcgctcaatcagatgaaggcatgacgaggaaactggttgccttgcagccgggagggcggctgctttcctgctttcagatttgagctggaacatcagctccacccaggtgtcgagtctgctggtgtccggcctgatttgccaccatcagctctcccagggctccagcttactgactcggtgcaggtctgcggactcagcctccatcattgtatgagctaattcactgcaataaatctctctttccacggcctgttgattctgagtctctggagaggagagtacagcagcagtgggtgacagacaccagggacctcattggcactaaggattgtccccgaccggaatgcggagtccgggctgaaggaggtgactccccacctccctgccctgccctgtggtggggatgggtggggggaaaatgcccagttcctgagctggactctgagtgacagtggccctggttagtgggggccctctgctgggcggtggccggagggagacagggtgccaggccgggagaaatgtttagagggcatcagtgccaacttcctgggcacggtgcaggtgtggagagagctgcccccagcctgagaggatgctgggttgggcttatctccactcggaatcgagagaactcaccgtccccagagccggactggctgccatgggaggccaccccacgagaagagaggaggagccgaggcctgttgctgagggttgcggaaggcaaggaggaggacacagaggggcccttcccaggcctctgttatcacggctcatttctggagtcccagagccgggcagagccaggctcagcacagcaaggatgacggcccaagtggaagcactggcagggagagctgggacagacgcagccccagacaggctggaccccagggacggtaaagggtgcacaccgcttgccccactcgtactctgcgcccagcagctccctggatggtggccgggcaggaggctgtcctgactgatcccgcaaatgtatttacagctattgacggcctgaacgtggcctattgatccacgcctgagcctggccgggcggcgcgtgcacttggccagggcagccctgcgtgacgaatgggcagctcacagcccaccctctccgacaggtgattgtttcagtgaaaatgagaaatgatgatcagggcttaaggctgatgattgaggaagatttccagcgactttgcaggtcgtctcggtggtgctaatagccagggcctcctacagagaggcatgttccccgactaggcaggtcaccatgaatgtctgcaaagacgctgtcctggcgtggggacccgggcaggggcacaggaggcacagacgttcctgcccctttccctggctgggttgcgctgctgaggtgggccaggtggggttcactctttctggcttctaagggggttccagaccccagatgggcctggggaaatgagggctttgtgtggacagccccatgggagaggggctgttcccagccctggtgcccgcctgcctagtcctccctgggactctgggcccagccttatcattcctctcttctcttctaagatgaaaagaggattcctgcaagtggagacgaatcctcgggcccctgagctgcaggtggtgaacaaggagctgagggcctgctggttccccaggagggcaggcagggctgtgctaacgaggagaaagaaccgagtgaaggaaggcacggaggtgccagggagagaccaggaacctcctcagcttcctggcttccttcctggcccaggccccctattcccggggccctaggctgggctgaggtcccctcgccctgtgcagggcctggggctcaagttctaccagctgtagcctggggcctgaaggtccatctgatatttgaaggactcagaaggccctgggagggtgttggcaggagtagcctcagtgttgattcctcgatggcccctgagccaggttcaggagcacagagagacgtgggtgccacctctcccgagcttggagctcactcttgggggttgagatggggccaggaaggggttaaagcaggaagcatcttgcagggctgttaggaaaatgatattctgctgtttgacgtcattttaattccatttcaagggcatttaatcttatttgcccgatgactaatccccggccttgagtgaattaatgtgcggccccttctctgaggggaagcgggaccctttcagtggagacatcgcgtcaccgcgtcccgcctcttgcttggcttggcgggcagggctcctggccagaggcgggggcagccactgggtgggggctgtggtgaggacctgacccctgggtgaggaagaacgactcggcatctccttagccctggaactttccagaagcgtgcctgcctgcagtttctcctttgtgcctatgggcagaaaatgcccatttcccaggcccaggacaaaagctccagaactggatgcttcgaggcaggtgcagggacccaggtggcagggcggggagcagcgagagccagctgctgcatgtccagggctggtccacccaggccacccagcaggggcctcagccagggccgcaggggccgtgacaggtgctggcatgcaggaaggagtcaccagacttgtccacccagttggagagggccaaagagaaactggaaactgaggcacagccgggcaggggcttgctagatgcatttttcagaagggcttgatcttgtccctggactttctctgtgatcccaccttgactttcagcctcacggggctgggaccccctcccctacccccacccctgctttgccttcagtggccacaggagaagaggacccatctgccgggtgggcaagctgaactgtcacagcccccacgcagtcccacgtcccctcttgctcaggccacagacatgcacaggagatgccaggtcctgtctgccttgaagagtccaaggaaaaactttctcgttgtaatttcgggccttggggagcctctaggaggaggagagggggccagggaggctctggtggatgtgagtggagtctcgccatgtggacagccctatgatgggtgaatattccagtcctcacagtgggtgaggctgagtggtggctcctggggaccagagatggtcctggcttagctcttcggcagcagcctctgacctgcctgtgctcagtgggctccctcctgccaccccacagggctgggtgaagcttctgcttggaacatcctgcccccggcctgacccttgtggggtgatgggtccttccctgaatccaggctccccagactttaggggcccggaggcctgggatgggggagcaggcagggccgcagccccaggaggcgagatgccctggctaccttcctccacctgcccctgcatctgctttcacctctgctggtgcctctgagctttgaggaacttctgctgagtgctttaaccacccacggcctggacctggttgagcttttgggtcttctgggagcgagcatgtcctgtgagtaccccagggtgtgatttgcacgcaagaggtctgtgtggaccacggggggctgcaggggctgcaacctgggcagcctgggcttgtgggaactgcagcagctcccgggccttcccaggtggtctggcagggactggaggcataggaggggctcaagatgctcgttccaccagaatgagcctcctaacacctggacaaccaggtggcacagaggtcaacctggtgactgaaggacagtgtggcctgcaagttggagatgttggaacatctgggttaatcagaatggccctacaagcacagccattgtagctggcattggggttgaccccagcatccactgtgccccagtgttgccctgagtctgtcaccatggcacctacttccttgccatgggcttggggtggcaaggtgtgaaccagccaggcaggcttgcccaccctctgtgggctgcatgggagcaaggaaggtcatacttcatggtggttggcagccaccgtctgctcagagcggcccctacctgacacagaaggcagtactgagagcggtacttcatctgtccatccaccaatccatccatccaatcttacacccacctacccatgcttccatctacccacccatctgtatacccatttatctatccatttacccatctgcccacctacccatccatccatccatccatccatccatccatccatccatccatccaaccatccatctacctttccatccatccatgcatccatccatccatccacccacccacccatccatccatccatccatccatccatccaaccatccatctacctttccatccatccatccatccatccatccatccatccatccatccatccatccatccattccatccacccatccatctacctaaatatccatccatccatccatccatccatccatccaaccatccatcttccatccatccatccatccatccaaccatccatctacctttccatccatccatccatccatccatccatccatccatccatccaaccatccatccatccatccatccatccatccatccatccatccatccatccaaccatccatctacctttccatccatccatccatccatccatccatccatccaaccacccacccatccatccatccatccatccatccatccatccatccatctacccatctacctttccatccatccatccatccatccatccatccatccatccacccacccattccatccacccacccacccattccatccatccaacatttactttgatcccgctgcattcctgtactcagactgagtgacagttctctgtacatagcgtccagggtggtcacagagggaagttctggggtggggatggggcaggctgtggcaactcagaggaagcccctggccctagccaggtaacaataaaacaatattttttttcaaaaaaagccacctatgaaatgtgttattaaacccaatttaatacaaatgttttgaaagtccttgcatatgaaatttgaagactaaacgattatcctttgccagatccctagtttggttctggaaagtagagtctgtgcagctcgaggaatttcttaaaaatttccttagaagttctgacaactggaactgggtccccagaggcagctagaaacagggtgggtgaggattctacagtgataataattttaataaaaaatgctgtgactttatttgggtaccataggcatggagatctgttttgccaaacagtgaagcaaaaagtctgagcgtgctgagctgctctgtttgctttcagctgtgtggcactggcaggcaatgtgatctctctgaaccccggctttctcctgggcaaacggggatgctggttccagcctgcgggtggctggactcaacaggcattgcttgcatcctactgtggggccactccacaggcaggtgttgcaggagagggactgagacgcatcaccccaggtggccgtgggcggagagcgctaccctcgcgtggcctggtctgtcccagctcctggctggccccggtggaggagggcagggtgggttctctgcttcggcagggagctggctctgctgttattgggttatctcatttgcaaacaataaatgtcatgagcaggagacccttgtcagcctccccttccaggatgcaaatgtagcctttatccgcctctgccctttattaaaacaaccacggagccagcggacaaacaagacaattagctgtgaatgatgtcatctccttctactttctgtaatgaggcccaggccctggcaagggtggtggcggaagctgggagaagccaaatctgattaaagtgcgatcaagaggcaatgctgacctttcgctttcagccactgacccagcgcctgagagctggtgcgacagttgggacaacggtgcgatgtcacagcgattacctttaaccaggggatatagactgtcccccgtgaggaggcaccagtggacgtcagtccccagacccgtggggtgcgctaggcaggggccgggtggtggccgagctttgacacatctcctggggagggcacccactgatgccactgcatggtgccactgccaccatgactattagtactacaatggccgccactgctgtgtcaccaataccaccaccactgctaccattactaccaccaccaccatgactactactactaccatgaagaccgccactgctctgtgaccacggccaccaccaccaccaccaccaccaccaccaccaccgccaccaccaccaccaccaccaccaccaccaccaccaccaccaccaccaccaccactgctactattttttttttttttttttttgagacggagtatcactgtgttgccaggctggagtgcagtggcgttatctcggcccactgcaacctccatctcccgggttcaagtgactctcctgcctcagcctgttgagtaactgggattacgggtgcgcaccaccacgccgggctaatttttgtatttttagtagagacggggtttcaccgtgttggccaggctggtctcgaactcctgaccttgtgatccacccgcctcaacctcccaaagcgctgggattacaggcgtgagccaccgctactattactatcaccgccaccatgactactactgctgctgtgatgagcgcccctgctctcctaggaccaccaccgccaccaccaccaccaccaccccggctataactaccactatcactgctgccactgctactgctatcactaccattactatggtcaccaccacctgtattaataccactactactatcactcctgccactattaccaccggtagtgctgttactgctaccactgtcaccagcacgtccaccacccctcctactcccactggcaatattatcactaccaccactgctattactatcaccctcctgcacccccactgctactgttaccgctgctgctggtagcggtggacacactaaccacgtggacgacctgccaggacctcctaagcacacggtactccagctgcctcatttcctggactcacgacggtgctgtgatgagctggtggccacatctccatttcacacaggggaagctgcaccagggccctcaggggatccgccccaggccgcatgggcggggaaggggagctgagccggagccactccacctggtgccgggcctgtgccctttccagggcaaccgatgtctcagagtcctggccccagagcagagagcctctgcaccctggaaggtcctgcttgctggagtgaggggcctgcgaggaccggccctgttctcaagcccagccgtggacctgcgtgggctgcctggcgggcctcattctctctgcagtgggagaaatgtgcagtcaaccctgagcgaacgtctaaacctccaaacacaccacgactttcaaagcctcattttctatcccgagcagcctcgctctgtgagacgggcccagctgctgtgtccgtggccacctgcctggactggggttggctgctgccgacacacatgtgctctgtgtgagtgcgcatgtgtgtaccacggttgtgtggacaggagggtgggcacggaccctcggggtgggttctgtttcccggggagagacaacacccaggctctgtgggatgctgagtggagcgggaggcaggcagtgtgtgttcactgggacagaattcttccctccccacatccctttcttcctgagactcacccagattgagcgctgacgctctgcagccctgggtggccccagcagcacccccagcccagcgtcagccttggggagagtcatggttaacagcacaaactgtgaacccaaaggattcgaatcccagctctgcctcccatgagctgtgtgaccttgggcagctgacttaaactttctgagcttctgtttgctcatctgtaaaatggggcaaacggcaggatctccctcatgaggttggtgtgagggtgatacgcactaagcgtagctagcacccagcaaatgtttatgttattgttacattatcacagaaaaatgcaccagaatttaaacaacgctgacaataaatatgcagtcgatgatgacttcccagagctccagaagcaactccagcacacggagaggcgctgatgtgcctgtcaggtgctgctactgaggaagccgttgctggtctccggaagctcttgtatccccaggagtgccgtctgcctggcctccccattcctgcagtcccggttgtcatctatgtgggccaggccatgagccctccaggcaggctgtgcttcaacccatcccctgcaccaacagcagcctgctcatctccaagctcagctcagcccaagagcagaaagggagtgtgctggaagcaggttcaggaagatgagcgttcatgggccgtctgcatgccctgggctggggagctctcagtgggagccacgtggggtcgaggattgggggaggctatgcaggcccaggggcctcgggctttcgagctcaggctctggaatagccttcttcatgcacccccacacagggactgacactgatttgcaagaatgccatttcgaaatttcacatcacacttccaccatggccccagacagcaagcccggcccagccccagacaggcaggcaatgggcatctgctcatcatccagcaccctggagagagcaggaatgagtgccgtggtccaagtgcgttcactggactctaagaggggagtgggagacctttctggagacccttccctggtgtatcagtttgccagggctgccataacaaagaccgtaaactaagtagcttaaaacaacagaaatggtgttctcccacaggtgtgggaatccaaagcccaccttcgaggtatggacggggttggtttcacataggaattttggggggacagtttggcccagaacccctggagaggaagcctagaacccacagagggttagccctgaaggcaggtagagtagtgccaggtgggtgacccatcccttaggggtgcccctctggatcctgctgggccctgggaggagatggccccaagtggagctggtggcaactggccgtcccctgccagggttcccctgctggagaccgtggtggctgagtcatcgcaggtcctcaggccggtctgggtggacgtggagggtgctcaggatgtgtggctggatgcaccaaagaatgaacgagcgccctgcgggaaacacggggaggtgagccggagacccctgctctgcaagctgcccgggtctggccagcgggcactagtgtgggagttcagctggcaacccccgacagccttctgagcacggcccccttaccaggtgccgccgcttcccagcctccagccccaccccacctcggggatcctgcccaaggtctgctctgcccggaagtgaaggagaagcccgttctcttccccctcgggctggggaagagctcacagcccaggtcacgccacagaaatcccctcctcatctggccctctgactccacctttccacgctgtccgtgggaccaggggctgagccgtcagcggccgtggaccttgccttgatcccacactgggccccgagccactttctgcacatgatctctcccaaccgcatcatcatcatcttcttcccaagtccccagtgcagccctgggggcctgtcctgtgagacccctgaagagagagaccccggcagggacactctcactgtgacaatgttgaatttacctgaaggttaagaaaccctctattctggtgttccggaaaacagctgatggcagcggggagcccccttgcccgtaagatgctggaaaacactcccagatgctcctcatttccagggccaggcccgacacatgccctcgagttcttgtgtggcctcacgagtgactggctgctcaactggaaggaaaggcgtgttactcagcctcggttcagctcctcactcccctcgagccccgaaccttggctgccctcactcgagccagcagatgccttcctgagaacaggcgcaccagggccaaccacgcttggctctgacgtctctgtcctgcagactgtccccgcttccccacgccacctcctcccagctctgtggacgcctctttctaaaagagaagccctttccccttaccctggagaagcctgcagccctttggtgaggcgggggcattctcccactggattgcccttccaatccagtgtcacctgtggcgacagcccgcctcccccttgcagtaaccctcttgaataaacgcctctccttaccagtctgcctctgtcctttctttgataatgcagaggagacagaggaggccaggtgcagtccgactcaggggtggctgcaaggttggcagggacttcggtgacccctgtattagggttctccaaaaatgccaacagagcctgtgtgtgtgtgcatgcatgtgtatgcatatgtgtgtatgcatgtgtgtacgcatgtgtgtgcacacgtgtgtgtgtgtgtgtggatgtgtgtttattataagggattggctcatgtggttatggaggctgggaagtcactggatgtgccgttgccaagttggagacccaggagcgccaatgctgtgagttccagtcccatccaaagggggaagacagatgtcccagctcagcagtcagcagagtcagttctccctcgcttcaccttcttgtcctgtgcaggcctccgacctactagacagggccgcccacatggggagcacccctgctggactcagttcactgactccagtgttgatctcctccggaagcagcctcacacatacccagagtcatgtttgaccaaatgtctgggcaccttgtgtcccagtcacattgacacatgtaatgacccatcacaacccctgagagcaccggctttgtgaactgggctgctgcggatggggcggggtgggaggtgtcccagggctctggaaacctgtgtttcagggtcacatgggtgctgaggtcaccatgccactccctggccctggtggctgtgtcagccctgaccccggacttgacttgggcctcagcccttgtgttggagacgccaagtggcagcccctcgcctgctcaccttcactcttaggggcaggatgcttcggccaaagcctctgccttgacggcatcgccttgatgtgagcacacgtggctcggagaagctcagggtctcgctgcacttgggcctggccgcaggtgtgtgtgtggctgccctgtgtgcagggtgtgcatgcacagcactctgacttcccgtgcgctcccagctccccagcactctgctctgctgcatccttggggccacagcgagatgtgagatctgcagccaggatctgggagtgaccatgtgacaagaaaacctcggccccttccttcccctggggaagcccgggggcctttgcctgctcaggtctgctgggcccttgtggccacagtgagtggtcatttccacagcaggttttgtgaccgtgtcggcactgcccgatgcatgggcagagccaccagctgtcgggcagacgggcagctgaaccctggttttgaccctgggagatgggggccttcatcagctgtttgccggtagctgccctgagacttgctcctgaaacagaagagggcctggagcctgtgcagatggcctggggaggctggtgcgagggtgggcggcggggagggcagagcaggcaggggcgccggtgtgctgggatctctgaaagcaccagctccagtatttcttttgtcaaaggcaggcatgtggtttggtccctagaataaaatcccccctttagtcgccagaggcttggattttcatgcctgcactgggggtgaggctccgaggctgattcttgactcctggagttttcagcccctctgggggctcctgggagggatgaggctgcttctgccatgaggcctggacccctgcagagttggaggtgtggcccagagcggggtgggctcggtgactttcgacccttgctgtgaggtgagctcaggagggaacttcaggactgggggcataggagggagcgagaggtgagtggccagggcgggtcgcgagcacagcggggccctgggagtccaggggcatgactacaacctgggctggagcccggagggcacgtgaggggcttcacctgggagccggctggtcagaggttgagctggtggtgcgttcctgcagggccctggcagctggggcagtgagccacaaaggtgccatggctggtgaggggagcacatgcagccaggcgcaagaagcagggagcgcctgatgggatggcgaggcatgggctacaggggcctgtcctggccctggggggtgcaggggtgctggagtcatcagcttccctctgtaccacatttcagtcctcccaggaagcagaagtgatggttctcggggctccagggtgtggtggcggtgacggccccacaggctgctgtctgtgggttttcctctccttgcttggagccaccttttcccctgctgactttagctcatggtcccttcagtctgggaagatttatgggcctccttctgggtgccggggacgtgggccagatcaggtggtcttgccagagggctggcggtgggaatgggagtgatcctgacatgcaaacaggagtaccaggcagggccagagccgtagggtctgggattcagccagcctgggggcctctcctgggagctgccctgttggggttccaggggtatgaatgcccctggtgggtggccctcagtttgcttgtctttgaaatgggccgtgaccaggctccccagggtgcctgcccagtgccaggatggggtgtgaggttgggattgcagctgccaccacaagccaggcagtaggacaaacatggtctcagagggtacgcctgggcacaggtgacccggacaccatgtggggcagccgaagggggcaagaggctggggctggaatcccaccaaaggtgcctggcagcctgggcaggagagggccggggagggggctgccctctgccccagtgaccctgcattgggcagtccctgggccctgacctcagcaccgcccctggcccggcacctcgtttttccacttggacccctccctggcttcctggccatgccatcgcctcatccagcccttccctgggctatcagggctgggcctgtttatgcagctggggccagaggaaccagctccaatgccgagacaacgcaggcacagccattagtcatgggtggaaatcagaagttagacgaaccaaggtccgaacgtcagggatggcgttcgggagcgcaggtgtggggccgggccaggccgcaggctccttggtgggagccccagacttgggcccatgggcctccatcagcccagccacaccatcacctgcactgagccgagctctcccccggggctcggatccgctgggtgctgataggcccctgtccttggctcagggcaactctggggaagtctggaatcctttgaatggtgcagattgctgtgactcacggctgtggggccatgagggactggcggccgcccagcctgcaacctcgttttgaaacctcagggtagacccctgtgcagccccaggccaccctggtcactgccctcaactgggtcctcatgcccgagcatgctgtcctgggccatgaccctgcccacgggctcttcctgcccctagcccagggactcagagtcacacagtggatgggaccccacagtcatgtaggccacattctgattgtgtggtggcccacacgcctccagaaatggggcttgctgtttgccagaggccagagggcacaaagaggtctcggattaggcccctatatcccaaagaaggatggctctatatcccaaagaaggacggctctatatcccaaagaaggatggctctatatcccaaagaaggatggctctagatcccaaagaaggacggctctatatcccaaagaaggatggctctatatcccaaagaaggacggctctatatcccaaagaaggacggctctatatcccaaagaaggatggctctatatcccaaagaagcgtagctctatatcccaaagaaggacggctctatatcccaaagaaggatggctctagatcccaaagaaggatggctctagatcccaaagaaggacggctctatatcccaaagaaggacggctctagatcccaaagaaggatggctctatatcccaaagaaggacggctctatatcccaaagaaggacggctctatatcccaaagaaggacggctctatatcccaaagaagtcccccttggctgcccacccaagggaaatggaaagttgattggcagcatctgccaagtcctggggagggtaccctatcccggagccctgtgggccggcagctggtgctggtgccctgcagctgaccaggcccaggcttgggctgctggcatccctcctgagggcacctgcgtaatgatagcacgattagacccataccctgcagggacaattcagagaggcagaaactgtcattgctaattggtaattccataaattagacagtaaagacagatgttgtgagtattggaaaaacgctgtcaaataattgggttattctcataagaggagaggcgatttgctacctgtcaaacagcatttcacccctgcctgttgcctgcctagctggatagaggctggctggggaggggccccaggacccagggccccttagaattctccagggccccaacatcagggggcagggagccctactgccagctgggagaggcctaggcttccccattccccataggccccttccttactgtctttcccagggtggacctcctctctgccccccaggctcacatgagcagcccccttgcccggaagctctctgtcttcctgtgcaccttctagtcctgggagaccctactgatggcatacctccagcaggaagccttcccggccccatgcagatgcggggcctatagcctcaactgcagctttgggggaagcttcagggcatggggggtcttgttacttctttccctcagcatgagccctacctgcccagtgctcctggaggtgaggaatcacatctgcacaatgccgtgggctccatcccacctcccacaggcctgccctgatgccaactgggagatgaagtcacaggtgagagggctcgttctggggcttcagctcctcctgcaaggctgcagactcagtgtgcacgagacacatcttgcctggagcagacagcctcgggacagggagctcatgccttacctggagagtctggccttcagctcgatgctctgcctgctgagaagcttgcttgccccactggggcctcccttgttagagccttccctagcatgggggagtgaagggccctgtagagaaggctggacgtgggcttcacgtgggacctggacaggggctgccttgcctccctgtgtcgagttgagctgcttctccatcctgggccccaggccccagggagctgcaccctggccacttggcagattctgggacagcctcaggcagtccagagtttggacaaggagagggctgctctggggtaggcagtggccaggcattgctctctgctgcacccctccaactctatgcacagttggcaggaagctgggtctctgggcctgacagccctgagtgatctgtgggagagacagtgtggagagatggacagggctgcaaacatatctgaagagaagcaggaagagacctggggtgaccccaggtggagctgcctctgccctcccctgattgcctgctctggcccatcttctccaggtaacaaatggccctgaagcccacctctggcatgcttgcagccccttggcagtgctgggatgtaggctgggtagggaatcctttatagaagcccagagcaacagatgaacttggggagggctcccctatggaagcgactttgggactgagtcagggcagggaagagcactgcaggcagggacacggcaagtgcaaaagccttggggtggcagggagtgccaggagcatgcagggctatggcagggtggcagggagtgccaggagcatgcagggctatggcagggtggcagggagtgctaggagcatgcaggagtgtggtgggtggggtggttgaagggagagggacagtgtggcagtgatagggggccccaggggtggatggagcagttcatttggaaacaatacagtccattgatcaaaaagaatctcaaaggaaattttaaaattacccaaaacagtataaaaaacaagcgaactacaaactaataacccctcatgaatacagacataaaatccttaccaaaatattagcaaacagaagtcagtagtatataaaaagaatatacactatgactcagtgggtttattccagggatgcaaggctggtttaatatttgaaatcagtcaatatcattcatcatgttaacaagctaaagaagaaaaaaaaaatcacatgatagtgtcaatctatgaagaaaaatcatttaacaaaatccagcactcattcatgataaattatcagcaaactgggaatagaggatgatacggtttgaatatagtttgtcccctccaaaactcatgttgaaatttgattgctattatgatggtgttggggagtaggacctaatgggaagtgtttgggtcatggggatggatccctaatgaatagattaatgccatctaaccacagtgcattctccttctctcaggactgggttagtgattgtgacagtgagttgctataaagtgagatttctctttgtgtttgcttttgcattgcacatgcctgcttgccttcccgcttcaccatgtctcgatatagcacaaggcccccaccagaagctgaacaggggctgatgctgtgctcttggactttccagccaccagaatcgtgagccaaataaacctcttttctttataaattacccagcctcttaggttctgttataacaacactaagtagactaagacagaggtgaagttcctcgtttgctaaagaacatctacaaaaaccctacagctaactttatatacttaaaattataactaactatgtaattaatactgaatttctttccccaagattggaacaagtatatatatatatacttaaaattataactaactatgtaattaatactgaatttcttttcccaagattggaacaagtcaaagatgtgtaatttcaccattcttattcaacatagtgctggaagttctagctcttgcaataagacaatgaaagcaaataaaagacatagtatatatatctgaaaggaaggaatatgactatccctacttgcggaggttgtctacatagaaaatctgaaggaattgacaaaatattcctagaactaatcaggaattcagcaaagtttcagtgtacaagataaacatacaaaactcaattgtatttctatatcctagcaatgaacatgcagatgctgaaattaaaaatagaataccatttacaactactcaaaaaatgaaatagttataaattcaacaaaacatgtacaggacttgtgctgaacagtatacaacattgatgaaagaaatcaaagatataaataagtagagagaatgactatgttcatggattagaagacaacatagtaaagaggccaattctccccaaattgatatgtgggtttaatgctattcctataaaaatcccagcaagcttattttgtagacacaaacaagataattataaaatttacacgaaaacaagaaagacttagaatagctgaaacaattttgaaaaagaataaaaaaaaatcctgccatccaatttcaagactttttagatagctatattagtctagatggtggtatttggtcaattggctgagggatggacccacaaaccaatggactagaacgagagaactcaggagtggagctacacaatagtacccaaatgatttttgacaaagtgagatctcacaaagtgcaaaagtaatttaatggaggacaaatagccttttagcaaatgttacttgagcagaaagagagcctcagtctaaacatatcacacgttatacaaaaattaactcaaattggacaaatagtttaagtgtaacaggtgaatccaagaaacttttagaaaaaagcataggagaaaacctttgggaactaggggtaggcaaagagttcatagacttgacaccaaaaacatggtccttaaaggaagcattgataaattggacttcatcaaaattaaaaattgtcactctatgatagaatctgttaagaggatgaacaagctacagaataagagaaaatatctgaaaccacatacctgacaaaggattagtatctagtatatacaaagtactctcaaaactcaacagtaaacaaaccttaacaacccaattagaaaatgtgcaagacccctgcagagacatttcattgaagagagaagatagatggcaaataaacagatgaaaagatgtttgacgtcattagctacggaggaaatgcaaattaaaacacaaggagatgtcactacacacctgtcagaatgactaacttttacaaagaatgaaaacaccaaatgctggtgaggatgtggagaagctggatgggaatgtaacacagtattgccactctagaaagacagtttggcaatttctttaaaaactcaattaccctatgatgcagttgttatattcctggtcttgtattccagagatatgaagacatgttcacataaaacatgtacattactgattagagcagctttattcaccatagccctaaactgaagtcaacccagatgtccttcgatgggtaaatgattagacaaaccatggtgcctccacaccatggagcaccactcagccaggaaaaggagcgagctagtgacacgtccagccacctgggtgaatctctagagaattatgctgagtgaaaaatgccagtccccaaagcttacatactgtatgtatggtttcatgtatataacgttcttgaaatggcaaatttatagaaagggaagaagagactggtggttagcagaaattaaggagtgggtgcagggggtgagaggaaaagtgggtgtagctacaaaagagcaccctgagggtccctgaggggtgggtgctctgtgtcctggttgcatccatcaacaccctggtggggataccgtgctagagttttgctggaggtttccactgggggggacggaatgaaggacacatgggatctgtttgtgttatttcttgtagctgcttggggatcaacaataatctctgaataaaaagtgtaataagtaaagcaataaaaacaacgaataaaggcatatgtatcaccaatttaacctgcttgggacgtggcccctccctgttctcactctctaggtcttcttctcggctggatgttgggtttgggggagggcaggggtatgggagggaggggctgctctcagagcatatggaactgcaggctcttctcattgaaggagacgcatttccatgtcaaggttaggaaacttctgaggacgcatcagaggaacctgaggcctctgaggctgggggagtccccttctctcaccacgttccccggggcaaggcccagcttcgacctcaaggtcccccgtgccaggtcaggccctggatgggcctctgggcatgtcctggctccatctgcctccatcccagcctggatgcgtgtgtggagatcccagcctggatgcgtgtgtggagtggacgacaggcctcccaactgctgagcaaactgcacgagccacacacctttctcagcatcgtgcttgctgcctgtctcagcacagacttgagggggggcctttgctgagaccctggatgaaaccctgcagccaaaggacaagcccggaacaggcctgcaggtgccacttccagaacgccttactgctccttgtccaaggagtggctgcaactccaccttttccctggaacaggccaccggggcatgtgggtgaagcctgagggtcactgcaccaggcaccctgccttggggtcagctggacctgtggcctcggaggactcgcttcctggctcctgctctcttctgtggcctgttgggctcactgctgcaggcccagcgtggactctcacccagagtcagcgcccggtgcctgggggcccctagggtggaggaactcagtcagtccccaggtggtctgagccgcccattggatgcccagccctgcacagtggccctgccccgccctgcccagccctgcctctggggtctccacctgcctcggaacagcccggtcattctcatccccagtgtttcaattgaaatgtcctaccaagggcttaaattaaaaaccaaacactcaaagcaccagtgccttttagatgactaaaataaaaacctaattgaattttcctagggaaaaatatctcgtgtaaatttagctaagggagtgaaagagtggctctttaaaaatagatatatatggtttttaattcagagttatttgcaaagcaaattaaagaaattaaaaaaaaacctgctctgccaatggggagactggatccagacaaagaggagcttgcgaggcttggcgagcacggggcggagccaggggccgaccccacagtcctgcccctgccagcctggctctggggcagctggccctggaccgggctcctcctgcagggccggtgcttccatccccggcgtgagtgcccatgtcctatgttcgtgtgctcttgtttttcaggctttgagctggatctatggggtctgggctcagctaccggctcctcaccatggaagccaagatgctgagaccccaaagccaacgaggcagagccgccacctctcagcccctccccaatctcgccctcactgcacccctgcccacctgaggacaaacctggcctcatgtcttttctttgctgacccttcttctatttggggaagggatttaataaaacaaaacaaaacaaaacaaaactgaagctctctgctgagaaccagactaaactgaaatctcattcctgcatgggaccctcccatccactgcccctgctcccaaaggagcagagcaggcctggcttcaaccaccaacaccctgcctttgcctccacagcaccatgcccatggcaggggccacctttaagacatgggacgaactcccccaccccaaatttggcccaaatgttgaggcttctgacaccacacacaccccatgggggagtgaagggcttgtcactcatatggtggggctttctggggacagcaaggcagctcccaaggtctggaaatagcttgggagagcaagagggccctggctttggggtttatgtggccgagtggggagtggggccgggtgggggggtccccaggctggcccaagctggggcatttggagttttccagggtgccaaggaaggagcccccaggacataaaacgtgagcccaactttatggcctgtgaccttccagcctggctgagcacctgcctggcctcaagggtgcttctgccaaccctgtgtgcgatgcccagcaggcggggctgcgatctccttggcccttgccatgggcagccctggcccatcttctgggactcagaatttcccactgggccctctatctgcctccagggccagtcccagcctggctgtcacaggccaggaggccctgccccatgcaaggaactcaccaaggacactgcccttccgtctgtggcactgctgcttttgcctgccggagggcaggtggggagcggctgtccgtgcctcctctccaggaagaaaggcactgcagcccgtcacaggtgcttccaggttggcggaggggcagggcttgggctgcagggccactgcaggtgagacctgacaggtgcaggcgggcgccgtgagggaagcgtgtgcaggggcccagcctgggcgcctcccctccagggacacccatttccacccttcctttggaggcttcctcttggctggaaattcagagttcactcccacaggcaaaggttgaatcgctgatgctgcgccaggcgaacgccatgcaccgcggccccgtcagggacacattttaattaagtgaggacaagagaggtgccctgccgttcctggggggaccctggactgccaccagcatctcatgacacacctgtcaaatcatcacggtcctggcaagaagttcgggagggctgggggcagggggctgggagaagaagggttgcccctggagtcagcccggcctttcctcagcttccagaaggaggtgtgtcttgggaggatgtgggcagagcagaggcagggaggcccgggtgcaggcagatggtgaatggcccttggggcagccatgagatgtgtggggcttcaggaccccaaaggcctatctgctctgcatctttgaggacacccaccctcagtcagcctgcagcctctccatggggacttgccctgcttccctcccgccatcctgcagctggggcccctgccctgcagcccccaccccagagagtgccccacacataggccacagagcttcagcccccggctagccggggaagctcagcctctgggtaacagtcttgtgtgcctgcatcctggagccagggatggccttttgggacccagcctatttatgccagggttactccaggaaactcaagccttgtcctcttctgagcctctcggactaggggctcatggagctgttgctcagtgagggcatttggggctttcccctgcagcatggacaggcctggttttgacggacaggagcatctccaggttcccccgagccacacactgctagggagcaccctctgctgcatgggattgacttctggggcttggccggaggagctgtgtatccttggcacgcgcctgttcgtgaggaggcagcgttttcttcctgtgagttctgctccctgggaagacagcggttcatggcaggcaggctgggtggactgcagccgttgctctggcctactgtggacccgacaggtactaacgcgctccgtgcacgctctgcttcacccgaaaatggggttgtgggcaggggcagagtgacgtgagtggacgtgtgtgtgtctgtgcccagcacgacgccagcgtgtgctctggagatgaatgctaacaggcacaaaacaattgataaggtaaaatcagtttcttaataaacactgccttgtccaaggtatggacactaacgtgagaggtgaaggctgaactgcagggatttcaggggtttgcacatgaatccctgtttttcaggctccccaagacattgagcatatggggagccctttgcagagcacctgagtgaagtgagtcccctgactttactggggagtcacagctgtcacccatcatggctcagccttcggtctcctccacggcacacctgtgagcagccgggcccagccctccttgtcctgagtggcctggcccgagctgtggccagtgctgctggggcagccccactagacctggggacagaagaggactgggaagggcccgtgtgcagctgcctacattgggggctcgaggaacaccccccatcccaggcctcctcctcactggggtccttacttggcacttggcaccctcttgggcatttggggtgggagttccaggttcctggcctctctcatgcccagacctggaagttacggaaccaagggagtatcggcgagcgggtttccacgctgcagcccaccccggcggccgcccatctgtccctctgcaccctgacttcattttcctgccgcaaggagaagcctggtgcctcctctgcggtatgtgactggctggagagtgaagaggctggagagattataaacagaccatgggtccaccagagtggcccgagagcttgcccagaaccggccccacatcatctctgtttccgcccaggcctgcccacacccagcctcagctggggtgatgagcttcctcccgtctcgaggggcctctgcccgccccttggaggacgtgccccagctgcggcggcacatgcgtgggcttctgtgtgagaggcatccctgttaagtcggaggggtggagaaactgaggcccagggaggcccggggcagaggagctgggctgcggcccctgccccctctcctgcccctcctctcggccctgtccaagactgcgcttcttcatcttcaaataaacccatgagcctccctgtgcagggacccgtcacccaggccggcctcagggcgcctccccactgtccctcctggcctcctggcccctgtggccaccagcatgggcacgacccctcaccccaccagcacacggggctccaagctcgcccgtcctggccctgctggctctggctgctgtgagttctccttggccaaaggaacgtcctaggccctgggctgtgccagcgccaagagtggggctgacaccaagccagctccccactagcagctccagggaagtcaagagatggaggatcagaaagccagccagcgccttcctcccccagagccctctgctgccccgtggggcctctcccagtaccatgggagctgaggccctttccctccccatggtgacaggagggccacaggctgctggggctgtggtggccacctggagagggcttttgctcctggggctccctccgtctgtgtcccaggctggccattaggagggtctggtcatctgtggcacatgccagccagcaaagggcactggggcaatagtgcccccctggtgtgggcacagaactgggcacccactgtggtctcagccagggcaggaaggggactggagtcacagggtggggagagggtaacaggcctgactctaacagagcctcctccctcgttcatcctccctcctccctcccgcgccgtctttccctccccagtgtctctggcctcgtctctaaggagcgggctgcactgagatgggccccgttctgtgtgttctgtgggcagaagagccggtgtgcctgagggtgcgggcctccttggtgccccagcctgtacatgggagccacccgcatggtccctgtagcgtcctttggtgacaggcaggccaagtcaagaggtcccagggtgtattcctggggctgaaagggaacaggggcgagggactccttgcccccagcctccggctctgcctctggcttctgtggggagctcagggtgcacagttggctcccagcagccctagcagtctcgatgcctcttgataagacttctatccatgcgggccgcagggcggagtgtgggagcctgcagaacccaggctggcctgggaagccctgagcctggtgtgaagccctggagaacctggctttcccactgctctcctgtggaatctgccaggcaccatttattccccgtgctcaggggcagctctgtccacacctgccggccacgcttctgcagattctcccagcagcccctgcgtgtgtccgggatgcaccagcccctcggcctggcctgagcagtgtggagaggctcctcctggcccagccccctagggtgagggcagcctcagccccttccccaggcagcccaggaggacagaaacctgaaggtgaaggatctctgcagagtggggcctgggcatcaggggcgaagagaaagtagcttagggacctggaagagagaccctgatccccagacacacaccctccacccctccccctcgctcccccacaagacagactctgggggtctttagaattcatcaggtccccacaagttgaagtgaaggatggaagaatgggttttaaattagtgaaacctttttacaggggatggctgtcaaggataatttttaattgcaaataaaaaactataagaaaaaaagtctgtcagaaggaggccagccctggaaagggcattctgacggcacctgctccagcagaagaagggcaaagtcacccaggcctgagcaccagcgccttctctgcacccacccacccacagccccttcccctcatcaccacccacggccccttcccctcatcaccacccacggccccttcccctcatcaccacccacagcccgtttcccttattgatggccccatcccctcacccacactgccctcctccgggctggccgagtctggcctcaggcccccaagggtacctggagctggccctgtcacgcccagggctgcgtcctaaggagcagagtgcccagaacatgggagtttcggtcttattggcccgagagctgctgtggccggggagccgcccacacccagctggagaggaggagaggagtcccaacggcgggactctcggcagaggctggggaagggggtgcctccagaactggcctgggctccgccagggaggtggccttattttcctcgcccgtctgagcagggtcaggagggtctcggggcaggcccggggggtggtgaacaggaacaccctccagtgccgggggtttctggtccccgggctcagtgcgccggggggcgggttatggctcagggagtattttttttcagagcctgccacagagacaataacacctcttaagacatggtaattaaaatcctctctgcacacagcaataaatccatgcagcacaactttcttgtaaaaatgaccttgcgagatgatgttttccagccgcatgttttatcaatatcacacttcccacagcctgacagcgcacggggtgcccccccccatcttcctgccgggctgcccggcccagatgctcactccttcctccagtccccctgcgcctctccatggcccctggacgcttggacaccgcccgtgctggacgctgcccacctttcctgccccctcctgagtctgggtatggggctccagtccccaccccaccactgacctgccccggaactttcctggctgtctgcagggccagaaggctccccagaaggagtctgggggtccccaccgctggtcttatcccatcttgggggacagttaggaagcaaaggtgtgcgctcatctccgccatcatcatgacgtaacagccaccatctaatgttccatgaaagggcaggagtgtgctgttggttttgaccaatgccatggtgacggtggcgcctctcctgtgggcaggctctgcgctagctcctagatcctaacagcctgcttggcaagaccacgagtatccccatttcacagatggggaaaccgaggcttggggtccaagtcggatgtgagccgggcccagagatcagggctggggcccaccaggcacgagctgtctgggagggcgagtggcctcggggatggaacacgttgcacagcactgggggcgggggcggctggaggcatccagcatgaggaaggaaaggtgggaccccttcctgcaggatggcatgggcgtccctgtgcccagagccctaggcctgtgctcctgcctgtctctgctcctgacttctggtagggacccaggaaggatctgaggagggtggagaaggggctgagaagaagccccgtgagcatccaggcatggccgcccctcctgcactgccaaagcctgtccccccatctcttcctccagtcttataataaaatgcagcttattagccaggtgcggtggctcatgcctataatcccaacacttcgggaggccgaggcgagcagatcacttgaggtcaggagttcgagaccagcctggccaacatgctgaaaccttgtctctgctaaaaacacaaaaattagccaggcgtggtgtcaggcgcctgtaatcccagctactcaggaggctgaggcaggagaatcgcttgaagtggggaggcagaggttgcagtgagccgagatcatgccgctgcactccagcctggtgacagtgcaagactccgtcttaaaaacaacaaacaaacaaacaccacagtttatttagctaaaattcatgtaccatacaattgacccatttaaagtgaacaattcaatgactatgtgctcacggatgcgtgcaccatcacatttgagatcgtttccatcacctcccaaaatcccctctccattagcagtcactcccatctccccacatactcccagcccctgcagaccctctgtctctgtggatttgcctgttctaggcatttatttaaatggcaccttcgtggcgtggcccaatgtgtctggtgctttcagtgagcacagcgtcctcaaggttctcacattgcagcacgtgccagcacctcattcctttttatagacaaaccacatcccatcatctggatggaccgcatttgtttatccatccaccccttgatggacacggctgtttccgctctgtggctgtgtgaatggccctgctgtgaatgctcgcatgcgtgtgctgtggggacgcatgtctgcctttcctccaggacagcaccaaggcggggagtcaccaggtcgcgcggttccactccagcctttgtcagctcccctcatgcagagctctcccttctgggctcatccatgccggcggtgcctagagcttcgaggctggcccctttggcacagcagagccttttgtgaagtctctgaagcagactctgaaagcctccgacgcccttgctggtggctcagcggctgaagggctgtctgagagcgacgtgttcatgcagcatcacctcccccatgttcccttagcgtgctcttccttgagaacatgcgcagggccttttaagtggtttaggaaagcacggtggtttaatgtattacaggaatataattgtatttttattgctcattacattctgagttaattacatagcaaccaggtttgtactttgtaatatccaacgaaataagcgtatgcactcttgattcagagtaggcgtcttctagcccacacaccttggggttagtcggctatggctcagtttgtcccacaaacagtatcagaactatcattggttactgggcacccaagagggtgcaccgtcctggggcccagcctttgctttagggtccaccttccacatcattccagaaggttccacctctttggggtcaggtgctgcctcacccctcctgcccatgggccggccctcaccttggctcagactccgccctctgagacgtgccgtggggtctttccaggatgaggaccgctagtgctgacatctcagtggagacatgcctgctgagaaatagactcgatctggcctcacgttggggaggcagatggagagtcggttggggcggggaggacaggttcaggctgagggatgggatccccccagccctgaagcactgaatgccagaggccctgacagtggcccctgcgtgggcaaggttccatttagttctggggactcctggagatgaaggtgctgcagccgctgacagacagctacctgctcctgggtccagagagcatccctgaggcttgtgtgccttctgtggtgcagggctgccttccggaagcctcttcttctgagagatgggatgacagagaacacaccagtaatttatcctaaggcaatcattggaaaaatacacaaaaatatatttccgaggctgttgcttctcttgcttattcgatgtgaatagtcactactgggatgagtgtcaatatgcattagtgggagtgtggatacgcatgaatgtgtttgaacatgcatgagtgggagtgaatatgcattacagtgagtgtgaatgtgaacatgcatgagggtgagtgtgaatatgtgcgactgtgtgagagtgaatatgcatgactgtgggcatgagtgtgcatgtgcattactgtgagtttgtgattatgcctgagtgtgagtgtggatatgcaggattgtgagcgtggatatgcaggagtgtgagtgtggatatgcaggagtgtgtgattatgcatgagtgtgtgattatgcatgaatgtgagtgttgatatgcaggagtgtgagtgtggatatacaggtgtgtgaatgtagttatgcacaagtgtgagtgtggataggcatgagtgtgagtgtggatgggatgagtgtgtgattatgcaggagtgtgagtgtggatatgcatgagcatgagtgtgattatgcatgagcgtgagcatggatatggaggagtgtgggtgtgattatgcatgagtgtgagtgtggataggcaggagtgtgagtgtggatggcatgagtgtgagtgtggatatgcaagtgtgagtgtggatatgcatgagtgggagtgtggataggcatgagtgtgagtgtggataggcatgagtgtgagtgtggatctgcatgagtgtgagtgtggataggcatgagtgtgagtgtggatatgcaggagtgtgagtgtggataggcatgagtgtgagtgtgattctgcatgagtgtgtgtggatatgcatgagtgtgagtgtggataggcatgagtgtgagtgtggatatgcaggagtgtgagtgtggataggcaggagcatgaatgtggataggcatgagtgtgtggatatgcatgagtgtgagtgtggataggcatgagtgtgagtgtgattctgcatgagtgtgagtgtggatatgcatgagtgggagtgtggataggcaggagtgtgagtgtggatggcatgagtgtgagtgtggatatgcaagtgtgagtgtggatatgcatgagtgggagtgtggataggcatgagtgtgagtgtggataggcatgagtgtgagtgtgattctgcatgagtgtgagtgtggatatgcatgagtgggagtgtggataggcatgagtgtgagtgtggataggcatgagtgtgagtgtgattctgcatgagtgtgagtgtggatctgcatgagtgtgagtgtggataggcatgagtgtgagtgtggataggcatgagtgtgagtgtggatatgcaggagtgtgagtgtggataggcatgagtgtgagtgtgattctgcatgagtgtgtgtggatatgcatgagtgtgagtgtggataggcgtgagtgtgagtgtggatatgcaggagtgtgagtgtggataggcagcagcatgaatgtggataggcatgagtgtgtgtgtggatatgcatgagtgtgagtgtggataggcatgagtgtgagtgtgattctgcatgagtgtgagtgtggatttgcaggagtgtgagtgtggataggcaggagcatgaatgtggataggcatgagtgtgagtgtgattctgcatgagtgtgagtgtggataggcatgagtgtgagtgtcattctgcatgagtgtgagtgtggataggcatgagcgtgagtgtgattatgcgtgcgtatgagtgtgattatgcatgggtgagtgtaaatatgcaggtttcagtgcgaatacacattgtcagtgtgagtgtgattattcatgagtgtgtgactatgcctgcgtatgagtgaatgcatgtgtcagtgtgaatatgcattacggttagtgtgagtgtgattattcatgggtgtgagtgtgtgcatgcacacccccaaaggaacatgcatggaggggaacaccaaatgttccactggggcctggtgtgtatggaggaatctcaagggtccttcctggaatctttgtcgttcctgggcctccgagttgctctaggtagagacgtgtttttcagtgacccaacacagcctccagcgccctgctcctctggaagaggaaggcgtccacacccgggcagcctctccagcctggcctcacccaatatgtacctgggctgctttgaaccctcagaatttcttcaaggggttctcccattggcacctgcttgtccatccttttttgtgggtggagcttcaggaacaagctttgctctgtttccctggggtccctctggggtccaggtctcagtggcccagtgagtctccaccacccctgctgacaccagggagcccctggcctgtactggctccctgccccctgccctgccttctggaacgtgttgcctcactcagcacctgtgtcctgtctcacaacagattttttaaaattgtgttttctaaatgttttaatagggagctttaaaaaagacacagaagcaatgtaatgagagagtgtggtatctggatgctcacatgcccatcccccagcttcaataatgagcaccaccaggcccccactgggttattttaaagcaaattattccatatttaaactttggtcttgggacccagaagagttcctgcatagatgtggccgattcatggcgcctgtcttcttatggctctgagtggctccaaacctctttgctggtctggctatgtatgtgttgaagaaatcagtgtctttgcctgtggaacttcctgccctctgcacggtcgtttgcgtccatgcggagagcctcatggtgcccttcaccctgcacttctgcccagcagtgccacgaatctgtgcttagccctgaggctgggctaagcagccgcacacacctgctgtgtcactgcacacacccttgggatggggctgccggctggggccactagcctggctaagcagccacacacacctgctgtgtcactgcacacgccactgggatggggctgccagctggggccactagcctggctaagcagccacacacacctgctgtgtcactgcacacgccactgggatggggctgccggctggggccactagcctggctccacctttataaggtttctcatgggcttctcaccgtggtgtgagcagccaccaggggtgacgctagtcaccattctaacccgctgcagctacctcctggccttcttccattagggacattttccttgccaatgatttgatgactttgacagacagttcacacagaaaaggcagccaacacctgatcctcacccatgtagctctgtccacagggatgagatggtgccgtggtccttccaaaggggccgtgagttttttcttcagtgttttgtccttatggtatcatttaatttggtttcagttcattgcagtcatacatgagatgtataaaggtataaattgtattcatttcctggggctgtgtaacaaagtgccacagaccaaatgacagctgtgtcttgtcccacagctctggaggctggaagcccgaggtccaggtgtcggcagggctggctccttcgtaggctgcgggggaggctctgctgtggcctgtctctgcggcttgcgatggtccttcctcaccatgtctctgctcacagttatccccctgtgcgtagttgggccgcaatcacttcctaagaggacatcagtcagatgggattagggcccaccctgaagatttcattttaactttattgtgtctttaaaaattttctccaaactatggtcacattctgaggtactggggatgaggacttcaacatatgactctgggagacacagtttggcccctaacgtagacgtggacttttgcgatgtgaatatcgtgccatcctcctctggagggaggcatcctggttgcctccagactctctcgctcaacctggtcatcctgagggctgtttattttcctgtatgacaagatgttcgagattcatcttgcacatttcctgctccaggtctcacagtggccatttctctaggcagccctgtttcctttagtggaaaatggcatttcatggtcacagtcgggagctaaggggattgcggctgctaggcaagtcattccttctaaacctttcctgtggccaaagctgagaaatgcatttattttttgggtttttttggcaagagaaaaatacatcatgaattcatactaatatttcccatttaaatgtaagattacagtgtttgtgcagcttctttgattttttaatttctatctctctcctcttatgctgaaaatcttggttcctaatgacatctgcgtgatgacttacctgctttctctcactgcacatgatctgtgcgactgtattggaacgtgggggagccaatttggccatgagatttttgctctgtccctgtcaagagggagagtctgttttcccatgttgtgcatccggactgatcttatttgctttgttctggaaggtgcagcagacatgatgtggtgtgaccttgaaggcaagccctcaagagatcttacagttcctgttttccactctccaggatcctgagaccgccaggctatgaagaaggctgtgatgaaaagctcttttatccagagtgggcccagcttttccagctgctccagctgggcctggtgcctgggccttcacctggctgcaggcaggtgggaagcccctgtgaggacagcaagggagccggtgtcgacccccatcattgtgagacgtataaagcattgttacttgatgccaccatgtttcagcatgtctgtggtgtagcaaatagaaaagtgattcagacattggtaccaccagtggactggtgccttgacaagcacctgagacatgtgacgttggctttgggcccaagggtgggtaatggctgggatggggaaaagggacctttggaggctggagaaacagtgacctttgtcacttaggaataagtggccaaactgtcacctatggtaacttggaaggtaaaagatataccttatgaacgtgtaggatccggtggaaggtcttgcctctggacagaatgtcaaaagtgcccatcagctccatctcacacatgtgataagatacagaaagaaaggtgagctgggccaggtgcagtggctcacgcctgtaatcccagcactttgggaggccgaggtgggcggatcacgaggtcaagagatcgagaccattctggccaatatggtgaagctcgtctctacgaaaaatacaaaaattagctggatgtggtggcacacgcctgtagttccagctacttgggaggctgaggcaagagaatcgcttgaacctggttggagattgtaatgagccgagattgctccactgccactgcactccagcctggtgacagagcaagactcagtctcaaaaaaagaaagaaagaaagaaagaaagaaagaaagaaagaaagaaagaaagaaagaaagacaaaggtgagctggagaagggatcattcaatctgcaatcggaacttaaagacaaaaggcccaggactagcttgtgtggaaaataaaactgtcactcatcccctttctctccaactagtaaaaatatgcaaagtgaaatgaagccagggccaaagatcaaattaaggatgtatctgtaagatcctttgttaaggcttttgaaagacttatggcagtacctaataggccctctcagccacacaaaagggattttaagaatccaggattgttccataacagccatacatggcccaagacagggaaagatctgtctcaaaaaataattatgcatgtggcttttgagatatggtgtaaacttcaattagattcataagaaatccacaaagttttaaagagagttgtattggtaaaaacactgtcagcttagaccacagaagacggtttaaaatgaaaagaagcttctgggaagaaaaaggttgagaaattactcagctacaaatgtgggtcacttcttaaggaaaagaaaataaaactcagagggtgtagccaagaacaaaggagaacaataaattagaaaaccactcccaaggaggagagctggacctaatcaaggaacattctttgcccttggagtagaggacactggctgtgtttcataattgccaggattggtgactgcatgtgcctcctgttcctcccctttttgaaggggagtgcgtataggagttttcctgtccctgactcatcagtgtacaggcacctgtcagagatagtgtgaatctggttccagatcatctcagtaaagcaaatagctaaaaaagagtcacacaattttttttatttttgcatttaaaagttatgtttatactatactgcagtctgttaagtgtgcaacagcattatgtctacaaagcagtgtagataccttaattaagaatttttttaattgctaaaaatgctaacaattttctgagccttcagtgaattataatctttttgctgatggagggtcttgcctcaatgttggcggttgctgtctgatcagggtgttggttgctgaagtctggagcggctgtggcaatttcttaaaataagacaataaagtttgccacattgatcgtttgactcttttcatgaaagatttctctgtagcatgtgatgccgtttgatagcatcttacccacagtagaactttcaaaattggaatccatcttctcaaaccctgtcactgtttcgtcgactaagtttctgatcctatttgaaatcctctgctgtcatttcaacaatgttcacagcatcctcaccaggaatagattccatctcaagaaatcactttctttattcatctataaaaagcaactcctcatcccttcaagttttctcatgagattgcagcaattcagtcacatcctcaggcttcacttctaattatagttctctttctatttctaccacatcttcatttccttcctccgctgaagccctgaacccctcaaagtcatccatgatggttggagccaacttcttctaagctcctgtcaatgttgatatatcttcaatcacaaatgttcttcatggcatctagaaggattaatcttttccagaagattttacttttcccagatccatttgaagaatcactatctatggcagctacagtcttacaaaatgtatttcttaaataatgagacttgaaagttgaaatgcctcctgatgcatgggctaccgagaggatgttgtattaccaggcatgagaacaatgttcatctctttgtacatctccatcagagctcttgggtacacagtcaatgagcagtcatattttgaaaagaatcttttatttctgagcagtagttctcaatagtgggcttaaaatattcaataaactatgctataaacagatatgttgttatcctgaatgtgttgttaaactttgggatttttgacagtggggtaggtggcacatggaaccttggtgtggttttaatttgcatttctcttattatgggggaagatgagcttctttttacatcttctagggccatttgcatttctgtttctgtgaactgtgtgttcctatctccagcacagcaggtgtttaaacccaaaggtgatgtgacaacaagaaacccccttcccaacccctaaccccaggcagactgctctcccaggctggggcctcttggaccttaaggaatgaggacagagcatcctgaagatggggagtcctcgtcccccaggtaagctcaggtgccctttccagtgtgccaagtgtgttgcctgtgtcctgccctggggttcaggagcctcctcttagaggagagaagcctgcaggggcctggcctgcccaaggctgcatgttcagcagcggtgcagcagtgcagtggtgcagcagtgcagtggtgcagcagtgcagtggcgcagccgtgcagtggcgcagccgtgcagtggcgcagcagtgctcctgctggcagagcctggtattggcggagcctcacgtcatgtgagccttggagccgtggttagtgttgtctgatgactgtgaaagctggaccctggaggtagcaagagttgggcctgtgagcccccaggagacacaaggcagccgtgcagcacagagagaacatcccggaggaggcctctccttgggaaccttgacacgcaggctcttctcctgtcacgccaccctccacttgcccatacctgcgtggtcggacggcagggacaccagccccccacgcctcagcctctgctgctgctgagtctctgtaacccctgatggccccttcaggaaaggccccttgttctccttgatcagatgtgagcgtgagacccgggctccagacatgctgtctgcatgaaccctgagaatgcttgggatggagctgcctgcctcctgggagcaaagtcacagcctgagctggaccgtcccagtcttcccagagggaccaagatttccttttcctcccttggctgtttggggagcccaggcttgagaaggcaaggcttgtccagcaggagcaggaaggcatggtcgtggggctagaacctgccacccaacccatgctctggtgaacgacagagtggtgaggggaggtggtagttaaggtctggccagaggagtccgtggaccagcctgctggccacgaggccttgctcagaccgaacccagagctgggtgcactgaccctcccagtccagggactgctccagctggcagcccctgaactaaggcagagccagtccccgggggccctgtggaggactccacatcctgggcagctcagccccgaggaagagggagagagtcagacccagttcttcctcccagcgtcatcctccctggggtcccagaagctcaggctcacaagggaccatgagcccagggcttgccagctgcctttcccagcaccaggaaacatccacagcaggaggaagtgtctacatgcccacgtgggggtcaggagaccgagctccctccagctgcaggctcgcccatgcgtccgggtgtccctgtcaccacctcagctctgcccagctggcctttcaaatgcagcagagactgtttccccggccagcccaggagaccccaccaaagcttcttctcagggttcctgggcacgaagggctgggacaggcttgtggtgggggtggctgcctcttatggggagggggttgcgttcaggccaggctgaagaggcaccaagaaagaagaggggggtgtaagctgagccagcaccacctccacaccctccacacccctacctccagcacgccctccacaccccctccatgctccccagggcgatgccttcaccaccctctccccaggctccagcttccccacagggctggtctctggaagcaaagacagattcggagccccgtgctgctccccagggaaggatttcacacttgtccctggaaaggcctgttgatgatggtgtgaccactggaaactgtccctaaatagctgtccgggaaatgctgctggtcgtgatgatccgtcagtcacatactttctatgtgttaggggaaataccttaaaatcttttttaaattgtcatttatttagacatttttaaaagaaaatctaagggaaaagtgctttgtttaaaatgcagggaggccatttgtttccagttataggcacattattataccactgacaaggagagaagtagcttagcattttccctccgcttctttaagaactattggggacttttggctttaaaacgggatcacttaggtcgaggcattctttgaagccaaaccgcttagaaaccagtattttgtgccaagggaagaaatctcacggaacagcaaagcacttaaatgttccactttaagaatctgaaggcacagatcgttcacatcggttccgattttacgttccatgaacgtcaaatggataaagcctccttgttgcagctgtaccaaaccagggctaacgactggttggatttcacgcttctttcaaaagctcctgtggttacaccatccttcacgtggcctttaatatccccacgtgccgcggctgcattggaacccagcgccacgctccccagtctctcgtgggttccgggcagtgagtggcagccggagggcccagggcaggtgctgcctgtcaggacctcagcctgtatgtgccgggggatgttcgtgcccaacagaggccacttgtctctgggccggggaggcaccgggtggccgtgcctgtcagggcctccttagacagtgccctctcgggccagccggcggctgcccaggtcgggaacagatatgtcgccggcgacaccattatctcccgggcgaacggcgacgtctccgcagccaggcagagcccaggctgccgtgtaattggaccattcagaagtaaattatctgcagctggaaacaagacactgccttttaactcgggcattataaggtcaagactcgagacatcgctgggaaaagcagttattgaaaagcgatgggaaaatgaaatttaaaattcaaagccaccatgggcggcgagcgtggcgggaggcgtgcgtcaccggcggccccaggagccgggtcaggaggtgtatttgcatctttattttgctgacgctggagagcactgcgtgaagtgactctaatatcaatctgatgaaaaaataaatcctggaacaaaagctgcaagacactcgtggagcccgggcactgtagaaggggcctcgcaacagaccccggcagggtggtgggacgtaggccctgggctctgggcaccaggccggcctctgccccacttcctggcattgggatggctgttccagggagggtgactcggtctcccccatttcatccctcctctcggcctggggcagtctcctcccagttccgcccacagccctccgcacacacccctgcacctgctatcctgtggcccctcctgccacaggagtttgccctcacccccacccctgtcaggtggctccctcggccctcggcaccctccctgccctcagcctgagccgagcctctgtgacctcatcccgctgtgtcgtgtgcaccattgtgggcccttctgggcagtcaacaagtgtgatgtgctcacctgggccccgctatgtggagtgcttacctagggcccgggtaccacacccagtctcaggctcttgcccacaactcatactccttttctccacatccttttctcttcttgtgcctggcatagagcctagcccaaaccaggacgcacaggagcaggagtggccctcagaaatggccgtgcccactccctgtccctgcagcccagtggagactggggagtggggaggcccagtggggaggcccagtggggaggcccagcctgtggggacaggcagccacaagcagacacagcctgaaggagaaagcatcccagcccctccctcttctctcaaccccgcaccaaactgccctccctccccagcccagcccagcccccaggtctcttctgctgccagctcacagtggtcacatgccttgggcctggtggaccatgtggaggaacggaggatgggtattcgcaggtggaggaagcgggtccctgcgaagtggagagctttgtctggggtcacacagcgacttagtctgggggtcctgagaccagagcccagcctagtgctgggtctttggcagcttccattcccagacgccagggtgggggagatgttccctcacacgtctgccagcatcctgtcgatggcctgagactgtctgcccactgtcttctgcgggaccctgggccctgggccctggaagaaagggatccgtttggagaggagcagagagcaccagccacatggagcccaaggcacactgtgtgcaatgccaagcaagccacgcaccgtctgtgggactcggtttcttgttctgataaacaggggacatgtgtgctcctcacagggcttctgtgaagattaaccagtgagcacagagcacccagccaagggggcaagtaatgggctggaagcttctgtatttgttttcagaggattttctgctgcctctcactcctatatctaattagaattaggttctgctggatagaatagaaagctccccaataatcatgacttcaacatgatagaagtgtatttgtctgtgtgtttgtctgtgtgtttctgaagctggaagggggcaggtccagggctgctgttgtgaacttggcatcaggagccgtggctgcttctgtcctgttgctccaccatgcatggcctttattcctgaggtttcctttccatcgccagatcttagtcacatggcagaccgcactgcaaacagggctgggcaatgtagcctttattcctggaagacacctgcccagtgaaaattgtgtgttctattactgaagaaggggaccgcagatattgggggcaactggtaatctatgcatgacctacagtcacatgcctgagaaaaaaaatatttttaagacctggaatgaataaggatattttcagctaaaagtgggaagaatttgttaacaataatccctactttaggaagagggaaaatgatctaggaggatgttctaaagcaaaagaaagaatagcaagcaaagaaaggtgagacatgtgggtacacttcagtaaacattgacaatatgaagccatggtggtaatgtctgactaaaaagaacaaggtagaaataaaatgcttgataataattacatatagataggaggtcagtgttgggagtgaaagtattctcagatcctgtatggttggagaggagagtaagaggattacagtattaactattgcattttgcttattttcttgctaatcattttaattttattaacattttatatggcatatataagagtataaaatgtatgtatatggtttaaagaagaaaaagaagattaataatcatgtaaactcctctgtagccaccacttggataaaatcctcccggagcctcaacagcccacggaatgctcctccctaatcatactctcttcttcaatccccagtgttcccgggtaatgcgaacttgaatttgtgttcatctttcccttgttttccttgatcgtttttgccatttatatctgtgatcctaaataacatattgtcttgtttgagctgcttttagaccttatgtaaatagaaccttcttcatatataacgtttgtgtcttggtctttcattcaatactatatgcatgaggactatccatttgaatgtttatggtgcagttcattagtctttattgctgttgggtactccgttgtgtgaatatgtcacaatttgttgatcagttctatcgctgatggacatttatgttgtctgcaggctttttacaatcacagtgctgctataaacatcctggtatacatctccaggtgcgtgtgcatgagcctttctctgggtgagcctgctggaatgctgtgattggggtgcaggcatgtttaagcaatggggccccactctgtctgagcagccagcagggctggagcagcttggaccctggactttctgtctggccttgcagcctggagcagcctcgcccatttactccattgtgtcatataagtactgctgttttctgccaggagttggaaaaggtttggggtcctctagagatggcacccggtgaggagttgctggctttttagttatgtgcaagtcacctctactaggtgtgagaaactgttttccaaagtaagtgtagctctgacagctgtggctgagacatcctattgcccactcatcctttccagtacctagaattgatctgcttcttaatttgtgcaaatttggttgtagtaaaatgatatcatattattttattttgacttaatagataaatacaatttaaatccagtccaatcctatctaatccaattgtctattattgagcatgtatatagctgaaacaacaaaactcacacagtactaaatggtatgttcactgatcttctcttccctgatcctgccagtgtcacctctagaattaaccatgattgacttaaaatttttttgttctggcatttacacatctgcatttttctaaatattgtgtatatattgctgcctttttattaattcatttagaatataatttttaaaatttcctgttacagtgatgagaatttagcccttgcattctgctagctcctgtgctctcctttcttctcttccagtatagttatactacaatttttgcttaagtaaagtttgtacctttacattgtctatataacattcatagctcagcctaacattatagtatactccaattatgtttccttttttactttctgtgtttcctaaagttattcattgccttgctttttgatttgcttactttttttttttctaacctattactaattcttcccacatcttcaaatgtcctttttgtgcacttttccacatcacatattcctgtaaaccctctgcctgaagatctttttctcctctcatctgggctggctgcacacttcgtcccgggacttgcctctgctgatgcttttctcccaggtgggggtccctgtttcctggatctcattcatgtcttcctttcttggtttgctcccttgtttggcatgaaccattttgtgggtaaatgatgtgaaaagatggttcatcagccctgacaaccttcaatattctggtgtcctgaaaaatctgctctgatctagactggttgccctgtatgcctggatcttccctcaccaccatactggatagtcctttcacttttctcctattttctagagaaaactagcaaccactaatcttttttcaatctctataattttgtcattttgagaatgttgtataaatgaagttgtaaagcatgtgaccttttgagattgtcccccctcccagcacaattcccttgagagccatctgagttactgcatgcatcaacagtgctccttcttattgctaatactccatagcatagatgtacagcaatttgttcaaccatgcacctattacaggaaattttggttgtttctaggttttggctattacaaataaagctgctatgaacaacagtgtacagattttgcatgtgaatataaatttttattttttagggtaaacgaccaagagtgtaattgctgggtcatagggtaagagtacgtttggtttcataagaaattgccagactgttttccaggtggttgtactaccttaaattctcaccagcaatgtatgagtgatctccagtttctccacatcctccccagcatttggtattatcactattcattttaggtgttcaactggtatgtagtggtatctcatcatggtctgaatttgcacttctctaatggctaaggatgttgctccttaagtgttgtgctctggcatcttgttagcctcatcctagtcctggctctgccactcccccttcatcgtcagtcctagagacacctgctgctgccagttcctgagattttaaatattcttgggagcaaatcagacttattcacagtttttcccttgctggctcaggagttgtctttctcaagtctgctaaggcagttagcacttgtctatctgctttccagcttccaaaattttgttgtgttttactgtttactgttagttgtttatgatttagtctgtcataaagtacacttcccctcttcctgttgtgttcttctcatccctaagagtttatgtcattaaaaaacctctcattatagttttagtaggagtgtggagagaaagtgagatgcatatgttcagtctatgatcacaatcagaattccctagaggattttcaaaaggcatttctgagtaggcacagtggctcaagcttgtaatcccagcactttgggaggccaaggcaggaggatcacttgagctcaagagttcaagaccagcctgggcagcatagtgagaccctgtctctacaaaactttttgaaaattagcagtgagtggcagtgcatgtctgtaatcccagcttcttgggaggctggggcaggacaattgcttgagcctgggggattgaggctgtggtgagctatgattgtgcccctgcactccagcctggatgacagatagaccccatctcaaccaaaacaaaaacaaacaaacaaacaaaggcatttctttgattactgaagaggttgaacttacttccaaatgtttatgaatctgtgtatttcctcttctgtgaaatgctagttcaaattttttgtccatttcttcccacggggatttttgccttctcttatcgatttgtaaaagctcttcatattttttgtattctgttggtcagttagatgtgttgcagatactttctcgtagcctgtgacttgtcttttcactttttgttgttgttattgctttttgtagagaaggggtcttgctatgttgcccaagcttgtcttgaatccccaggttcaagcagtcctcccacctcaggctcccaaagtgttgggattataggtgtgagtcactgtcctcagccttcgttttcactttttaaatggtttcttttgctgaattgaatttcttaattttaataaaattgccttttgttacagctttcccttcacgctttgctctttttgtgtcttgagaagcccttccctcttcaacagtctttttagttatgcctttcatgtttaaatctttgatcatttgggatttatttctgagtatgatgtgaggtagggattcattttctctacttaaaaaatgtatggagagcaagtttcccagcatcttatcaaaaaacatcctttctacactgatctgcactgtttattctgtcagttatacttcaagtttccattagtatatatttttctgtgttctcagtaatcttctgttggtctttttgtccatatctgcacccataccatacagtttaatgacttcagctctgtgctaagtcctgctgtgttgcataggtcccagcttgctttcttcttcaagagcatcttggctaatcttagtcctttgctcttacatgaaaaaacctcttgtgatttttgtttaagtgtgttaaatctttaggtcaatttggggaaaactgacatggtgatgaagtacatagtatgtttctttataaaatatatgatacatctctccttttacttacaccttctttaatgtctttgaataaagctttcattatttttcccataacgtgtttgcacatctgttgttggttttattcttaggtattcaatatttttaattgctagggtaaatgacattttaaaatttatattttaagaccatggttggtatagaaatcggtttgtatagattgtgattgtattgaaatgcagttggattggggtattgattttgtgcccagcaaacttgctaactatcttcattctaattagtattagtttttttcccttctacttaaacaatcatattatctgcagaccatgatcacattttctcttttctttcctcatgcatttatttctttgctttactgaaactggactggccctttggttaacttttgactttgtaaaaaagcctattaaaattatgagtaacaactgccttagtgcatgcaggctactatatcaaaatacctcagaccaggcaatttataaacagcagatatttattgcttacagttctagggcctgggaagtccaagatggaggtgtcagcaaattcagtgactggtgcgccggtttctcacagatgatgacttctccctgtgttctcataacgcagaagccggaaacaagctccctccagccccttctgcaagggcactaatcacctcccaaaggcctcatcacctcttgatactattgcatgggggttaggcttcaacatatgaatattggggggatgcaaggattcagaccacagcaactactgagacaatgtgaatagtacacacaacctccaacccggtacagaaggaaaaatcaggaataaaaaatgtctaattcacatgaaggtcagaaaggaagaggaaaataaaggtcagaggcaaagtatggaattccaaacgtggaatgccgaaatggagaactcaggtccggagccggtgaattgccctccgcgcttatggagatcgcctgcagcgccacctgcaggctggaggagcactccgggccccagttcaccgccctggacccagctggcaccacctgcggttcccaaggacgcatccagtaaggggcggggcggggcggggcggggaggggcgggactcaccacccatgtgacctgcactggcctggaggagctgcctgactgcagcggactctgccaagaatttcaagaggtgcagtggtccagtcataaagcaacatgaaaacgctgtaaaaagagtttaatcgcgcacacgaggcagacattgcatttaatttatcaccctgcaaaattaaagccattctggggtttgctatcgctcatgcagggtggagttatttattggacactgtcagagccgaggggatctgaaattcaggtcagggaaagtcaagtttacaaaggcccgtccgggtccctaggggcccagatggctcagggcaatgttcctgtgtcttgctgctgcagaggctgaggggagcaggcactgtgttcacatccttgatgagaaagccgagctccgtgtgggtgcgtgcaatcctgcctccccgagctccacgctctgaccctctaactcctcagaccactaagtaggctgtcccctcacctgcccctttgacgatgtgctgggtgccaggtgcctgaaatgcgtgctcctacctgcccagccctgtaaggaagccctgcatggtgacccccatgtcacagatctgagccctggctgagttgatcaccgggcctggcgctgtccacccagtctgtgctgaatctatttgaagaaacccatggggtcctgggcttggaccttttgcttggcccagggaggaggggcagggcaggcgtgaggcctcctagaggaaggatggcggccggtttgaaatacacctgggaaatggctccgggggacaccacagatttgccttcaaagcacttgttcaagcagttactcactgggactgattgcagaggaggtgggcagggggcgctggccgggcctctgggctctaattagtcaggtaataaggctgtttgtgccaatttgctgggccgacaggctggctgctcactggctgcctaacgaggtggggagttggggtgagtggcccaggcaaggcccattgactcaccaatgggctgcggctgcccctcctgctcctgtctgcagggcccaggagaggtgagtggaagctggggaggccggaggtccctggcgtgggaaggccacagcagtcattggcacccagaccagcaagaccaaccctccagctggaggccctctgtccctccgaggactcactgcccgaattgccagacaacctgccaggagtcccggcacccacacctcctgtccttgtgggtctgggttgtttgcactgagtgcagagctctgcggctgatgtagggagagaacagagggcttaaccccttcctgaatcctctcattctggcccccaccactgctgagtttaacaccatcctgacacccactttccagagaaatcagcagagcctggaagagcctcagggagttgaaggagagacgaggagaaggggctgccactgtgggttttctgtgtgacctcgggtgatggcctgccctctctgagcctgggttccctgtctgtggtatgagctggtgctgcaggtcagcctttgtgcctctcagagacagtgtgttgggtggctgaggggggcgctgggggtgtgaggggaaggaagaagcccagcaaatgcatgcggtctgcttccccgtgagatgttctgctttctcccatctctgccacaccccttctcctggggacccccagcccagcgccctggacccagggccatgctgacaagggatcctgtgagcagcctaggagcaggcgcacattccacacatacttctggagcatgtgctcagtgccagatgccacaacaggggctggagacacttggggagctccaggctcacatccctggggaggcaggcgccagccccatagtcctctgagtaactgtcctgcagggtggtgctcagccgtgcctgcccacacctccatcgactccaggtggcacatcagggcagggtcaccctcaccctccagttcccagaggcctcctctgtcaggctgcaccctctgtgagtccctggaggaccctgggctgaagtcaggcctttttcctctcccctgcacagatctggcaccttccagctcctgcccacagatctgtattgcacctgccaagctccagtctcccacccccaacctctgcagactcttccagcctcctccaactccaggttcctgcaggatccctccctgtcctactagactggagtgactctgaagtcacttctacaagcctgcgttgggctcccatgcagatgtcccatgtgcacagagccccgattctggctgcagaggcagctggcaccagatgtgcagacacaaggtgcctgggcaggtgcccagacagaagcctcagtctggggccatgaggtgagcacactcccgagggaggcatcagcccaggacctcaaacaacgatggtgagaacaccagcccgcactcttcctcattagttggagtcaacttggatgccaccttcgtgggaaggtctctcttccccaccatacctctgtgcctccatctctctcggcctttcaccctaccaaggaaaatcttccttgtccttcctttgtatcactgatcatcacccagcatgatctattcatttgtgagtaagctttctgctctttcccctgcgatgcaagctccatgcaaacagaaagatttgtctgcatttcttttcctgccaaatctttagcataaagaatagtgtctggcatgtaggaggtgctcaataaatatttgttgagtaaacaaacgaatgaattggttgtacatccccttcgaggcaatgtccacacagcacatttatcatcgctgcacttgcaggacaaatggcttctgtgtcctgctggcttccctccttttggataccagttgcccacgtttccattagatcttctgatttttcactagcgctgcccaagtgctatcgactgcctgatgggtgccttcccagactcttctgcacattgcacactcaggctgtcaacacatcactcctccagacaccatggagaggggcgccttagtggcaaaatttttccaatcgggggagcaattttctcaggataagttcccatgaattgcaattacctgatagaggagcccttgctattgctctcgccatgtgttgcaaattgcatcctagaagctatgtgctgctcacgtgccaccagctcacagtgccaccagcagtgcaagcacctgctgggggaagtccaagctgcacctgcctgaagccagcatgaggctgaatcccagccctgagcctccagggagaggcatgacccagacatgaaggcaacagaaagatatctgtgacctgcccacatggagggatggtgccatccagggtcctttccaaagagggcacccaagggcaaggtccagtgtgcatggagcttagggccagggagggtgaggagtgccggtggaaccccctggaatgagcaccagtgcagagaagcattgcctccctgctagaggaggccccaatggatcatcgtgaccaagggggcaagctctagatgaaagagtaggacaaaaagagaaaggagggagggccttggagagaagagaaggaaggtgagcaggccagcggtcactgagctgggtgtccatctgtggcttcatgagcctggtgcccctctcctctcttgaggtgcaatggcagaccctgtagggtcccctacccccactgcatgtgcccctgctggggctgcccatccagggtccagggctgcctccttccctccaggccctcttgacaaccccgctcccctaccctaatttgtgggaggattggatcctaagccagtttagccaactctgagactcactctgtgccagacggaggcaaagtgtggggctcacaggctccaaactgaaaaagcaagttcacaaaacggggggcacccggcaccgtgggaggcgtgcaagacattggatccgacttcactggagggcattgcgagaatgttggagatggggaatgagagagaccggcagtgaaggcggcacacccgccccaccctcaaggcaccgtgcaccgccctgtcctcggatctcccctccagggcaggaacgcacccacctgaccgagttgctgaggacaggctccagtgtgagtcatctgggccacgcttggctcctttttggtggggagtggaggaggcaaactctaaattttatttttgaagtgaaaaaagctgccatttaaaaaagttgtcagtcaagttccactgctgtgtgtccatcaaagctcgaattggactgatcctgccatagataatggtgataacctctggacaaataacaaaaataaatcaatcaacagaacttccagtttcagctgcaacatgtaaacagcttggaagtcactcctctccttacaataagaaaaaggcggaaaaagtgaaaatcagtgacttttctcaaacccatcagagaatggggttgcaaagcaaactgccaccctcaaatcccgggagacacatgaatatggaagagcaagtctgagatctgctcacctggagccgaagccgctggagccagaaacccgcaacttgactggcagccttgatgaactgctgggggctgaccgtggagtagcttgacagggagcaatttcctggggccacactctttttttttagatggagtctcgctcttgtcgcccagtttggagtacagtggcacgaccttgctcactgcaacctctgactcctgggttcggggccacactccttatggggggcccattttcgtgggcttcactcccagaaaccaacaagtctttcatggtgaagatctgaaaatgacccctgtgtctctggcagtgggtggcgaaggcaatcgtgtgaaatatacccagtgccttcttcataaccaaggcctgttctccaggaaaccttattgcaggtgggggagggatttcctcccactcctgcccccgccagtgtgtctgtctcaccttaggataaaaacaaaaaacatagtaaacgagggccagagagcttcaaaagaatagattgggaatattgcaaccaggaaaggacttgcagggataggaagctatacccatgcagaaacacgtgaaggtaacagcctagggtcacaggcccactacaacactgacatgtaattggaagattataaagaacctcctccccaacacctaccacagccccaacagggctcccatataatagcagtggattctgggacagacacagactctctaaggaggattactcagggaagcccaaagtcaaaagtggcggacacaaacaaggatactagaggaatctgatgcttctggcacccatagctacagcaaacattaaacatggaccaactcctagcaaggttaacataaaacttcacactaggccaggtgcggtggctcatgcctgtaatcccagcactttgggaggccaaggcaggaggatcacctgaagtcgggagtttgagaccagcctgaccaacatggagaacccccatctctactaaaaatacaaaattagccaggtgtggtggtacatgtctgtaatcccagctacttgggaggctgaggcaggagaatcacttgaacccaggaggcagaggttgcggtgagccaagatcccgccattgcactccagcctgggcaataagagtgaaactccgtctcaaaaaacaaaacaaaacaaaacaaaacttcacactaaaggcttatttctctcagttcttaccacccaatacaatatgtcaggttttcagcaagaaattacaaagcatgctaaaaagtaagaaaaaaacacaatctgaagagacaacgcaaccattagaaatggactcatgtaacacagacgattcaatcattagacaaggaaggtagatataactataattaatatgcaaagggctctaatggaaaaagacaacaagcagaaacagatgattaacctaagtagagagatggaaactcttagtaagaatcaaaaagatatactagaaattttaacaaacaaacaattatgacagaaatgataaatggctcatcagaggactgacacatccaaagtaagcaccggtgaatttgaagataggtcaattaacacgtcccaaactattctctgtgtctcttaatatctcttttgtattttctacctcttttctctctaagacgcattctgtgtaatttcttcagttctcttgtctaatttagtaagtctgtctttgactgcatctaatctgctactgtttatatccctcttccctctttagcatatttgttgagtaaacaaacgaatgaattggttgtacatcccaccaacccattggttgtacaactgccaccaactgagtcctaggggttctcttccctaaaggcaggttgtgggtagcacacaacctcaggctctgcttaccttgacttgaaaacctagtgacaagaatgtaagtcttggcagagagacagtctctttattcactttttaaaaaattattaatatataattaatataccatgaaatgcaccatcagttttcctttgctgtgcaagacatcaccgacaatctagcagcttacagcaaccattcatgttgtgcacggttctgtgggtggttctcctctggtctggtcaactgacctcagctgggctcactcatgcacctatggtcagctagcaggtcagctgcgagccagaaggtccagggtggcttcactcacacgcctggtagccagcagactgttggctgaggtgatagggcttctgggcaacgtgtctctcatcatccagcaggctggtcctgtctcctccatatgtgttcacaggggtctgagagcagaaagaagtcaggccccatcatgcctatgtcacatttgctattgtctcattggataagccaagtcatgtggccaatctcagattctgtatgggaagggactgcatagggatatgatgcagaaagatgtgtgactgcagtggtctacccagatgttaactgttctatggccccggtcctgctttctctgctaatggtccctactctgttatctattggtgtgaacaaatgactccaaaacttagtggcttaaaacagctattttattttgatgggccaagaatttggaaaaggcttggctgagtgattcatctctcattcagttggtgtcagcgggggtgactgaggctggagactctacttccgaaatgccttcttcactcccatgtttggagccccagtgcctctgtttctctctctcctccacacactgtctcatcccccagggcctctctgcatggcttgggcttcttacagcaggtacatctcaggttggctgaatttacatgactgctggtctcctggagcaagcattccagtgagtgaggcagaagctgccagacttcacaggacttagtctagaggtcctggcatgtcatgcctgctgcattctgtaggtcaagcaagtcactaagaccagggcagatccaaggtagcagcagattcgacttcatttctcaatgagaacaaagaatttctatccatctttaatctaccacagtctgccctgtggctacaactgttgatactcctttcaaatgcaacacacactgaatctcactgaaggccctcgcaacgtgcacccagccccactggagacccccgtttgtctcatctgtttggctttggctggaggtccaggaccctctgggctaatgaactccagtgcacatggggtcctgggtcctccaacacagttgttctgatctgaagaactgcaacccagatacgagccatggggcccttccacccacctagattctggtggtgagactctggggaccaccagaatgaacacccattcaacagagcagaaagcaggagtacatcacagtcattccatggcgatcctgaaatccaccctggcatgttgccagctcctgcgccctgatgtgatgcagaaggagtgtgactgcaatgacccacccagatgtcaactgttctgggggcccctgggtgaagaagattgtgccttctgggctcctggcatcatcctctgagtcactctttctcttccatatgagctgtccctgttcacaggtaggtcctcagctcggccttcctcctaccttaggaagatagagaacaccactggtacaattttgttaaaaggtttgagaggttcttccagaccaactaaaaatcagctggattggatcaaagctgccctggcattgcctgctgaggctggcctatcttcaccctgggcagccggctatggaacagcacccaaacatgcctggaagcctcattgactggctgggagcatcggtggggcaccccctgaagatgtttaaaggctcttttgtttagctgagagggcagtgagccacccccttccttctctctgaggtctggacaagagcgcttccagctgcgctggcttgcagccacacatttctgccccgagatcattgtttgtactgagaatcttcgttgggagagcttgagggtgacacagttttgtttttgaactgagcaagtcctgggtcttttatgttcactctaacttctgctaagaatttaactgttccttaagctgaccccctctctctttgtattttatcacaggcaaagctggctgcctggaagggtcccctgtcagatccaccggtgggtgagctgccctttctcttttgcaggtcaaactttccattactgtcaccatgtaacaggggccctttcctccagcctccagtaatgtcctcgccaccctcacccttagagccctcaccaatgattccccatgctgcctcccatcatcttgtccccaaaccaatgacccatggtgaacttttccttattaacatttttaaaataaaattgtatgtatttaagatatacaacatttgaacatacacatagtgaaatgactactatatatttcattgtatatatttaagatatacaacatttgaacatacacatagtgaaatgattactatagtcaagccaattaacagagtcatcactccacaaagttaccttttttaaatgagagcacctgaaatctattctcagcaaatttccagcatataatatagtactgactacagtcctcatgctgtacattagagctctagactaattcatcccacataactgcaattttataccctttgatcaacatccccccatacccactcctgcccctggtaaccaccgtttctctttctgattctatgtattcaccttttaaagattctacaaatacatgcagtatttttctttctgtgtctggatcatttcacttggtatgatgtcttctggattcatccatgttgttgcaaatggcagtatcttttccttttttatggctgaatagtactccattgtgtatatggacctcattttctttacccattcatccactgatggacacttaggttgactccatttcttggctgttgtgaatggtgttgcaataagcatgggggtgcagatatccctttgatatgctgatatcatttcctttggctacatacccagctgtgagattactgggtcatacagtagttctagttttagctttctgaggaagcttcatactgtttgccacgatggcagtacttattcccaccagcagcatgcaaggttgcaaggtttccttttctccacaacctcaacactgctattttttgtctttttgacaacagccattctaacaggtgtgaggcggtatcccattgtggttttaaatgtgtcaggttggtgcaaaagtaattacggttttccattactttccattgcaaaatctgcaattacttttgcaccaacataacacatttctctgatgattagcgatgctgagcatttttcatgtacctgttggccatttgtatgtcttcttttgggaaatgtctattcagaccctttgcccatttaaaaattggatgatttgttttcttgttattggatcatttgagttccttgtatattttggatgtgagtcccttagtgggtgaatggtgtgtgaaaatgtcctcccgttcctcaggcgccttctcctggtgctcacggctgcctttcctgcactggaactttgtcgtttggtgcaatcccgcctgtttattgttttgttgcctgaacttttggtgtcatctccgaaaatccaagttcaggagcttccgcctgtgtgttctacccatttaatggttgtaggccttacatctaagtctttaatccattttgagttgatttttgtggatggtgtgagatcagggccaatgacccatgtctaaagattttgttacagcagcacgcccaccttccaggtatcagattatattctggtgacttattgctgtgtaataaatgaccccaaaatgtggtggcttaaaacacccccccattttatttggctccttattttgtgggttcaggtttggaaagggctcagctgggaggtttttctcggatccacatggtgtctaccgtgcccacttcccagatggcatcttctcccacatgcctggtgcctgggtgccacgtggttcctcctcctctacatgggagtccacggcttctcacggcatggccagggagtaaacatgttaccctgaagatttccaagtgagttgggtaaaagtcacaggactcttgactcagccttgggagtcccagatgtcacttctgccaaattccattggtcaagcaagtcgccggttaaggccagtgcaggctcaacggggcgggtggatcagagtccatttctccagggaggagaaacaagaaatttgctaccatcttgaatctaccatggtctctggagcccggccccttgcctcccaagctagatcctagcttcttcggcctctctttgctgtctctgtcccaccaggagaacaataggggtgggtgccctccaggcctgtagggacccagccagtttctcctaacccgggcagctctggcccagagggattgtacatggcagtccaggggttgggggctggggtggtcaggctggaacgggagcggccaggggcaggggacaggaatgtgggggaacactggtcctagggaaggccaggaggcctgaggaggaggccagcggatcccagcaggtgagggagacagtggggcaggaggggagtgaggatgggggattgtgacggccccttctcccagcatgaacctcccaagccggctgtggatgtcttgcagctttgctccttggagctggggcccccactgtggtgactggccgctgcctcctgctgtggtccctcccccagattccagcattgcagataataagtgaaggggctcccagtgccagccctgcccacttctgaacaatagtgagtgtcctcaggcactcagagcccaatgaggaagaaagacacatgactggctggcaaagccctattgtgaggggcacggagggaaggggcgggaggaccccgggtcggctgctgggtggcctcgtggtacagagacctaaggggtgggaaggaggccctcagggaggagcagaggctctgtaccgacaggtgggctggcccctcatccacccatgtcctctcctggagcctcagtctgtccatctgtcaaatgggcagagggacagcaccatctcatggagctgtcgtcggggctgcaggctgtgaatctgaaggcttggcacatgggaggtcctcacgaggatgagattcttcgctgtgttgtcgagttttcccagcagagggaagcgtgcagaggcgcagcagagcctggtgtgctggaggaacagacgtgtggtcggggggctggaggcacgggctgtgaagtgaggtaggggttgagggtcaggttttgctgggagagccttgacttctgtctcacagcggaaaaccagagtccttcaagcagggagtgactggagtcccaatttggtttctcaattatcagggaggagggtgagctctaggggttgccagggagatgggggtctccgtggtgggtgcagggcttgctggaactgttctggaggtccctggagatagaggggccctgggttggccctggagcccccggtggtgctagagaacttggcatctgggtgtaggctctgccgggggctgtgtccctgcccagtggccctggctggccttgtctggagaaagctccaccatgtttggccctgggtggcggctccatcaaggccactgccagccgctggccctcagcccttccaggagcctgctcgggagctgccgggacattgctctgcatcgtaatgacgcgtgctggctctcgaggaaggatgtgacattcagcatccaggaaattcattgttattgccgcacactgaatgccaaatgaacccataacggtggtgggactgagctgaaatattatccaggtttcaagtgactctggattattgcaaacacacagggcagggggagtgggtggaggggttgtgcagacgcaggtctgggacagcggctggcaacaggaaaaggggacagagttggaggcaacaggttgcagctgctgggggcagggggctgggggcagggggctgggggctgggggcagggggctgggggctgggggctgggggcagggggctgggggctgggggctgggggctgggggttgtgggctgggggctgggggccgggggcagggggctgggggctgggggctgggggctgggggccgggggcagggggctgggggctgggggctgggggctgggggcaggggctgggggctgggggctggggcaggcagggccggagcctctctcagtagctctttgctgccccagggaggtcctggtcacagcacgtgggctgacgtggctgctcagaatgggggtgcgtccaccagcggtggctccccggcacagcaggccccaagttggccccgcccctgaggcccgcccgagggtgaaggcttctacagggggtctccgatggcagctgcctgaccagtgcagcacccgcaagctgcactccagcttggggctcccttccctgtcctcccgtccactgtcaccttgcacagccttcgactcgctctcctgactgggaccggcctctcccagccaagctgggcccctgggagagcccccacactaggtctgcaccccgtggtctcccatccctgactccgtcccacaaaccaagctcctgggtggggagagggggcctgtagctgcatgcagtgatgggggggccagtcccccacctccccaggctgttgagaaggcaacaaggaccaagggtggtgagtggctgtccccctttctcagacccagagccagtggctgccccgtggttactttgtccgacagcggtgggttggccggggttggtctctcctgcactggggcagaggctggggggacaggcagcctggatgcagcctctgagcctgtccctctcgggaatggcagcccagaaaaggctttttccttccgttctgtcttcttgtatttccactttttttacaaaagaaattgctcagaaatgatttagagctttttgctaaaagtgcattttgtcattacatggaaaaagcattgataattatcccagctgcactctgctcctgggaggatagatgggtcccagctgtaccccactcccacgaggatagatgggtctgacatccatatccagccctcattgtcctcactgcctggtgcctctgccaggatgccagaccaccctcgtccctggccaaagagagaagctccttctcactcctaccatccaccagaggcccactccctccaggtcccaggccctccgtttttttgggcccctccattctgggttgtgggaggcatttggggagccgggcctggtgtggcctcgggggttctgagtcagtcacggggcatcctcacaggaaggcatgcagggaggcgggctgcagctgtcttcaccgtgggccatgtcctgcttcccctgccatctgcaggacgctgggagagccagtcagatgagggaaggccccggacggctcccctgtccccacccgcccctgggctccatgtaggacagtccccacccacctctaggctccgtgtaggacagtccccacctgcctccagaccccaggagacagggaaaggcctccgtctttctcatttgtccgtgcttctcctttcccagctcttcaggagggaatcaccagctcactgctgggcgaaagttctggcagcagctgcctgggctgggctgggctggctgaagcctcagccactgctcctggtgggaagctcacatggaaagcattccagacccagagtcccagcagggccaaaaggtgggctgtgagcacaggctggggcccagcagctccagggtaaacagaaggtggccagctgccccttggtgctgggtgggctcctggatattccagggcacgaaacataagcctggcctgattctcccttggatgcgtcttctgcaggcctggctccctaaggacatagcagggaaggttctggccacggtgggaccccaggaagccagcaggcagccccgtgcagcttaggctgggcctggagagcaccgaggaggccatcccaggcacagctggcgctcacatgctgcgggggggttggatggtgcccctcaaggatatggccatagcgtaatgcctggagccagtggtgtggtctcacctggaactagggtctttgagtgaaggatctcgaggtgaggtcgtcctggatcgtctgggtgggccttaaatcccacggctggcgtgtgtccttacacaaggaaagccgagggagattggacacagagaaggaggccctgtgaagatggaagcagagactggaaggatgtggccacaagccaagggtgcccagggccactggaagctgggagaggcaggaagcagcctctcctggagcctccagagggagcagagggtgagtctcctccagggcggctggaggctctgtggggtttgcactcgtggtggacggccacccctgctggcagcctgatttcagacctctgacctccaggccctgaaaaaatgcacttctagtgtaagctcccggcctgcagacgtttgatgcagcggtcacaggggagcaaggcagatgctggtctgggcgcctcaatcaccatctctggtcccgtctgtcttgctcccgagaccccagggcctggtccttggtagcacagggaaaacaccagagaagggaatgcaggaatgaacgacacggcagacccaagcactggctggagggcggtcaccgtcaaagacagggcccaagagtgagagtgtggccacaggagccgagagctaggagggccaagtgtgaattgcaagggccggggctgtcctatagcagggctcagggccccagcggatgcagcctgacactcgtggtccagcttcctgagcacgttcttcgagccacatattttgaggacctactgcgtgctggccagtgctcggaggcttacgtggatcatgtctacctcggtagccctgtgggcagcatcagaaccctggctttgtgggcgagtgaaagtccaggcccacgtgtggccgggaagtggcaggcttgggcttggaccccggaccccagacccacgtctctgcccctggagaggcctcctgcagtgccgcagctctggagttggatggaaactagagcagggacagtgttgccgcagcagagcgctgcagtcccaggaggtgagagccctggtaagcgtgggcggtgcaggaacccgtcctggaagtgtccctacatacccgtgtgccagtcactaaacgccacacaggccgcaggactccttcggcccagggccactgtcctgcagtggtgagaagcctgtctccacttggtaggaccgtaattaaccagtctggaagcttccgtcaagctctgtatagaatcagccccaggcaaggcaccgcacagtggccatgggcctagcgcactccatgggcggagaatacactgacgatggctgagccgacaatggactgggcacagactcagcgtgccagggcctccctgaagtccagacagaacaactgggacgctggctttggggatctgatgatcatagatctttagccgcaaatgtgggaggatactggagtaactcacagctgtcagtgtggaaggagacaacccagagtgcagaggaaatcagcatctgtacagagagtggcgggcacacggggcttcgtgctccccacctgcttaccaggcactgggagccatgggtggctcttgagcacgagagtggcaggacaagcctctcgtctgggagccgaggcaggcgcttgcaggcacgggccaggtctttcaggagcatgaggaggtgggggcacagggcagtggggggccagggcctctctgtgggctttggcattcccatctgtgccatgggatgagcaccctgctctgggatgccaggccgggcaggggctcacttggcactgggtggactcttgagaggaatgagcctggtgttgggctctggccctggcccctgacatttgcttcttgccttggaattgggggcagtggcctggcccactggaatcgtggtgacagggtggtggctctcccttcaccagaagtgtgacctccatggaaagtccaggaagcagggatgaaggagtgcctcattctccatgctggactcaggcggacctgcggctccaagggctccatgctggactcaggatgacctgctgttctgagggctcagcggcttcctccagggccatcactgggatgagaggacctggtgtcaggtggggatgtgccagctcctgtgcccccagctcccctcctcctggggccgaggtagctgagtggatggggaacatgccctcccttgccgggccagccagctccctgccctcgtctaagcagcctctcagtgggcagtggccttgggccatccctgcttccagagggtcccccatggggccctcggcccctggcagagctggggagggcagctgcagtggggtcgcgtgcctggggggccgcgggaggtatcttgtccggggctgtgttttggattcatttatttccgctctgcctggaaacccactctgtcccctgtcctccgggtgtacagtgcctcctcagagattttgggggctctgcaggggcgaggacagctgtgtgtttgccggccacatggggcagcctgtgggatgaacggccaatgagtgaggtccggcaagcaggtctgggccccagctcagctggtggccatgacacaggctcctagaaggcagaaccatgtgtgtccatctgggccagaggttgggagtctgcagcatcaggttgggttcaaggcctgggaagcctgtcctgacagctccccctgcctccggcccccagccctgaccttaagccctcacaccaccatgcagaggcccagatggtgcaagccactctcctggctccccggctccagcacctgctgtggctcccagatagacagcagctaccatccctgcagccctcctgcaaaacacggccattcacactgcagggacccggaggggacagtggacccacaacctggcctggagctcccgaggtctttcatcatctggcccatcagcccctccagctcgtgcccatggttcccttgcacaccctacaaagttcagccaaactgccactctgggctgacccgagcacctgctgctacctgggcttccctgggctatcccaggggtgctcccaatctccagctccaagccaaggcctctctgggactgagcatttggtcctgtgtccaaattcctgttgtccatgttggatccagctcctgtccctactcctgcagaggggcccagccctgcagtccagcaagatgttggcgagtggggatgggggcagcagccctggcttttgctggaataggaggatctccccggccgttcccacacaccctgggctccacagagctgggaggacggagcctgggttggggaaactgcctggtctcccggtgtccccacagtcatctctactggtcctgccctggctgggtcagctcctggctgatgacccaagcctgaggtccacctgtgagctggtggttggggccatgcatggcccacgcactggctgcccccagggaagacagctgcccctcacccactgttgggcgagggttgagttctgttccccattcacaggtgggaatccagcccctgggatctcagactgggacctcatttgggaacaaggtccttacagaagcaaccaagttaaagtgagctcactggggtggtgtcctgtgtggctggtgtccctataagcagggggactttggacacagacgtacacagagggaagacaattaaagacacagagaagacagtgtctatcagcggaggccggaggccaggcacagactcccctcaggaccctgggaaggagccttgaccacagactccaggccggacctgtgagcagcaggtgagtgccgtctaagccctggtctgcagggcatcaacagccacaagaaagcagctggctgtccccgagggagcgatctgcccggcagacacactggagtccagggaggggctcaggctgggctcctgccccagccactaccttccctcccctgcctcccctcccctcacccttgccctcacccttgaggggctgagcaccaaaatgaaattcaaccttctcaagaaaacgtgtggcttttggaaccatgaaaaaaaggcccttcattgtacagatggggaaactgaggtctggggctgggagcttcctcagcccatttctggcccatggtgcccatctcccacatgagatctggcctccaagcggtgggggtgtctgtctgggccaatgaatgtcttggcctttgcttggcgtctccctgtggcctgactcattcctgggggagtgtttgattttagaaggaaagggggacccactgcagggtctggagagggactttccctcgtgctcccctccctgatgtcccggtgcacttcttagctcgcttgggaaccccttggccggagcaagctcatgggtcaggcgagttgacgtgaggctgctggaggaatgactgtggctgccttaagtggctgggatcccacgagagcaggcagcccgagcttccaccgagggcagacaaggtcaggggcagggaaccgccgggtctggggaccagagaacctggggaagtggcttgtggaggagcaaagcctgtgtctgcacaagagcatgtggtgggctcaccagggcctggcgggggtgagactgctgagctgctttggaagggagtggggaccagcagacctgggacagacatctttgtgcagaaactgctgtggaattggaagccggcctcactctcctagaaatcaaagcagtcagcaaaatgcctcctccttcagggagccctcctggttcagggtgtgtgtataggagaaagaaaccacctacttcacgctggcttgcgtagtgagctgtaaggaatgttctggcatctcctctggggttctggcattctggggaaactggctgaggagaccttggagcccactggccagggatgagaacaatgctttgggagagcctgggttcttgcactggaacctctgggctcggttctgtggaaattgttctgagaatctgcccttgatttggctgctctggagcatggtggcggagtctgggtgagtgccaggccctgctcccacccaccattgctgttctgtgtggtggggactgaggctgagaagccgaacaccagccagagcccacaggactcacgtggcaggggcagggcagcctggtgcccgagctctccttggcccatctggagaaggctgggctggccaggaggtggggggtcgggtcctggagccctcagccagggtagaaggaggccagggcctgcatcccctgctgtgtccctactggggagtgggtgggcaggagccctggccatccagggcgtgtggtggcccccggagcagtcgcaccctcattcctcacaggtgggccctcgtcctccagagaaactgcagctgctttatgaggccagcccggcggtgcaaagcactggggtgataaaggagggcagggccattacttatcgggttcaattgttccggggccctgggcagggaggtggggtcactgcagagcactctgacatctgtgcttggggctctgactgcggttggggcctgtggagggggtgtgggggtgcagggctcctgagaacccaggaagcagcgagaggaatgttccgggaccggcttaggctctgccgttctgggtgttggaggggagggcggctgcctctgcacagcagggcccggaccaggatctcacaggtcccctgggagctcttggaccatagtggacagaagcaccaggatttctggggtcctggctttggacctgggtgttcctcatgttgacgggggtctcccacacaccaggtccctttgtggcaggggggtcaccctgagctactgaaccagcctcactttccgtaggaggccagggggataatggtgcagggtccgtggctgtgggcttcatgctgctgggggccaagaggaataaccagcgatgacatcagagcaggtatgcaggagacgctgcctgggtcggcaccccgtgcctcagtttctccatctgcaaaaggagtgacaacactccagaccccacaggatgactgacttcaagggggaaaagggactccagcctggcctttactccgaatctccggacaacagcaggcactggcaccaaagacaccaccccctcctgcggaagtggatttccagcgcgggcaagtggaaagtgctcatgggggtgggggtgtctgccactgcagagctcgttctatgaggggcctcgttccttcttcccaccagcctctgctgtgggcatctgtatcagccccaccttgctggggaggaggtggagctctgcctggcccaggagaggggcttggcctccagcacacctgggtctggggccctgcctgggctgccagggcagcttgggggactacgtgaggtcacctgttcattttgcaggaattcatggccctacgctgtacaggatcttctctgggctctgggaacatagcaggtgtcaacagcaggtgggagcctgcaccctcctgagagaatggggggctctgtgccctccacactaggcacagctctgcggcgcccgccggctaaagccacatcttggttaattcccaccagctgtgggaagtaggaatacccatcccattatagttgggaaaatagactatccctgaacatccctggtgttcagtgcagtgtcccctcctctaggaagccttcctgggctcccagctggggtctcagcccctcccagcatgtcaactctgaagtctcgtggtgactgtctccacggagcacttttgagggagtaggctcttttctaacagacttctaaatatcacatccctttgtcccctgcactatctccccaggtagggactatcagtactgccactgacagctggaggacttgaggcacagagcagttattaccctaggttgctgaactaggaaagggcacagccaggatggactctccagcagcctggcctggcgtcaggatgctcgaccccaagaaagttctggaacttccctgtgctctccctctggctgctccgtgtggggctccgactcccaagagccccggggctgctgtgggcagataatcaggaagcagacattcaactacaaaagcaaacattgaccaaggcaggcagcagggcctatggcgtgggagcgctacctggacccctcacagactgccgggtggggctgggggccggggacaccaggagccgcccactgacctgtgtgtctgccctgtggctccgtctgtcctggggtgcctttctttcctccctgtcaggccacacacatgaggagccagctcccatgcagagggccccctcatcgccccacatggacacacctactttccattgtcacctgtcagcatgtccgggctgtgctccagtcctgactgtggccctgatccctctgggactgatccaacccctcccccttctgcaccaactacaggaagaagggcttccactaggccagcacccagggctcctcaggcccccactctgagccaccgtgtagcgtgggctctgagggagcagggtcagtgggagccggcagggacagagtggccctaggatgtgctctgccgagagaggggaattgagtcactgcgtggggtcttccatggtgccctggagggcacttggaggaagctaactagaacaaactgggcactgtccacgtcgctgggctcagcaggggtcacccttcccagggtggggactatgaggtcttcactcaactgtgatgccacaccagattatcttgctatccagcatgtcctcagtctgaactgtgctctgaccagacaatcacaccaagacccaactcccccacacaatgcgactgagatctgtgtttttggagatgattgcctgatttctcccaaaaagggttttaacttttcatagacagggggattctaggagcctcatgactttccctaattttccctccacctccaacacgtacctgcccacctcgtccaagccccgggcttgacaggtgtcccctctgagaacattactgcactgactttgtccccgagggtgaggtgaaccgctggggactgatgccagggactggggagtggccgtgccctgaaggaaggtcaaggcacaggagtcatgtaacgcaccttctccaaccacagcacaaccatgtgaggactgatgacaagaacggagtggaaaatacccggccatctgggaattacaaaaacaacccatcagccaaacaagaaaccataatggaaaccgatatttggaactgaatgatgaaaaagtacttcacagtaaaacttgtaggatccacctaaaattgcatggaaggataattctatggatttaaatggttatattagaaaagaaggatgtctgaaaagtaatgagccgaacatccagctcaataaactagaaaaaggggaacaaagaaagaaggaaataaaaaaataagagcagaaattaatgaaatggaaaacaatatacaaaacaaaggaataactaacgccagaagcttgatctttgaaaggacatcagttttagtgatctgtttcattgcagtgaccgcagttaataataatgcattttatgtttttaaattcttaaaagaatagattttaaatgttttcaccacaaaaaataatgtgttgatgaggtgatagatatgtcaattagcttgattgaatctttctacaatgtatacatagaataaaacattacattgtaccccataagtatacacaattattaattgttaattaaaaataaataaaatgtaaaaaacctgtaaagccctggtaagtcagatcaagaaaaatgtgagaaagcatgaatagccggtattaggaatgaaaaagagaacatctctacagatctgatagatctctaaaatttaagaagagaaaaaattataagtgaatattatactattattattattattattattattttgagacggagtttccctctttgttgcccagactggagtgcaatggtgtgatctcagctcaccacaacctccgtcccccgggttcaagtgattctcctgcctcagcctcccgagtagcagggattacaggcacgagccaccacgaccagctaattttgtatttttagtggagatacagtttgtccatgttggtcaggctggtcttgaactcccgacctcaggtgatctgcccgccttggcctcccaaagcactgggattacaggtgtgagccactgtgcccagccataagtgaatagtattaatcgattcatgtcaataagtttgaaacatttgatgaagttaacaatttctagaaagaggcatttatcaaaattgccacaacaagaaatggaagacctgaaaaattcttatctatgactattacagaagttgactttatagtgtttcttccctagagaaaactctaggcccaaagagccttcattcagaactttgatttaatatttaaataaaaaaatgccatttttatacaaaccctttcaaagaaaagagggagctcttcccaacttattttatcaggtgagcataatcttaatacagaaatccaaataggaaagtatgaggaaggaaaatctcactcacaaacacagacacaagcatcttacaacctcagcagactgaatatggtaatgtgtaaaaaggatcatgaccaaacatcatgaccaaactgtctgcatttcagtattatgattttagttaaacagaacatggatccaggcagccatgatgaaggtgggaggcagtgaaacagcctctgcactactgagggaggccagctaagatagcctttgcagaccaggaagagttcatgggaggtattcaaggattcagtgatgacacattgccccctaccctgtccgaggaaagcagataatgacggacaagaacagagaactcaagaagggagaagatggcaaggggagcccctgaagagcaatggccttaaagatactccccaaaatgcaaaaaaaaaaaggaaaaattatttttaaaaatgaaacattgcagaatgtcttccttttctttattcattcccttgttccctcgcccctgctcactcactcattccacaagtactcactgaccccatctctgggcacagctggctcaggggcccaggccccctcctgaaggaagaagttcacacagatctgcgactggggctcccagactcccacttcctcctctcactgtcacccctcttgtgggccttactcctttaggggcagggctgggagaagaaggggccgggtgacactggtgtgggaaggggaagcagctaggggcatctctaaggctgctctgagctggcccaggtgctgctggtcagcatgaaacaaagctggcctgcccaggcctgctgccctgcagacagcccccatttgggtcacaatggccgtggccatggtggaggggccctgcccttgccacctccactgcgtgctgatcattcccatgccctttgtgtccttgagctgctgttgttccccagagccccacctcccgagagagcccctgagaggtcgggacaagaattggccagggggtaatgggtgcccagccccgagacagcagggggtgcttgggctggtcttcagcccacctgggcccacttccacctccttcaatggtgggacagggaacccccagtcctgctggccagagcggatccctgtggggacctcagtcagccaccccagagtggatccccatggggacctcggtcagctgccccctcttatgtctttcagccaacgcttgccaggtccagctctgcctcaggctgggcgggcagcagggtgacaggtgtagcagctcgttgcaccacatcctggaccctcgagcttgtcccggggggcttctgcaccccacgccaggaagctcttcccataggaagcctcagggtgagtgggcgccctcggagataaacacggagcccaagcacacgagctccggcctaagtgaggataaatctccatgacaaatgtctcctcgaaagcccggaacaaaggccgcggcgtgtttatccaccctaaaggccgcgcagacagcccagaccccggaaacagccaatcgtgtcgaaattgatggcccactcaggatgcctcatttattaccagagatgtgatagagacgcaggcaggcgtgaccgggagaggctgcaggcggccaggtggtcatggcctcctgccacccagagggcttgggctccaccctcggccactcagccttccgcccaaggacaaatggggtcagggcagcagctgtacctggcgagaatgcactcccttcctggggggccacttttttccaggagtgcatggccctgggctggctgctgagacctgtgcccagcccctccgtggtggtactctcgtcagacaccagcctctgcggcacccaggtgagaggtggtggtgctggggggccccacccatgctcttgtcctgtgaagtggtcccagggtctcctgggctctccaggcccatccgccgcctgcccgcctgccagcaaatcagctgtgggcaaaaagggtacttttggttcccgtggtgatggcccatgaagatggagctctggccctgcagaccccctcccaccgcctgggcacctgcctggaggggccgggctttcacagcagggagggacaaggcggaggagcggctcctgttttttcttgcgtgaggcctggatctgatttgcacaatgatttcattgtgtggaaatgtgccagcacctggctctgacgccagaccaccacgagtggcagcttctccaggacatgctgacatgtgacgagggggtcctgcatgtggaggggcagtggtgggctgtgaggctcgaggttcaggcgaccagcagcgggtgtgggggctcctgtggtcccagagtgcgtgaccgtcaaccagagcagggacccccacagagcctcccagttagggcccctggcaatggctgtggggggctgcatggaggggcagtggcccagggtctgtggcggtgtgtgccgggcacagcagtctcgccccagctccatctgctcccctcctctggaggaatggaaatgggacccctcctgagcccaggcctcgcccagggctggcacctggagggtgaggccccctgccctcaagcctccccagtgacctgctgcccccagggcggagcctgcctgagggggaggcagcgctcagccctgaatgagctgtcaactgctgtgtcacaaattgccccaaacttagcatctgaaaacaacacacattgattatttccagtttctggtggtcagggatcttgacatggcttatctggggtctctgactggggtctgagggatcggcagaggagcaggttccccctgtagccaggaagatgctgcgtggaggtggggcagggtgcaggtccactgaaagggagcatgaatctgctctgcacggtggccccaggcaagtgggggcttgttgcagtggggacacaggatggcttttcccgtgtaccccagaagtccacactcccctggtgcaatcttctccagggaacgggtggatttatccgtggagatgcatggagccccgccgagccaggcccagccccaccagggtctcaggagagggctggatgtggggattgggggagaggggcttttctctgggacctgcaagttactggtcactgtcaatcacaaacggagctttcctccatctctccctcccctcaccccacccccagtctccctcagctccttccccagattcttggcagtgcagcgtctaagcagggcctccagacagagccccgccctcgaaggggcaggaggggcaccccgctgtgatcctaacccgatccccaccaccaaaatctgcagggtgaccctgggaaagccactgcccttcaaggagcctcagtttccccatctcccatgggtgatgggaccagactctttccttctctccttcaatcgtaaagccatcgacatcctggccaggaggtggcctccagtcacctttatcggttcatttgcccattcattaaatagttgtggcacctttcctgtagcgggtggcatggtagcccccaaacatctgtgttcatggacccaaagcctgaggaccaggcaatgaggtcttagttcaaacgagagcgtttgcagatttaataaggtaagtaaggatcttgggatgagattacccaggccctaaatccaaggacaggcatccccatgagagacacacagggggaggccacgtgaagacggaggcagagatggagggacgtggacacacaccacggatgcccggggccactgaagctgggagggcggggaaggatcctcccccagagcgtgcagagggaggggtccggcacacctggatttcggactccagcctccaggactgtgggggagtaagtgcctgttgtttcaagcctctgagctacggcagccacagcaaacacacaccttcaatgtgcaccatctactggcagccaggggacagccactagagggacggctcatctttagcagagaaatggacccgggagggaagggacctttggggctgagggttccaggagctgacagcctctctgccctgctccctccaggccccagctgggccagtgtccttcagctgctgtgggacagcacctgccgtcttcacgctctttccacagcgcggggtgtggggagggtggccgtgcatttcaacaaccatcctcttgggattttgtcaggagtggcctggcgggcccaggcgctgtcctgcgttggataccgcacgggtccttcagcaacacctgagctcgcgggagtctcaagtaaactctgcatgtcgcaatgagtttcagcaaagcctcaagttaaatggcttgtgataaaaatattaagcacattatgactgcaagacgtgatctcgtcaatgaaggaggctcttaattatttttgaagagaaatatcaacagtgtcagatttaaccgccaaactacttaatataacttccgcccaattttgcagatcatgatccgctcgattaacgggcaggaggtaatggatggagcccgccatgctgctccgggtgccgctgctgatgctggggaccgagccaggatggagggaggggcgtgcacaggagaaacctggaactttccctgggaatagaccctgcaggggaaagccctgtcccagcgccttctgaagtgggctgcaagctgcattcaaaggggcttctcaccccagactgagggtgggagcgagggctgcgaggctgcaccctggagatgcagccaggccaggcactcacttacgctgccaggcggttcacactcacagcgcgtcctgaaccgccttagaggggccgtagagggcggctctctcattcacaggtgctgagtttgctgagcccctccgtgcttcttgcttgctccccgcactccagggtggaggtcctgctatctcctctctgcagatgaggagttctctcatccgaacctcacggctcaaggaacagaaagctggaccaacggtggtcaaatacagtgggcgcttaactacctcatgggagtgaatggaaaggagttcccaaggaccccgggttctagccccagggccctgtggatggatctcacgtggaaagggggctttgcctctcaaggatctggcgatgcggagagcagcctgggttatcctggtgagtcttcaatgtaaccacgaggcagaggaaaatttgacagagaacagaagagagaaggggatgtgtcccggagatggagagtgcagtgatagggccacagccaaggaccactgagtgccaagggggctgggggaggccaggactgactgcccggggcctctggagggagcctggcccactgcaccttattgcatccccatgaaagctgttgcagacttctacctcgagacctgtgtgagaatacagttctgttgtcttaaaccactaaatttgtgatagtttaattttttttcagcagccacgagaatctaatacattcatgaaaggagcctggaggtgggtggcaccggcgttgagaaggaggtaatgacatcacccagggccctggctcctttccctcagtcatccttgaatgttggctacttgttctctggctcctgacctcacagtcacaagacggctgccactgctccaggcgtcccatcctcacacgacagcctctgaagcagagagtgagaaagggtgggtgtggcttctccttgtatgggtctatctttcatcaaggaggaaagcctttctcagaagcccatcagtgcacttcccaggctacatccaagcaaggtcccatagctatcctgggcccatccatggcaaagggaataggttgacctgatgggcttagaccagtcacaggtcatctactgggctaggcccacgctccccaggcacaagcaggttctgttggcaaggataggagggggatgggggctggggtcagtcgcggtcatggagttgtggggagtgcctggaccgagagagtgagaggcaggatggctgcagtgtgacctcctgggtcccccaccacccagctgcccccacacacacccataaacacccatatttggagaggcactgcctaggatgtcctcagccactaccctacagggctccacacctttctggtaccacataggcaggcactctgcccacacaggtccctgcccacgggccctctgcgcacctgctcctccctgagtgtttccttccatgactcccaacagtcttggggggaaatcaggccccgtcactgtgacattaacactgtaggactttgagccccatcaggcccacgggagagcttcctcctcctcctgtttcctggggctgcctgggcgtttcagcttcactttctcttctgcacaggcatggagtggcatcacggttcaaagctggcagcccctggtccccagactgcaccgggccagttccagcttctggggcctgagaggcacgggcctcgggttccctgtgagaattgttcctggtgatagacctgtgggctctctgggggctgagcgagagccgtcctaacggggagatggcccatccagggccaacacggcacctgtgcgttctcccatcctccttcccaagggagtcctggccaggcccctctcctgtgtccgaggagtcttgccagccctcatggtctgtgtcacgatctgcagtagctgtcccatcagggctgatctggaaggagcctttcctccacatggcttttcccaagtcagccctcaagtgctgtgagcctggaccgcgcccctgtcctccaggcagctgcctgcactccacacccatgcgcgtggcagctctgcgcccagcagccctcctggtgtgatttttatttatttacctgaatactggaacagctgctttattgagattcattggtcgcaaggcttaattaaaataatgccacgcgtctcactcagcgtgggtcaccaaagcaaatgtttgttttgctgctgtcagttagggccacgtgtgatgaagcggcggctcccggcagggaaggcacgtgggccctgaccccctgcacctccctgggttgcacggattgggggttgctgagaaggagggagggaggccccagggagggcatttctggtgtcttatcaggcgcctggtgggtggacgaggtgagggccacggcagtggggtgggaggctgtggtaccatccaggggctgttccacaccctgcaccctcagagactcgacttgaaatctgagtcccaactccccaggggtggggtggggtcttctgctgccctccgataggggaagccagacagatagcccccgggcaggacacgggagggccctggagagggtcccagggcagaggagcgaggtgtccacagtaggaccgctgaggtggtccaggaggaggttcctgttgctgccataacaagctcccgccactgcagcacctccagctccacagagctggcgccttccagccctgggggacgggtgtccaaaacgcatcccaccgggtgaaggtcaagggtcacagggcggctccttctgggggctccaggggaggatcggttccttgtcttctccagcttccggaggtgccccccgccccctcctcaccttcaaggccagcagagtgcccctccgtcctccccccgactctgcctctgtcctcacgtctccaccctcaccttcctgctccctcttctgaggcccttgtgacaacatttagcgcccacctgggtcgtccggggccatctcccacctcggggtccttctgttagttgcatctgcaaagtccaggttcacaggttccagggtttaggaggagggcgtcctgggggagactcagcctgcctcaccccaggcattggctggcagagaagaggggtgtcaggtggaggacagtccgagggagaggaggaccccggacccagatcggcgaggctgtgaggaggggtgcagccgcccaccctggagagtggaatgccgggggcgaaggtgggggggcagactcggcctcacgttgggggcagggaactcagctgacgtgagcctgagtgtttgctactgttgcaggggcggtggagctagacggggccaggtgagggacaacgccagacagtgaggccaccatcagggaaaagtgggtatggggaggccggaggggccctgctggctgggtgctgctgggtgcggggagtggagctgcacaggccaggatcgagccctggcccaggaggagaggcccctgggcaggtgatgagcaaagcccagggcaaagtgaaaagctggggccttgcttcaaacattatgaggaatttcagagctctaaccaagcttgagttcctctgagcatgggcctcgccacagccatgaagccggccctggggctgtgctggccaggctgagtttgagaggcttgtgcaaccccaggaggggtgaagaggcctttctcccccagcagctgtgtgacctcaggccaggggccacacctggtctgcacactgcctgggagcacccagtggggctgtctgcaccagccgcccccagacctagaggagctcaatggggtgagggtggaagcatgagggagaagtggggagcctccttatggtgcagggggagcggggtacaggaggagtctgggggagctcccttatgggatagggagatgggatgtggaggagcccaggggaccctttacaggatgggaagacagggtgcaggggaagatggggagcaggagaagccccttataggagggggagacggggtgcgggaggagccccttactggacgggaagatggggtgcgggaggagtcccttatgggatggggagacggggtgcgggaggagccccttacaggacggggagatgggtgcgggaggagccccttataggacggggagacagggtgcgggaggagccccttacaggacggggagatgggtgcgggaggagccccttataggacggggagacagggtgcgggaggagccccttacaggacggggagatgggtgcgggaggagccccttataggacggggagacagggtgcaggaggagccccttacgggatggggagatggggtgctggaagagttgctgagcggcagtggtgaaggaggttggaggccactatggtgactgtcccaagagttacgttggagtgtcctaggagtagaggggaagatgcggctgtcggctgcgtggggtgccctgagagggccagcgtgatgctggggtgccttggcgtacatgggaggtgtcatcctattggcagggctgggccagagccgtggacagtgcaggacaaaatgggggaatgggacctgggctctagtggacagcagacggggctggctcaggctaggcccaggggtcagagcaggcgggatcctggggacagcagatgcacagcccgtatagatgcccaggacttgcttcatttgtgttaattaccttcttttgattttcctgatcaataaattatcccgacgtaattggattatttgcatggctggcaagaggtcgctgtgatttagcgcctggcatcctggcagctgcgtggggtcccattctctctgagctgtcggcctggtcctgtcctgtgcctgcaggatggggctttggggcctcggcctgaaccctcctcaccatccactgtactggctgagttggggctgctcccttccactctgaccgcatccttctctgcggcggccatcctccgtgtgccttcagggagctgccctgcctcccgcctcacacctaccacatcctctgctggccactggcctccctggacgtgaagtgcaggccctccgggcagccctcacaggctggctgctgcacccatctggggctcctctggtcctttggaaccggcctcagtgcctcctccccagcgaggctactcccggccacctggactcgaaggacccccaaccctctggctctcgtgattttactcttgccatggtgagtgccatgggaactggtttgcctgtagcttggaggtcagggcccccgtaggggtgtaagttccaccaggcagggagtcacccagctctggcaccccgtggagcaccggcccaggaggctcccgctgcctctccagccgctgtgtttcgaggtgcttccttccttagcgttttttcttggcttcagttggcgagcttggcagagctttatccaccctcgtggaggtcagatttccctttgccctggtaagtaaaaggcatgccctcctctgcactgtgcctctccccaccgcccttctcacccctagcggcttccctctgacaggtatgaccctctgtcccctgtggtctctgtcccaaacagccccatttctcttacccgtgaggctaccgggaggtcaccacccccagacttgtctcttccctgcggtctcaggcccagtgacccggggcggtcccgagggcagccactgttctccccgaggcagcggatgagggctccgcactttcctctctgaccctgagctttctcatccttttcattaggatcgggacaggcctctcctgggctgctgtggggaccccagcagatgggtgtgacaccgagcccaaagaaaggggcttgggacactctcagcccctctggatatagaaaccaccccacacattgtctgagcttggcccttggggagtgactgaggtgcttttggcaattgtgcagggacataggagcccgcaggggctgtcaggatgggctgggaggctggcggccacctgcatgttgaccagcacccacaggggcccttgggccttgcctttgccagttggagattctctctcgccaccttcctcctctcttccagcctcgtcttagggctgtggaggcccctccctgcctggggcctttacagtatatgctgtttgatcacccctaccccaacctgcctccatctccaacctgccccgcaggcccctgtgtcccctcgtccctccaccaccgtgccctgcacacccccagcccaggctttgcccagaagacagtacacttgtttccagaacccggatcaagaaatagaatgtttctcacccccaaagcccccataccccaacctcagaggcatccgctgtttcaacttcctacactgcagacaagttttctcccgcttttgacttccgtcagatggaccatacagcgggggcttccccaggtctggcttccttcactccacgttgagctgtgagcgtcagtcatcctgttcatacagcaaatgtttattcacattcgtcgttcgctgcatccctttatgactacacgccggctttgtatccagccgcccatccgtggacactttggttatttctggtttctggaattggaagcagttataaacaccttttacgtgtgtcttttggcaaaaatgcatatgcacttccattgggtctctatctaaggggggaaaagcagggcaatcgtacatatgcaggttcagtgtaacaaatgctgccaagcagttccacagggcatgtgccccaaacacacacctcatgtcctccttgcacgggacattttctctcttcccttttggccattcattttagagggggtgtcccatcgtcattatagctcacatcttcctgctaactaaggaaacttagcattttattgttcatacatttagtgggcatttggatatcttactgtgcgagatgtcagttcaaatattttgcctatttttctatctatttgtcttgctccagtttttaaaggattgatgtgttgggctttttaaaatctagatatgagatttttgtcagagatatgtatcacaaatgacatctcttagttgtcttttccttctcttaacaatatctctgatgaacagaagttcttaattttaatgtggtccagttaattgatcgatttttttctttatggataatgctgtttgtgtcccatttaaaaatgtttagaattctaaatcctctcaacactgggatgattctgaactatgcttctgacttgtgatgtactttctgtcctttgtttcagcagcaactcgtcaggcagggcttttatttcctcatagaaatcattgatcagaatatcagacaatacaggactgatgtcagagtcctgggggatgctggagacccccctccagggtgacaccaggtcattagctaactccctttgtctataattgtatataacagacacattccacctaacagatcatctgggatggatttcccatttcatcctcaaggataacacagcagaccttgcaaatgcctgctgaaatcacaatcacacgtcccttgtctgccagtctaaggaccatgacaaggaaagacaatgatgttagtctcacatgatcacctcttggaaaacctgtgtagtcagagggggagggtgcgggggcttaccagtgcttgtgaagcacgctggattttccgctcttctctggggctccatgtgctctgagttctgatattttaagaaattggcaggggcacttcaaatccaagagcaggcgcccctgactccgtggagccagttgcctagcaactgcctctcatgacatcatcaccagcaatagtctgggtacccgagacccagagcagtgagctttcaggggaggaaagagggccatgcagaaagagaggaagggaggatcactgctgactggccggtgaaggccagcagggcttcctagaggtggtgggatttgctgtgtgcttagggctgggttgaaactcagcagagataaggaaagtgtttcaggcttttgaacatgaacaaacccttgctgtatgaacaggatgattgatgctcacagctcaacgtggagtgaaagaaaccagacctggggaagcccctactgtacaattccatctgactaaagtcaaaagtgggagaaaactggtctgcagtgtaggatgtgaaaacagtggatgcctccgaggttgcggtacaggcagctttagggtgaggaatgtgaaatttcactcttttgtgaaaacccttcatccctctggtctgtgcatttttgtgtgtgtgcctgacactttaatctgaagttctgttagggaccgaggagagctgttttgactgggacatgtgaactagcacagactttccgtcatgtcacaaacaactacagaactgaagaaaagatacagagtgatgtttttggatagcggacagcaggcagtgcaggactgaggtccctgagaagagggaggctgatgaggccagccctatgagtgtcccatttcccgctcaggggctctgcccagaatgcaccacaggaccaggggcccccagtggagtgcagtagatttgctgagttgagaagatacaaactcaggttcagggaagtggccaggatttgtggggaagagcaccaaggagcagggctgtgtgatggaatggctggggtatctgcacagggctccctcgagcctgttctaatgctaacctgtggttgcatggggtaaaactctgcaaggccaggcaacagacagaggaaaggaaaagctaagcatttccagaatggacagagctgggagacatttaagctctggccagccagagagagaaacaccctttaaaacatctgtattacattgctcaggctgccataacaaaataccagactgggtggcttacacaataaaaaaatgtgtttcctctctgttctggaggatgggaaatccaagatcaaagtgccagctgggttggattctggtgaaggctgtcttcctggctcgcaactggccaccttctcactgtgtcctcacacagcaggggcatgatggggagaaagatctctttcccttcttataaggccacagtcccatcagattagggccccacccttgggacttcatttaaacctataggccctgtctctatgaacagtcacattgggggttagggcttcaacatatgaatttgggggacacagtttagtttatagcaacacttgagacattcagctgagaattcagagggccacgacttagcaggaagataaaccagccccagagtagaggctacactggcccatccctaacacagatgatgaaaaaccagtcttgaagttctgatcctggcagcagcacatgcctccctgtagagcaacccttccaaagatagcagccgtcaacactgaacatgagatgtgaaaatggctgacggcactggggaagacctcggagaaagcaggcagattctggaaggatgtcagctcttagaagaagggattggaactgagtaaggtccccattttaacagcttctagccaagggcagccctgtgtctacaccatgcaggtcacagagatagcctccagtccagtaggaaatatgcagcctccctggcttgaagacagagaacaaagtttaaggcagtctcagccacagaaaggcaaaaagaatcacttgcagaaaggaaaaagccaaaaggaggcagaccccaagccctgtgcataagctacaacccaggaccagggcagagcccaaggagccctgccaaggctcaggactcagggcagatttgagctgccatccaaagggaggacttttcagttcgaatcaaaccagttaattacctgttaaaacagtgaaaacgggtactcttcaatccagaggcattataacacctgtttacaaagtccaatatccaatccaaagtaactcaacatatgaggaaagaggcaaataggaaccattctcaaactgaaaccatccatggagactaatcccaaaatgaccaagatgtcgagctaaacagacaagcattttgaagctgctatttctacaatgcccaatgacataaaagaaagtatgctaacaattactgaatagattgcgcattgctgtagaaaaatagaagctataagaaaaagccaggtgaaaattctagaactgaaaatgtaaatctgaaataggaacttcactgggctcagcagtagcatgaaaatgacaaagaaaagaagttagtgaacttgaagacaaatcaacagaaatgatccaatttgaagaagagagagaaagaagaaaaaaatgttaagagtgttttagggacttatggaataatcatggaagcctggcatatgtgatcttgaagtgttagaggaggagacaggataaaatagggacttttttttttaaattttagaaatcatggctaaaaattacctgaatttgttgaaagacaccagtttacagatttttaaagtgtggaaaacccaagtcaatataaatacagcggaaaccatgccaaaggccattagagtgaaacagatgtaaaacatggacaaagaaagaatgctgggaacagccatgaaaaatgacacagtacacagtggggacaaggttccaggggatgctgacttcttgtgagaaggagaggcggtcagaagacagtgggaaatagttttataacaccaacctgtgctgtggggttggaggggagccctataatagtaaaaaccattcttaaagagtgaaggtgaaaggaagaaatgttcagataaaaataaacagctcaggagtttttgacaagcctgaccaacatggcaaaaccccatctctacgaaaattagctgggcatggtggcacatgcctgtagtcccagcttctcaggaggctgaggtgggaggattgattgagcccaagaggcagaggatgcaggagctgagatcccaccactgcactccagcctgggcaacagatcaagactgcctcaaaaaaaaaagtaaaccaaaagaattcttcaccaatgaatacgcaccacaagcagtgttgaggcaggttctcccaatggatgggaaatagggacgtgctgccagatggaaacctggcgctttggttcccaggacggagagaccatggtggttgagtgaaaagtacccagcaggtttaacaaggggaagaatctgcactaattctcccctggcttacctccggcatcacagggccggtgccccagggctctttccaatgcccagttcggagcccgtgtgcttctcataggtcttcaaggtggagggaaaagcaagaggccgggccccaggcaaaccttggaacacgcatgtccatggcaggttggtagagaacctggagacaggctggtcacaccagaggccggctgtggggtgtggggcaagggactctggggtttgggcttccagcgtggagctgggtccgggcatcagtgccagcattaccacccagctgtgccaccttaagccaatgtcctcccctctgggcttctgtgtaaattatagggaaccgatgatgggctgcgcgggccctgaggcagctccagcgctgagagcccggatatggcctgtttgcagctctagggttctctggctcttggagcccatgcagacgaaggagctgagcagagcaggtgccgggcagccatggttctgagtctgagcctctgtctcctccgtggtactgagaattgctctctgccacctccccgtgtccccagctatggtcctgctcttaggatgggtttgcagatcctgggggcccaggttgtggccgaggactgccctgtgtctggggtcagggctctggcatccgtggccagcaagaggggcttccctgctccctgagcctctgcttcttttggtagccacgacccactgtgaccggaggctcttttagaacgtgtgtataaccaccttccctcccctacatgctcacactgggtctggaaactccatctttctgcttcccctgacttctgcagtctgggtctgactgtctcgagggccctgcttgctagaagaggtggaatgggatggctcgccatagcctgaggtggccgaggagccaaggttggtgggggcatgaggggtgtaggaatccccctcccaccagtggtgcccagcccaggcacagaccccgtcagtgttggatgggggtgtacagttctaggtctctgaatcggacttggctctgcagcctccctcctggctcagcgcccccagagcagagccttcccccagcagagagggtgtgagggaggacagtgacagtgcaaaggggagctggtggcccaggagtggggggggcacatgggggagctcccctctcctccccagcccccacctgcaccgggcctcgcagccgtttggtccctgaaaaggcctccctgccccagcatgtgaatatggatgtgtgcctaaggactggaggtgcggccctaattagagcgtgatgactgcctcccgccgctgccgggagcctggggcgggcgtcaaaggggagcagcccgctaatccccccttccaagggcagcatctgctcccctccccttgtctctctgtcggcagccgtgagagccctggctatttaattaggacagaaagttcccccaaccttgggaaatgatttaatttcaatatttcctttgctgagcgtgagatccttccccactgcctgccccgtcctcaaaggcctttcatctgcagcccaccctccccctgcagaccctcgcactcccctctcattccggatgtcggagcgtttccaagggatcgcagggaggagtgaggctgggctgggggtgctccctggctgcgtgcccggcttcagcttcggctgggaccagctgctcgaaccacccctccagcctggccttcctgcaagcaccaccctcaatgccgcccggagtgctaggcagggccctctccaggcatccacccaggcaggagccaggcctgcaaaaagcccccatgaagccttggccccagagattgcgcctctgtagctcttccctggacgtcgccaccttcactaacgggcctttgttatcgtctttaatctggcctgactcattctgcccccagcatgtgggtgtctgcatgtgtgtgtgaatgtgcacatgtgtgaaggggagcatgcctacgcctgtgtgtgcatctgagtatgctgtgtacacgcaaatgtgcatagttttgtgagtgcatgtgcccacagtctgtgtcaatgtgcacaaatgtgcgtgtgtgcacgtttgtgtgtgtgcatgtgtgtgcatgtgtgagctgagagtcccctgaagtctaagcctgctttctcccaattctttttagacaagtgggcgctcatgtcctcagctgacacatccagggccagctccaggctaggcacatggcaggtgtggggtacactggcaaagcaaacatgtacatgctcaaatgaatggagtcagcccagcccaggcctggcaggtaggcagagggggtgggtggtggtgctggggatgctaagattgctggacttggggacagaaggcccagttgtagtcactctgtcccctgctctttccagactcagtgtccccatttgtgcaatcacctcaatcccagagatcagtgccctgtgcacagctgggaaagccaggttagcaaggatttctcgtgaccctggggagccggcccagcccccaggatggtcctcggcctgatttcctccagcaacgcctcctcacagccccctccctgagctggtcttcaccctcactctccagccactctcctccttcgtcctgtcctctcccatttaggacaaagatcagcgtcatcccagctctcagctgggagggcctcaagcccaggcacaggaggcggctaatgagaggtatcagctgggcggctctgccaggaaactcgccgccctgagcaatttcttaaaaggaaaattctaaccttaaagagtcctttgaacacgttgtgaatgaacaacggactcggtggagttggttcctcagaattactgggagatggaggttacagaaaagagaagattgatttccatttggtctcctgaatatatttcctgagttcttaaggagctgtttatcacgcctcacactgagggcgaggtgggaatccttggctaacaaattatgatcactgttattctccctcccctacccatcccccacacgagaatttatgcattttccagacaaaacgtgctttcgcagagaggcactgggtcgtcctcaccgcagtcaagtatcgacagtattgatcagacgctccccggctaacaggcaccaatgagtctgtgccgcccacggtgatgttctggcggctcgtggggaccccacccaccgtcagcctagcttatggtccccgtgcctcctgaccccacctaaagatgagccccagcaggggccctttagtgcatattcattccctgttggtccactcgccagccaggcgctgtgccagcacgggcttagaacaccagtcactcagaggacgctcaatgcatgcgtgcatgaacgagtgagggtgtgaatgaatgaatgagtataggtgtagtttgaaatagagctggaaacagaaagccagggccacgtgaggggaactgctccagcttgttggagatggcccttttgatccccaggacaggaatctgacattgatcaccccagagacccctctctgggcctcctgtcaggctcccggaggtcccgtgggccaggcgggcctcctctctctgtccccccagtgatggcactggaagggctctgaggacggctgaacaaggacgcatgactctgctgtccagaggcaccgctggctcctggtgaggagcttggaaagcaaatttgcatggaactttgagaattgctttctttctgttttatgaaatccttctctaaatgtctgcatattgctctcctgagggatagagggagaaaaatagcaattaaagtcttgtcatccgacttgttcaggccgttaagttgttcaatcttgcataagaaatctgctagtgtgcttaagtgggagggagcacctggagccggctgtaaatgtaaatcaatatgtaatgatatgcgcccaggctgcacggcctgtcacttgcgggcgcaaccaccaggggcccaggtgtgtcctccgtgtgcgcctggtggagccgggcctgggcccttctgcccgcagtggtctaagcagacggagagaatggtcccatgtgggcacaccctgtggcgcggcctctgagccatctccctcttcaccagtcttgctgggaagtccagatgaatcacatttggaagaagctacttgctgggccattggcctggacaaacacaacggcattcctgggcagcatggccagggcgtgggggctgcgccaaagtgccaggccgccccctcgcagcccagcagggtcgggtggtggtgagtccaggccccgggctccgatgggagatcggatggggcgggcttgccactgacagacagatgtagagccgggcaggtgggcaggggcaagcctgggtctttgaggtgcggcagatgtgaacatcccattttccagaggaggaaggggaagcagaagcgccctgtgcccctgaggtccctctctgctgcctcccggacagctgtccgtggcaggctgggagccaggcctggtcctcactttatgtccccattttatggcgtctcaggagaaggatataaagctggggagattcatcccctttgcaagaggttcatttattttgacacttgtggtttagtttcaattatttatcataacactagagagggccctgataaaagcacccaagtgtgtttaacagcagccacggtgagggtgaccagtggagcaggcacttggggaaggcccctggggaccagggcaggaaggtgtgggtgggagggagcccctggtcgagggagcccgcatgggctggacggcactggggttttcctcttggctggaaacacaggaggtgaaggagatacgctccagcgtgcttggaaatgacaacttgttccagtgctgtctgcagagccagatggcagccaggaacctggcgatgggattttaggagcgaagcttccttctcttcagtggatacagtttttccacctgcttgagcttgagcgccaagtgggaaggcccagcccctcggctttggtgagattccctcagcctgtggcatctgcactatctgggcacccacctgccctcacgtctgtccatctgcccacttacctgtccatccgtccacatgtctgcctccactggtgacggtgcctgcagcagacgccacatggggatggccgacatggaggcgcatcaggcctggcactgcctgggagctcctggcctggggagaggtgcagctcccaacacaggaacagctagtaagcccctgctgggcccaagtactgttctatgacctgtccacgcaagggccatccagctccagggcaggcccattgacctgcatcctgtatgcagacaggttcaggccgagcctgaggacggactcaagccaagccgctgggtggtgtcctgcctgacggggcctcctcctagacactcgccctcagacatgggggctgaggtgcccgccttctcccaggggccatgcctcccgcccttcccaaggctacacccttactgcctggttgtggagaggttcatttctgagccatacacagcccctccctgggtcacacccatcagctctgggcggaggaaaagtgggcatagggggaacacagcctgcctgttcctccctgagcggctgggtgtgtgtggctccatcttccagaagaggcagactgagtgagatgggcgtgcagaaccagccagctctggcatttcctacggcggctgggaaatcggaggctccagagaggagagggcctgcccggggcacacagcaaggtccctggctcaggaagcacacacaatggcttcctctggccccggcaggggctggggtgcttggagggccccttatgcttcatggccccgcagcgtctgccccaaaacaagccaagatggatgaaaaatcgctggcgaaggtcactacaggacagccgcggaccggttgattgctcggggcggccctcgccccgtcggcgactccatcggcaacttcgccgcgctctgatttatgatgggaagaaaatggtcccctgaaccgccaccggctctggtttgggattctgtgtgactctctgtgtggccggcccaccgtttattcacaccactgaagtgtgaattctatgaataaattttattatcttggggctttgggatgacaaaaacatgaaagcctccggaattggtgagatgcccgcctctcctcattacgtcggctggggctgggggcgggggccctcctgggagcctcatttagattttaattaaactgacttttcccaaacaatttgcaataaattagtgccaaccaggcttgcaacatccaggcgcgaggccgtgccaggctgtcacgggggacgctggctctcagttggggtcacccgcatgggaggccatgcacactctggacaggccggcgctggctcactatgctggccccaaggtttgcgtggccaggggtagcccaggcacacaccagactcccagctgacacctgctccaggagaggggagcggccatgtgctgggaggggctggcgtcttttcactgaatgcccacagcaacctggtgacgaagatgtcagcatagcgctcagtggcaccctcagggcagaggatgctgagcgcccaaaccgcagctttgaggatgcagtgtggtggagggtggccggcacggtgtgggggtgtcctcagcaccctccgccctggaccttcctgttccaggtggactgagcatcagtggggtgcagggtccaggacagacggaaagggaggctgggccccgggtgccagccgagagatcctgacatcccaagttccctgaacctcaccttgtgttagacatgtgggaaaaaccgaggctcagagaaagggaggtgatttgaaccccgggcttcttccactgcaggcccctgttgccatccccagcctgcccagggagcactccctcagccagcacatggccagcctccagtggccatccgtgggaaggagcagagctgctctgctgatgcccagagagatgtggggggaaaacctgctgctcctcggctgggagaaacccccagagtggcttgcctcccagtgacaacactcaaggtccccaggaagagggcgtgttcttaaaaccggaaaacagcccagtgcagccctggtgtgtgtctgaaggctttaggatactgaagcttggcccacaggccctggccttcctggagagaaggggcagggaggaagggaaggggccctggagggaggctgtgtgacctgagggctgggtttggccaggctggtgcaggctccgacagcagcctctctccaagggcctgaccctgacctccaggatgcgaggcccaccaggaagcccccacctgccttggccctgcctgctgcccacgtcggcagctcccacctggcttcaccacggcctcggggaagggggtccctgcatttgtgtgccccaaatccccgaacggcaggtatggaggtgacagccacagatgaccttgaggtggccccagggacctctctccccatcaaaggctgtgcagacaggcatcctcctgctttccagcatcgacgtctacgtcacaggtggaaggcacatcactctttctaatattcacaccgacagtggtccctttgttcttgattttcctgtcccgtggatttgtaaaaatgaatctgcgtcttttattgtggtcaaatatacataacgtacagcgtatcacggtaaccactctcgggcgtagtcagcggcgttcagcacagtcgcattcgtgcagccgtcaccaccatccacctgcagagcatcttcatcttcccagtcaaagtgccgttcccattcaacactgacgccctgttcctcctccaccccagccgggagaggcgtttatgttttataagaggctttggggctgcggagacgaacccccaggtttgccaggcccagctgtggttaattcaggtcacatattccaagttcccgatgaggaggatctctgtcccagtgaggcaccggggacagggtgcaggggacacaggcccttgccaggggctcggggaagaggtcggcacaggtagccaccgtcaagggccaccgcagagctcaggcaacgatgacgatccttccgttttgctcaatgctccacagtcgacaaagagcgttctggtccacacacgactgtgtgctcgtgcgagagccttggggatgacattacacagtgtctgtccatcaggcccacaggtatccagcaaggtggcgtctgcacatgctgagtgaggggaaggtgctggttgaggagggagcgaggctgtccccggccctggccagctcccaaagcgtccctcaaggccagcgatgtcccaggtcttggctccctcgtggctggattggtctggggactggtgcatcctcactctgaaaggctgctggggcctggactgggcacctgaggatgagaaagtcagatgcatctccctgggtgcctgctgccgccctcctgggagtttgtggtcataaaataggatcctgggaagaagcgactccagagggagggctccgggagagctggtgggctgctgtcatggccttgtggggctctgcagctcttggggcagttatgagcacagcgatatacggggccactggggctccatgtagctctcggagactctgagagaaggagctggccctttggagctggagagtagaaccagcctggctccccagtgtgccggctccagggaggccctgaggcgggcccagcaggccagtcgctgctgccatgggtgggcgtgcagtcggttctggcaagtcctgcctgcccgggaggcctggtgcacacactggggatataggacagcctcactgcttcaactgtggggttggtggcgggggtcacctttcctgctttacagatgagggagccgaattgcactggggagagccctggcccctagtctgtgtgtccaacattctagagcctgggttctcgaggctggtggctacaaggtggctattctagattccctgtgtctggatggtgtggccgcagcacccagcctgaaggctgatggatcccactcaagaacccggcctcctcatgctatgtgcacacagaggggcaaggttggggagggagaggggcgagtcccaggctgcaggtggagcgaccccaagctcccaccccaaacagcacagtccaggacgcccacccggaaggaagctgccaagagcttcagcacgtggctttgaaataacacagtgtgatttaacggcccgggtggtgtggaacagcggcacggtggctcctcagcagtggaggctccggtcctggctggtgcatctgctccggcagctggccgcccctccatccgcggccgtaacatttcaagacagttttgcttgcaaggagtcacagtccattggttttatggaaacactctctgagtttacttcccgcgcaggggaaagacagctgttttatatgcacttggaggaacacctaaagggttttagtgttaattaagttgggaggacggttcttaacaagcacctttttgtaaatgtcaagctgctctgctgtttcactgttgttatggaaggtggaaattaggcagcgccccctactccctcctgcggcaggaaagggggcaccacctgtgtgtgctggggcaggtgtgctgacaccggcttgctcagtagagccacttcctggaatgatccggaaagtataagggcagcccaagagggcagaaaagccgcagcatccagagagtaatggggaggctctgagtgttgggggctggtctcagggactggctccatctggggagagctcacaatgtgagggctgcagacacagctcccacccagagccctggcaggaccccctcatgggcaggtccgggcagcacatgggaatccctgtctcagatggtggatgccagcttgaagctcccaatttcatctttagatttgggcctggacgaaaagtccgacgtgcggggcggtcagcgcttcggctgcggtgggttcccgccccttgctgcctccccaggatgggttcttggccttctggagctccaggccctacccggtttccccctctcatcaaaacatgcgaccaggccatgtttgcggggaggccagtgccccacagcccctgactgtccccggtggggcctgaggtcgatcaggagcagggagagatgaggcgtgaacacctggctgtgagctggtccttccacgtggaacaccctggatggatgggggctgcagatgggccccggggcacacgatggggaaggggaggctcccaggagtatcttcagggcccacagggaacccccagggaaggggcttggacgggtggggctgtggttcccgagggcctggaaagctgtgtggacctgagggtgtgctgggtccaagcccagctgattccagcgggtgggaaaccgtgtgtgaggctctggacggcctgtggacagggcagaggcccgggatgtctgggaggccgggtggggacacagcctttccctgtcggctcaggagttggcaccgctgaggaaagggggatgttcaacaaatgagcttcagagaaaccccccaacaccactactcctggaggaggcatcctgaagactgaaatgttcccgggtctccagaaaggaatcctggggccagcactgtgtgggggcagctgacctcccagggccactgctgtcgctgcacccactggcagtgggacaggagcctgggccaggacccagagacctgagtcatgtcaaccccaccccctacccccaatttcttgaccaccggggccttcaccagacctgcctggctccggcctctgtcatgtggagactggaagtttcagggctcagcctgggtgagcacgtgggagccctgcggtgagtgggggtggaaccccggactccagggacggcgctccaggaggggtctcaggcacaccccaacctcccagcggccgtgacgggcttggaggcctgtgtcaggccacagcaggccaggcccggtttccggaccctgctgagagccacagacccaatgacttctgcagcttgccccgtgaatggagctccatgccaaagcttggtctccagggtgctgcttctccagcaccagcggctcccaggcttgcaggggcggcgtggcctgggccagctttcccagccattgttctccctgtgtgaaaaccccagggctccccagccggcaccaccacacccctttgcctttcccctcctgcggcccctctgctgggtcacagccttggagatgggcctgcagaggcacccacacaccctggccagagctgacatcctaagcaggctgacaaccagcctgcaggctgaaggaccctggagagacctggccaggctggaccctgcaatcagaaacagaaggcccttctagtgggggaaactgaggcccagaggagggtagaagactgcccacagctgcccgagggggctgagttctgagtctgggctctgggtggcctgagcaagaaatctgctcctgggcacccgcggctgtgacggctcctgtggctgggtcctggaactcctcctgcctcaatcatcgattgggcagaaggtctggagcatgctgggcctggctgctgcctgggcacgagtggggatagcttcagtgtcacctcagtcaccccaggagccctgcgggatggctgccccacttcacagatggagtcttgagagagctgatcaagaacggggtgtgggcctctgtggtttccgcctcccggatgccccatgcctctgtgtctcagaggtgcctgggcctctgggctgctgccaagtccaggactaagtgttcttccagagccccagatgcatccttctggtgtgtgtgtgtgtgtttgtgtgtgtgtgtgtgtgtgtgtgtggtctctgggggcagtggtaggagcctgggttgcaggggctgtctttgctagatctcaaactcaaaggggaccctctctctggttgcctggggagtctgctgccccgccacccccccgcaacagtcctgcttgctgctcctgtgccttcctgcccccgagccccgtccccagcccctttccctgcccagccctctctgctgccttccaggcctgctctcttgacttcagaggatgagactcgggtctgccttcaggctcccaggggaagggtcccaggagctgcactctcctccctgcctgacagtgcaggaggaggtcgatgccgtaggaggagggcaatgccccggcagcaggtgctctctggctccagctccccattcgtgcaccgcctcagccctgcaaagtaggttggtgcagtcttacggggggatgtctgcagccaggcatcaccatccgcagccaggcagaacgtgaggctggtgctgtgacctgggccagcacttccctcacactctccttgtccttccatgcctggcctcagtgaggaagggtcctcctggagatggggctgggcagacgtccctggagggtcccaggaaggctctgaaatctggcacattctgcaacctatgttccaaccactgactccaggaactggtgcatgggctgaagcaatgaagaaaagtcaccgtcccatgaggcaaagctgatttaaaagctcacttattcttagtgggaaaaatggggttagcaaccataacatttgaaaaccaactggaaataggctggtaaataactttatggaattgttggttcgggaattatgttaggaacttggagtctgtgattatcaagcaaaaaatgtctcagcatttcaggccagggtcagggagagggtaggggtgggaatggggtctatagaggttataggaaaagaaatctgagtggttgtttaggagactgaggagactgaaaagaccctgaaaccccacggaggtgatcagggacactggcctgccctgagatgcctcttccagtgtgccttcctccccgctgccctgcccaggccagctccctggaaacccactaagaggaagggtgtcttgtgaccagccacatcacgagatgtcccacatcgcagatttcaggtgcaaggattgaggtgtcacagcaaacagaggaggggctggggtaggtgtggttctacagcagctcttaaaacagaataaacaaaaactacaagcggtctgccacggtggctcacacctgtaatcccagcactttgggaagctgaggtaaaagaatcacttgagcctgggagtgtgaggctgctccctctggtgagctgtgatcacaccactgtactccagcctgcgtgacaaagcgagaccttgtctctaaagaaaacaaaacaaaaaccaagtgtaatcaaccttgcccttgaaaatgcgttagtccacccaccaggtcatctggaatctatcttgggataggtggtgacctggtaggaccaagggtcttccgaggcactgaagaacttgggttttgctgtagatctgagtggggagttttgggaggaaggggcgggaagtaccttgatctcactgccagggcccctttggctgctgaggggacagcagctgaaacaggacgggcagtgcacgtccagcgaggacaccctggccgcaggtctgcccagcgacaggaggagggctgcatctggggtccgtggtggaggtggacacagcggccagcttctgggagcgttttagagtgaagtccacaggacgtgtgtgagggagtgagccggcatccagggcaaggtcctgagattcagacggtggtgctgtttggcagtgaccctgggtgtgggcgtcccgggtgccggggagagctcatcttcagaaatgaggaggccgggggtggcacagactgtccacacaggggttctgtggcctggcgtgctgccagtccagagatcccaaaaaaacctgtgtcccggctgctgtccttggccctgctctgacccctgctctccccgctgcttttcagaattgctgctccgtgaatttctgaattgcagtactcgctgtgcacctgtctcttccttcgggagccattgtcaggtgggattgcgtaaatgtcctccatggcgtgaggccctgactcacctgaacaacattccccagtgagcacggagcagcagcccgcccggctcagcagtgccttgccctggccctttctctcctcgctggttcatctgcattaaagaaacagaaagcttccttcgctggcccgctcattgcctgtcttctctccctgcctcagctgcggtcaggctccaggtgagctgcacctggccgtctcaattacactgcttctctggcatcggataggaactctatggccaacttacccacaaggtggtctgcaatatctttgaataaattaatgattgaatgaatgtcttagtccatccaggccactacaacaaaacaacacagatggggcagcttaacagtggacattcattcctcacatttctggaggctgggagtccaaggtgaaggtggcagcagggttggctccagagagggctgcttcctggtccccggacagcctccttcttgctgtgtcctctcatagcagagagaggatgttctgtcacgggccctcatgacctcctctaagcctcatcagctcccaggggcctcacttgcaaataccatcgcattggggtcagagcttccacataggaaacatttggtctgtagcaacgagtgaatgaatcattacagatttctctataagaccaccaggtcttaatgtattcaaagatattgcagaccacctcttgggtaagttggccatagagttcttatccaatgccagagaggccgcgtaaatgagacggccaggtgcagctcacctggagtctgaccgcagctgaggccgggagagaagaccgacgacgtctgagtcgtcaatgttgtgaaagatctccagagtgatgaaattaagggtatttatttctttagttgttgcttttgttgtagcaaacaaaatgaaacaaacacacatgcacacaaaacgaccaagcaaaaagtgtccgctacttgttaaagtgaacctctagtaaagttgtctctctttttgtcaccgaggatgagaaacagagatgggaattctatcctcatggaaaacaggaggcacccacaactctgagcccctgagagtgtgaaggccttgccgagtgacctcgctgctccagggcgaggcggaggccaggctgcggggctgcacagccagccagggaagctccccgccccaggactgccctcccacacactgcagacagttgtttcgggaagaactcactttatatgcacaaataaacaatgacagaaaggaatgaaaatagtgtccactgaaaacattacaagaaaaaggaagaaaataatagaaaaggtaaaaagcaaagacacaaaaaatcctcgcattggggaagatgatggaaaccttcttaacaatcagaaacttaacgatctaaatgaaaatgtctttcacgtaaaacaaaagccaagacagacttcaataagaaacaaaaagatgataggagatttcaaaaataggcaggcagagctcaagaaaagaagcagaattttaaaaatcacaaaatgaaggccacactagaatcaaagaaaaagagaatagattctcctaaaaccattgccagggatgtggagtcaagcttggaaaaagtgaaaaaaattcaccagaaaagaataaagagttgcgatggtttagaggaaaggatagaaaaggaaaacacaaaatgccgacacaacacacacataattggtggccttgcaggagaaaatcaaatataaaagaaaaataattcaaataattcaagaaaatgtggtgaaactaaaaaagatgaaatctatggattaagagggtatatcatgtttctacaaaaattggtgcacttgatcagcactgagacttgggggtcaaacacgaagaatttgtttggcaccgaggcaaaaatatgaaggccctgacatgagaagagaagtccaagctggcttcagattttctacggcaacacctcatcttagagaagagggaaataatgcctgcaaaatctccaggaaaagaaagtatgaaccaagaattttatatcagagtaaaattttagaacagaataaagctgttactcatgctgaatcataaaaaagcgcttctgaaaatattcacaaatggaggaactcttgtctactgaagttccttttaaataaataaatagagaatgaattttagtccaccaaaaggcaaatgaacaggctgtgaaggactaggtcaaaacaactgagagacttaggccgtggagcgttaagtagtgtggagtgtgtcagtggagacaggcggcagagctttggtggcctgtgacaaataaatccggacagctcctcctctccctgtgggtgcagccactcacccaggaagtccacttccctccacctgactctaggctggcctcatggcttctttggccaatccaatgaggcagaaggggtgtcttgtgagttctggaacctgggtcttagggcgtggtagcttcaattttcactgtcatggcaaatcctgatgccggggcgccttctgatatggtttgaataaaatctcacctgaaatgtgatccccaatgttggaggtggggcctggtgggagatgtttgggttatgggggtggatccctcatgaatggcttggggctgtccccatggtagtgagtgagttctcactcttaattcacacaagagctggtgttaaaaagagcatggcacctcctcctatctctcttgcttcctctcccatcatgtgacattcttgttccccttccaccttccatcatgagtggaagcaacctgaggccctcaccggaagccgagcagatgccagtgacataattctgtacagcttgcagaactgtgagccaaataaacctgttgtctttataaattatccaagctcagatattcccttatagcaacacaaaacagagtaagacatcttccctgcgctgctcccgccaccccttctccccggagagcagcttctcggaaaatcacctgcacctgaatctttggctcagcatctgctctgaaaaacttgatctaacacggcatctaagatccaaaggaagttagctcagcctgacgccagctttctctctaaaagcacccaatccaagcacatggcctgtggcaggatgtggaagcaatgcccctgggtctcaggacactcagggtaggcaggtggagagctcttagtatggcaggagtgatgggggtgggggtggggatgctggaggtggtgctgagaacacaggtggcacaaagacccagtccactcctcctgtgacctttgccctccagctcctgccaatcaacttctcagtcagtgtctaggcccagccctctattgcctccgtgctgccatggcctccctgtccatctcccaggcaacagaggagtcggtctgaggcctccagcctcacagccagtgtagttgcatgttaggtaccacttccatcctcggctgtcaaagaacaatgctccttatctgaagaatgtggtctggagataattagttctaacgggacacagccctgtggctgctgtggatggggctttgttgtggctcaacaatgccaccatcagcccagatgtcgtgcacaggcttgggcaaaaggcaggtgactgcagactcacaggggctcaagaagcacaccacatgggagagctgtggagattcactaaaggatggaactaaacagatcgacagagacagactaaaaaacagcctcttcagcctttgtctgcagtgtgcctaatgcctccagccaccagcaaatcaataacaataataacaaaaccatcaccagtgacgacagggggccctcatcaggcactccacccatgaggcactcacagtaactcgataaagatgatgcaaattacatatatccctattcataggtgaaggaaaggaggtgggcagtttacctgacttgctcccagtcctggaattctgagcagtgaagccgagattcaaacccaggatgcctggctgcaaagcccacacatgtgcacagctggcaccatacccacccggtgctgcccacacatgtgcacctggccccatactcaccctgtgctgcccacgcaagtccccactgatatggtttggatttgtgtccccacccaaatctcatgtcaaattataatccccagtgttggaggaggggcttggtgggaggtgactgaatcatgggagcagatttcccttttgctgttctcacgatagtgagttctcatgagatctggttattttaaagtatgttgcacctcctgcttcccagtcttcctccttctctggccatgtaaaatgtgcctccttcctctttgccttctgccatgattgtaagtttcctgaggcaccccagccatgcttcctgtacagcctgcagaactgggaatcaattaaactcctgttctttataaattacccagactcaggtagttcttttttaaaaatttttttccttttaatttttctttgtcatccttgtacagggaccatgctaatgttctctgtaccattccaattttagtatatgtgctgccaaagtgagcactcaggtagttctttatagcagtgccaaaattggcaccaggaagtaccaggaagagaagagaagagacctgaaaatgtggaagcagctttggaactgggtaacgagaagagggtggaagagtttggagatctcagaagaagacaggaagaggagggaaagtttggaacgtcccagagatttgttgaatggttgtgaccaaaatgctgatagtgatatggacggttaagtccaggctgaggaggtctcatatggaaattaggaacttattgggaactggagtaaaggtcattcttgctatgctttagcaaagagactggtggtgttgtaaccctgctctagggatcagtggaactttgaacatgacagtgatgatttagggtatctggcagaagaaatttctaagcagcaaagcattcaagatgtggcctggctacttctaacaacatatggtcatatgcatgagcgaggagattatctaaaactggaacttatatttattaataaaagggaagcagagcataaaagtttagaaaaattgtagcctgaccatgtagtagaaaagaaaatccccatcaggtgcagtagcttatgcctgtaattccagcactttgggaggctgcagcgggtggatcacttgaggccaggagtttgaaaccagcctggccaacatggtggaaccccatctgtactaaaaatacaaaaattagctgggcgtgatggtgcacatctgtaatcccagctacttgggtggctaaggcacgagaatcacttaaacccaggaggcagagattgcagtgagccaagatcacaccactgcattccagcctgggtgacagcatgagactcctcaaaagatttaaaaacagaaaaacccattttctggggaggacttcaagccagctgcagaaatttgcatgagttgctgaatgtcaacagccaagacaatggggaaaatgtctaaaaggcacttcagagactttggcggcagccctccgatctcaggcgtggaggcctaggagggaagaatggtttcatgggctgggcctagggctccactgccctgtacaactttgggacactgctccctgtatcctagccactccagctttagccatggccaaagggccccagatatgtcttagatgatggctccagaaggtgcaagccattcagtgttggtggcttccatgtggtgttgagcctgtgggtacacagagggcaagggctgaggtttgggagcctctggttagatttcagaagatgtatggaaatgcctggatgtccaagcagaagtctgcaacaggcctggaactctcacggagaacctctactagggcagtgtggaggggaaatgtggggttggaggccccacacagagtccccactggggcactgcctagtggagctgtgagaagagggccactgtcctccagaccccagaatggtagatgtactgacagcttgcaccacgcacctggaaaagccacaggcactcagcggcaccccataaaagcagccaagggggctgtaccctgcagagccacagggctggagatgcccaaggccttgagagcccacaccttgcgtcagtgtggtctggatgtgggacatggagtcaaaagacattattttggagctttaagatttaatgactgccctgctgcgttttggacttgcatggggcctgtgacccctttgttttggtggatttctcccttttggagtgggtgtatttacccaatgccattaccctcattgtatcttggaagtaactaacttgcttttgattttccaggctcataggtggtagggccttgccttgtctcagatgagactttggattgtggagttttgagttaatactgaaatgagttaagacctgtgggactgttaagaagggatgattgtgttttcccatgtgagaaagacgtgagatttgggaggggctggggtagaataatatggtttggattgtgtccctgcccaaaactcatgtcaaattgtaatccccagtgttgcaggagggcctggtgggaggtgattggatcgtgggggcggatttccccttgccgttctcatgctagtgagtgagttctcaggagagctggttgtttaaaagtgtgcagcatctccccccacccttcctccttctctggccatggaagacatgcctccttcccctttgcctttcatcaggattgtaagtttcctgagacctacccagccatgcttcctggacagcctgcggaactgtgagtcgattaaacttttctttataaattacccagtcttggggagttctttatagcaatgtgagaacaggctaatacacccaccttgtagcatgcctatctagtgctgcccacacacatgcccactttactgtatgcctgactggtgctgcccagacatgtgcccaccctgctgcattcccgccctggtaccactcagacatgtgcccaccttgctgcatgcccacctggtaccaggcccatgccgaccctgctgcatgcccacctggtacaactcagacatgtgcccaccctgctgcatgcctgcctggtgcttcccagacacgggccacgttgcagcatgtctgcccagtgttgctcacacacatgcccatcctgctgcatgctcacccagtgctgcaggcacagagacaaaaagctcagtcctgcattcagaagtttctggtccactgggggccagtgtggttgcagagctgtgaatagcgcatgggacccacggggaggtggcagctcagaacttccgtggagccagggatgtgggtggggatggcttccctagaggatcgcatccaatcgtgtccatgaatctgagcaaagtgagggggccccaggaagggcaggacaggtgggggcatccaagcaatgccagagcagagaggggacacagggcagttctgaggcacctgcgaatgagaaaggaagaaggaagaaccacattcagcctgggcgagcacagaggtgagaggatttgctaacagtgagcaaaggacatggagtcaaaaggcctttggttttgtttttccttcagatgcaaaagactcaagcatgtttatgaattgagggtaaaagccagaggagtaagtaagaggatgctgggggagcaggggcttggcacaggttctgctccatggcagcaggagggcaagacttggatcgcattagagctcaactgtgtgttatttacaagggacacttaatacattttgatgtacggcttaaaaataaaggactgatgtaggcatttgcagcggcaaatgttgacaaaaagtgccaaggagtgacaatattagtatccgcggaaaataaagcacaaatcattaagaaggacaaacagaccaatttatattaataagagttattataccccataaagttgtgatgtctaatacacagccgatacacacgttagatgtttatgtgtccaacatcgaataccgaaatatatcaagaaaacctgttagatatattaggtaaatagacaagacccagctgtaacgagaaattcaacacggtactgttgattcctgtcaaatcaagtgtacaaaataaataggactatcaagaatgtgaatcatataatttgtaatggagattctataagtattgtatatatgtcacactttacccctccctgtcatgaaatactgcttttcccccatgaacccatagaatataagaaacatatgaaaagtctgtttatctcattcgttagggaaatgcaaatttttaagaaataagctattgttcaactatcagataagcaatattaaaagtattccagttatcaaatttggtgaagatatgtagaaaacatactcctctctctgacggtagtgctcatcacaggccttcccccagccatgtgaccatgacttgctctaatcagtgatggctgagcaggagtggcaagtgtcacctcgttacagagaagccagcatgtggtccactgtgcttgcgtttctccctgtcacagtgaccaacagtggcccagagagagcgccctgcgtcttccggggttctggagtgaggactgtgtggggcagaagcacagccaaccacatggacatgaagcacgggtgaaaaaaatgtccttgctgttgtgatcactggggcttgggggccatttgtcaccacagcatcacccagcccttcatgatggatacagaagaccattgggtgttcctattaaaagtctagatgcttataaagtgcgacccagcaaatctacttcctagcaaacacctttaagaacacccgatgcgattctcctctgagcagctaactcccattgcccactgagaacacacagaagagctagtcaacacacagaagcaatctgtttaaaggtgtcggagaactgtggaagcaatgagactagagggactaaagttcagagagcagggacctctgagaggtaaggtgacgatcacagccacactttcctggggcctttgccaacctcccatggctggaagctgaggatccaggcatggcccagccagaggaacagtgctagggacaggaaagcaagaagagcttatagcatcacttgtgctggagagagaggggtggagacttaaagagcccaggcacacagtcacttgacatttgccaagttctgaagctgcaccgtgtgaaaagctaaaatctaagcagaaaccctctaacagcagagcggagtgtcccgaacaccacgtgtgccaaagagaccaagaccctgggcaggaggctccagggagcccgccaggctcgcatttgaactcactgaagcgttccatggtagagaagaggtgagcccaagaatgtccccagctgtggttctcagccactcactggatctggagggtcatcttcccattctgtctgcctgccagaagaatgggtgaatatttcctgatgcaggacatcatgtgttccttgtatagtttgtgtttatacatcatgtcccacaaccaataaaaaaaattgctaggcatgccaaaagacatgtggctaaaaaccaagaaggaaacacacacaccaagaacagaatcagtggtgagatagtggagtaacaaataaggacctaaaaataaccaggatgaaaacatgcaaaaaaataaaggaaaagatggggaaaataaatgacaacagaaaataattttaccaaagaaattgaatccataaaaataactaaatggaaattcaaaagccaaaaattataatatctgaaattaagaactccatggctggatctagctgcactttagatatagcagaactctgggttaaagaacgaaatgaacagtgaattaaaaaaatctaaactaaagcacacagaggccacaaatgaacagaagaaaagacacgtgacaccccgtaaaaatgtccattctatatgcagttgtaccccctaaaggagagaaggcacatttgaagaaaaggggattaagaacattccaaaatgaatgaaagtcatcagtccacagatttagagagttctgcagcaccaagcaagataagtgcaaaggaaaccacagtttgacacatggtggaaaaactgtggaaaaggaaaaagagaaaactttaagagtggctggagaaaaatgatgtgctgccatcacaaaagcaaaaaataacatggagagctgagtcctcaccaaaacagacagccagagacagtgggatgacagttctaacgtgcccaaataaaaagagaaatgcaactcaggagtctatactggggaacgtatgcctcagaaatgaagacatttcagcagaaatactgggaattcatcaccacaggcttgaatgaaagacattctaaaatgagcacttccgatggaaggaaaataacctcagacagaaacatggaaatagaaagaatgagaaggcggggggatgtaaatcctggtgtaaatataatagacattcactatgtgcgacagtagcagtgatgagtacatttaaatgcagggggagggtgacgcacaggctggcagtagctggagctccggcacctcagttctggcagagcaggaaatgggcaaagtctccattcacattgaacccttatatgctagtcaaggatgaatgctgaaatctctaggataactgtgaaaaaaatagtgaaggaatgtatacctagcaagatgagaggggaaaaaggaataatggaaagatttcagtcatcttaaagaaggcaagacgtggaacacgaagcagatgagtcaaacagaaaacaagtagcaaggtgacagcgaaccaaacacaaagaaattgtgttaaagacaatgggtgaaataccttgaggaaaaggctaataatgtcagatggcatgcaaaaaataaaacctagttgtaaggcacttaaaagacacagtccttgatatggtttggctgtgtccctacccaaatctcaccttaaattgtaataatccccatgtgtcaagggcagggccctgtagagatacttgaatcatgagggagtttcccccatactgttctcgtgttggtgaataagtctcacaaaatctgatggttttataaatgggagctcccctgcacaaactctcttgcctgctgctatgtaagacgtcactttgctcctcattcgctttccaccatgattgtgaggcctcctcagccatgtggagctgtgagtccattaaacctctttcctttataaattacccatcctcgggtatgtctttattagcagcatgagaacagactaatacactccttatatacttacataagggtgtcaatgagaagagtcaaactctgtaaaatatttgaagagatttattctgagccaaatatgagtgaccatggcccatgacacagccctcaggaggtcctaagaacatgtgcccaaggtggctggggcacagcttggttttatacattttagggaggcatgagacatcaatcaaatacatttaagaaatacattggtttggtccagaaaggtgggagaactgaaagtggggggaagggtggagggcgcaggctataggtaaatttaaacattttctagctgacagttgcttgcatttgtcaaaagacctgggatcaaatggaaatgttctggttaagataaagcattgtggagaccaaggttcttttaaagtcttacagaggctgcccttggaggcaatagatgaaaaatctttcctgttcgcctttaaagggtgctagactcccagttaatctcttcaggattgggagggcctggaagaaaaagatctagctatgttaatagagattctttactgatgcaaattttacccccaccaaggatgactttgcagggccatttcaaaatacggcaaacaaacatggtttagggtaaaatattttgattttctactttgtcatgtaatgttatgccagagtcagattggaaagtaagtcactcacgatatgtacggttaaataaattccatctgatgagaatttatggtttgtagggcatgactccccagactccttagatagataggaatttgggcaagttaaaaaaatcagagcttagtcctcaagggcacaaagcaggttgaaaggacaataaatgggaaaggtagaatatgtaaacaccaaccagaagaaagcaagtagagtgatagaaatgtcagacaaaacaggtgtgaaggtgaggtgccttgctcaagaccgacatgggcatgtactgaaagaatcaacactccaggaagctattacagccccaagtaagcatcaatgcatacattatgtgaaacaaaaattgaccaaacttgaagaagaaagaaatccatgttcatacagagagactttaacctgcctctcaatgcctcaatggctgatttaataagcagacagaaatatcagtaaggatatggaagttctgaacgacgcagttgacaaacctgacctaattgacaagtgattcagaccgctgcactggcaacagcagaacccacggtctcttcattagcacacaggacattcaccaagattgtcgcgtgctggatcgtggagcaagtcccaacacatttcacgggattgaaatcattcagagtttgttctctgtccaccatggaattaagctggatataaaaacataaatacaactagaaaatctccaagtgcttgggaattaagccatatgcctctaaatcataggccacagaagaaatcacaaaggaaattagaaaacactgtggactgttggataatggagatacagcatattgaaattgacaggtgcagttaaagcagtgcttagagggaaatttatagcctaatacgcacatagttaaaaagaagaaggctgaaaataaatgatctaagcttctatctgtagaagctgagaagagctaagcctagtaagaggggaaggaagaaaataataaacatatgacaaaaaacccagtgaaatggaaaacagatgtacattttgggaaattcacaagccaaatttggttatttaaaaagattaataaaatggatgtatccctaataaaagtgatcaaggggaataaaagagagaaaacacagccaggcgcaatggctcatgcctgtaatcccagcactttgggaggctgaggcgggtggatcacgaggtcaggagtttgagaccagcctggccaacatagtgaaaccccatccctactaaaaataaaaaaaaaaaattatccgggcgtggtggcatgcgcctatagtcccagctactctggaggctgaggcgggagaatcacttgaacccaggaggcggaggttgcagtgagccaagactgtgccattgcactccagcctgggtgacagagtgacagagtgagactacgtctcaaaaaaaaaaaaaaaaaaagagaaaacacaataaataatatcaggactaaaaagacattaacaaaataatgagaggatattataaaaatttgaagtaaatacagttgacaatttagattaaaagggtaaaccctctttctcccaaaaacacaatttatcaaaagtgacagacaatatttaatgtgaatagtttgatatttcttaaataaattgtatccactagtaaaatgtttctcatcagtaaaactcaaatctcaaattttatcagtgtatttttccaaacattttgggaagaaataacactgatcctacacaaaccattttatggaataaaaaaatgaaagaatgtgtcctaattcattttatgaggccagtataaccttgatatgaaggcctcacacagacacgagaagaaaggagaataataggccaatgtccttcgtgaacattcacagggaaatataggcaaattaaatcaagtgatacataaaaataatagtatatcggaaccatggaggagggtttaatataagaatgcaaaattaatcaatgtaattcaaattatataaaacagagacattataagtccatcccaataaatccaggatttgataaaatctaatttcatgaaaaaattgtttgcaatttggaatagatgtcattgatcttccttaaactgataagagaatacgctaaaatcttacagtaaatatcatgacagcaggaatggggcaagaatgtccactatcgatatttatttctcttccacataatagtgtagtttgtagcaactgcattcaagcaagaaaaataaattaaaatataggaaataaaaaaatcaaattgacgtattttgcagatgccatggctagtacatcgaaaagccaaactaatgatacactttttaaattaagaagtaaatttaacagtcactagttgaatttttatgtattgtaacaaaagttggaaaattaaaaattaaagcccactatttacaatagcattaaaaaatctaacatctatgacatctatgagtaaatgtaaccagagatgcataagacctctacactgaaaattacaaaatagatttttttttttttgagacaggatctcgctttgtcacccaggctggagtacagtggcccaatcacagcttactacagcttcgacctcccagactcaagagattctcccacctcagcctcctgagtagctgagacaataggtgtgtgccaccacaccctgctaaatttttttttatttattgtagagaaagggtctcttcgtatttcccaggttggtcttgaactcctgggctcaagtggtcctcctgccttggccaaggtgctgggactacaggcatgaaccacagcgcccagccttgaaaattacaaaatagttttgaaagaaattaacaaagacataaataaatgggaaattatattatgttcatagatcagaagagtaaatgtgaattctgaaaataatttacaatcaatgtaagttctgatcaaaatcaaagtttttttcataaattgataaggctgcatcaatcatgaagaacaaaactgaaggatttgctctaccagatgtcataacctgcattgtcagtagataaaatggccagtgtttggcacaagagtggattgatttaccactgtaataaattagagtccagaaaaagacctaaaggtatacagtcacctgaatcgtgggaaaagtaaaagttcactgagtagaaaaaaggtagtcttttcaacatagggtgctagatcaatagaattttcatacttttaaaatatattttgactctaaccttataccatatgaaaaatgaatttcagatggatggcagatctaaatgtgaatggccaaacaaaaacctttagaggaaaacacaggggtacattgttgtgaccttagagtaggcaaatatttcttgaataggaaacccaaaaacaaaatgataaatgtttgaggtgatggatacgctaattaccctgatttcatcattacacattgtatacatgtattattaaaatatcacgtacaattattacatgtcaactaaaaataaaaggggaaaagagaaaacacaaaaacgctaactaccaaaaagaatgataaagtgaaccatatgaaactttattttttatttttatttttattatactttaagttctagggtacatgtgcacaatgtgcaggtttgttacatatgtatacatgtgccatgttggtgtgctgcacccattaactcatcatttacattaggtatatctcctgatgctatccctcccccctccccctaccccatgacaggccccagtgtgtgatgttccccaccctgtgtccaagggttctcattgttcaattcccacctatgagtgagaacatgtggtgtttggttttctgtccttgcgatagtttgctgagaatgatggtttccagcttcatccatgtccttacaaaggacatgaactcatcctttcttatggctgcatagtattccatggcgtatatgtgccacattttcttaatccagtctatcattgatgggcatttgggttggttccaagtctttgctattgtgaatagtgccacaataaacatatgtgtgcatgtgtctttatagcagcatgatttataatcctttgggtatatacccagtaacgggatggctgggtcaaatagtatttctagttctagatccttgaggaatcaccacactgtcttccacaatggttgaactagtttacagtcccaccaacagtgtaaaagtgttcctatttctccacatcctctccagcacctgttgtttcctgactttttaatgatcgccattctaactggtgtgagatggtatctcattgtagttttgatttgcatttctctgatggccagtgatgacaagctttttttcatgtgtctgttggctgcataaatgtcttcttttgagaagtgtctgttcatatcctttgcccactttttgatggggttgtttgattttttcttgtaaatttaagttctgatattagccctttgtcagatgggtagattgcaaaaattttctcccgttctgtacgttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgccgaggttttcttctagagtttttatggttttaggtctaacatttaagtctttaatccatctcaaattaatttttgtataaggtgtaaggaagggatccagtttcagctttctacatacggctagccagttttttcagcaccatttattaaatagggaatcctttccccatttctttttttgtcaggtttgtcaaagatcagatggttgtagatgtgtggtattatttctgttctgttccattggtctatatctgtgttttggtaccagtaccatgctgttttggttactgtagccttgtagtatagtttgaagtcaggtagcgtgatgcctccagctttgttcttttggcttaggattgtcttggcaatgcgggctcttttttggttctatatgaactttaaagtagttttttccagttgtgtgaagaaagtcattggcagcttgatggggatggcattgaatctataaattaccttgggcagtatggccattttcacgatattgattcttcctatctatgagcatggaatgttcttccatttgtttgtgtcctcttttatttcattgagcagtggtttgtagttctccttgaaaaggtccttcatatcccttgtaagttgaattcctatgtattttattctctttgaagcaattgtgaatgggagttctctcatgatttggctctctgtttgtctgttattggtgtataggaatgcttgtgaattttgcacattgattttgtgtcatgagactttgctgaagttgcttatcagcttaaggagattttgggctgagatgatggggttttctaaatatacaatcatgtcatctgcaaacagggacaatttgacttcctcttttcctaattgaataccctttatttctttctcctgcctgattgccctggccagaacttccaacattatgttgaataggagtggtgagagagggcatccctgtcttgtgccagttttcaaagggaatgcttcccgtttttgcccattcagtatgatattggctgtgggtttgtcataaatagctcttattattttgagatacgtcccatcaatacctaatttatcgagagtttttagcatgaagggctgttgaattttctcgaaggccttttctgcatctattgagataatcatgtggtttttgtctttggttctgtttatatgctggattatgtttattgatttgcgtatgttgaacaagccttgcatcccagggatgaagcccacttgatcatggtggataagctttctgatgtgctgctggattcggtttgccagtattttattgaggatttttgcatcgatgttcatcagggatattggtctaaaattctctttttttgttgtgtctctgccaggctttggtatcaggatgatgctggcctcataaaatgagttagaggggattccctttttttctattgattggaatagtttcagaaggaatggtaccagctcctccttgtacctctgatagaattcggctgtgaatccgtctggtcttggacattttttgggttgtaggctattaattattgcttcaatttcagagcctgttattggtctatttagggattcagcttcttcctggtttagtcttgggaggatgtatgtgtcgaggaatttatccatttcttctagattttctactttatttgcgtagaggtgtttatagtattttctgatggtagtttgtatttctgtgggatcagtggtgataacccctttatcattttttattgcatctatttgattcttctctcttttcttctttattagtcttgctagcagtctatcaattttgttgatcttttcaaaaaaaccagctcctggattcattgattttttgaagggttttttgtgtctctatctccttcagttctgctctgatcttagttatttcttgccttctgctggcttttgaatgtgtttgctcttgcttctctagttcttttaattgtgatgttagggtgtcagttttagatctttcctgctttctcttgtgggcatttagtgctatagatttccctctacacactgctttaaatgtgtcccagagattctggtatgtcgtgttttcgttctcattggtttcaaagaccatctttatttctgcattcatttcgttatgtacccagtagtcattcaggagcaggttgttcagtttccatgtagttgagccgttttgagtgagtttcttaatcctgagttctagtttgattgcactgtggtctgagagacagtttgttataatttctgttcttttacatttgctgaggagtgctttacttccaactctgtgttcaattttggaataagtgcgatgcagtgctgagaagaatgtatattctgttgatttggggtggagagttctgtagatgtctattaggtccacttggtgcagagctaaattcagttcctggatatccttgttaactttctgtctcgttgatctgtctattgttgacagtggggtgttaaagtctcccattatcattgtgtgggagtctaagtctctttgtaggtctctaaggacttgctttatgaatctgggtgctcctgtattgggtgcatatatatttaggatggttagcgcttcttgttgaattgatccctttaccattatgtaatggccttctttgtcccttttgatctttgttggtctaaagtctgttttatcagagactaggattgcaacccctgcttttttttgttttccatttgcttggtagatcttcctccatccctttattttgagcctatgtgtgtctctgcacatgagatgggtctcctgaatacagcacactggtgggttttgaatctttatccaatttgccagtctgtgtcttttaattggagcatttggcccatttacatttaaggttaatattgttatgtgtgaatttcaccctgtcattgtcatgttagctggttattttgctcattagttgatgcagtttctccctagcatcaatggtctttaaaatttggcatgtttttgcagtggctggtactggttgtttctttccatgtttagtgcttccttcaggagctcttataaggcaggcctggtggtgatattaaactttaaaaattcctgctcatcaagagacataattaagacagggaagaagcaaaccacagaatgggagatgctatttgcaacatgtatctgacaaactacttatgcccagaatgtgttaaaacccctatagatcattaaaagaaggacagataaaccaataggaatatcagtcaaagatttaaatagacatttcagaaaagaggatattcaaatggccaataaatatatgaaaaatgctcaatgccactggttggtagggaaatgtaagggaaaaccagtattaggttagcattatacccaccagaatgactgaaatggaaagatgaaaaaccacattttgacaaggctgtgatgcaactggaactctcacacactgctggtcggcatgtaaagtggtacaaaactttggggaaatatttgacaaagtctgttaacacttgatgcagcacttacacttctaggtatagacccaacagaaatgggtaaatattttttaccaaaagtataaacaagaatgaccatagaagcactatttataacaacccaaaactggacattaaaatgccacccctccgccaaacagtagaatgggcaaataattgatggaatgctcacatggtggatgctgggtgtcaatgagagtggtgagccacaactacacacgacagcacgtatggaccttacaagcaaactattgagtgaaaggaccagataggaaagaaggtatgttgaatgattccattctttaaagcttgaaccaggcaaacatagtttaatatgtgctgttagacgtcaggattacagttgctcttgggaggagacacggtgagcagaagaagatacaggagaggtctctggaggaggctagcagtattctgtgactttatgtgaatactgctttcacaaatgtatttactttgtggtgcttctgtgagttgtaacagtatgatttgtgcacattttcatttgtatggtatatttcaaaaaagtttacctgaaaaacatagtgcatgtgcatgtggaagcatgtatgaggatgttcattgcaatgctgtttacagtagagaaaaattgggaacagcctaaatgtccatcaacagggaaatgattaaatcaattactatctattaatattgtgaaacactaggtagaacttttaaagaataaagtagatttaaataaactggcaaaaggcaaatatggaagctatgttgacagcaacaaaaccaggctgcagaacaatacatataattgtttagacatatatgagtcaagttatagatttttgtaggttatatatttatatgcaaacacatagaaaagtgccctaaagaaagcacaactgtgctatggtttaaacgttgacatcccccaaaattcatatgttggaatctaatacccaatgtgacagtattaaagggtgagacctttagaaagtgattaagtcaagggagctctacctttatgaatgggattaatgcccttataaaagagggttgagtgagctccatggccccttccaccaagtgaggacacagagaaaatgccatctgttaggaagagcaaggcctcaccagacaatgacaatctgccagcaccttgatcttggacttctcagactctagaaccatgagcaatacatttctgttgtttataaattacccagtctaaggtattttgttatagtagcccaatggactataacaaactgtaatagtgattttctggggaaagcagactaaaattaggggtggaggtcaaagttattttaggtttatttttgtttgtgttttattacaatgacaatataatcatgattacttgagtaattaaaaataatatttcaaatggtaagtgaaagatttccaacaggacatttcctagcaagaaaatgcatacatatacacatacaacttcaatatattcaaaaagttaaaattgtacaagcaaaactactttaccttgaaccactagaactagaaattattaataagtctaaataaaaaacccttaccaactggtaatttaaaggtacttctgtaaacattcgtagaaaatgaaaaaatatttttcaaactctagaatagcagagaaataatgaaattgttaagaacaaatgggtttcaacaaagctgtcctcaaagatgaagtcacatctttaaatgctttcattagcacaaaaaaaaatcaaaactttcaagtcaataagttttttaagcagttccaaggaagaacaaaatagcagatgatagcagaaattattgaattagaaaagggaaaaatgaggattagtaagtacattaagagctaagagataagtaaattaaaaagttaagtcttttaaaaatctaacacgacagactcaactctggctaatctattaatagttactacaaaggggaaagcataagaaatagcaattaaggaacatttaaaatcccataataaagacagtaaatgtgcatgcaattttaaaaatgaacaaggcattatttgcatggttatatgatgataaatctgaatggaaataaatacatgatcaaagttaacattaaaagaactgagcaacatgaataaagaattattcttggaaaaatgtttaaatagaaaggaattacatccaaaagaggtaccagactcaggcgttcttgttggtgagatgctgtgaaattttaaggcataattaattccaaaagtatgtatcagttttagaaatgtgtaaatttggaaaagtaattttataaaagtagagtaaccctgaaaccaaaatctgacaaatataatccaccatctgttcttcagtctacaagaaatagccattacattaaaagaagtttccactatctcataagatttaccaaagaattaaacaaagtcaatagaatctttaaagcagaacttctcagagcctttgatatgcaaatgtgcattgtggttcttaagaagggcaggaatacagcctgcagtgtttcccaattttattcgtccaagcaaaaaaccatttctacctggaagcatctcttgggagtggtgatctggggtacatcctttgggaaagcctgctatggaatataaaactgcatgcaaaatcaaaagtgaaatataagcaagtaaaattcagctgtgtgtttaatcaacaatctatgacggtttaacatgggaaaggaagaatggtttaatataacacattgtattattttatttataatacaaaataccaataggcctcaaaatagaacctgaataaatgttgaaatattattcagaaaatttaaaaatacatttctgataaaacatttagtaaatagtaaagtctcttacatgcataaaagcattgtctacataactacctgttccgtgtatcaaaatcataagcaacagatttgaaaagcaaataaatggtgaaaatttatgcaatgaatatcatgaacaaagagagatctctttaaaatcatcaacaaaagcattattatcccacataaaattggcaaaggtcaactcataaatgaaggaatacaaatcaccaaaaattattaaaaagtgttcatattataatcaaagaaatacaagattaagatattcttatttttatctttcaggttaaataacatatacattgcaaaacatcagaagagtatatatcagaccaacatttttacaaatcacaaatataaacttagacaaaatattttaaaaatctatgtgaagacaccagagaatagccaaaagcaaacagaaacagaaaaagataagagtccagatactaaacaacagaggtccccagtccccaggccatggaccagtaccagtccgtggcctgttaggaaccaggccacacagcaggaggtgcgtggtggatgagcaagcattacagaaagaaaagcattacagttgaaagaaaagaactgcgttgattgagttcatgtttctacgaccttttggtgcagaaaaatccccaatttttatgacgtatagcaactaaaacttaaacagaaagttgcaaacttactggctgaaggggtgagagaacagtgtttggaacttccaggccagctagaaatagaagaaaaatcccagaaaggagagagccagagagagagaatcccccagatctgcacacaaatgctgctcaaatttttggctgacagctgcactgcacgggcacaaaggaagctccaggaagcccagcacaaagctactgctgaaaggctggaataatccagcagatagttcagcagaggtccaccaaaggagaaacatggtttgaagtctatgtctagcaaaacttcaaatttatgtttatattatgttatgaagtttatgtctagcaaagttgtggctttcaagaacaaatagcaacacacttcagaagataacagtccagatactatacaacaggggtccccaatccccaggccatggaccagtaccagtccgtggcctgttaggaaccaggccacacagcaggaggtgagtggtggatgagcaagcattacagcctgagctccgcctcctgttaggtgagcagtggcattagagtctcatagaagcacacaccctattatgaactgtgtatgcgaagcacctaggttgcatgctccttatgagaatctaatacctgatgatctgtcactgtctcccatcacccccagatggaaccatctagttgcagaaaaacaaactcagggctcccactaattctacattatggtgagttgcataattatttcactgtatattacaatgcaataataatagaaacaaagtgcatgataaatttaatgtgcttgaatcatcccgccagcctgccacggagcacctgtggggctggagcctccgacgcagcctggcagggaggggtgttggtgaagagtcagactctgccggcccccctggtccggcacccgcgggcatctgcctggccagagggcagctccgtagccaatgcttctctaagcaacctgtggtccctgaatccggacctggtgcccttgggtgaagggaggtgacgtgcctgttctcaagatgctggatgctgggctaccccaggctccctgggggtggaggtggggagggccactgaaaatactgaagagcatccccggggccccagatggaaagagagtagcggttgggcctctgtgcataggatggaagggggccctggggcctgtcccccactccatttctctttcctcatctgtgaaatggaggaaagcatgtatttctccagctcagagatgcccgggaggaccaagggcctgggggaggcagggcttggccagggtggctcgtggctgtgagcaggtcccagagactggcctgtctccctgggtccactgcagcatgatgggttcctgctgatgtgaataggctgactgctgccctcccagaggtccccttaaatgccgtaccacaccaccccggggaagccaggcccaggtgcccaggagctgcccagagccaggcccacatggatcccagcttgctttctgcccctccttgtcctgagctacctaagcccaggttaggctgagcagccccctccccacactcccaccagactctagggcattgtggggggtcccttcatagagcaggcttgtggctccggcctctgcagctgtcctggttttgagacattttactccacttaataaagattatttgttgaaagcagaaatgaatgtgtctcatttgtgtgctgcaggaattcataagcatcacctccctgatccccctcgctcctgtgggacctggtgtttccccactggattccagcctgccctcctggcaccacccaggccgccccagccaccgcagccaccctactccctctccctctccctctccatctccctgacgcagcgactgagtcggcttttgactctatgtgatgtctctcagctccgtggcctctaaatgaaaagattaattagttcggggagcccagcacaggactgccaggggcactctgctgttctgcagacagggggaccgtgtcattgccgttttgaattgaaacaggcctcttggagagaaccatgcttaggaaagtgtcgagaaacctccagcgctttggggcaataagggtgtagtgctgtcaagatgctcatcagagcctagtaagatcacctaactgctaatagctggtgggagcgggaagccagcgcctctgatggagcagaaaggcccacgtgtgaggaggaggcaggaagggcttcgcttccaggagggccagggcgggaggactggagactgtgtcctctgagtccctgctcaaggaccgtgtgaggaactccataaaattttatggagtgaatgaactcgccgtgtttggctcgagcaagtgacaggcttgccagctctgaaggtctgttaaaaggcagatgggaagatccgcctctattctgagacaaacttgccttgtgtggtgcgaggtgaggtgtggggaccggcagcgggcctgccgcgcttcccgggcagcggagccggactgcgcacccagcgccccgctctgtggtgtggggtgtgtggtatctgagcccgggacgcggctcagtgactgtgatgggggctgttcagctgttgtgggactgagttacacgcatctcactggcaaagccacatcatctcaccccacaaaatacggaatttggggtgtcatgggtcaagaggctctgcgctggacagtgtggggtatggtgggtgtgtgtccgtctggacgtgtgtccctctgcctgaagggatgcagggccgtgaatggacccagcagcccccgcatcagccctgccctcccacaagcagccgaggaggctggtcctaagccggcgtctgcacagctccctgagggggaacaagggggagggtctcagaatggggctgaatttttctccacattcagtccccggctggacctgcagaaacctaggacggctttgaccctggtttacagctttcgggaaccccagggaatgctctggcctctaggctggaaccctgcccctctgaccccagccctccggccattcctacagcgaaggcccagggatgttaaccagtgcagaggccgggagcagtcccgggaggcgcccctgtttagatctcatggctggtctctgtctccacgttctcagaggcctgggaggggcaggctgagggctctgccagaccctcctgcccagagcccctccccagggtctggcccagcgaggggatggcatcactccctggggtgggtgccggggattacggcaggtttggggaggaggctggtggggcctgagcacgggctggtgtgggggccaggtgaagggtgcccaggtgtgtcaggatgcggctgggagctcactcggctggggggacgcctccccagcgcccgggtggtgaaagtgggtttccccctccagcaagttctttcctcagcccataaagcgggaatcctcccatgtggaaatatggagacaggcccctcccgctgcctgttctccccacggcaggtgaagggcctccttggagggcctctgctttccagtctgttaacacgaagcctgccagaaagtccccaggaccccaacccccactccttagagaagctgctctggcctgtctttgtccctccccgacactgccaactccaggcccccgttaccccactacttatgggcttggtcacctgtcacctcccccaggaggctccttgggccccaggctgccctccagctgggcccagcggctctcctgccagtcccgctggctggggactgcacctgctccccaggcgtggcctggtgccatcacccggacacccaaggacaggtttggactgcccatcctaggctcccatccaggagagggtttggcgggggcagcctggacctgcccattccttgctgtcctagctgcccaggactgtcccagttctagccccagaagccctcagccccagaaaactaggggtgacttaggcttggcggggcgggtcaggatgtatccccactagggagacagtccggccccccaagccatgtgcagagaagcccagggcagtgggatggaaggaggggttcggggaagaatcctgctggggggggtgtccaaaggacaacccgaaggagaggttcaaggaagtcctggctgagcagagatgctggcgggcagcgggggcagtaggggaaccggtggatcgagggctcttcctctaggacctagtgcttccaggagcatctcaggagctgaggggcatctgaggccacagacgggaggctgcatgggtggcgggggaggcgtctgcagcagcaggcgtgggagcccctgaaagctcttggcaggggagggacgggcagctggcatccacgaagccccctgggctgtagcctggagcccagcctggaagggcagctgggtgagaggaggctgggcacacagatgcacagtatgggcaaatggccaggtggggctgtgccgccccggaccgcagggtcccacttggcttctgtctgtcacagtcaccgcccccacttggagagcgtttgctgatggagctcagctccagaaagtgctgtttaaagattgaagagctccaggcaggcgattacagagcacgtgggttgactctctctgacccacagctggtggagggaggggaggagctgggggcgccacagctggatgtgctcctcccccacgagaagcgcccagggcacgtggagcagagggaggtgctggctctcattttcctcctcactggagcgaggcgctggaaggccactccgagggtgggggcggcacgctgcctgttccccactggctctgcccttggggcaccttagcttgggtccagcccacctgccccaataccccttgccggaccctgccctgctgcctgcccctgcctgaaccccaccccccacccaacagtgcttcccgcccagtctttcccagttgcaggctgaagccccccactccctgggcatcccctaggagccctccctagcaccgcctcccacacccatttcccagataagattctaccgttgagaacataccatgggggggccacccaaggcccctgagccacacgtccaaagcacagacaccttcggaacaaaagcctcttggtgcaggggatggcggcggccgaagttcaccctgcccagggcaggacaccctgcagcaccgggagggtcttggtctgtgtttccaggactgtgagcggggcctctttggcctagtggggaagagggcacgtatggggcccacgacctctcctgtgcccaggggctgtggtcagggcactcgtcctgcagccacagacaagtaagtgaccaggacctgcggggaagataggagatgaagcccccccggacatccccggccctccccaggaaccaatttacagttgctgagctctactctgggccaggatgaatcagggacacgacctgggaaggggcggagaagaggacctcacgcaggtgccaggactggccctgcccccactgccccaaccttcatgattctgccccagagtcacctgccctgggcctcagtgttctcacctggcggcaaggatgttcctgagcatttatttctgagtgggtttgtgtgtgaggtctctgcatgggggctctgtgtgttggcacatgtgtttcggctcagagtttgggtagggggcttctgtatgcacatgtgggtctgtacacgtgtgcgtgtgtgtgagtgcatgtatgtgtatgcacaggcatgcatggcctgtgtgtacgtcagaacgtgtgagtgcacatgtatgcatctgtgtgtgttgcatgtgcgaacaagtacacacgtttgtgtgtgtgcacctgcacgtgtgtcacttgcgtgcccttgcctgggtgggagaaaggacaaaggcgaatgctcttgtctcctgctgctgggtaacagctcaccacaaggcaaggccttggacagcaccacattcgtcaactcagtttccctgggctgggggcaggctttgcttagctggactcgctgccccgtgtctcacatccgggtgctggctcctgcattattccaagagcatccaagctggtggcagaactgggtgcctctgggttgggactgaggccctgtttcctggctgttggggcccctctagagccctgggcctctcaggatgcctcacgcacacccctcactctccaactctctctgcctctttttctgctctcggcttgtaatgggctcacctgactgggccaggctaaacccatgacctccacgtcataagggggcctgacctgggaccatgactccatctggagagtcccctcacagcagaaagtggattcctgtttaattaaaaagctaggccaacataacgaacccccgtccctactaaaaatataaaacttagccaggcatggtggtgcacgcctataatcccagctacttgcgaggctgaggcaggagaatagcttggacctgggaggcagaggttgcagtgagctgagatcatgccactgcactccagcctgggagacagagtgagactccgtcttaaaaagaaaaaaaaaaaaaagggccaggaggcaggaatcttgggcggtaactgctaagctctgcctgggtgcacccatctgagccccatctctgtcaggtgtctgctgcacccgccggtgactgtaccaggcatagcagcagcacctacccctctcctccccgcccaccctcctcctccccgcccacccctctcctccctccctgctgcctctggcctctggcatccccagcccatgcagtcaccgaatccccttgttcctggacatggtccaagggagatttattactcagcccatccttagtgtcgagggagcagccccagacacagcctctgctcctgggaagccatggagggggataggggagcctgtggcttggagacggagctctggctgggacgagctccttgcacagcatggtggaccctcgctgaagtgaggaggaacccacctcaccgattgctgtgacctcccaagatgagtcgggccacgagcctggcctggggctccaatcactacagcacgctccttccccgagtcggcctcctgggcctcactttccccagctgcacaacagagagtgaggccctgagcgttgggaggttggaagccaatctacagccttcctccagtgcaccctcccatcttgggcagaggccagcagcacacacgggctctggaagatgggactgccccgtccatgcagtgcccacctcccatacaaccaacctgggctgcactgcgggctgctgcaccactgcccaagtagctgactagggaggcaccacccccggccacgcagccgaggccatcgtctccctggaggtcgcctggtggttttctcaggttgtgcccccaaatgaccacgaacccagggcaccttcctcactccccctgcaccccagggcctggccttccctcacaccaggccccaatttcctcctcctacgggaagccttccctgatgccaccaacctgttctgttcttcccagacatgttcttgggccgagccagccagagggtggggaccagcactcaggccatgtgtgtagctggggacttgggtatagaaagatagggtctctggccgggcacagtggctcacgcttgtaatcccagcactttgggaggctgaggcaggcggatgatgaggtcaggagatcgagaccatcctggctaacatggtgaaaccccgtctctactaaaaatacaaaaagaaattagccgggcgtggtggcgggcgcctgtagtcccagctactcgggaggctgaggcaggagaatggcgtgaacccgagaggcggagcttgcagtgagtcgagactgtgccactgcagtccagcctgggcgacagagcaagactccatctcaacaaaaaaaaaagagaaagaaagatagggtctctgactgccatgggaggaccccagctcccacattctccagctatgtgacttcctccagtctcagttttctcatctgtaaagtgaggtgcctgattgatgccaggtcatatgtggggaattagagaagccagcctgtgagaggcgcccctgaggcctggcggcttcgttcctgcagccccttctcacctccctgagtctctgcacccccaccctggcctgggggctccttgagggcgggggcaggggtgggccaatgggagaacaagtaagggctgagctcacctcccagctgggactcccagaaccttcccttaagagcagtgaccctgcaccacccaccccattagctgtgtcctaagtgatcctttagaaaccccgcaggaggcggctggacagagcacctgggtatcaaatgtcctgcagccatcacacaggtcacacatggggtctcaccacccaaccagccaggccccgagacccgcccctgcagctgcccctcccacccacttgccgacctctcctctctataaaatgggaagggctccagggtcagcgggtggatgtcagggtgagacaagtattgtgacgcagactccgtgttcagcacggccgtcgggtgtgcctaggggttcccaagcactgccttgcacagcaagcccatgttgcttatggaaatttcaaacccccacgaaagcaataaggacgcacaatgcacctgcacactcagcaccagccgaacaacgaccctctgcagaccttcctgtcatctgcacccacacccccaaagcatttgttaacatgctgctgtctggaacagttttggatttttgcagacagcacagagttgccacgtccccacaggtggtttccctgttgccaccaacctgcatcagtgtaagcgtctgacaactaaggagcaatattgacatgattcatgacaacatcactttattcagatttcctggttttccctgatgtcttttcctctcccaagaccccatccaggatcccaggtgacatctgttttgtttttgtgtttttgtttttcccccgttcctacggtgttgaccacatggcgtttggtcgttgtgcctccttggacacctcctggctgggacagtttcccactttccttgttttgatgaccttgacagtggtgaggtgccctgggcgggcactttgaaggatgcccccgcggggatgcggctggtgttcttctcacaagcagcctggggttgtggccgtggggaggaagggccatctgctcacaccctctccagggtgcacgccgtcaacaccaccccgctgctggcgctgactccaccctcctcatgtttcaggaaacttgactgacagtaaatcttcatggaaagcacattggggtgatggcgcccggacagccaagacatcaccgccctgagactcctcccgagcccctggagctgctacagcccccgtgggtgctccctggccgcatccttgccccgctccagcctctgtaacttagcacgcgtgctcgtccagcggcctttgctctgtgtgtgactgtccgtgttgctgctcaggttgccctgcgtttaggcagcaccctatccgttcatccgtcccactgcgggcgcagcaccctagccagtcattcgtcccactgcgggcgcagcaccatatccattcatccgtcccactgaggaggcagcaccctatccattcatccgtcccgctgcgggagcagcaccctagccagtcattcgtcccactgcgggcgcagcaccctatccattcatctgtcccactgcgggcgcagcaccatatccattcatccgtcccactggggaggcagcaccctatccattcatctgtcccactgcggaggcagcaccctatccgttcatccgtcccactgcgggcgcagcaccatatccattcatccatcccactgcgggcgcagcaccatatccattcatctgtcccactgcggaggcagcaccctatccgttcatccgtcccactgcgggcgcagcaccctatccattcatctgtcccactgcgggcacagcaccatatccattcatccgtcccactggggaggcagcaccctatccattcatctgtcccactgcggaggcagcaccctatccgttcatccgtcccactgcgggcgcagcaccatatccattcatccatcccactgcgggcgcagcaccatatccattcatctgtcccactgcggaggcaacaccatatccgttcatccatcccgctgcgagagcagcaccctagccagtcattcgtcccactgcgggcgcagcaccctatccattcatctgtcccactgcgggcgcagcgccatatccattcatccctcccactgcggaggcagcaccctatccattcatctgtcccactgcggaggcagcaccctatccattcatccgtcccgctgcgggagcagcaccctagccagtcattcgtcccactgcgggcgcagcaccctatccattcatccatcccactgcgggcgcagcaccatatccattcatccatcccactgcgggcgcagcaccatatccattcatctgtcccactgcggaggcagcaccctatgcattcatccgtcccgctgcgggagcagcaccctagccagtcattcgtcccactgcgggcgcagcaccatatccattcatccgtcccactgcggaggcagcaccatatccattcatccatcccactgcgggcgtagcatcatatccattcatccgtctcactgcggaggcagcactctatccattcatccatcccactgcggaggcagcaccctatccattcatccgtcccactgcaggcgcagcaccatatccattcatccgtcccactgaggaggcagcaccctttccattcatccgtcccactgcgggcgcagcaccatatccattcatccgtcccactgcgggcgcagcaccatatccattcatccgtcccactgcgggcgcagcaccatatccattcatccgtcccactgcgggcgcagcaccctatccattcatccgtcccactgcgggcgcagcaccatatccattcatccgtcccactgcgggcgcagcaccatatctgttcattcatctcactgcggaggcagcaccatatccattcactaattccactgcggtggcagcaccctatccattcatcgtcccactgcgggctcatctgggtcttcgtggagccacggtcctgcttcagtagatccaattttccaaagctgctctgtggattttcagcccctcccaccgtgtgtgggggccactgccttctctgtcctaaagcggccctgccatcgccgctctggagagcaggatccagaagctcagtgggctgagcgcatccgtaggtgccccacctccaccccaggatgggcccagtacccacctcaggctgcgtctgctgcaagtggaccagccagctccaggtggagagaagtcccaaggaccccacagcagaggtgcctagggtgagggacatggggggtgccccgtgccagcttctgcctgggccaagggaaggggcagtggcagagctctgacagcctcaggagtttgagatgggtcctcctgcagctccagaagcaggagggcttgggcaggggtggggctgcctgccgggctgaagctcctgaggtggcggtggaagagcacacttcaccctcacaagtgtcttgcagaaatttccagagacagtgtcctggaacggtcacccagctctgcctgccccatggtggtgggatctgcctgcccaaccttggctcatagcgacattggaggggccgggacagccagacctcacctcctcgaggagcttcctcctccaaggaggggctcaggtgagcatccggtccccagaagggccctggccttccagtttgcacactaaactctccctgctgtctgtgggaggagccggctcctgtgggaggagcacaggctcctctccctgctgtctgtgggaggagccggcacagctctggagctgcccccacagggcacagccttgacctgggctcagggagggccaggggtcccttctggccaccccatgtctccagagggccttgtagcccatcctggggtaggggctcagtctgggcatggtccttgcacgctccagtgatgtggagggtggtccctggggcaggccccagcttgaggttgggccagagtggggtgaggcctgaggaagggtctgggccacaccaagcccgaaaggagcgaagagaaatgggtccccatgccaccgagagcaaccacttgcctggccctctgcatctggccaggctggctgggcctccccatacctacggtccccattttacctgcactctgtggcagggctggtggagaccagggcctgcctgggacccacagcagccagcccaccagggctctggccagggtcaccaccctgggttccaccagggtctgggaccagggaccagagagacccagagctggggacacaaccaaggagcctcggagtctatgaagcaccaagggtcagccctggggacatccttggagatgcccaaccggctcctggcccagcagtggggaggccgatcctgaaggggccggagcccgtggaacacacggacgcaaacaacgctgcacagacccctttcccagcctaggatgtggccgccgggagggtatctctgaggctggtgctcaagcaccacccacacctcctcatccccctcacctcacctcccctaatctgcaagctgcggcccgaggcgcacctggctgtcccagccctcccagcagcacctggcggctccctgagcttgtccacagcagcagtcgtcttcagggtggctctgcactggcaggccccgggtgcccttcccacgggggtggcagggagccggctactccagacgggccccgcactgtggacaggcgctgatgcttcggtttccgtggttgccccggccccgttgtttgagggccccgagcctggcccacctgcccacacccgtgaggaggccttcaggaaggtggggcacagcagcggtgcccagtttggagcaaagcctggacttggagcttgcagaaggagctcttagcccacacagaaggaatcacaactgggaccagaagcacctcctccatcttgtggagttgctgaggacagatggtcagaaactgagtttgctgtggtggcaaagtgtccctgccaccccggcccctctagagagggcagcgcccgccccctccaatcacggcatccacagggctcctggagcccctccagccagtcgggccagccatgggggcaccctgtgcctgctccgctccgaggtgacctccacccacagctgctctgaggagcacggccggggttccccgagacttccctggtccactttagagccacggggctaacgggttttgttttcagtggtatctcttcctcggtgatgtcctgtgggccaggtctcagcccaacccctccttcacaagctggtagccaccctggagcccgccagtccccagctcccggatgctcacggtgggctaggcacggtcaccacaccctgggctgcctgtcacagaagtggccccagcctttgaggatcacggagagaccagggtgacagtctctgtcaagagcacctgtggcacctgaggtggcccctgctacctccctggagggtgagcttcaggcaaggcctgagggtgtctagagggaccctgtgcagggccaccccgcctgagctcaggccccgtccttcctgccctccagagggggaaccagccacagagcctcggcctagggctcacgtgggcccgcgcctgcagtgagtggctgccctctgcagacagagcgggctcaggcgccccggagctggaggggtcttctctgtaaaagtgacctcaggaggtccgggtcctgcattctttctgtccccagcccagaacctgatttctgaaacaaagtttcctgggcctcggggagtgaggttggggctactgggagttcacagggctcatcccttcccctggagtctaccagcctgagctttcctgccccacactgtccccgaggggcctgggatgctgacagaagtctcacggctgctaatgtaaggtcagggctttagtgccctgtgcccctgcttgtcgccacccgccaccggcctccccacacctttggagcaggtggggaccagcatggatggccctctggactggtgtggggggcccctgctttggaggggctgctggccagtggcaggggttggattggagccaggcggatctcaccaacccccatccttcaacacaacagaaaggggcgggtgggaggttggagccccggccgtgttagctgctgtggtgcctccagccaaccctattccatccccaggaccacctgctcaggggtgccctgatcccagcaaccaaggactccagaaggtaggtataagttccatgggctttgcagggaggggctgagcagtcccacacaggcactcatttggaaccaaacagagggctggggactgaacagaggcattctgaccccacagcaatggggagccatggcgggtccttgagcagaagggtaggctctggaatgtgtttgaagttgatgctgacagcaggtgtggggtggactgagggaagatggagaccaggggttgccagggcaatgcccaggagcaacgtaaggaggcccccagggtgcaagggagggccaggggcagggcaggaggtgggagtcttggccaggaacatgctgtagggctaggaactacccggaaaagggtgagtctcaggggcttggaccccctcccggagcagaggactccagggtccccagctgtgtgcccttcactgtgaggcagtgtgagtgctggcccactcacgacatgcccagacctgcagaatgggaaaggccttcctggtaacggggcctccaagagcaggcaggtggcctgtgagcggcatttccaaacatcagacttcgcagggctgacttgatggctaccagcaagcaagtcccaccatggttcctgtggggcagtcggggtgctcagggaggtgggctccaggcaggggacctggcccagcctcactgtgacccccggaggcccagcaaggggtgactagtgggcacagtgccttggagtgggaggaggagaaaccctaaaatgaggcccacgccccacagccgagtggctccctggagccagccctggccccgtcgtgccccaagaaggcctggctggccagggcctagggctcctgtggggttgccagcaccacagggtcagtacaggctgtcatcaggcagtccagccaccctgagggcaggtgctggggaaggaccctgtcccactccctccatcacctgtgctggggccactggcagtcataggagagcagagcaggcccaaggtaggcgccagacatggcgcccttgcagccagcgtgtccacgcccatcctcaagccgagcctggtcaccagcagtgagaagggagggtaggcccacggccctggctcccctaaagtcctgtttccacggaacgatggcccagcatctactcctccccaggacccccgctaactgggaagggtcagcccctgccctttgcactctacccccaagacatgcggcctccttgacctctctatgctcaagcaagtcttgccagaactaggaaaatctgccccaagctatgatcccagctggtgcagatggtcccaggctgtggtgggccctgttctattcctcccaacaaccctgcagtccatcccacaaatcgggacaatgcgctgggacagctgacattccagaggtgtccagggacgcacagtgaatccgtgtccactggggagcgcccactaggagggaggaagcccaggagagtgggcgctcgcaggaagccctctggcctggcccggtagtcctggcgggcttccagggggaggtggagctgagcctcctgcagatgggcggagctgagggaggcaggcctggggcagtcggggtgaaggctccaggactgccagggcaggaaaccacacaggatgttatggagaagcaggacggcagcaagggtgtacagctgggcctggtcactctgccaagcccctagcccggcggctgcctccccgcagtggcctgttttctccgcggccatgccaggagacgtgccgggggctgaccgtaagcttcccccaggaactgctgacacaagctcctcccactgcatgcctgtgtctggctggccaagctctgtcccaggacttccctcccaccagggccctgttcccattcccaccacaggaccaaggggccctacttagcctccagcctcccgggcaccccctggtccttactgcagctgcgctggtgtcattctccgtcctgtggggtgagctccagcatggccgtgcgtgctctgctgggcagtgccaggcccgtctccactggcctcagacacggcaaggctggacccctacccagggtcagagcttaggtgtgggaaggagggcgatggagcagataatgagtcaatcagacctggagacgctgggggctggtgaagcaccaggcaaggagtttggggctgcccctggtacaggagccgtatggtcctcaccccacaccccagggagtcacccagccagggccaggggagaggcaggtgactgccgtgtgcggactctgcactggctactacactgcctgtggggctggaatgggggctcccagaaaggggctggactccagcccctggaggacagggtgttaggcagccagcagtgggtgaacccaagggccaggccagcacagcacgggggcagggtgagggtcccaggttgtggctcagcctgacgggccttgctgtgtaagctgctctcagagagggaggtggctggtctctttcttcccttgtggagatgcagccagacaggggccagaggcccaatgaattaattatggagggaaggcagccctgctctgagcagcggggctctggatgaggcggtggctccagctgctgcagggccctgaaagcacactgcccacctctgccggccccacccagctgcaggaggcccagccccacctgccctggaagccttccaggactgtcaggcagggggatctcctgtaagcgcccactctcctgggcctctcccctctgacagggcactcctggggcaggtatcgcagagggggagttcctgggccctggccagctgctcagtgggcagctgtgggcccttcactggcttcaggttcctctgagctggtgccctcccgcctgcctgtgggtggtgacactgggctgggacacatgagtcctccccacactggccccagggcacaatcaatacccagtgagcctttcattacctggctgttaattattcagcgctcactgggaaggccacatgccacatccgtgccctcaccccgccccaccccatgggaacacaacagaaagtgcctgggagtgggcagggaggagacgctaagcacacagtgaggagaccacccctggaagcccccagaccacagcagagagaaagagagagacagaaagaagtcttccctggtgggtgagagcccaggctgttcttccaagggcaggagggagggaggcagggaaggaggaaggaaggggggcctgaccacccaggccagccccgggggccagctccactggcatcacagcacttaatttgcacacagcgcaggaggtgaggcctgcctgtctgctccctccaggcccaaggtcacagtgaagggacgcaggggatccagggcagttggatgccccgcaggtgggggatgaagacttggccaagccccctcaagcgccaagctcttttactaggcagtgtctaaaagccccttgtgagtgtcccaccagccacatccattctgtatcctctaagaaagcaaagcaaaggaaagaaagaggggaggggagggcaggggcaggtcctgagggctgcaggcccccgggtcccaggtgagtttgtgggtcagctctcagaggtgtgaacacagccttggtggggcacccagatgcagactctggcctcagaccagcccccaccttgtttgcgtcccccaagtcaagtagccgtccccctggcatgggccatcccatggcaaaggggttgcagggaggaggtgtccctgtggcctgtgtcgggggtacacgccagcacagaggctgagcagcccaagccaccagctccagatgctacaggtggagtttggatgtcgaagcccgaatccccagtacacagaacgtgatcttatttagaaatagggtcactgcagatgtgattagaaaaatgaggccaccctgcagcagggcaggcccctcatcggacatgacagttgtccttataaaaagaaggaatttggatacaaacacgtgcacagggcaaacaccgagggggtgagagcaagggtcggggtgatgtttccacaagccgtggaccccagagacggccagcaacctccagaaacgaggcaagagctgtggaacaagttctccctcacagccccggaaggacccagccctgtcaatgcctggatcctggactttctgccttcaaaacattgcgggaaaaaatctctgttgtttaagccacccacgatctggtacaggcaaatctcagagatattgtgggttccattccagaccactgcaataaagtgagttttacaatacggtgagtcacatgaattttttggtttcccggtacatataaaagtgacattttcactgtactgtagtctattcagtgtgcaatagcatcgtctaaaaaacaatgtacttaccttaattaaaatacacttcattgccaaacaatgctaacgaccatctgtgccttcagtgaatcatcttttgctggtgagggtcttgcctccatgttgatggctgctgtctgatggaggtggtgggtgctgaaggctggggtggctgtggcaatttcttaggacaacagtgaagctggcctcatcaatagacttttcctttcctgaaagattttgctgtagcgtgcgattctgttgacagcattttatccacagtagttcttctttcagcagtggagtcaattttcccaatccttgccactgctccatcaactaagttttgatggaatattctaaatcctttgttgtcatttcaacagtgttcactttcttttctcatccgtaaaaagcaactcttcatccattcgagtttcttcatgagactgcagcaattcagtcacatcctcaggctccacttctaattctagttctcttgctatttccaccacatgtgcagttcctgcttccctgaagtcttgaaccctcaaagtcatccatgcgagttggaatccatttcttctaaattcctgtcaatgttgatatctcaacctcctcccattcttcacggcttctagaatggagaatcctttctgaagattttccattgactttgcctagatccatcagagaaatcactgtctatggcagttacagccttacaacatgtatttcttaaatagtaagacttgaaagttgaaatgactccctgatgcgtgggcggcctgatggatgtcgtgtgagcagccatgaaaacaacgttcgtctcctgcgagtctccagcagagctcttgggtgaccaggtcatgtcaatgagcagtcatattttgaaaggaaccttttttttttctgagcagtaggtatcaacggtgagcttaaaatattcagccaatcgtgctgtaaacagatgtgctgtcatccaggctttgttgttccattttcagaacacagacagtcgactttgcgtaattcttaagggccctaggatttcaggaatggtaaatcagcactggcttcaacttaaagtcaccagctgccttcactcctaacaagagaggcagcctgtcctttgaagctttgaggccaggcatcgacttctcctctctagctatgaaagtcctagatggcatcttcttccaatggaaggctgtgtcttccacgttgaaaatctgttgtttagtgtagccaccttcgtcgatgatccaagctggatcttctggataactcgctgcagcttctccgtcagcacttgccgcttcaccctgcactttcatgttctggggacacacattaagcctcacgaaccgacctctgccagcttccagcttttcttctgcagcttcctcatccctgtcagccttcacagaactgagaatcagggcctcgctgggggtgaggctttggcttaaggggagtgtgatggctgcttggatctatccagaccactcgagctgtctccacatcagcatttttaaaatttttaaaatttccttatagaacttttccttggcattcacaacttggccaaccggcaccagatgcccagctcccagctttcggcctgcatggggtctccacctgccttcctcacagaggtgaatcacttctagcttttgatttaaagtgagagatgtggcatggttcatggtttccccagttacactagtaacatcgaagatcactgaccacagatcaccataacatacagtaatgatgcaaaagcgtgcgatgttgtgagaattaccaaagtgtgacacagagatgtgacatgagcaacgtgctgttagaacaacagctctgattgacttgttcaacacagggctgccacaaaccctcaatttgttaaaaaaaaagtacagtatctgcaacgtgcaataaagtgaagaggaataaaacaaggtgtgcctacacctgggtacggcagcctaggacactaatgccacagacgtgggaactgaatggtggggtttcgagtagtgttttctgggatttgtaccaccaacccatccctttctgattatacaaggcttcagtgacagatggggaaactgaggcattgagattggaagagattcacccacaacacccacaaatccatggtggggctgagccagagtccctagctcccctacccctgcccattccctattccgggccctgtccttccttccagctgcaacacaaaggtggtgtccaccttattgatggaggggctgagtcccagagtcacctggtgcctgcacagagggagacggagctggacccctgccgggggtggaggccctggacaacgggcacaagtgaggctccagacagcatgggagacagcccagtggatggtgggtcagggaggcttcctgggggagggtgctccaaggggctggaggatggacatggtttagcaaacctcgctggggcagagacaggaaggacacgggtgagttgggagctgagcaggcaggcactgggcatggggcagcagctggagacggagggctcagggctcactggcaccaggatgcctcagctggagaggaacagccagcaggatggtaggccaggaggacagcaggacagcagtggccacaccacgtggcccaccgtctgctggatgcctgggtggtacacaggcttccactccgcggtgaatgcccaaggcccttttattcatgttcgtaattacagaatgcagggcgcattatccacaatttgcttcacatgaaaaagcaggaccatttgctgaagcccttccccgtgaagctcagcacgctgctatcaatgaacccggaatcctctcccggctggcaaatggaatcttttctgctcctgacaaagaggaatgtcctcaaggtgaatcttttcattcctgctcctttcagccagcaattttggtggctgacagattcttctgtgagaaatggcgatttgataaaatgcaaagtggatgctatcgagctcacgggcttttcagaggagttgggagccatggccctgggctcctttccgccctccatccgcctcctcttgctcctccaagcccagcctgtgcatcctggaaagccaggagcaggactccagccccagccgccacagcaggcagcagctgaccacttcgaagctacccgccccgaccccacgaggccacacagcctccctcaccggctgggcctggctgagaccccggacttggagcaggagcagacctcagccagtgcccaggaactgctaggtgaggcctgcactgggcagcaacaccccctcacgaggcacaggagcaggacctgggcctgggcagggctggggggcagacacctctgtccacagcacatacggcttctcccggccaccccggggtccgtcggagaacctgggatcacgcagggcccagaacacggccagccaagcctcctccgagccctcctgggagtgcccccacccttacaccgggcacgaggcgaccagagtttcaggccagggctatggaatgctgtggagtcaggcgagtcttgggagcagggatgaacacaagccttccaaccatgtggctttgggcaagtgatctctcagaacttctgttttctcctccataaaacttgcatgggtttatctgccgctcccagccaaccacatggccagctctgtgctccagaagcatctgaaaacagcagtgggatgagggaatgaaagagcaaatgagtgaatgacggggagcagccatggtgagggatgagagcctggcctgcccttcccccactgaccccaggacaggatggaactagccgtggaaggtggatttgggaagacccagctgtaggggcctggcaagggctcttccggcagtatccgcacgggtgagggagtgtggatggttgtcattcaggaattactcagactgcagggtgagggatcacaggcagctctgggacccttccacagaggtggtgcctaatcactgggctgaggctgtgatttgcctgcctgcaggggagccctgcctgctccgacttaagactctgcctcagcactaacttttaacgagggggtgccccagagggccccacccaccccagagtcagaggcccggccgcagctctgtctcagcacattacagggaacccaggagttctgatcctgattccaggccagccgccccagcactgtcccccacgagagtcctcaggggacagctcagcccagccactccggccctccccactctggaccctgagggtcacctccctgcaaatgaggctttcccaggcagcaggccccttgctttccggggcccagtggcagctgcagagcagggcaggctcaggctggtctggaagcccctgcccctcacctgctggaaggctgctctcctccagagcagatctggtccttccagaagcctcctcctccccacccagcagggctctgcaggcctccccctgcctcaggcttccctcactccgcgccacactccactgtgccacccccttcaagcctggccctgctcgaggctgcagccgaatgcacctcctggaggggcgctgctgatgcccctattcccctcttgttcctcgagccctctgcttccctctgcagcagcgtctgctgctggatgtgtggtgtgtggtgcatggtgtacgtgctgtgtgtacttcccatccagctcgggcaccgctgtggggatccaggccaaggatgacctgtccagtctcccacatgtggctccagcaagtccgtgtttgaggaagaaaggcctgagaattccagtctccaaagcagggaaccctgggctcggggctggggctcaagatcactcacttctggggcatgaggctgatcccagagcttcatggagctaagcagcctccacagtgggtcaaagtggcagtgggggcagggagaggagccagggacgtgtctcatcccccccaagggcctagagaagagcccaggggcctggagtagatgaagccttaccaggtttgcccaggccctgggggaggaggggctgtggctgaccagccaggacacctgcctgatgtctgggcctctggtggctgatgagtacatcagtgcatttcacactgaactcctagcaaggtgcgtccacacagggagagtcctcaggcagctggaaccatgcacctgtgggagttgagaaagcattcacccactcacttactcacccactcactcattcacccactcactcacccactcactcacccactcgcccactcactcattcacccactcactcatttacccacccactcacccattcacttattcacccattcacctattcacccattcacacattcactccttcactcattcacccattcacccattcactgattcactccttcactcatttacctgttcacccattcactcattcacccactcactcactcactatctcacccattcaccatctcacccattcacccattcaccctttctcctgctcacccattcacccattcaccacttacccattcaacagttcaccggttcacccattcacccactcattcattcagccactcacccattcacccactcccccatgcacccatttatcccctcacccattcactccatcaattctttgcacattcacccactcgcttacttacccactcacgcattccgacattcccacagcaggcatgtactgagtgctcatggcatggtgtgggcacctgggctgttcaagtgcacaaggaggaagcttcccatttccaaggcagctgggtgcgggagaaagggggaagaatgaacccaggatcagagagatggggcatccttcaagacagtgggatgggcattggcccagaggaatcaaccccaaaggtgtatcaaggccctgcagaccggagctcctgtctgttccctgtgcagaggaaagccgggcaaccacctgcctccctccacgtcagagggaaatgtcttcattaaatattgattggtttgcacaagccttgggttgtctggagggaaggatagagagacttttgcatgtaaattacattttttttcagcccttctttaatcctttcctgcctaggcaccttgacacctgttttgattccccacaacaccagcaggaggtccctgtgggctcagggcagcccccgggacttgggactggaagcatccagcatctcttctctgccatggccttgaaggtcttccaggtccgctctgcctctctccacactgggcactgcctgctccctcttctgctggattggagatgcaaggatgccagcacccccatcccctggcccaggccagggcagttgatctctgcagacacagactctaaccactcctcagccaggccttggcaccaagtcttctaggaaagagctcacctctgggaccaccaagagcttccatcttgacttttaaatgttataatcctgccttgctgagcaagctaagacccacagaggcaccttccaattgggttccagcacttgggatctgtgtcctgggggacggtgggctggggggaggggagaacagctggcaccacgagcctaggtttccacatttgtaaatggcaggattattgtagcttcccttaaaattgtgaccaggatgaaataaagccatgtgtggctagcacagtgctgggcagatgactggtcaagaagcagcattttcccgactgtgtgtggagagagggaaggataataaatgagtgagtgagtgacagatgagtgggtgaggagtggatgagcacgtgaataaatgaacgaatgaacgaacggcccagtggtcctgcatggccttggctttcctgcagaggctaatgagactccttcattcaggagccctggcctccaggagcagctctggctctctttggctgtccctgggatgctggctccgggtcgctgcaggtccagcctcctgtccggctcctgagctccctccgtgctcctggttctgcaagtcactctgctccctcttgaaggtctgaacctatcacaggcctgtatgtccctggatgccctgctgtgcttggggccccttcccttcctacccctctggcctttttgacaccctcactgataccaggggggctcccaaagctgcttccagggatgatgcctccttctcactcagtgacgtggaccctcagtaacccgggaagtaggcagtacctgccccgccaccactgtgcagtgcatgggggctcagggcagtcacagctgggaggcttgctagcacctcccagccatctgtccattgtccatccactcctgcctccactgcctaaactcagcctggactccccctgtgattggatttgactgacttctggagtcctttgcaggactttggtttgtttgtttgtttgatctgcagtatctagctgagattgccttggaatgctacaggttctggtctattcaacaggcacagtgagattggagtaaaacgagttcacacccactctgtcaagatgttaattctgcagctcccacgggcaggtagtgagggaggcccgggccctcttgttcctgcaagggactaacaatagccagacacgctgaccatcatccctcacctctgttctgtgtctgttctgagagccttggcctgttctcacttccttccaccttgtttccaccacacctgcccctgtctacagcagaggcccttgcaatcctgccagggctcccaaagcaaggccaggacatggatctgagtagaatgctgtatgtgcacacatgtacgtacacatgcgcagactcacgtgcctacatgcacacgcatgcatgtgctcacaccaactctggctgactgggtcaccagatggtcctctccgggtcagtccagttcccttccttttgtggtaaaactttggaggaaatcttaaataaggttttggggagcaagagctttgcaacttcttatgtgtgagctcggctgagccctcccaccctgggcttcatttttcccagatgaaaaacggaggacttggacccaatgacctcttctatatcttccaagtcaaacttgccaggagcctgggactgctgggttatcttgggcttcagcatcaggttctgtgggtaacaggtgagtgataagtgtcacttctaaaagcagttcagatgacacagtgggaggaatagaactgtgcaggatgacctctgggagcaggacttagaaggctgtaagtgacaaaagaggccattccctctgtgctccctcaaacctaccacccgcccacctatccatccattctttcattcactcattcaggtgccaggcaccaggcatgaaggaggtgaggaacacacagacttgccttcgggagccaaccccagaatatggcagctccgcttttggctattaagctttctgttaatagtcctaagaaactctaaataaacaacacaagcctccatttcccaatttcttagctttagacagaaaaaaatatcactcctcactatggaagttgaaaaagatgaatacccccagcatccactgaccgctcagctcctgaggcccatgagcggtccttctgctctacacggacaaggtttacggtgtccagttctgtttcgtagttacaatgaagtctttcatgctttgtctctttgctgagttttaaaatggaaaacaaataaatagcattccactaaaatgcaaatattatacagggcagacttctgcttctgcttctggccatgctagagtagcagagactggatttaccctcccatttgaaacaactaagacaccaagtaaaatgtataaaataatgatgttgatatgttgaaaatcaggcagtgcaggagagtgactcctgagagaggaagtgaaagagatgatgcctgtgatggtcagcttattgcctggagagtatttagggctcagcccagagccagtggttacctgagttgaggaagcagagttgagtgttcagagcgtaaggcatctagaatcctggagcagaggatctgggtggagaaaatgcatagaaaggagagagctgcacagagaaagagctccagattctgcaccaatttccctgacagccttcctggtcagtacatgtatatgtagaaggcatcaagaccagggaaagatccaccagaaaggaacagggaggaaaatctctgcagttgacacagggctaggagtagctcacgtttccaccagccagaatggcaaaatctcatagtacacaaaacacggttagagtacttggcagggcatgtctcagatggggcataattagctctcctctaaaggctgctgtggtcccaactatcaaaactgacgtacaagcctcaaaaaagaatagtcaaaatagtaaaactaacagtgccccataacaaagtccaagcatgtttacaggagtaaaaaaaatacccagcaaccaacaacataaaaatcacaatgtctggcatcctgtcaaggtcaccagacatgcatacaaagaaacaggaaaataccagtcaaatgagaagaaaaaatccatccatagaaacagactgagaaacaacacgtgatcaaattagtagagaaagaaattaaaacaactattttaagtatgttccatgtgttaaagaagatagaggaaggcatgagcaggttaaggagaaacatggaggatgtaaaaaaagattgatacaaaacttcagctgatgagaatggcaattcttgtgatgggaaaagcactgagtgggattaacaggatatttgacactggcagaaaagatctgtgaacttaaaaacatagcaatagaaactttccacaataaaacacagacagaaaaagtgacctgcaggagaaccacaaatggattaatgtatgtataattggagtcctgaaggagaagtaggggatgtaaaatatttggaaaagtaatggctgaaattttttcaagatgctaaataaaccccaggtagaggtaaaccatgaagaaacgccaacaaggcacaccacaatcaagttattcaaaaccagtaatcaagggaaaaccttaaaagcaaagaaaaaaagacatatacacagaacaactgtaagaatgataccaatttcttatcagaaacaatgaaatccagaagatagtggagaaacacctttaaaatacaaaggggaaaagcaaattgtcactctagaattctatacccagaaaaaaaaaacttaaaaaccacagcaagatgaagactttttgagacataagagaggtaagagaattcattgctgtcagacctgacttataagaaatgttaaataaagtcctttatgcagaagaaaaataatagcaaatggaaatctagatttgttcaaatgaatgaagagcactaggagcggtaaacttgtgggtttaatcatgaatgcacataaaatatagtcaagttctttaacacataaataattgactaaaggaaatgtgataacaacattgtggggcttatcacatgtatagaaagaaaatgtataattcaagaacacagaccctgggacaagggaactagattattactgttataggaattttatgctacacatgaagtggtgtaatattacttataggtagaacataagctaaagatgtatcctataaaacctaaagcacccacacacaaaaatgatgtatagccaatgagcccacaaagaagataaaactaaatcataataaatactcagttaatccaaaagaagttggaaaaagaggaaagaaaaaaaagcagatgagggaaaaaaagcaagtagaaaacaacaaagtggaagatttaaacccatcacatcgataatcacattaaaactaaatactatacttgaaaggcaaagattgtcttattgggacaaaaaggcaaaagcaactatatgctaactaccagaaacccactttaactgtaaaactataaacagattaagtgtaaaaggctaggaaaaaatgcaccatgctaatactgatcaaaagaaagctggaatgactatattaatcacaatataagtaaatttcctggcaaataatatcagtgataggtaatttcataacagagggtcaatgtatcaagagggcataataatcctaaattgtatccacataataacatatattcaaaatacatggagcaaaaactgatcaccctgcaagtagaaataaataaattgagaattagaggtgtcaactccctattctcagtaattattagaaaaatgtagatagaaaatgggcaaaaaaaaaggaggcttgaacaacaccatcaatcaccttgacctaacagacatttatagagtcctccacccaataacagcagaatacacaatcttttcaaggacacacagaacatttaccaagattgaccatattctaggccataaaacaagtctcaacaaatggactagattcatatcaaattctcagccaaaatggaattaaattagaaatcaacaacagaaagatatctagaaattcaaaatatttggcaactgaacagcacacacctctaaataacccatgacttgatgtgttagtcctttctcacgctgctatgaagaaatacccgtgactgggtaatttataaagagaagaggtttaattgactcacagttttgtacggttggggaggcctcaggaaacttacagtcacggtggaagacacctcttcacagggcggcaggagagagaatgagtgtcagcaggagaaatgccagatccttgtaaaaccatcagattgcggaaacttccgagctctactctgcgtctgcagccgccgccgtcctgcagaggagcacgcaacccaggcgaggccggaggacgtgtccatagaatgcccaggggtgacgagctgtcctgagcccctctgctgcagccacctgcctgtcccatacaccctgcccaccacggagtccagagggaaatcggccagcagccccaagcccgacaccaaggtgacccaggccaccaccgaggccaaggtacccccggcagccgatgggaaatcccccttgaccgagccctggaagaaggaagccccggcagagaagcagcagccactggcagcccccaccatggcgcctgccaagaagaccccggccaaggcaaaccccgtccttctcaacaaccacggcaacctgaagccagcccccacagcccccatggtgcccagcagtcctgatgcaaccccggagcccaagggtcctggggacggggcagaggaggacgaggctgccagcgggggcctaggggtcgaggtccctgttcctgcgagaacttgaaccccctgctggtggctggagatgtggctgtggcagccatagccctgattctcggtggggccttcctggcccagaaaaaataataccttcgggccaggcgggggtcacagagccacttcctgtgcagatctcaggaagccagcgcatgcagaattcacccttatctacgtgtacacacgcacattcattacacatctacatatgcccccaacacacgcacacagtggagaagatgctcgagcccacccttgctgatccaggacttccccaacctccagggcagaaggaacctaggctccggggcccacagcgccggactgggggagagggtctagctgggggactgcaagaaaggaatggaccctgtgtgtggccctccaacggctgggtgatcctgggcccccagggctggtctctgagtgtaggtgggggtgctgggatgggttctgcctgggcccagccctcttggggagattaaagggcggacattaattgttgaaaaaataaaacacaccaaaaaaacgtcagattgcatgagactcacttattatcaaaagaacaccatggggggaaccacccccataattaaattacctccacctggtcccacccttgacacctggagactatggaaactgcaattcaaggcgagatttgggtggggacacagagccaaaccatatctctcaaataagaaatcaaaagagaaattggaaagttatttgagctgaaaatgaaaacacaacataccaaaatcagggagatgcagctaatgtatgcttggaggcaaatttaagcactaagaacctatgttataacaaaaaagaaaggtctcaaatcagtgacttacattttcacttaagaaactgaaaagagaagagcagattagacacaatgtaagctgaaaaagaaaataataaaaagaacggaaatcaatgaaagagaaaagtaaaaattataagaaaaatccaagaaagtaaaagctaatcattttaaacaatcaattaaattgttaaacttctagtcagttgataaagaaaaaggtaaaaaggcacaaattaccaatatcaggaatgaaagggtgggtgtcaccaaatattctgcagtcattataaggaaacaatggactattgtgagccacttttttctaataaatttgataacttagatgaaataagctaattccttagaagccataaattatcaaagttcactcaagaagaaatagataacatgaatatctattaactaaatcaagtttttaattaaaatcccaatgacaaagcaaactataggcccaggtggttttcatggtgaagtctaacaatatttgaggaaaaaataacaattctacacaaatccttccagacaatagaaaatgaagaggtactttttttattcgatgaagagaatgttactttcctactaaatcaaacagatataagaaacgacaacagagaccaatatccctcatgaacaatgatgaaaatattcttaccaaaattttagcaaatctagtttatctaaatcatgacaaagtgtagtttacctcaggaagacaaagttgatttaacattcaaaaatcaataaatgaactttatcttattagcggactaaaaagaaaaatgcgcatgatcatctcaatagaaaaagcacttaataaaacccaacattgagtcatgattaaaaaccctcagaaaaccacggataaaaatgaaaagtcctcatagaataaaggccgtctacacaaacagcaacaacaacaacaaaaatctatatcttcctaaaattgagaacaaggtaaagatatctactctcaccacttttattaaacattgtactggaggttctatctcatgaaataaggcaaggaaaataaataaatcatctagattggaaagagtaacactttccttatcatctgtgtagatcagcccatggaatccatgaaataaaagccactagaactagtaagtgagttagcaaagtggcagagttctagattaatatacataaactaatggtatttttacatataacaatcagaaattgaaattttaaaaatgttatcatttccaataccattaacaaatataaaattgttagccataaaccaataaaacatgtgtaagacttgtacattttaaactacaaaacattgctgagagaaattaaagaagacctaactaaatggaacatgtaccatgttcatggataggaagacttgaagttgttaagctatcaattctcccaagttgagttatagatcaatggaatctcaatcaaaattccagaaggatttttaaaatgaaaatcaattattgaacttcacattttatatggaaaataaatgaaggacctagaaaataactttgcaaaagaagaacaaagttggaggacttatttatctgatttgaaggctaaatataaagctatattaaaacaatatagacaaatagatcaatgaaacacatagagtttccagaaataggctcacatatatatggccaatggatttttgacaaaagtacaaagacaattcgatggagaaagtatagtcttttcaacaaatgatgctgaatccccaaaaaagtgaactttgattcatacctcacagcatatacaaactttaattcaaatgaatcatagaccttaaactataaaatttttaaaagagagcagaaatctttgtgacttcggatacaacatcaaaagcataattcacaaaagaacaaattgataatatgcatttcatcaaaattaaaaacttccactcttcaaaatacactgctaagagaatgaaaagacatagatcaagagaatgtatttttaaatcacatatctgtaaaggacttctatgcagaatgtataaaactctcaaacctcaataataaaattcaaacatccaataaaaaggggaacaaaagatttgaaaagacacttcaccaacagaaatattgatggcaagtaagatcatgaaaagatgcttcatatcattattcaataaagagatgcaaattgaaaccacaaggtgacaccactacacacctgccagaatgtgtaaaattaaacagactggcaaaccaagtgatggcaaggatgtagagaaattagaaacctcctacactgctggtgggaaggtaaaaatggcacaaccactttggaaaacagtttggcagtttactaaacagctaaatacacctgccatatgatccagccattctactcatagagaaataaaagcatatgtctatataaaggtttgtatgcaaatgtttataacagctttatttgtaataaccaaaagctggaaccaatccaaatgttcatcaactcgtgaatgcgttaacaaattgcgtgtattcataaaattgaagactcttcagccatagaaagaaatgggttgttgatactgccaaaaacatggatgaatcttaaaataattttgctgaaggaaagaagccagaccccacaaaagtatgaggacatacactatgcttccaggtacataaaattatagaaaatgcaaactaacctatgataactgaaagtaggtcagtggttgcctggggacaggctgagggtggagaattgcagggaaggattacaaagggcacaaggagagactggggtgatggatatgtttattatcttaactgtagtgatggtttcacaagcataaacatacatcaaatgcatcaaattttgcactttcaatatgtgcggtttattgtatgtcaatcatccctcataacactgttttaaaaagaaatattaaaattaaattgtaaattatcaaagaaaaagataaccactgaaagcactttttaaaaacgtataactataaagacactcggattagactgagagcaaacttcacgattgcaacaatcacgaccacacacaatggaacaatatattctaagtgctaatgaaaataatcatcaatatggaatctatatcctgctgaacagtgttcaagagatagtataaaatgactgcatttaaaaattacttatttttaaaaattcacacataatactgtatgtatttatggggtatgtagtgatgtttctgtacatacaatgtatagtcatcagatcagggtaattagtgtatctgtcatctaaaatactgatcgttttttgtgttgggaacattcaacaccctctcttttagctatttgaaaatatatattgctgactatagtcatcccacagtatataaaatattagaacttattcctcctgtcaattttgtgtcctttaacaaatttccctatatctcccttccctttccagtctccaataattgaacctaggaagatggaataagatacatgaagcttggatgagcaaagaaaatgcaagataatacaggcaaatctaaaagagcactgagtgtgtaaaataataatactgacaactactaatgtaggtaaaaaatattactgtttatgagatcaactttttagcttctacgtatgagtgagaacatgtttaactttctgttcctggctcatttcatttaacactatgtcctctaggctcatccatgttgccatggaggacaagacttcattttttactgctgaatagtatttctgtgtgcgtgtgtgtgtgtgtgtgtgtgtgtgtgtgtgtgtgaaatcacattttctttagccattcatctgttgatggacacttgggttgactccatagcttggctattgtgaatagtgctgcaacaaacagggagtgcggacaactcttggatgtactgatttcctttcctttggctatttacccagcagtgggactgctagatcatatgctagttctatttttgtttttttgaggaaactctatactgttctgtatcgtgactgtacccaccaatagtgagtaagaatttccttttctccagctccacaccagttgttattttttgtattttgacagtagccattccagctggggtgagatgatacctcactgtggttttcatttgcgtttatctgatgattagtgatattgaactttttccatatatttgttagccatttgcaggtcctttggagaactatctgttcaaatcatttgcccactttaattgttttttttcttcttttgctgttgagatgtttgaattcttcgtatattctagatatgaatcccttgttggatgaatagttggcaaatatctctcaccctatgcaaaattaactcaaaatggatcaaagacttgaatgtaaaacctgaagctataaaaactactagaagaaaacacagggaaaatgctttacaacattggtctcaggaaatattttacgaataagacctcaaagcacaggcaacaaaagcaaagataaacaaatgggattatataaaactaaaaagcttcagcacaccaaaggaaacaatcaacagagtgaaaagagaactgacagaatggatgaaatgaagacttttagaaccaaaacatccgagagattgtcccactgaagacctacacacaacaccacactaagaggtatactttgaccaaaagtaaattgaacctgagaagatggaataagatacatgaagcttggacaagcaaagaaaatgcaagataatacaggcaaatctaaaggagcactgagtgtgtaaaataataatactgataactactaatgcaggtaaaaaatactactgaactaaaaccttatagaagataaacactaacttatgatttaaggggaacaacaacctcctaacctaagaataaaaaagaatttccttatcctgataaagatgattaaaccctatagaaagtattacctttaattgtaaaattcagcactgctctaaaatcagctccatttttatgcctcattgggctacagagtctggaagcacattgtgagaagaaaaaaaatcgttatagggtctaggaaggaaaaaaactaagctattactatgtgcagaacatttctgaagaggaaattcaagataatctagacagctattagaattaactagagagttcaatgaattgcaggatataaattcagcataaaaattactagcaaaaattagataagtaatataagattccattaacagtgaaaaaacccacaaggtttccagagatacatgtaatgatgtgcaagaccttcctgttaggaggaaatgggtaaactttgttggaaggcatgaaagaggacctaagtgaatggagaaatataccatattcatgaatggggagactccgtcatgatgaaaactatcattacattgatctaaagattaaatgtatttccaaaatatttttccaaaattagtttctcatgctgatttacaaaattaatatacaagagcaatgagccagaaatagccaagacatacctaaatataaaggtgagagagataacggatatcacaacttattttatagagccgcaagtcttaagagagtatgacatggttcagggatgggtaaacaaaataatgaaactgaggctacagctagaaaaagacccatgattatatgtgaacttgatataggatggggggcatcacccctcaatggggaaggggttcactacttggcacgtggtgctggagcaacagaaaacaaattcatcaagaaaaaatgaatcacagataggccaacacctaaatgtgagaatgcaaagctgtaaaagataacatgagtttatacgaatatcacaaaacataagggaaagtttgaggtatcagacacagtaaaacgtaaaattctgttcagaaaaaggcaccatcaataaagcaaaaaaatttacaagactcagtctgagaggatatatttgcaatccacataaccaataaagtatcactacccagatccataaataactctgaaaatcaataagaaaaaggcaagcgacccaatgggaaaatgagcaaatgataagaaacaataaatatcaggagaaaacgatgggcaataaatatgtgaaaagaggctgagcttcactgctaacactgagaaacacaaattaaaacaactagatgccatttttcacccattagagtgtaaaaaattaataagtctgatactactgagtgttgccatgaatctgtggaaatggaaactccgtctgttgctggaaggagtgtaaattggtataaccactttggacagcaacacagcaatacttaataataatggtaatgataacgctaatggttaatacttattgaacatttataaagtgccaggcactgttaaaagctggcgtggaaagctgacaacacacattcccacaagccaggggctctttctgcagtggcctggccacggcaccagcagacacaagcaaggctgctcatggtgtggtgggaaagcagaattcatttgtaagttcctgagtggggaaggatcattaatctgtgcctcattggcatgacggaacatttactccagttaacagaaacacactgaattgatgtccatcaatattgataaatttcaaaaacttgatgtgagcgaaaaaagcaagttgcaagaaccttgacactattttgccatttatgtcaactttaaggcacataaaatattggtggatgcaagcatgtgatagaaaagtattaacttgtaggtgggaaatacggacaccagccctcctccatagtgagctgagagctggctagggagctgctggagcctgccatccgtccatctgtccatccatccacaggagccaggccatctccagcgggggaacaccggctagggaagcaggagtcagccttgaggagctggaacctggaggaaggttactctaggaattcaaggacttacgacgtttgaaatctactaatgtcgtttgttatgattcagtatacgttaaaaagtcaggaaacagcagatgctggagaggatgtgaagaaataggaatgctttttttttttttttttttttttttagacagagtctcactctgtcacccaggctggagtgtagtggtgtgatctcggctcactgcaacctccgcctcccgggttcacgccattctcctgactcagcctcctgagttgctgggactacaggtgcccaccaccatgcccggctaattttttgtatttttagtagagatgggatttcaccatgttagtcaagatggtctcgatccgcccgcctcagcctcccaaagtgctgggattacaggtgtaagccaccacgcctggttctaagtctttgctattgtgaacagtgccgcaataaacatacgtgtgcatgttttatagtactatgatttataatcctttgggtatatacccagtaatgaggttgctgggtcaaatggtattctggttctagatccttgaggaatcgccacactgtcttccacaatggttgaactaatttacactcccaaaataggagtgtaaattaaagacagtgtggttggaaggaacaaaaatgcacccaaaacctgtgtgaggaaaagtaaaactttattggcagacacaaaagaaactttctgagtaaatggagagacatgttcttcttgaatgagaaaattaacattgtaaagatgtcaacggtctcccaaagtgatccagatgtgccgtggaatcccagtcaaactgcagttgcatcttttatggaatttgacacactgactgaaattcacctggaaaagaacatgcttagtaaacatggtttcctgggggcggggcggggggagggggcagaggggagggaacaatgaaaattggtcccgcagacaaggttcaagttagagatcccagaaagaagcagatgtacctccgtgcagtgaggtacactggagcaggcacatcccacggaaagggcagggtggacgatggaaaacaggctggaaaacaggctgccaggggacaaaatcaacgcagatttccaagtcacaaacacaggcaaattctgtggattaaagaaagacatctaaagatctacaaacacaaataaaaagaatgcttgatttcactggaaatcaaagatgttgatgagagtaataatgagaaattgtttttcacccataaaattgggggtggggagataaggattagactttctaacaatgacaaaagtgtaagaaaaacaggtaattggctgcgcggctggtggtgaatactttttacaaccttctcagaaaacaatatggaaatgtccaccatgaaggagcagagaaagcctgtttgaggcctccgctgtagctggggacgcctgcctgaacacagaagaatcatccatatccatgctagttgcagtttggtaatagaaaaaaaaaaaagaatcagaaggggaagaaaagagaagcaccttaattcttcgccggcagaggagagctccttacacagcagcatcgcccacaggacagaagcctctgcagccatcaaagaaaatgaggtcgaactaagtgggccaatgtagaaagctcccgggacatcgtgttaaatgtaaaaagcaagttgcagacaacgcatgaaatatgtatgattccatttgtgaaaaagcagcatcgctagacaaaactgtgtattttatttcgtatgtacacacgtgtgcaggtccatgtaaagaaagcagtccagacggtggggcggggttggatatgaagccagccctgctttgtgtctagataccctggcatgcttggagccccccaggcccgaggtcatgtgctcctgccataatttaaacaaatgccttaacagcaaaaagaaattagaatagtcagctggacgtggtctggagtgcaagacgaaggggcggtgcggagagaagggaggcgacctgaccaggcagtgtcttagggaccggagaggagtgaggcccacggcggtcctggggagcggcccacctagagcttgtcgccagtgaacagggagccgtggcgagagggacggggaaacccaagagaccgtggggtggggggaaagccagggaagccccaggcttctaggaagggcctggcgcggagtcagtggggaggagcaggaggccggcgtggccttggacaagaggctcggcggcgcgggggagccccaggacccggggagctgcggagggaagaggaggagcagagcgtggctggaaaggcggtgggacagggaggggtaagctgtgcggccgccttgtcccctacggagaggagccctgggagctgcgggaagagccgggagagagaagaggctgtgggcgggggacatggtgggggggtggacgggggacatgggggggtggacaggggacaaggggggtggacgggggacggggcggggcgggggcggggcgggggggtgggcgggggaggggcggggcgggagggcgagggctgtctctccctcaggactggggttagcgaggccgggctgcgtgctcaggagccgaggcagagaagtcgtggctgcgcagagggaggcggtgctctcctcgcggggtctggggtcccgcagcgcctggggcgggagcagtgagcaagcgtgggtgggagccgcggtctgggtccctgcgccctcccggctgcccggacagcaggtgcacccggggggcctcggcgcatttccagggcgaatgagtccagggccctcggcctgcaggctaagcagcgaggacagcggcaggggggctccgtggcacggcctggggggtcaccgcgcacgcctaggccccgggagctcggagacgcagcagccgtcgcgcggggctaacaaggcactccaggcgcctgcgccaccgacacggagaagggcgagctgcggagcgcggggtgcggacggccacgcccctcccgccacggccaccccgagcccaggctgccagggcggcatccccagcaggagacccgcgcagcagcccctccagcccccacaggagagggcaacagaccgcgctgggtttctgccggttagatgctcagatgctttgttaccgcggcacgaactacccccaccccgactgtgcgtgggtgccggagcctttgtccataaggatccgtgtgggcagtggcttaaggtggcttagggttccccagagacacagaaccagcaggacacacacagtcccgcctgcatctcagtgattgcaagcgctgacctcacacacactgtctatatcccataagattataacgcagcagaaagcctccagggtttagtgacatcttgatggtcctgatcctaggctgatgtgtgtgttcatgccttacttgttaacaaaaaagtttaaaaagtaaaaatttttttaaaaattaatagggaaaagcttatagaataaagatctttaaaaaacatttttgtacagctgtacttgtttgtgttttaagttattacaagagtcaaaacgttaaaaaattacaaagtgtataaaataaaaaggtacagtaagataagattaatttattattaaagatagaaaaaagtgttaatacattcagtgtttataaagtctacagtagtgtacactaatgtcctcagccttctcagtcacctacactcactcatgactcacccagagcctctttcagtcctgcaacctccattcatgggaacagccctgcgccagtgtgccatttttaatcatctatgccctgtttttatggtaccttctctatatttagatacgccattacttgccattgtgtcaaagctgcctcccgtgttcagtacaagtgacactctgtacaggttagtagcctaggagccataggctgcaccctgcggcccgggcatgtggcaggttgtaccgtctcggtttgtcagtgacctctgtgatgcttgcagaggacgaaatcgcctaaccacacgtttctcagaacacatcctcattatgaagcaacacttgactgcgtgtctgtgtgctgcgtgtgtgtgtatacatgaagagatttattacagaaattgacccacaagattatagaggccaagaggtctgaagcccaaagagctgctgcctgtaagctggaacaccaggaaggccagtggtgtggctctgtctgagtctgaagccagagaaagagcatcactgaggtctgggggcaggagaaggtggctgccccagctcaagaggagatggaggatgtgccctgactccacccttctgttctacccgggccttgggtgggtgtgatgatgctggcacatattggtgagggcagatcatcttcaccagttcaaatgctaatctcctctggagacatcctcacatcgacaaagaatgcttaccagctacctgggcttcccttagcccagtcaatttgatgcatgaaattaaccccacgagtccaccctttgtcaacttagcatccatacaaatcttcaactatatttagtctccaataaatacaatccgatcacagtcctgcctaatctgatacaactatcgtacatacaaccaaaaacacactaattccttccccaaaagagctggtcaagtccttgagtgatagtcacttttctcctgatgtcccgtaacataaaaaccaagatgtaaaattaacagcgtttaaatactgatacgaagttgttacattttatgctacatgctaaggagataacagagaaaacaaatatatttggttaatatatgtatatattcacacaaacatataagttacaaaacgaggaggacattctgacaatgacagtccttatttctcccaccagccatgtagttgtcactggtattaataacccccttcttccaccacccaatccatatccctttgcccttagcaagcgccgcagctggccatggttctttactggtggactgacccaaaaccttcattcttgaagggtctgagccaatagaggtcctgcctgaattgtattattgtggtttccagtgactttaatcacagagcatggcagtgccaagacatgcctgaggatctcctgtctcccagacacactgttccttccctccatggaggagtgcagtccaatttcccctcagtattccaatcaatcaccccagccagcgcctttattcccctctcagcctgctgactcttgaggcttgagggtcccaaaatggcatactaactttctttcttttttttttttttttgagacagagtctcactctgtcacccaggctggaatgcagtggtgcgatctctgctcactgcaagctccacctcccaggttcacgccattctcctgactcagcctcccgagtagctgggacgacaggtgcctgccaccacacccggctaattttttgtatttttagtagacacggggtttcaccatgttagccaggatggtctcgatctcctgacctcgtgatccacccgccttggcctcccaaagtgctgggattacaggcatgagccaccatgcccagccctaactttcaattcaatgggatcactgttgtgcctcctggttgaagcatttctgcctctggaactaagacccataggccagcagaatacaaagttgcagggagcacctggtcccagccctgcaaggtattgccatctagttggtaattgaccttcaaaaggccatcgcatcattctatcacaccagctgcttcaggatgcaacatgagcatcgttgcacttctttggctgtgaagtgagttcctcggtgagaagcagtgcgaggtggaacaccgtgacagtgggtaaggcatcctgtgagtccatggatggtggtttttccagtaaggacaaacctctgccccttccatgctggggaccatgcaatgttatcaacctgccccaggtagctggctgatcgcctgggaatggtgccatatcaagggcttggtgttggtctccgctgctggcagattgggcagtcagcagtgtccggagccagttaggccttggtgaatgggagtccatgtttctgagcccatgtactacctccatccctgccaccatgcctgcttactttatgagctcattgggccatgacaggggtggcttggcaagaggctgaccagtgtccacagaaggagtcattctgtccacttgattcctaaaaccctcctctgctatggtcattcattgctgaccattcacatgggacagacatatcttcatgatttttgcccattctaagagggctatccacatatcttttcccccaaatatcttcttcaccaatttttccaatccttctttccatgttcctgaccatccagcataaacactgagcacggcccgtgaattagtccatcactgcacaactgcccactgctccttccaagcaaagtgcacagccaggtgcattgcccacagctctgcccaggaggacttcccttccccactgtcctccagggatgtcccaggaaggagctgtagttctgcagcatccactttcagatggtgcctgcatatggggcagagccatctgtaaaccaggcctgaattatctcttactctgtcaaatgatcatggggagctcccccacgaggccacaggcacaggctgggagagaggatctcagctgagaaaggcagtggagcaggggtggggaccgtgggcactttggccctttcatgtaacctacttgagcattcagggtctggttggacccaatcacatacgtaccacttccatttgatgacagagtgttgctatgcatacctaaccatgtggcttggtgggtcagataacaccctctgacacacagacgtctcaccaataaatgtagagtagttgctacttcttgctcactaagtccaatccgcacaatgtcatcaatgtaatgcaccagtgtggcatcccatgggaaaagcaaccaagattcctgcagactaaattataatgtaaggctagagagttgatgggacactgtccctgagatgggacagtgaatgtgtattgctggccttgccagctgaaagaaaactgcttctggctggccttctggacagggatggacaaaaggcatttgctggatcaatagccgtgtaccaggtaacagaggatgtgttaatttgctcaagcaatgaaaccacatctggtacagcagctgcaattggagtcaccacctggttaagcttgtggtatttcagtcactctccaagatccatctgtgttccttacaggccaaatcggagagtcgagtgggaatgtggtgagaatcgccagccctgcaccttgcaagttcccgatggtggcatgatctccacagtccttccaggaatatgggattgtttttgacttatagcagtcaccacttatccctggtttcactttccacattttaagtgacctgttgcacagtacaagatattttgagagagagaaatcacattcgcagagcttttattgcagcatattcttctaattgtttgattttattattgttgctaatctcctacggtgccaaatttataaattaaactttatcattggtatgtaagtataggaagaaacatagtatatatagtgtttggtggtttatatgtccatggtgtcaggcatccactggggtcttagaacatattgcctgcagataaagggggactactgtattattttcctaagcagttgcaatggcttctacttggtcttcttcactgtaatagtccttactccacaggtcagggacccaatgtgtagatgctaccagctcctcaattacgtctcttccgattatgcattctggaatggggaaataactacaggatgggtttggggacccactgggcccactgtaaaatgaacctgagctaaaactccattgatcattgagctccataagcccctactctgcctggatggccacagagaccttttcaatcttctggagtcaatgtcagtgcagagccagagttcagcagtccctgaaaggtctgagtatttccttttccccagtgcacagtcacctggtaaaacgtaaggtaggtccctttgggaaaggctggggaaaagattaagagtatacatttcggggaatttacagagttgtttcccagggggacactgtcgtcccttcattcgctggttctgagtctgtagattggctcaggtctgagaattggttgaggggccatgactctgtgctttgagagtcatgattttattatttgagttagacttttgtttttagagactggatatcattacgtcatccaggctagagtgcagtgatgtgttcatagctcactgcagcctcaaactcccaggctcaacagatgcccctgcctcaacctcctgagtaactgggaccacaggcatgtgccactatgcccagattcgacttagacttttgttcacttgacctaaaactttcctgcttatacagatcatgtaaggatttagtaggcttctgatcaaattcctttccaggagccccatgataacgggccagagccatgagtctcatgagccaggttgttctgattgctgctgtgccactcctgcccattgctatgcctgcacccaccttgcctgtgggatcccccaccacaggatccagttgctccccttgcacttaggtctccagctgagtggctgtggttcccaccataaggtctgacttacagggacgagttatggcggagctcttcaaggaagctgggaccccctcacacagttctttctcgaggtgttggtgaaaggccagtcttccagatccccgcgtgtgggcaactaggtctgaaatgacaaacccactctaacacaccagcttccctgagccctttaaaccccctctacattaaaccggggagtttggatctttccagtttgctcacggcagggcagactatcttttgacccctgttccgccatccaaccaaactgagccctttctaactcgttgacctgcaacattaaatccagaatcattgcttactgagcccatatcaataaatttggcctgatccaactttatgttccttccactaccatcccacacccttaatattcattcccatccatgttccctggatttctgctcgtataaattagaaaacccatgttgttcttttggagagcagcataccttctcatgggtcacagtttgtccctcaccttcagggcctactggggtttgggtctagttatagggctagaggcaaagaggggcggtgagggtgggtcctgaaaataatcagcattgtcctgcttggccaccacctcagaggaagatattactcaggatgcgggggactccttcaagtcaggtggaaaggctacaccactgttggcagggatgctcctgccaccagggatgtgaaggccactttttttgagcgtggggggacctcttccactggcaaataataaacatcagaacttaggggcttgatacccccagcttcatcagggtcttcccacatgtccccattgcaacttacagtatcccgttctttcccagtcaatttccccactcaagagtagacattccaggaggctgggagctcaacttgcattgtattaataatttggccaattgcaggatgaggtcctgagtttgattttcagaaacttcagccctgtggttgtatgagataaggctcctggggcaaacatagaaactcttaggtcatttttgtggctcttgagctgggaatttgaatccctgagctcatctttttcttttaccactttgtccaatgacattagaagcaaccaatgtcattatattcctcagttttcctaaaatgttcaaaagtatcatatacagagtcatgtagctcctcgcttcttacaagtagtttattagaaggatccaatgcagatattttgcatatctctatagtttgtgccatggatgatcagtgctctctttactaccggaaatacagtcattagtgtctttacatatagttggattaaagagccaattccagaaactccagaaagaattcagaaaactcgtcctcaaaattctggtcctctagatccactcttggtaccaaaatctatattattcagagttctacaaaaaacagaattaatagaatatgaacatatatatgtatatatatatatacatatatatgaggagatttattataggaatcaacttatgtagttatggaagccaagaagtcccacaatctgccatctgcaagctggagaaccagggaagtcagtggtgttattcaatctgagtccaaagaccagagaatcagaggcaccaatggtcgagggcaggagaagatggatgtcccagctaaagaagaaagtgagttcacccttcctcaggcttttcgctctactcaggccctccttggattaagtgatgcttgctcactttgatgagggcaggtctgtactcagtccactgactcaaatgttaatctcttccagagacaccttcaaagacacatccagaaatgttttatcaactatctaggcatccctcagtgcagtcaagttgacacctaaaattaaccaccacaagcagggaagatggtgtgggaggtgagatgtgtgtctgtgagcagaagccgggtgggtctctgcatgaacatgtagatacgggtgcaagcatgtgggagctgctggtggcaaaactcaacagaagcaactcgtatttaggaagcgaatcaagcgtcccatcctttgagccccatgacatttcatgatcgggaacaataacagactcttagagcaagatgtataataaaaagctaaattttcaagtatggtttttggaagaatgtgacttctgaattttaacaaaaagcagaaacaaacactttctttcacacttaagaattgtctgccaggcttctggaggcacctgggccatgtgggttcactgtggtcattcagggaatggatggacaatggtgagtttctggagcacggacatgacctttggggtagagggagggctccaacaccaaggcccccagcacacatttcacgaggaaaaatgaccatcaactctgctgaaactgagaagggaattttttctaattagaggcttcacattaagcatgcattggcttcatctggagtgtgcagtacagaatgattctcttccccattcctcaccaagaacagtaattagaatgcaaggtcatctccatataatgcattatgactttaatatcagtaaactccccttacgtgttagatgcagtgaggaaatagtagttaaattatcacagactagtatgatcagtttccgctaggataaaatgtgataaatgggttttaataaactgaggagaattataggcaccatcttcttggttgctgtcaattttatttagagtaaaatgccattgcgataattagttggtttttactgtgttcattaaaagcttttctaatgaccgcttgaggaataagtaaaattaatttctttcttgaacgtcgaaggaattaatcaaacaaacaaaaagcaaacttcagggattgtgcgagacgggatgagggccggtggttttccgtgcccgctgtggggacagcactttcccgccgtctgtcgttggtgttgcagctccaggccattcccccgagctgtgctgatggagagggatgcaagccccggggcagaggccttggccgtccttctcaggtgccattgagctgtgactcccaggccgcctcctccaggcagctttccttgactgctccaacttcagggctctcttctgcctggcccacacacttgagctagggctcctcagtctcagaggctgaggccaggttctctctctgcctgtggccccttggagtccagcacagggctaggcactctagagggctcaagggcttgagcctgagatcctggcctgtctcctcttggacaggactccttgggcctcctggccactaccctatgtcccagcccctgcagtgcttgcccaagctcagcctttgttcagcacaccagccctgtgaaccacactgtccctggagggactgagggatgtccaggggtcattggtggcataaaggatggagccactgaaacgcagtgggtggatgcaggaagaggagggctgcccagcaaggccacacctggcctggctcggaggatgccaggaggagtctccagcaggcaggcgtggccagaggggccgcggggtagccagatggagtctttgtgctgaccccacagtccacagggaggagcagaaaagtgggtgaggcctgcggagatgccatcacctggctgggggtactcagtggcgaagggagagacaaagccagacaccgctctggctagtgggaagagcaatggtccttctgacctcctgtgccaggtacagcactagcacgggcctgagaacctggctggtgagcacatccacctgcacctgtacccatccccactccccacacacgccacacacacacacacacacacacatgctcatcacacacacaccgccacctgcacccatcagcactctccacacacatcacacacacactcatcacacacacccatcgcacacaccacacacacactcatcacacacatgcttatcacacacactcacacaccacacatacattcatcacactcacacacacaccacatgcttatcacacacatgctcataatacacacacctccacctgcaccagtccccactccccacacacatcacacacaccattgcacacacaccacacacccactcacacacaccacacacacgttcatcacagacacacacacaccaaacacatgcttatcacaaacttgctcatcacacacacacacccctccacctgcacccatccccattccccacacatcacacacacactcatcacacacacccattgcacacacaccacccaatcacacacacacatccacctgcacccatcagcactccccacacatcacacacacactcatcacccacactcatcacagacacaccacacacactcatcacacacatgctcatcacacacactcatcacacaccacacacattctcatcatacacactcatcacactcattacacacacacttatcacacacatcacacatatgctcatcagacatgctcattacacactcatcacacacaccacacacacacaaactcatcacacgtacacctgcacacagccacacacacaggcccatcacacagacaccatgcaccacacacacactcatcacacatacacacaaacccaaccacctcacacacccattcccccatcacactcacacccccacctctgctggatggagccccaccatccttcaacgcccagttgacagctcatcgtccttgacgcttccccaccccaccgtggcctactctgcgccccaccacacttccctctcccgcccacaaggacctcggtaatgtcgcccctaaaactgctgcggaacctgcagccggctgtgacgcagaattggcatcccagctcggcccctgcacacccgacgcccggaggggtgccttagtcctgagactctcctggttcttctccctctccagtgaggtgagaaggtcaatccggccctgtggggtatgttgagggttaagtgagaccctcgtgctcatgaagaggccaggcaggtcctctgcgagtgccacagccccaggcttgtgcagccagctcacggaggcctcccaggccctgaacacacacaggacagggctttcttgcattatcacctgagtgacactgctagggggctgctctctggatgtcactgcggccgggtgccgggacagccggctgcttgactccaggacttagagcttgacttggccttttaagcctctgtctcagtgccctcgggtcccttccgccccctctgtggctcacctacctgtccctcggcctctggggtgggctggcagggcttgttctgggacccaggtggggtggcagcagtggctgtcatggtgcagcaccagcttcccggagtgcccggtctggggatccccagcgaaggcaccgaagctctcttcttggctcccgggcctgtgaggcccagccagctccaccccagcccctcccaccccaagcctcacaaggaacccccacctggcagctcaagcccagccccctttcctggggtcctgggagttcccaccaccaccttgtggcaatcaagggtaatgtgtgggctgctgggcccttggtccctgtcagggtcactcagagaggcccgggtggacatgaaagttcaagtctaagccgcatccaagccaagactcaggaacaagcagggaccctggctgtagcgcccccaactcaggagcagctctccggcttctcattcccctggctctttctggctgagggggcttctctgtgtaactcggccaggtcctctttccagcctttttattcttcctgcagtcagaggcaggggcagagggggcctctggtgccagctctgaggcctctcttgaagcccagcctgaaggtggctgaccccacccgctgccacccccaccctgagatgggggcttagcgcctttgtcttggtggcttgccctgctgggaccccttcctctaatctcagaatggccgacccctcgcctccctcacggcgccatttcagagctacattctcaggcagacccccgacctggcgctcctagttcgcccacccacctgtgctgcgtgttcccaggcgtccgccacctgcagcaggccacccggtcacgtctccctcctggcgcgctttcatcctcgagccccttctggccccatcctccagctcccgccgtgttgctcagagcagctcacggtgggcacgcggcgactctgaggaatgggcgttcccacagctccccggcttccgtgacggccacgaccggctctgcagggcaagctggcctctgcaatcaccgcgcagcggcccctcacaagtagcatttttgcacttggcagtctacacgctttttcattttaaaaggagtttgtccctggtgtttgagaaatatgcccaagaacacagcccttctcagagagtctggattctaacaaggaaagctcttggttacacaggggagtccacggtggtgcaatgtcggctgaggcatggccagcgcagggcaggagctgggggactggcgcctctgaggacagggagacactcatcggagcagcagcacgctgcttgcacctatagaggccgcgggctcggcagagctgccctcacgatactggtgatttcgggagctctctctagagggccgggagatactgcagcctcagaagtggctgccaggagtggctctggcagatttagacggtgatttagtcggtgatcctgctgccgtccgtgttcattctccagcagaagccacacctcactctccccttagagcgagggagagatatgctcaattaagctgggggcaaatggcgtctgcacagccagatccaggggccaggaggatgggggactgcccgggaggagtctccacgccatgtgagtcaatcagggaaccctaattggaaagcagtaataaaaagtaattgagtttaatacataatttagatcgttacccgttaagctaatgcctcccgcttaggtgtggggagaaaattatttatctcgtagacggggaagatttcatttgtttttataatggaatgctcgccaattgactttaataagagcagtttgttaaatcagattttgaattggtgcatagatttgaagttcatatgttaatatttgacatgatatacttagcgcctcccttctccccttaaagtggctggatttattctcccgtgaggctgtgcgctcattgttgtcctacattatggaaattaaatcggttctctctggtgtcttgatgggaggcaatttggctcctgacttctacctttttttttttttttaaattaaaaaagggacattaaagagtctctgcttgcttctttgcagggcctttttcctcttgaaaacagtcccagggctgcaaacaaatgctttgcttaaataccagaaaggaacttactaacaactccttacttgggtccagccatctgccattccttagccgtttgattttctcagcaatcctatgaagtcaagcggccactaggaacccggctcctgcgtgtgcacatcgaggcctggggcctggtccccacccgtaggtgggcgccagcctggcagtggagaccaggcttttcacacccgcaaggcagggccgcctgggcctggacccaagctcctctggccagcctattgatggagactctgggactcagtttccctatcaacagaagagggataagatactgagtacctcagaggggattttaggatggaaggaggtgctgcctgcccggggcacggaacacagccagtaccaagagcttaactgtgagcactgcaactaccccagtggagtggctcccggacccctccccaaaccagctcccccgaccccaacagccgtaccacgaggcagatagcatctgaccgagagggccccaccctcacatctgcctctcaccagctgtggggcctcaggtgggcgtccctgtgctccaggcctcagcatcctcggctatgaaacaggctgctgaggcctccctagggcacccagtgtccctgtcaagggcagaggggatcttgctgacaggctacaggagaccaccccaggagccaggggtttgcacggtctcctctcggggcagccgtccaggcagaacctcagcccccagatggcaggatcggggcgaaagctaagtcatcaggaccccaggtctggaggccgtccctgcccggttcctgcagcagcctcagtggcaggtgctggggaaagccctagtgccggcagcctttacctcgggtccccctggactcccaacccctccagctccagcctctgtgtcccacagagaccccccagcgcattgcagagagagctttccacagccccagctgcacccccacttccaacttgcctctggaaacagccatgaatggcaggggagggcaccagaaggaaggcctttagggagaacgaacacaggtctccactctcagaaacaggagtctccacagagcccccaagggaccctgggacaccctggaagtgtccactgcacactggagccacctcaagagccatggggcttggagccccacggtcctggagaagctctccccggtggaacatcggaataaatgtgtgtagctgtgaaaccccactttacataaaatcagaaagaaagcctgtgtaaaacagatttctaagtacccaaggcctgagacacaagcctctcctgctgagcacctgtgcagcctcttcctgcccttctcgcctccaagccggcgcagctccttctaaaacaccttggtgcacccagggtgcccagaggaaggtgggagcccatggcagccatgtggacgggagcgagcccctccaccagcatgctgggaggcagacggtcggggaaggggtgccctgccactctgctgcggaagaatctgttgccgtggaagcatccagagcaacaaggaggagatgactttgtaccccaggaagtggggctctctgcccagggacgagtgagctcatgtgcaaggagggcccttaggactgaggcacctggggtgggggtgccaatcccggtcctgcccccaagggcactcggcatggatgccctcagcaaactctcctcaagaccaggcacagggcgaggcaccttaggactgaggcacctggggtgggggtgccaatcccggtcctgcccccaagggcactcggcatggatgccctcagcaaactctcctcaagaccaggcacagggcgaggcaccttaggactgaggcacctggggtggggtgcaaatcccggtcctgcccctaagggcactcggcatggatgccctcagcaaactctcctcaagaccaggcacagggcaaggcagggcctgtcctggagctcccaggctgggcagtagggacggccagggcgaggggccctggtgtgaaagtccaggtgggaaccgccctaatcgctcccccgtcccagacctgaagctgcccctggggctgaggagcctcactctgtccctgggccagggtcctgggctcccccgcctgtggagcaagagccgcagggcagggatgggcaagcaccagcacccacggctgcggccgcagtccagccacctcagagtccccaggccttcacccagcctcgcaagccccgttgcccacacctgggttcatggatttgagccaagctcacccatctgcccagtggctttggatttgagagcgtccatggctccccctacgcccaagccatgcctcatagtcccctggggtgggctgaaggtctctgatggaaacctgctctcactgtatggagcacaggccctggcccactgagacacccaaacagagtcactcagtggttcagaaacagggtgggcaggactcccaggtgcaggggcagtggggattctgagccctccgggaaggggtgttggaatcattagagtgaatgagggaggggattgtgtggttgttggagggcagccacccagcaggactttctaggaggaggaaacagtttctttcttggctccccgtatggtgccacatgggccatgtgcacctggcgcgtggctggcacccagcgtcagttcctttcattcacttccctttaagcagctccgtggacgagcagccactgtcctggactcacacaaagtctcagccggcgtgtgaaagcctggggggagctcagcccctccactcagaggcggcggccgtggccactgccccgaacaaaaggaagagcttgtttacaaattgtccattgaaaattgagttgcaaacatcggcatcaggcctcgcctgccaggccacccggattggagagtaatttatgaagattgctttacctggggccgtgctggtctgtgcctgcaagtaattcacaccaggctcattttggatgcagtcaaagacccccgtatttcacggtgacaacgtaatcacagaaccacattaaaaagtcattattgtttagaatccagcttggtttgaaaaactcttactataaaattcaacagcctttgtaaattaccgaaaggtttactcaagaatcctaggtgccgtgatttagaccgggaagttaccactttattgattctgtgggattttgttggtccccgcatttataaggaatgattagtgagtgatcagagtaataaactcctctgtgctggttcataaataatgatgaattgagtttgcatcctcaaatttctcatgcaaaccactcctattccgaagagtcccagatgcaactttggggcagtgtggccgttagcccccacggggacagaacacagggggatctggcttctccgcttgcctcttcataggatcccagcaggcctggccactgcatcccaggatagcagccgtggagccggactccatttccccccagctcgaggggtgctgggggccactggcagagctcctgcagatgcagatgctcctctgcctccatcatggcagtccagggagcagatgtgtgtctgcacaagccctcgtcactcacacatggttgaacaggcaggacgtggccaattccttgtcagttttgtcctgagaggcagaaagcttgcccctggcggccttgaaatgaggggctcatttggggctcctgaaagctgaaactccaacccaggaagtgccccagagccaggcaatcctgacacactcactctccttccacactgggagacagcagctctgctctgcccaccggcccagctggcttccagccaggttctgccctctgaggccctgaaactacacttgtccctttttagaagttgtcaatgcccaccagtgcccaggagactctaggaaggactgcagtgaaatgctcaatgtgtttaatccatgtttcccactggcccagccatgcctttgacccacaggacagcagccatgggtgtgcttgggaaaaccaccatgatgggtccaggcaagagcaccagcctgagcatgggtcacgctaacgtgggtggctcaattaaggaacagggatggacttcttgttctgtggcccccacacgctcctgcttcatccggtggccatttctgggtgaggcctgttcccccacatctccgcagtgggtccctctgcccaggctgctgccagctcccacctccctcggtgcccagcgtgaggctggggcacagtggaaggtctgtgaacctgtattaagcaaaatagaaactaaatgtggacttgaactggactgaaatgaaattgagttagactgaatgaaaatggattggaatggaatggaattcggatttgaactgaatggaattgaattggaagtggactaaaatggaattgaactctaatctaaacaccagtcaggcaggagagatggacgggctgagccaggggagctgccctcaccccacctgccccctgccctggggaaccctctggtcaatactgctaataggaactgaaaattaaagaaaatgatgctgatggatttcctttaatatgcacagacgcagctcaaagagagtgtttctggaaaagcagtaacagagcctgcagaggtcacgaggcacctggaccaaaccctgagatgctcccaggaacagcacttgagttgtgcagtttaaattcgaagcgctgtccaccttcagcaagcacctgagccacagaagaggcccccagaagccgtctccagcagacaggaatgaggaggcactgcacacgggcagggtgcatgcgggcctgcagtctgaggaacacacctgacgtggggcagcaaggattttccaccacagggtcactctgtctgttcagggtcccaagggcaccgagaacaccaaagacttcaagggcctgacatcaaacactgctctaaggggtgagcagacacctgccaggagcagagggagggccccctggagagcaagaggactcagccttccagcactggccgagacgtggagctgcgaggtcactcaccaaataacacaacagcctctagaagtgggaacggccctaagctgacagcagcaagaacacagagacctcagtcctgcaaccttaaagaactcagtcctggtcacagcccttgtcaccagtgggatctggtcttatttttacaggaaataaacatggtctatgagaatgttaccaggtccatgcccttcacccagcacccttcggcctgcttctcctgcacatgagaacattgttttaatcagcaccacaccatcagcatgttcgggagacttacaggaccccattctggcatctctcagggcatggtgttggtcaagaaggtgtttccggagcaaagcgtgccctgctgacccccaggcaggtggcattctctgcttcagggactgtcttcattctcctgtgtctttcgggctggatgggcggtccaatgtccactccacatttccccaatttcaagttctttcctgcattgagggggagaagccaggaaggacccccaggccctgtcccctagatggctccagtgaggttggcaacaggaggagtaaggtgaaatttggaaggtggcggggggacccagggccttttcaccagctggtggcttctccggcttttccacccactcccccgtcaccactactgatggcgactcgagatttgtggtagtttcctgggtaacccctgaggacccctgccatagtgattcaggctgggcccatctgggctttctttccagcccctcctacctcacctccctgtgctggaccctctgctctactgcttggagccctccatttcccagccccacccaaacccatccatgcttgaattcttttctgctctatttcttgttgttcttctttcatttttctttttcttttctttggaggcagaaacaaaaagatccctcttctccctaaatgcctgtatctctactctcctccgctttctctgtggctcagaggccactccatggcataaggttgccattctgatgtttcccaaagcttgaggctgcctttcctggctgggcttcccactccccaggaagctcactctctacccatggctcccccacatgtctgggtggccctgacgtccttgctccaatacccatggagatcaccttttctagctctggcgagagctccaggtccacaccttggctggagcggaccggagcctcctctcaacccccagccaagtgggcacctttctctttccagacctgccaagccccccgcagccagtgctgcatcggccactcccactgccagcaacaagctgggcaggctctgagcaccgcccctgctgccccgggtcctgggtccacccctacagagcaagcccacccgtccagtccccaccgtaccaccaggcacagccctccacagccctcagcagcacaatctgaaagcttctggatttgctcttcctggctgtttgcctctctccccatggggaggctatcaggggaacccacccccaatatttcaacgtaggttctttctattttccctacgttttggctggctgagaaataaaaagaaagagtacaaagagaggaattttacagctgggcctctgggggtgacatcacatatcggtaggaccatgatgtcctcctgagctgcaaaggtttttattaaggactttcaaaggggagggggtgtacgaacagggagtaggtaacaaagatcacatgcatcaaagggcaaaaaggagaacaaagatcacatgcttctgaggccaataaagatcacgaggcaaagggtaaagcaaagatcacaaggcaaagagcgaaatcaaaatctcctgataagggtcgatgttcagctgtgcacgtattgtcttgataaacatcttaaacaacagaaaacaggattcgagagcagagaaccagtctgacctcaaattcaccagggtgggttttttcccccaccctactaagcctgagggtactgcaggagaccagggcatatttcagtccttatctcaactgcataagacagatactcccagagcggccgtttatagacctccccccaggaatgcattcctttcccagggtcttaattattaatattccttgctaggaaaagaattcagcgatatcttccctacttgcatgtccgtttgtaggctcttataggctctctgcaagaagaaaaatatggctctattctgcctgaccccgcaggcagtcagaccttatggttgtcttcctttgttccccaaaatcgctgtcattctgttctttttcaaggtgcactgatttcatattgttcaaacacacatgttttacaatcaatttgtatagtttaacacaatagtggtcctgaggtgacgtacattctcagtttaccaagataacaggattaagagattaaagtaaagacaggcacaagaaataaaagtattaattttgggaactgataaatgtccatattaaaatgaaatctttacaatttatgttcagagattgcagtaaagacaggcgtaagaaatttataaaagtatcaattttggaaactgatatatgtccatattaaaatgaaatctgcacaatttatattcctttgccacagctccagccagtccctccattcagggtccctgactttctgcaacagacacaactctctgagtccccaggacctgactctcacagtgctcagtgattatttgttgaatgaataaatgtccttgacaccacctccagcagtctcccctgcttgcttctgagacggtttctctctttcacacctgtcctgactccactggctcgctttcccaccctattctgcgaccctagcatctttcgttttcttgtatttcttcttaggttttgtttttcttcatgatctgtgttctttgctccagtgttttattatgggatagttccaacattgagaacaaattacgtaggataatatgaactgaacccaccacctgggcatgacaaatattagcattctgccatatttgctttaggtaatcatttttagaagtaaagcattatgaatagagccctggtatatcattcagcaatcacattttcctctctcctccacagccttctcaatcatgtttgatatctttaccacaatctatcctgctgtttagtaaagatatgttttaatactttacacaaatcgtaccccacggtgcttataatgtgtgccacttgtttcttttttaactcaacattgcattttcaggttggtctgcatctgtgcaggaccaactgttgcagatgcctctgtcttactaatttctgtgagttctctacacacgctggatgatgaacactggtctgtcatgtgtataacagaccaactactggatagtactttgtacacatatgccatggatgtatagcctgtgctcactcgccagccttcattgttttgatgggtcactgtcataaggggggcagcagcccacattcctggggaacctttcttgtgcaaacatgcaacatggtccctagtctaggagagagggactttgccaggtggagggacatgcctggttccagcttcactaggagtagccaaatggctctttgaaaggtggagccaatgaaccttcccttcagcatgggctaagcgctccctcgcccactgccagcttttttactcttagatccctaatctttgttaatctgatgactgtaaaacaaaaggttactttaatttgcattttcctggtaactggggagagtctgcatcttttcacggtcattgcatgtctcatttccttttctgttaattgtgagtttgtatcattcgcctggttttcactgagttcattacacagtaaacatgcatatgtaagcacatatatctttactgaaacaacaggatacattgtagtaaagatttcaaacatgattgataagactgtcaaggagagaagaaaatgggactggtagatgacataccagggctccactttattcataaatgtttcacttctctttgtctcattgatttgtgtgagctctttatatgagatggataatcatcgtctgcctgttatgtttatagcaaacatttcctcctgagtgtggccggtcttttgactttcagctttgtttatggcatcttttgttgtatagaagctattaatcataacatagtcaactttatcaaatttcagttttatggggtttacgtttgtatgtcttacttgagaaacttttctgggccaggcgcagtggctcacacctgtaattccacctctttgggacgctgaggcaggtggatcacttgaagtcaggagttcaagaccagcctggccaatatggtgaaacccgtctctactaaaaatacaaaaattagcctggtgtggtggtgtgtgcctgtaatcccagctactcaggaggctgaggcaggagaatcacttgaacctgggaagtggaggttgcagtgtgccactgcattccagcctgggcaacagagcaagactccatctcaaaaaaaaaaaaaaaaagaaaggaacttttctgtattttgacatcataaagctatttcactgtagtttattctaaatgttttaaagttttgcatttcgtatgtaggactttaacccatctgagctttattaccggtgcagtgttagataataatgtgaatattttacctttctatcagtggcatttgaccaacaaacccccattcctgttgacgtatggatccctgtggtgcacagcaggtttccactccgtgcaggtctgcttttgcctttctgttctgttctgctgatctgtttattcttgaatagtctttatcaaaactagaggaaatcgctggctatttgttagagaaaacatctctaccctctgcttcttcttcaaacctgtcttcaccatctttggtcctttgctattccatgtgaaggaataatccaccttatcaggtgccaggagaaaatgctgctaggatttgaatgaaattgcatttaatttattgattattttacaggaaaacagaacatttgaaactgagtttttgcattcatgatgtagccttccaattagttaaatctttgtctatagcccttaataaaattgtattagtttctcatttaagatgtcccacatctttattatacttatttctaaatacctcagtgttttattgctattgcgaatggtgtgttttttctattacagtctccaattagtgttggctattgcatagccatgctgtggacttttatatcttcttatattaaacctcattagctctcattgtaaattcttagaaaattttatgcagaaagttatattgtctaccccaaaaatatgaaaatgtatgtctcctcctttccaatcctcactcctctttttccatcttggcctgtaacattggctagatcatcagaccatgctgagtgatggctatgagagagtcaactccctgttttccactttaatgggactgcatctggagtttcgcgggaagcttgaggcttgctgcaggctggccgtggtggccttttatcaggcgaaggtcgtccttgtagcttttgttatctacgagcctctgctgggaaggagggtgaaataaatgtgggttacatcctctgagatgaccatagcttctctcctgagacctgctgatgaggctgatgataaaagtggattgcctagcgatactttatgcttatgttcccaggacaaagcttgcttggtcataattgattctgcagccagttgcccatcctcacccctggtgtggccagccaggctggcggtgtgcccaccctctgctgaccactggctcttgctgatgacccccacccccacatatacacatagctcaatggacaaaaaattctaggaagagactggagccattatccaggtatctattaccaaagagcctcccatagtggggtagttccatcaaaagtagtaaccgacccagggaataggtggatgtatttctctccagagcaaaaaggttgatgcatacacatctgttctaccaaataggcaatctggtgactgttgggctagggatctgagggcctctctgggttctccaagtgcattctctcccaatgccgggatgcagggcctgcctcctctgagtggctgtcatccgctctgtctctaggacgatgcacccacagcaccatcagcccagcacagcacccaccgcattccttgctgccctccgacggctcaggtgtcccagacgttgggtgcagtctagcaatggggtggcagggccgtgactggactcctggcatctcttatgttagatttctttcctctgctcaatgccccccaccccgaaaggaaaagatgtgttccagggcagaggatgcgagttgaattcacccattgaagttaggggtaccgttgacaggggcagcggtcagacacagccatgggtcagcagtgcataaaaacgatttgggagtcatgaggctgaggatggcatctgacaccacgggagcatgtctgactcactcacacgcccgccatggggctgagggtgagctgatgaaggaagaaaggaaagaggagctggcagataaattggttttaaaatgacttacaatgttgtgattcattggttactccctgggcctcccctcgcctgctcctgacactgggactcaccgtggaggtgtctggaccgtgctccggggggcagcttcaagcatccccaggtgtctccttcagccattctcattactctgctccagtggtctctgaccggtcactgctgtgggagagaaaagctatccctttatgtcacttcgttgcagaatttgtgactcgcaaaatattaactgactgatgtttagagacacgtcgtccttggcagaactggaggaacaacttcccttgaaaagcttcagaggcaggtggctttggccacctggccctcctagtggcactggtctctttctttcaagtcaagggcagagacttggggcgtctgatgcgactttccactttaaatcatggaagaggaatgctggaagcacggctgtgtccctcccttctcagatcaacctacccacctcttctgaaatggatgctggctcctgggtggactgagtcctccctgctccagacagggggcagtagaaagaggttgagagcagtagcaacttggaagacttacaaggcttactcataaacatgtagattgcctagtgataatgtagataaaggtatcactaggcaaactacattagaaatacatatgcctatgtatatacaccactctatgtatatatacatatatttacatatatacacacatatatatcagtaaggattcgtgaacatttatttttatttattatttttttgagacagagtctcgctctgtcacccaggctggagtgcagtggcatgatctcggcccactgcaacctccacctcccagattcaagcgattcccctgcctgagccaaccgattagctgggactacaggcacacaccagcacacacagctaattttttttctttttttttgtattttagtagagactaggtttcactgtgttggccaggatggtctcgatctcctattgtgcactgcatgtgctttattttgttgctcagattattccagctttggctattgggagctctttcagttggttcctgtgtccctctggcataatctcattcttgtgggggttttaaacacttctttacctcctggcactacacgatgctctaggcccctcttgtataatccttaccctagccctagaatcagccatttatctaaagatttctgattccttttattggagagagactttagaaaccaagatgtgggcactgggtgcacttattgtgactggagtgtcaatggaaattctggagattaaaagtataatgattaaagcggaaaatttactagagaggtttgatggtagatttgaattggcagaagagatcaccaactaatttaatgacaaatcaatacaaagtattcaatttgaagaagagatagaaaaaaactaacagagcttccgtgaaatgtggaacaccactaagcaccctgacctgcacatattgggagtgccagaggagaggagaaataggaggagacaggaaaagtactcaaagaaataatggctaaaaactttccgaatctgatgaaaagtactagcctcacatccaggaagctcaatatggcaagtgggataaaaacaaagagaaacacacccaaacacatcataatcaaaatgttagagacaaacacaaacagaaaattttgaaagcagttgatgacagaaaaatccaaatgttgccaaaatatatttaaagaggtttactctgggccaatatgtttgactatggcccaggttacacaatctcaagaggtcctgagaaagtgtgcctgaggtggttgggttatagtttggttttacacatttcagggagacaggaattgcaggtaaaataataaatcaatatgagaagggtgcacattggtttggctggaacaggcgggacatctcaaagtgggggcttacaagtcataggtgggtttaggggattcttcagttgccagttggttgagagagttaagctattgtctaaggacttgaaatcagtagaaaagaatgcctgagttaagattagggagttttggagaccatgttcttattatgtagatgaagcctcatgggtggcagctctcagagatatgatagctgatgagtgactcttttcagactttaaaggtgtcaggctctcccttaatctctcctggatctgagaaaacctcctggaagggaaaatacctggttatattcatggagattctctatagctgcaaattgtccccataaaagatggctttgcagggccattttaatctgttggcactgtggcagccattgcaaagtacattaaagaaatatattttgtggtaaaatatttttattaatatgtcctttagagtctgctatctgtcatgtgatattataccaaagtcaagtggaaagcaagccacattttataaaaacctgtctgatgagatttttatggtttgtagagcatgactccccagtccccttagataggtatttgggcaagagaaaaaaggtccccatttactcctcacagcaagagaaaaaaaaaaagcaattcatgcaaagggacaccaataagattaacaactaaattcattagaaataatagaagccagatggcagcggaatgaaatagtcagtgttgaaagacaaaacactgtcaaccaaaaatcttatttccagcaaaaccatcttgaaatataaaggtgaaataaagacattcccagataaaaactgagataatttattgctagcaaatctgccttacaagaaatactaaaggaagttcttcagactgaaagcaagcaacacaagatagtaattcaaatccacacaaataaacaaaagtgtcagtaaaggtacttatatagataattacaaaagactgcataattgcatactttccctttattttcttgccttacttaaaaagtaattacataaaacaatatatgtaatatacaggtgtattgttgggcctcaaaatggcatcaaaaaatggggagagaatggaggaatataagggtaaagctatatttctctggaaataagtcagtataaatctgatatattaagatatacactgtaagccctagggaaactgcaaaaaaaaaaaaaaaaaaaactcaaaatacaatgtaaacattatttaagaaattagtgatatctagtgttgcattagaaaatatctacttaatacaaagtaaaacaataaaggataaatcatgtaacaaagatgataagagacctatagaaaaaggtaaaatgtcagatgtcaatctaactatatcaatcataacattaaatatgaaagaattaaacaatccaatcaaaaggcagagattgtcagactgaatttttaaaagatcgaggcggggtggggtggctcacgcctgtaatctcagcactctgggaggccgaggtgggcagatcacgaggtcaggagatcaagaccatcctggctaacatggtgaaaccccatctctactaaaaatacaaaaaaattagccaggcgtggtggcacgtgcctgtaatcccagctactcgggaggctgaggcatgagaatcacttgcacctgggaggtggaggttgcagtgagctgagatcacactgctgcactccagcctgggtgacagagtgagactccgtccaaaaaataaaaaaatacaaaataaaaaaaaagatcaaattacatgttgtttacaagagacacattttacaagcaaagatacaaatgggttgaaagaaagggtggaaaagaatacaccatgtaaacaacaattataaaagacttggagtggctttcctatgatcagacaaaatacgctttaaaacaaacaagtgtctgggcatggtggctcacgcctgtaatcccagcactttgggaggccgaggtgggtggatcacaaggtcaggagttcgagaccagcctggccaagatggtgaaaccctgtctctactaaaaatacaaaaattagccaggtgtggtggcaggcacctgtaaccccagctacttgggaggccgaggcaggagaattgcttgaacccaggaggcggaggttgcagtgagccaagttcgcaccatcgcactccaccctgggcgacagagcaaaactccatcaaaaaagaaaaaaacaaaaaaacaagtaaaaaggttactagagataaagaggaacatcttacaatgataaaagggttaattcataaagaagctaaaacaattataaacatatatgcaactagcaagagagcccacaaacattggagataaaactgacagaactgaaatgggaaatagatcattcaacaataatagttagggactttaatatcccactttcaataatgaatagagcaactaaagcagaagaccaatacggaaatagaattgaacactggaaacaactagacctaaaaaacaccaatgaatatgccaccaacagctgtagaatatgcattcttctcaagtacacgtggaacgctccttgagatagatcattaaacacaattgtcttgtgttagacaattaagcacatccccataaacttaaaatatttaaatgatacaaaatattttctccacccacaatgaaattaaattagaaatcaataataaaagcaaatttaaaattcacaaatagtgggaaataatatacctctaaataactaatgtgtcaaagaggaaatttcaagggaaatcggaagattcatttagatgaataaaaatgaaaacacagcataccaaaacttgagatgcaaataagcaaataaagacgctcagagaaaatttatacctgtatctatattttaaaagaagaaagatctcaaattaattacctagccttccaatctcagaaagtagaaaagcaagagtaaactaaacccaaagcaaacaaaaggaaggaaataaccaagattagagtagaaataaaggaaataaagaatataaaacaataaagtcgacaaaacctaaagttttgttcttttgaacacaggtttggttctttgaatagatgaacaaaagtgacaaatctttagctatactggccaagaaaaaaaagagagaagactcaagccactaaaatctataagatgtctgatcttacagaaatgaaaaggagaataagggaatgctataaacaactgtctgccaccaaattagacaatttagatgaaatagacaaattcctggagagagaaaactactgaaactggttcaagataaaatagaaaaccttaacagacttataacaagtaaagagataggattagaattaaaaaaacaaaacaaaacttcgcattaaggaaagcccaggtcctagattcactgccaaattctaccaaatgttcatagaattaatatcaatctataagttcagtattaacctgatacaaaaacctgacaaagatatcataaggaaaaaaaataactctggtgaatcctcttctgaatagagatgggaaaattctttaaaaaaaaaatactagcaaactaaatccagcaacatataaaaaggattatgtaccatgaccaagtggaatttatcccagaagtacaaggttaatttatcattaaaaaaaatcaattaatgtaacacaccatattaatagaataaaggacaaaaatcatattatcatctcaatgcagaaaaagtactaaacaagcaacattttttgtgataaaaaatttaacaaaccagatataaaagggaacttccccagtccgataaaaagcatgtacacggccagatgcagtggctcacacctgtaattccagcactttgggaggccgaggtgggcggacacgaggtcaggagtttgagaccagcctgaccaacatggtgaaaccctgtctttactaaaaatacaaaaatgagccgggcgtggtggcacaagcctgtaatcccagctactcaagaggctgaagcaggagaattgcttgaacccaagagacagaggttgcagtgagccaagatcatgccactgcactccagcctgggcaacagagtgagactttgtctcaaaaaaaaaaaaacttacagcaaacttcatacttaatggtggaagaatgaaagccttgccctctacagtcaggaataagacaaggatgtctgctgttgccatttctatttgacattgtactgaagtttctagccaggacaattaggcaagaaaatgaaataaaagcattcagattagaaaagatgtaaaactatctctgtttgcaaataatattattttgtatgtttaaaaaaccccaaagaatccacaaaataaaaatcattagagctaataagtggcttaaacaaatttgaaggatacaggattaacatattaagacaaaaatcagtgtatttctatatactacgaaagaatactctgaaaataaaattaggagaaaaatccgttactaattgcattcaaaacataaaatctttaagtataatttaaacaaaataagtgtaaaccttgtacactgaaaactataaacattgttgaaataaactgaaaacaatcaacattaatggagacatatcatgttcatgggtcagaagatttattattgttaaaatgacagtactgcccaaatcaacctacagagtcatctcaatccctatcaaaatcccaactgactgttttatagaaattgacaaactgactctaaaattcatttggaaacacaagggactcagaatagcaaagaaaacaaattgaaaacaaagaataaagttgaaagactcacacttcctgatttcaaaacttactacaaagtgacagtaatcgagacaatgtgatactgtcatgaagacagacacacagatcaatagaatagaattgggagtccagaaattaaccttttcattcatagccaattggttttcaacaaggtgctgagacagttaagtgggggaaagaagagtcttttcaataaatggcattgggacagctatatttccacatgcaaaagaatgaataacccctaattcataccatacacaaaaattaaaactcaaaatagatcgtaaacctcaatgtctatgagataagagttaaaactacagaactcttagaagaaaacataaaagtcaatcttcatgaccttgggttaggcaatggtttcttaaatagcacaccaagagcacaaacagaaacatcaaccaaaaatagataaactgggccatatcaaaatttaaacttttatgctacaaataataccaccaagaaagcaaaagtagaacaccatagaattggagaaaatattttcaagtcatatatctgctagaggccttatatccactatatatttaaaaattcttggccgggcacagtggctcatgcctataatcccagcactttgggaggccaaggcgggcggatcacgagttcaggagattgagaccatcctggctaacatggtgaaaccccgtctctactaaaaatacaaaaaattagccgggcgtggtggcgggtgcctgcagtcccagttactcgggatgctgaggcaggagaatggcatgaacccaggaggtggagtttgcagtgagccaggctgcactccagcctgggtgacagacagagtgagactccatctcaaaaaaaaaaaaaaaaaattcttatagctcaataacaaaaagacaaaaataccatttaaaagggggcaaagggcttaaatagacattccttcaaagtaaatatacaaaaggccaataagcacgtgaaaagctgttcaatatctttattcatcagggaggtagaaaccaaaaccacaaccagattctaccccacatcctgaggacgtctaggatcaagaagacagacaatgacagctgcagacgaggatatgaaggaactggaagctgatggggttgcaacatgctgtagctgctttggaaacaggttggcaatttcttataatgttaaacatagatttaccatatgacctggtaattccactcttaagtgtatatacccaaaataaatgaaaacacatgtccacaatttttatatgcaaattttcatagcagcactattcgtaatagacaaaaattgaaataactcaaatattcatcaaccaataaatgaataaataaaatgcattctatcagtacaatgaaatattatttggcaatgaaaaggaaatgaaatactgataaattccacaaaatgttgatagtgatgaaccttgaaaacatgctaagtgcaagaagtcggtaacaaagaaccacatattataggattgcatttgtaataaagtgtctaaaacaggccaatccatagagacagaaaatggattagaattttcttagagctgggaagtgagcagagaggaatatgaatgactgttaatggataaagggtttcttttatgagaaacaaaaatgttctaaagttagattatgatggtggttgcacaaccctgtgaatggtgaatgtactaaagcacatcaatttgtacactttaggtgactcatatggtatgcaaattatatcttgatgaaactgtttctttttttaaaaaaagtcaccaggtttaaacaggtcaaagctggctttctctatataataatacaaataatttcaatgttattttgaacattctgggacatgggaaaagatgggaaattttaattgtataagtgaaactttaattgtataattaaaagagaacagaaaaagataactataaactgactcacaatatatatgtaaaaagaatctgaataaaatattagaaaatagaacccagaaatatatttctaaaaatctgctatgaccaagtattatgtgttggttttcaggaatgcaagggtagttcaataccaagaaactagctacaaaatttagtatatccatcaaccacatgatcccatcaatagacaccgaaaaagcatttgaggaaactcagcaatcggtcctgcaaaaaaatctggagaaaagtaatactaaaaagaaactattaaaaaagagatctcaaatcccagctgctatttgtaggggaatggctctcccatggtgcccctaccatgttgcacatctccttacaggcctcctagaggaggcttggccacagtctaagctgagtcctgggaatgactcctcctgaagcaaggggagattaggctggggaggagtcagcaagggcagcccctgatccgtgtgagaatgcctccaagggttgctcatccatctccccggtttccgttgagcacaaagctcttcctcaccactcccctgtcatgtggagctgctggcttctgtgtagtctgtacaaatgcttggccatagtttagagaggactcctcaatggcagagtgacccaacactcaagccgacgatcaccagacctttctgtttcagtcgacctgtggattaggggcaccaggacctgacactgcactggttgtggctttgctgtctgtgtgagtaatgaactgtcttgaatcctcttggctgctctgtcttcttggcagcgaggtctatgggagtgaaacctgctgacctcactgccgctgccacgctccctttagggatgacttggccacctgacacagataatatccaaatcatgaaacaccaaactaatacaattaaaaccagaacttagcaagggaggtccaccatttttatttgatattgcactgaggcttcaagcagatgcaaatggccaagaaaatgaaacacatactttaagcgttggaaaagatatagctattagttttcacaacccagatattgtatttaaaaattagaattaaaaagaaaatgtgataggatgagatgatgtcatataattatgcagaaacaaatgcactatctcttttcaaatgataggcatctagaaacggaaaggggaagaatcagtctgtccacaacagtgacaaaaccgtgagctacttagggagcaatggaacaggactcgggaactgtgtgcccagcatctgcccactgctgctcggagccatttcctgtcctgccctgctccatactccaggctcccttcccttctgtcttccagtagatttggccaatgggcggtgctgacccaagattgaagggtgggatgaaaggacacgtgaggcccttctctccctctctctgttccagtggcacctccagctgcagctgggtctcctcggtggctgtgggctcccacctgaaagctcctttctccatggtcccaaatggggctgagagtctcaatatgattagagcatgctctacactgaccctccaggcccagccctggggtagaagtgacctcaccaccatacaaagtaacccctacaaccagctccctgcattaaattccctctgcttaaaagatctagagtgatttctggtttccaggtcagaacctgactgatacaatccctatgggataaaaaaatgataaaatcttatttaaagacacaaagcagacacatttttctggataagaactttcaatttaaaaatgtcaattctcttgaaatttatcttttagtcaaatgccatttcattagattcccaacagagttttaggggttttggtgtggtcttgttgggtagaattatgtagacatttttatgggaggataaatactcgtgcaagatgagacaaccctgccactgtacacacactgacaacacgccacgagttgggttagaaaaccagaaaatgacctcaggataagcaagaagataagaccaagcttcatttgtttcagggtaaacagaagcatcatttaattaatggactagcacacccagctgccatctagaagaaaataaaagtggatccactccttcatcttaatcaaaactaaattctaagtggattaaagacttaaatgtaaaagaaagtaaaaataaaataaaaatactgcaagaaaatctggaagaccatgccagctagggtaaggattcctcattaagcaagactgaaaactcagaaattcttagaagaaagtataaatatgatggactataaaacaatttaaaactcatctatgaatagatacctaaaaccaaatcaacagacaaagtataagtttagaaaaacaaaaagtgggccagatgcagtggctcacgcctggaatcccagcaatttgggaggccaaggcaggtggatcacctgaggtcaggagttcaaaaccagcctggccagcatggtgaaaccctgtcttactaaaaatacaaaactagctgagcgtggtggcatgttcctgtaatcccagctacttgggaggctgagggaggagaatcgcttgaacccgggaggtggaggttgcagtgagctgagatcagaccactgcactccagcctgggcaacaagagtgaaactccatctcagaaaaaaaaaaagaaaaaagaaaaacaaaaaaaaaagtgatttatgatgaaaacaacagtgagaaagctgttatctgtaagatatgaaaagtgcttacaaattgataggagaaaaaaatccaataggaaaagggtcaaaacaatacacattcacaaaagagtaaatccaaatggctaacatcatataagaaatgttcaaaactaccaataattggtgacatgcaagttaaagccacaaggagctgtcacttaaaacccacctgaccagcaaattgaaagggcagcaggaccgattgcaggagaggatgcgaagaagagagagcgtgcatcactactgctgggaagcggacattcggcagcatttttggaaagttatctagaaatgtcagttcaaagaaacaccatccatgctttttaacctccaaatcccaatctgtagtatctgcttgggtagccacagcacagcagcacacatggtgcccttcacgggaggaaaagggattctcacactctcggcggctgaaggtccgaggtcaaggtggtggcagggctgctttatcctgggcctccctcctgggcatgtggtgtggtcttttccctgggtcctcacatggttgttcgtgtgtgtgtgtgtgtgtgtgtgtgtgtgtgtgtgtctgctactgttccccctgccaggaggtgatgacctatgggttgcctccatcctgcccaggatgtctgatgtcagacagagcctgaatcctgttcccagactgaacactggtatcactcagactgagtccaaatcctgatctcagactgagcctgaatcctgatttcagactaagccctaaaaattctgcctcagattgagctctgaccctggtctcacactgagcctgaatactgatctcaaactgagtctgaatctttatctcagactaagcctgaatcctgattttagactaagcctgtattagtccattttcacactgctataaagaacttccctgagactgggtaatttataaaggaaagaggtttaattgactcacagttccacatggcttgtggggagcgctcaggaaacctacgatgatggaggagggcgaaggggaagcaagtgccttcttcacaaggtggcaggagagagaagagcgaaggaggaacttccagacacttataaaagcatcagatctcatgagaactcactcactatcataagaacagcgtgggggaaccgccccatgattcaatcacctccctccctcaacacatggggattacaattcgagatgagatttgggtggggacacagagcgaaaccatatcaaaacccaaatcctgatctcagagtgagcccaatactgatttcagactgagccctgaatcctgatctcatactaagcctgaatcttgatctcaggctgagctataaatccttgtctcagactgaaccctggctgtgctacatttccagacctttctcacccccatttttgttgccacctgaggtcccctgggagcttcattctgggctggcagatgccctaatgttctagaacaggagctctggagtacctgttcactttccagtccccttttcccatgtcccctcccagttgtcctcttgcagcctgaagaagtctcatggttctagactgcagacttctgctggggcagcttgtttacctagaagaggtggccagagcccaggtgaccagggaaggagttccctgcagtgtaactccacctggggactgatcactcaccattgcctgccacctggggaggaaaggctcacctccacttccttctcagatggccccacccttgcatcctctggttgccataaaattcttttgcacaggaggttcctgcttagccctgtgtcacctctgggaccagcctgcaggcctgcccagtgctgtggctctgcccaggacagcaaggtgagttcagaagcagaggttgggcactctcagactcccaggggccaggtatagcagccctggctcaggcagctgctgtgaccgactgggatcccaggccgctttccacctctttccttcctgggaagcactgccagtccttgtccttccaactgaccaggacaggaggtcagaggggaggtcatccccacagacagggctcccaggacggcacctgcaaagctgccctctgtggtcccgagagccagtgcctggcacggccgcccgcttcagactgtggctgtgggcaagtgtgtactctccaggaagaaggggcctgttgcctcactgttgatcatccttaaaaaagaaactagagacaccccgggtgcctctctgcggccccataaatctggagaggagggagctgcaccgagcgagcttaggcttttgaattttaaatggccaatttggtcaatgaatcaatttcactgggctgaggcagcgtggagatgaaagcggttttaagacctattgaaggcggtgagagcctctttgtccatgcttttctcaggctgccgccctctaatatttcatctatattcatttttatggctttccaaattatagatgtcagctaaaaaaactgaaaaaaagagagggtgaagaaaggagggggaaattcactgctgttgaatagaaaggcgaagttatccctcccaaagccagccagtgtgctgggacgtgacccagaactcacagccggtccttccatatctgggcctcattcctgcatctggtctgtgacccaaggctgagcctttgctgcccatggggcaaaggatgaggcagacagttctccctccagtggggagctcatgttctagtgggagaaggagagagacctcctaaaagtgagcagaacaaagaccctggtactcagggcaacacagagtgggtgaggcagggctgtggaggagggagttgagagcagggtaggaatgacctgcccttgtgcaagcattttctttccaatttccaccatgctcaaactgtaacctgaggttatgatgcccattcctgggaattcatgttctactgatctggaataattctgacctaactggctaaaaattaatgtgtacattatctttgataaagggcttgctctgcaatttgtagtataaagggatcacaaggtaaatactttaaaccagggctcagcaaactttttctgcaataggctggctagtaaatatttcagccttggtgcaccatgcaatctgttgcaactactaaactctgatgttgttacgtgaaagccgtcatagacagcaatacggtttggctgtgtccccacccacatctcaaatgttagctcccataattctcacatgttgtggaagggacctggtgggaggccattgaaccatgagggcaggtctatccagtgctggtctcatgatagtgagtaagtctcacaagatatgatggttttacaaatgggagctcccctgcacatgctttctctcttgtcttctgccatgtaagacagaactttgcttctccttcaccttcccccattattgtgaggcctccctagccatgtggaactgtgagtccattaaacctctttttctttataaattacccagtttcaggtatgtctttattagtagcatgaaaatggactaatacagacagtacgtaaacaagtgagtgtggctgcattccagtaaaactttatttataaaaatgggcaacaagctggatttggcccataggccacagtttaccaacccctgcttttaaataccaaagtgaattcactggtttttctgcagtgtactgtcccatccagtgaacttttcacttcagagattggcacaatttgccacttctagaaattccacttggaatttctgtgtcccctatttctctcctcgctctgttcatgttttcctttaagtccttgagtatatggaacatatttataacaagtgttttaacatcctggtttgccttttccatcacctctgtcagttctgggcctatctctattattaataactaattttttcctgtcgataggccctactttcctacttgtttgtctagtgatttttgattggatgctggacattgtgttgaatactgtacattgttgagttctgaattcacttacatgcctttaaagagtgttgggctccattctggcaggcagttaagtcacctggagagaagtttgatgcttttgagggtgagtctagagtcacctttcctcttgggtgagttaagccccactactaaagcaaaactcttctgagtctctagtgaatgcccatgtcttcaataacttctctccattctggctggtggaaacttagatggttctaagccattcaccttgcagctctctgataattgttatttcttcagcattgcccttgaagtttcacgccttgcgtgggacaattgacattcaggcacagacctatgggaacccctatgcagaattctggcactctttttctgcctatttccctcttctctggtattctgccagcaaattctagccatctcagcctcccaaaattctgatctctatctcctcaatccaatgagaccaccaggctctgtgtggatccctcctctcataagaagacaaagagctgtcagccttaaggaaggacggagaactgaaaaaatgtccagccatcctaaaggaatctccaaatcagtaccaaggaagcaggtccaccacaccttgactaaggccttccttccccatcacagcccattactccataatccagtcctcagcatagcagccctcctggacattgtctccacacagaaagtccaggcctcagaggggtcactttatttgtttccctctgaatgggtgtctcagttctgcacttgctgtggtttgaatgttttccccccaacctcatattgaaattggattcccagggttggaggtggggcctaatggaaggtggctgggtggtggaggtggacccctcatgcatagatcatgccctccctcagggaggagcgagctcttgctgttagttctcatgagaggggcttgttgaaaagggcctggcacctcccccatcttgcttcttctcttgccatgtggtctctgcacacaccagcttcccttcaccttcccctgtgagtggggaaggtggcacagcctgaggtcctcaccagaagttgagcagatgctggcaccatgcttctgtccagcctgcagaaccatgaggcaataaagctctttttcttataaattaccgagcagtaggtattcctttatagcaacaaaaatggactaagacagcgctcactctccaatgtctgagaacagtcgtttcatacttttttgcccagttttctagttgcttaactcagaagagtgagtctggaagctgtagtaggagactctgcccatggatcttaaataatataaaagtactcatttctatctaacccactttaccactttaatataactgtggtgagttggcagcatcacagactttaggttggacggagcttagaaaccacgtggtgctagcctttcacattgcagacagagaaagggaagcccagggagtggtggggcatggccgtttagcagctggtggcaagcaggctgatacaagacttgtctatccctgcaccaccctcagctactgcccacccatgtcctcctgcagcctgggcacccaggtaacagctctgaactccgtgtttacaacccccatgccgacacacatgcacactgctgcataagcatcaatttcctaccaagttggtccatgggccagcgggctgcacctagaggagatctgtccacaccagcccgcctgaaaacaaccgagccacagtgctgggcccagaacccagtacagccccctttcctctcaggccatcccagcctaccagaggagtctagtaatgccagccctccaaagcaaggttcctcagcaaaccacaccccgcccacaccacagagccctcaggccacagcataacacacataacacagcttctcattcatttaggggctaaatgtcagcaactgcaggcacaggtctctgctgaggccaaggtattagacctgctggggagagggaggagcagttatcagcctgccctgagctggaggtgggtgtgcctcagacctcgtgccagcctgggtcctgccaccctctaggtgtcaccggccccctgggcccccacacagagagtgagactcattcagcaggaagggctgagaaagctgggaggggtggccggcagctggcacagcacaggcttctccatgcacgcattacctcccagggttgcctgactgactgttgagagtcaggcttcatcctggtgctgcaggtgccctggagacatgagctgctaaggtgaggctgccacagaggagggcggctccccatccctttgcttgggactgaggggtttcccagggcatgggactttgaatgccaatgccgggaaggccccaggcagactggatgagttggtcacgccaccctagtgtaatagctgataggctgacatctcaaagattcacatcctggtggctggggcctgtgaatgtgtgacttcacatggcccctgccggtgtgattaagtcaaggactggagctagggagtggctcttggatggggtggaccctgcatgcaatcacgggaatccttttaagaggaagcaggggcagatttggcaacgcagaggaggagaccgcgcagacagaggcagagatggaggggtgcagccacaccagggccacctggagcccccgaagcctggagagacagggacgagattctccctttgagcctccagagggaaccagccttgctgacatctagattttaaagccatgagacttgttctgaattcctggcctctggaaatgtgagataataaagtaacgttttctaataaggccagacctccaaagcaaggctcctcagcaaaccacacgccacccacaccacacagcccctcagtctgcggattcacaacacaacccaggagataggacccgggagacgccggcccccgcctgcagccaggctgagcttgacggccacaataggggcagccatagcagagggctgcctcagaagttctgcttcaccaccggggaaagtgccaggaggcctggcacgtcccgggatagtgaagacgggtagccactgggccacctggaaggtgactgcggcacctgcaccccccgcatggttgctccccacccccagagctgctgcaggcacacctggcgcctgctccagccagccttggcatcttcctctctgttcctccctccgggcagggcaactgggcaggctggacacccagcaggggagctgtccacatcaagagctccccttctactaccatttctgggccacgtcctccgccctcaaaacagcaaacccgtctccagtgccagactcggggctgcacatgaccagggcaggagtaactgaactcgcagaggacaaaaagaagaaagaggaagggaatcccttcagcgccacagctgagctgtgtttgctgtagtttctccaatttctttgtgaaaatgtaatcgcggtcccggagcacgtgggaccctctgcacactgacagtgggagggagactcactgcaggggctgccgagagcccccgcctggggtccttgacctgctgggctggggggctggggagagtctgtgggtgcagagagctgagtctctggggctggggcccctcctcctccatgtctttcagacaaggtgtcagggccccacctgggaccacactgacctatcatagccaaggtgaccttggctggctggcccctgagtgaggctggggaaggaggcaggaagcaacaggcctggatttgggatgactgccccgctgggacctcctagaaggtgtcaccctgaggggccaagagggaggtgagcctcagagctgaggtccacctgcagcctttgcctgacctttggttctgggggcagcttggggacccccacctgccactgtcagcctttccacctgcagggtcaggcaacttaaaacctgaggacatcacaaagcaggaaatgagttcctaaatagaaacccactggggtctcccacctactaccacccctcctcctctcctgcctccctgctcctcctggcatgttggctcccccagcaacgccgccctcctctcagacacacactccctacctgcctgcacccttaccccacccagcctcctctggcctccctggcccccaagttcagcctcctcgttccctgtccctgctctgtcccacccaaggagcagtgtgcagcccctcccctgcacccctccctggcgacctcaccccacatcttggcgccaggcacctccagacactctccccacttgtctgccattaaggagacctcttgtcctagaagcttccagcaaggcaaccaccacattgcagacccccttcctcctgccccctgccccaggcccaggtttggagcagctgcccatcgcagagcagccaccgtggggtgtcagctggccggggtcaccttctcagtgtttggccatttcctcactggcaggaccctgaagcttcatccaaagcaagaggagaagacaggtaaggactgcaagccacactgggcgcttggatctggaagagaagggcagagacttggctggctgagggtgaacctctcctccaccgtgggcagcccaggccctgcctggagaacaagcagagggggagattctccctcaggagagagcggagggggagattgcccccaggttgccatggggctgggatagaagattctgtgaccaggaaatggcccagcctgctgctccacctggctgcagccacccctttctccaagaccagacttatgggtctgtctccctgctgcctccctctgccgttctgcagctctggggagctctgtaactggggggcccaattctgccattctgcagctctgcaactggggggcctgggtcggtggggaggtggaagttgcccctgcagagagtgtgttctcttttcggggagacctgggcctcctggtgctggaggggctcccagctgtgagtaggcaggccccatgtagcaaggagacagctcgccatgtggactcccttgggtttggtgattggtcactgcccactggcgtgcactcagtgcgttcctgggcccacccaggcttcttgatctcttgtgatgtttgtaatctggcatttgggagagagtgaggtaaaggcaattttgcaactgcaataaaaccagcaaagtgatcctctgatggttcttaatgagatccgtctatctcccctgactgagccggcagactgcaaccccatgtgtgaggtcaaaatgaatgtcacatggtcccccacagaaccagagaagccatcaccatggtgcctggcctaatctgctccagcatccgacaggagtgatcagaagatactcacaggaaattgtttttcctgcctcgtaaccataacaacagatgagagctggtcttgctcaactttccgagtgagcatctttgtcaacatgtagccaaacccaggacacaaaagcagagaccagggctggcaaaagggcactttggagatatcagggtttggggctcctgtgaggtctggattctcccctctcctgccccacccgacagggatggcttagaacgttcctgagtgtggactagaaggtgggtggaaggacaatgggccccctggaagtgtgcatacctggcatcacagtgagctgtggctgctgcctgggcagaagctgagaggctgccttgctgcccagagtccccacaggcctgcaggtgggcaccagtccttgcttcccagattacagtcaaatgctctgcccatatcattccctaactctgacagcaccaggtccagatctatcccctaaactgcaacagtattgctgagagaaattaaagaagagctgaatgaatggagaagtataccaagttcatggatgggcagactctctatggctaggatgttgttcagccaccccaaaatgatcagtagaccgaatgtgatcttcataataattccaatgagctttttgacggaaattgattgattgattctaaaatgcatttgcaagtgcaaagacctggaaaagaaacatgatcctggataaagagcaccgttggactaatacgatctgatttcaggatgctgcaaagcccagtaatcagggcagtgagatactggcgaagaaatagacacttagataatggaagaaaatgtagagacaagaactagacccataaatacatttcccatcgatttttagcaaaggctgcaaggaaattcaataaagaaagaaagtctctttgacaaatgatgttggagcaactggatacatttatgggggaaataaaccccaaccccttcctcacaccatacatgaaaattaatttaagataaaccacagatctaaatctaaaatatggaccaggaaatacctagaacacacaggagaaaatctgcaacattgaggtaaacaaagactctttagagaggacacaaaaggctctggccaataaagaaaaaacaacaagcagaaattaatcaacatttaaaatttcaggtcatcaagacattgtcaaaaaacaaaaaggtatttcataaaattagggaaaaaaatatatgtgtgtgtatatatatgtgtatatatacacacacatatattttctctaactctattaatatatatgtatatatatatgcacacacatatacacatatatatacacactcacacacacatacatcttatatccagaatatattgagagttcttacaaatcaacaataaaaagacaatccacttatccaaaatatataaagagttcttacaaatcaataataaaaaatccaattaaaagatgcttcataaaagaagacacataaatgctggataagcacatgaaaagatgtgtaacatcattaatcatcaggaaatagatacgaaaatctccaggaagtagttttttgcccatcgggttgacaatactaaatgtcagtgtggatatgcagaagccggaactcgcctatactgcaggtgagggtacaaaacggtgctgccacttagaaaactgcttggcaatctcttacataattaaacctccacctgtcctatggccctcctagctatttatccaaaggaaatagaaacatttgtaccccaaaaatacttgcacaagaatgtttatagcaactgtatttataatagtcaaaaactggaaactacccaaaggtacactggcaggaaaaagcataaatagattttatatttataaaatggaatacccttcaaagataaaatggataaactacacagataaagctcaaaacaacttggttgggtgttggttatgtgtgtgtatttgtcaaaactcatcaggttgtacccttaagatctgcacatttcactttatgtaaaatttatttcataaaaagcaatttccccaaaacaatatgataatagcacaaaagggctgccctctcccctcagccacggccaagtgtgatgttgcactcagaccccacccgagcgtcctggctttgagtctccttcaggatgcccaggtgtacactttgctcggagctccggagcagcagacagggttgcaggggtggggggctgctgccctccagtggtgcatggccctagcaggtcccccctcaccacactacaagctccccactggaaccctggagcccgcatgcctcccagagggctcgtgcagggacccccaggcagcagatacgggcaccccacgagtgtggccacaggaggctccgtgaagggcagcagcctgcagccatcactctgccagtctccccgagacaccccagtgcgccctgcagtagagctggctggccgggctgggatctgcagacaggtggcagctccacctggaaggatagaaaatgcagttgggattgccacttctaggtcttgcctgacttctgccctttcccaaacacagggccttgtggtgccttcagctggtccctcctcctggagtcccctcccacccatcccagcatcacctgcagcactctcccgccaaggtcaggctcaggcagggcctcccacccccatccaggaggcttggccaggcccatcctctagggagctggggacctggccttccaagagccaccaagacatgtctcagaggtagatgggggctgggcagtgagccggagcctgccccctcccctcctgccccagggccaggggcagcagcatgaagcctcctggtctcccttccattccctggccaggatggagacgccctcagggctggtgcaggcctccagcccccatgcctagtggcctgggagacagccagccccaccagatgaggatgtgagccacacaggcaattttctctagaaataaatggagagaaattgctctaacaggcaaacggcctctgtttcaaagctaatttccacataatagaaccaaactacttccctttcctctcctctgtctcttctgcataatttgacaaattgcaaagctatttgattcgggggctcaaacacaagcactgactccaatagtcagggacagatggggagaggggagaaggcaaagctccccagaaagcgcccgctgactccagggctctgagaggacatttctgggactggcaggtcagagtgcaggggtggggcagtggccagggctgggcacctccgcattctgccaccatctccccaggcgagcagaggcccgtctgggaagggctgccgtggtagctgatgcacaatatgtcccgcggggcttgccagcgcgctcctggctctgatctggtgcctggcagggccagccctgctcccagccaagaccaaggcctgtgcttgtgctgccggcttggccacgtgctgagaccgagccagacccagccaggagaagcagctggtacctgagcaccccagccaggccacggtgcccgtcaccagcgccgcacagcccgccccatcttcagctccagccgccgagcttgacagctctggccctggaatccccacaggccctgtgtgtgtctctcctgcatctccttccctgtccatgtcctcccgggaactcagaacccccctcgccacccggggacctgcacatccctaccacacacgcagcccacagccgggcacgtggtacggtgcatcctgtgtgcaggggacgcatgaagaaatgcacgcagctggggctgaggacacggaggcctccaggcaggggtccgggccagcctcccacccacaccccaggcaggtgggcaagtcacggagcacaggggacagagagcagtggcatttcctaaaaggactttctattatttaacctattaaaagatgtctttaggctgggcatggtggttcactcctgtaatcccagcactttgggaggctgagacaggtggatcacctgaggtcaggagttcgagaccagcctagccaacatggcgaaacagtgtctctactaaaaatacaaaaattagctgggcatggtgatgcgcgcctgtaatcccaggtactcaggaggctgaggcaggagaatcgtttgaacccgggaggcagaggttgcagtaagctgagatcataccactgcactctagcctgggcgacagagcaagactccatctcaaaaaaaaaaaaaaaaaagaaaaagaaaaaagtatttaaatgaggatgttatttttaacaatattattttacagctatacaaatactacacgaaagcaggcttgatattaaaaagtgagagcctccttcacctgcaccccagtcccccatactgttccttccccgagattctccccgcagtgcacctgtgagcaccttccagagctgtccaggtacctgtaggcaggtctgagtatgcagacatgtggctcggggcagtcgcaggaggaatcccactcgcctgtgatcccctgccctgcgtttgtgcttctcatgtacttccacatagagaaacaagggtcacacatggaccctcagcaagaccatggacaacaagtgcaagacccaggacaacccagcccagcagatcctgcccgcccaccagctgccatgcagtgctcagaggctggaagttgagggtcactcgtgcaccacccctacctgcaaagagcacccatccaggggcacagggcacaggaagctccggccgagaggcgtgcagatgggagatgccctggggagtggtggggaaactcctgccacagggggccttcaggggccctcggaaccacagaatccttttggaagccaaggacatcaagagagaaggatcaaaagaaaccgaagcacaggcttgcgatgagcctgggtgacatggtgagaccctgtctctacaaaaaatacaaacattagtcagacatggtggcacacgcctgtagttccagctacttgggtagctgaagctggaggatcacctgagcgcaggaggtcgaggctgcagtgagctgtgattgcaccactgcactccagcctgggcgacagagcaggaccctgtctcaaaaaagaaaaagcacagaagctgcaacaagccaggcatgtcgggtgtccccaaagaataccccgccaagggaatggtgaggtgagggaggcagccacaggctgctgaggctaagcctgacagtggggccttagatgagaggctggggtggtcggggctccccccgtggtcagcgcagagccaggcagcgatggggaaggagagccgagacagggagcctggtagggtggcttcggcatcgccagccccgcgacgacaaggagccatgggaggggacaatgcagagccgtcctgtgggggacgcagacgttgtggaggctggcacatgctcggagcacacgctggttgaaatagcagccgagagacataattaagaaggtgaatctgctgccaaaacatgcaccgtgcttcaaagtcaacaacgtgtggtttgggggacagcctgtttctgggataagttggcccctgcagggcagctcacagggagtgagcatggtggggacgccttcagtcactctctggcatgggcaccccacaccccgccagggcagggagggaggggcagccgagggaagcatgcgcccagcgccacatcctccaaaccctggctgcagacacacgggacaggctgagcaggagctatcgggctgggctacaccacgcacacccaagcacaagcactcctcgggctcaagaaaggagtggagggtcggaacgttctagaaggcctcccaagggagaggggcttgtgcagatggggcactccaggccaggagcccagcctatacaaaggtgcggaggtgtcctgtgctggggagtgggaccaggccaggccgggtggctgggcccggggatacagaagatctgggtcagtcggggatcaagggggccaatgttcaggagaaggtgttgatggtgcagcccagctgcccctagctaagctgttccctcaggagttcaccagaagcccatcgcgtcagcagcagccccctcgggtttgttcagcagcatccatgcaaccacatcagctcagagcggggatttcagacccaaagggccaccaccaggggggatttgtcctgggatcagggaccaccgctcctcagcctggacctttcacatcgagtgcccagagaagcaggggctggtgggcacctgagggttccctgagagtcctgccctccagtggcttagagatcaacccctggcccaaaggtcctgcttgacaggtgccccagattctgtgagttacttaagatcaagtaacaaaaagatcaccctcatggcagatgagaggttaattcagtcacatcgttactggtgacagtcccacaaatgatttattgatttttttttaaataaaaatatgtcacatcctctggtatgggtatagaccaattctgtgcttgggccaactggataagaagttactagtttgtaccagatgccaacttgctattccatgccaagcagaaacagcactacccatgatacagcactgctacctggcacttcctcacgcaccacacacacacgcccctccaggagtccgcacagcctgcagtgagcacctcctccgtgccaggcgccctggcagggttgctgtgtactgtgggggttgccaagaccaatcagacttggcactgcccttgaggagctcaggctgcagaggcgagaatgggaggataactcagccccatgtgccgtccttgaatgggtctaatggggcccacggtcattgcatgtggctgacgtggcgtgactaggaggctgaggagggtgtccccatggaagtgacgttccaacatggactggaaggataagtacagcccagtcatgggaaacagacagagatgctcagcctgggcagtgagaaggcaggtgggaaactgaggcaggacagagtgtggtgaggtggaagatggcaagcagggcgtggagccaaaaaggatgagggtggggtggtgcagaggagtccccggggccccagggctgggccacaaagaggcctgtagatcttgctaagcccctggaaggttctgagcagaagagacttcaccaaatgaatgctttaagaatctccttctggcccgatgtccatcgcggatgaatggatgagcaaatcgtggtctagccacacaacagaatatgtattattcagccataaaatgaaataaaatactgattcctgctacatggctggagcttgaaaactttctgctgcaagaagctggacacaaaagttcacgtgttgtatgactccttttacatgaaatatgcagaatagacaacaaatccgtaaacaggaagatgaggggttgccgggggcttgggagaggggcaatggggagcgactgtgtcatgaacacaggacttctttttggggtggtgatcatgcttcggagctcggtggtggtgctggctgcacagcactgtgaatataccaaatgccactgaattataccctttaaaatgatgagttcacctcattgagaaggaggagaaggacagcagctgctccctctgacagccgtgcagagacaaggctgccggcagctgggtaggaactgggaagaacggaccgagacccctgcactgggccagcccagaggggacgatggccccagccagtgtgacagccattgcggggaagggcagagagaagtgggtgggtttgatgtacttttaggagaagagaacacgaggaattcacaattgcccagatatggggaggaaggaggaggatatgagatgcatctggcccagcacccgccctcaggatgctcatacgtccctaaatgacaagaggtgggcaatggcgatggactgcactccagtcgtgctggagtgaggccctcaggaggctcctgactcagctgggcatccaggaaggcttcctggaggaagcattgcatggagacagacccagggcttggggaacacgagctgcctcatgaactgcgttgtgagggagtgggagactcccacctggggacatctgcatgtcctgtcactcattcattcattcgctctacacatccacactgaatgcccactatgtgccaggtgtccttccaggcactggggagagggtcgttttgcgaaatgcctgccaacatttgaacgcactctgaaaaccagtggttacccggatagctcggaatagtagctggacttgagtttggtgtcatggaacccaaggtcagaggccgctgttgttgttattactatcatcggcacttacacagcatgttcgggggccaggcactgttctaaggccctggcagaagtcagcttgtttgcatctggcctgttcccagatatgaggcctttcatagacatgagggtcttgactctcgggctccaggcctttcccacccatgagtggacctcagtttccctctctgaaaaacaagcagggtaagtgtaatggcctccagggacccccggctcttcagtttcaaaacgtggtagaaagaccctggctgagtccagggagctgcacacagcagctctcccaggctggaggggctccgccgtggacatagaagggctggggtggagagtcttgttctcccagaaggctgggctgagagggagccatcctggtggaggcaggggtgcatgctacctggctcagcatgtcctggagcagggccaaggcatggactacggtgatgcttggagggcccagtgctggtcccgcactccaccctgcccagcacaaaggcctcacagaggcaagatcctgcagcaaggaagccgaggaaagtgattcctgccgggaaggagatagcccagcacctggcccctctcagcagcacccatggttatcgctgaacagagaagcaagagggtctggggaatgagagcggatggccagagggccttcccgtctgaggccagggaagttgaacagaacaggtcagtcacgtcccaagcagatctgctgggctcgaagtccgctggagcagggtaggcaggaggctgagggggaggcagggctggcagagatgctggtctttgtggagacagcatgtcagatctccagagtccctttcttctgaccctccttcccacctaatccacggcctcagggcctcccagtttcctgtcccctctctaactctccaggcaagaccttctactatgccccccaccccagaaagtttccatgacatccaaaagatctcttatttattgaagccctagggcgaatgttgttgaaatcaaatagtgcagtgtttcctgtctcacagcccaacagtgctctaacaggcaacctgtctgccaggagctcgccacggagttccacagcccggcacctccccagggggcatttcccagcacgtcatctgcaggggtggcttccctgcagcccttcccaccccttcccacccacttcggcagcatggcatcccagcaaacctctcccccaccctatgggccacacacacactctctccgctggagttgggatcacagcccgggatgggatttgacctctccaaatttgcttctatttggggaactctgtctccacctagaagtagctgctgcctgtatctgctgttcctgtgcttttggcattctcatgccactcaacaggaaacgccctcttatagttaagaattctttatattaaactttcactgttcaaattgctgcatgacgcctgtctcctgattggaccttgactgatagagagtcagtaccaggagccatcctgagggacaccccatgaggctgggattggattggtttgtctgtatttgtgacgcaagtgcagtgctgagtttattgccaataagaaatcagatgctgacgacccacagcccaaccccaagcccgatccccagcccaccttcacatcataatcaatcaagccgacacctgtggtggtttcatgaaacgccagctgaagcgtgtgcctcggggttccatgaggctgctgctctgacgtgtacagtggcaagtgtgatgacaaggaccacagtgtgggacagtgttcctgatgcactggggcccctccaaaagatgatgctcagctagggggcccctccccatgcagactatgctctgaaaaataaagtattcatagttgctccaaaagaatccctcattcctgcagccacagggagaatactgctgaaaatcaacatggagcaccttgtagtgccaaaaagtaaggaaatgcccacatcacacacacaaacacatacaaacacgcacacaaacacacacgaacacacacacacaagcatgcacacacaaacacaaacacacacgaacacacacgcacacacacacaaacacccatgcgcacacaaacacacacgtgcacacacacacgcacacacaaacatgcacaaacacacacaaaaaacacatgcacccacagacacacaaacacacacatgcacgtgcgcgcacacacacacgatggggcgtgtcaaagggacaccaaggccaacctaaagtactccccaccaggtgcgatgcttcacgcctgtaatcccagcactgtgggaggccaaggtgggcagatcacctgaggtcgggagttcgagaccagcctcaccaacatggagaaactctgtctctactaaaaaaatacaaaaattacccagacgtggtggcgcatgcctgtaatcccagctactcgggaggatgaggcaggagaatcgcttgaacccaggaggcgaaggttgcagtgagccaacatcgcaccattgcactccagcctggggtacagagtgagactctgtcaaaaaaaaaaaaaaaacaaaaaaaactcccaacagccaaagctggaacaatttgagcaagaaaatatagcattagattttaacccaaactataaaataaatatccataaatgcatattgatagaaacaaatgattaaataaatgaataaataaataagtgaaggaaaagaggcaaagcccccatgctgaagaactccacaccacttccgtagctgctccacaccccttacatgcgggctgtgcagacacttccctccaaagaggacgaactctacatcacttctgtagctgccccacaccccttacgtgcgggctgtgcagtcactgccctccaatggcagtgcagtcactgcctttgctatgagaaagagcaaaagaatgatcagtgtgctgaggaggcgtgagcaaggaagcctgacatgctatcccaccaggtgatagaggccccagccagccacgagccacatcaactgtgtgcgcccgtggatggcatgagcatggcacttcaccactgcggtcttcctcccccaaacctatgactccagtctcatcacgagaaaaacagacacatcctggttgaggggcagcctaatgcctgagcagtgctcttcaaaacttcaagctcgtcaaaagcaagggaagtctgggagctgtcacagccaggaggagcctaaggagacgtgatgatgaaaggtcacgtgggattctggacgggcccctggggcagaaaatagacattagagaaaaaccaggaaagaggaaagtgtgaatgaaatgtgggctctagtgaaaaatgtgtcggtattggttcattacctggaacaagcgcaccccactaaggggagacgtcaacatgggggaatgggacgtgggtgtgggaagcaggttcactcaacgccagtccaaagggagtgatgcagggcaggtgagccccaaagtggggctcagcccgtgagagtacttggcttcacccaagagagaattcaaaggcgagctggagatggaagaaacagctctattgaagcagccatgtcacagctctgtgactccttctgcagggcagggctaccccataggcagagagtagccgtgcagggtggctctgcagtcgtattcatgcccacgtttaattccatgcaggctaaggggcggtttatgcagaaatttctgcatcaacttctgggtcgctgggtcattgccatggaaaagagtggtaaccccggggttttgccacggcaatggtaaacggacatggcacactgctgggtgtgtcttatggaaggctgctttacctcacccctgttttagctagtcctcgatttggtccagtgtctgagccccacctccagagttgagtcccaactcccacctgtggaggacagcagagatcctcactctgccaagcccagaacatgagtccagacacttcccccacggcactctgcctttgcattggcttgtgcccctgtgcctaagactctccccactaggcttgaacaccctgcaagaaccgaacccgggccagattaggttagattcaggatgccctctctcctcaagacgccccataactagcacctgccactggttaagtggggtcagatctccaatgctccagggagaaagacacacactaagacccaggagggattgatttacacataaaaagaatcgcagtaatttgctaatataaatctgcagtaacatggggaacgtgtttgagagtggattaaatgggcgttagaccaaggaggggaggggaaatataaccttagattaggccaaattccttgacacaggtgcactttccagagagcttggatttcatgtgttaacgcgtgcatctggaggtggctcagacagcttacttggtggctcgactgaagcttgaactttgtcgtggcctacagttcatgtaggaggtgtgatgtggaggaaagagcccaaaagcttagggagaaaggactattgggctggatttatgtgcaacctcacagccacctcccagctgtggtccctgaggggccacaggacactctcttgactaaggtgtgaagcaatgctttcaccttggctgtaggctccctgcaagctctctggttgtagaccaggtgtgactgtggaagatgtcaccatgagaaattcctcccttcagtggggacgatggtatcctgaagtagcagaggctaacacagcacctagacatcagagaccaggcagcccaccgacagcgagggaaagcagggacacacataaccatggcaccttgatcaccaaggtctttggtggcagctaattaatcacagggtctcaaggacaaaagtggtgggcagcctactagggtattctttggtctaaataacaggagaaccccaggtgtgccagccaaacccccgacctgagtcaccgcagtggccagtcgcagcctctcacccatttgcacacccaactcaatgcacaatccaatgacctgtgatttgcagcccatgctggaaatactcctccacgcctttcccaaagggatgtacgaccattcatgggagtaactgtgagctggagaatggaactttgcagggctctgaattgatgctaatccttgggaacccaaaacacgagcacagcccatcagtcacatgggaacatacagtggtcaggtcatggatggaacccccattagctcacctctcacagggtaggctgtccacggacccacagtctggttgtatccccagttcctgaatgtataattggaatagacatactgccaactagcgggatccccagcatggttccctgagccctggagtgagggcatttgtggtagaggaactagatggaaaacgctgggacttcctttcctatccataagagaaccagaatcaatatcacattcccggggaaactgcagagattaacgccatcatcaaggcttgaaagaaacagaagtgatcattgcacacacacacacacacacatttaattcggctgtcaagcctgtgtaaaagttgggtgaaccttggagaatgaccgtgcactgatgtaaactgaagcaggtggtgaatccaggtgcacctgttgtcccacatgtattatctttactgtagaaaatggcatggcccctagcccttgttattcagctcttgacctcaccaatgtcttctctgtaccagtttggaaagatcaccagagcagtttggttttctcacctggccgggccaacagtgccctttcacagtcttgcttctgggtcatgccagttctcccacctgcagtgataagaagcagagattttcccacctacaaagcatcacgctggtcctctacactcatgacattacactgagctgactgtgtctgatgagcaggaagtgaaaataactttaaatgccttagtaagacacacactaactagaaggtaggaaataaaccccacaaaacatcagaggcctgcccatcagtgaagtctccagggcccagaggtgtggcgtatgtcaagctccttcctccaggatgaatacaagatgctgcacctcacgccatctttgtgagtgtgctccatggtcatggtcttctgggttctgtggaccacactgaggggccaattgtgcggatattggctgctgttttgaagatcgtctgcctcttccagctactttcaggatttttccatcttctgttttccacattttaatagacagttttgttggttcactctgtcactcttacctgggtctatagagtccctgggggctgcagcctggccactgtggcagcggcatagaattggaacccactgtctgtcgctcccaggactgcccattcatcagtgtgggcagagtgggagccatctaaggaggttgtgcagggagagtcagaagtgaaagcatctcagggaaggtttcccgagctgggtcagcaccacgccttgccaggatgctggggccacacaaaactgagcatctgctcagcctcagaggtggacaggggccttctgcttcatctccttagagcagttcaggcctctccccatcagctctacaaggtcccaggccacaggcctggcttccttatcctctccctggctgcagatgcaggccccctcagggtaccttcccagcagccatcctggtcctggagatcaggcttggagcctggtttcctgacctcccatggcccttttcccctgtggcctccaggccccttcctctcttaggatgggagccctgctgccacaagtatggctcagtgataacatcctgccaaggcctctggggtaaagtcacaggcctgcagtgtgctggcctccctcacaggcctgcgctcccccaaggactcgagcgggaacccctcctgcttcctccagcttctgggggctccagcattcctgggcttgtggaggcctccctccaactccgtctctgtctcaatgtgggcttcttctgcctctgtgtgcctcctccatgttctcttacaaggacatttgccattggatttggggcctgccgggtcagccaggatgttctcatcccaagcacaggaagccaggaggacagtcctgctcagagccctgaggcccagcttggggacggcagcagcctccactagaggatggggtctgtggctgtgggtggtgtggggacccccggccctcagtgctgctgccttccaaccagtctcctcccacgcagacccgcaccatctcacccccactgcatgggccttccctgaacatcagccatcctgggacctggggctcttcttccaggataacagcaacatccggattgtggccatggagctggggcagacacaaaggtcactggagaggccatcactggacaagagacccagagccctctgaggcccagcactcatccacctgatgagctctgagcccggtttgttcagctggctgccctcagacaggaggcgtcgtggcctccatcccacccggccacgcacagattccacggccacctctctcaccaacaccactgcacccgtctgacaaatcccaacataaacccccagctgtattaggccattcttccattgctatgaagaaatacctgagactgggcaatttataaagaaaaatggtataattggttcagggttctgcaggaagcgtggcacccacatctgctcggctcctagggaggcctcagaagctttcagtcacagtggaaggtgaagggggaacaggcatgccacagggagaaagcaggagcaggcggggcggagaggtgtcccacacatttaaaccacccagtctcacaagagctcactcactattgcgaggacagcaccaatccatgaggatccacccccaggacccagacacctcccaccgggtcccacctccagcactaggaatcacaattcaacatgagatctggcagcgacatgcattcaaactagatcccctgctgcctgattctctgtgtctccacctagctgctaaacactgtttgaaaagtcccacacaagccatggatcaggcctcctccagggtgtggcctcctgagcagccatgcaattggcacttcatttattattattattatttctttttgagacagagtttcattcttgtcacccaggctggagtgcaatggtgcggtattggctcactgcaacctctgcctcccagtttcaaattattttcctgcctcggcctcctgagtatctgggattacaggggtgtgccaccacacccagctaatttttttgtgtttttagtagagacagggtttcaccatgttggccaggctggtcttgaactcctgacctcaggtgatttgcccacctcagcctccaaaagtgctgggattacaggcatgagccaccgtgcccagcctaattttgtctttttagtagagacgaggttggccaggctagtcttgaactcctgacctcaggtgatctgcctgccttggcctcccaaagtgctggaattacaggcgtgagccactgtgcccagccctcatttattatttattgatttagagactgggtctttctctattgccccgtctggagtacaataccacagtcatagctcaccgcagccttgacttccccacctcaagcgatcctcccacctcatcctccctagtagctggaaatacaggagtgtgcaaccatgcagggttcattttttaaagggtggggcttactcttttgaaatgtactaagtgacagctgaggagatgttccagacccaggaaacaaaagaaacctcagaccctgctctacaccactaaatggcaaaagcaagaagattgacgacaccaagtgttggtgaggatgtggggcatctgagattcccgggccctgagggtggagggacatggtcccatccagatgctgacatcaggagccagccccgcagggcctcatgaggtggcgtacccaccccacaacccaggcactcctctccagggtgcccgcccaagagaaacgaaacctgtccacacacagatcggtgataaacaccatgcagccttattccttgagccaaaagggaaaagacccaaacgtccatccacaggtgaataaacgtcctgtccatccacaccatgaatggtccattggcaaggaaaagcaatgaaggctggtaaaaagatacacatgcctctcaaaatcagcgtgctgagtgaaagaagacagatgtaaggggattggtttggctgtgtccccacccaaatctcatgttgaatttcccacatgttgtgggagggacctggtggcagataattgaatcatgggggcggtttccccgttactggtctcatgagatctggtggttttacaaggggaaacccctttcactcggttcttaattctctcttgtctgatgccacgtaagacgtgcctgtctccttcggccatagttgtgaggcctcctcagccacatggaactgtgagtccattaaacctctttttctttataaattacccagtctcaggtatgtctttatcagcagagtgtgaacagacaaatacataaagggacacttactctacaactccctgtacaagaagctctagagcaaaatgactctatcatgaaagacatgagaacagcagctgcccctgggtgggaaggactgaacaggaagggcctggaagaacctggggtgtggagtgtgctacatcttcatggaggtgggggctgtgctcagatacgcatgcctcaaaactcctcaaactctacacttaatatctgcacatttcacttcaatttttaaaaatagatgctacaccaagaggacattttcctccatcagagtggcaagaacccaaaagcttgatagcaccctgcctggccaggccggggagagacagccctccctggcatgagcacacacaggtgcagcccctctggagggcaatgtgcacacttccatcaaaattacaaatgcatgttctctttcacccagcgactccacttttgaaaacgttgcagtctataaacactctcgttcacgtgcccagagagcggcacatgtagaggcctactcctcacagcacagtgtctagaggcaaactctacagcagtctataaatactctcgtacacgtgcccagcgagcggcacgtgtagaggcctactcctcacagcacagtgtctagaggcaaactctacagcagtctataaacactctcgttcacgtgcccagagagcggcacatgtagaggcctactcctcacagcacagtgtctagaggcaaactctacagcagtctataaacactctcgttcacgtgcccagagagcggcacatgtagaggcctactcctcacagcacagtgtctagtggcaaactctacagcagtctataaacactctcgttcacgtgcccagcgagcggcacatgtagaggcctactcctcacagcacagtgtctagaggcaaacttcacagcacctgcaaaggaacaggtgtactatgctacctatgctaccttttgcataaacatggaaacatgaatagattcagatttgcttgtaatttcctaaagaaactctagaagacatttgagacgttgataatagtgattatcagctgatgacataggggctgttgtctagaagcatctataagccacaattaacggcctgcactaaaggctgaaggggtgtgtgtccaccaggaaaggaaaacagatattgtgagagagcccttgagaaaataaaccagagtggaggcgtggcctgcaatggccacacacacaattcacacacactcacacacagtcacacactttcagacacacgtacacccacacacattcacactctctcacacatacacacagacacacattcacacacagacactcatatacacacactcacattcacacatactttctcacacacacccacacacatgcacacacactttcacacacatacacacattcacacacttacacacgtacacacaacacacattcacactttcacacatacatccacacactttcacacacatacaccacacactcattcagacacacactcatacacattcagacacacagacacacacatacacacccacacacatacacatttagacacacattcacacatacacccacacacattcacagtcatacacacatattcacacacatacacccacacacattcacagtcatgcacacatttacacacacattcacacacatacacacccacacactttcacagacatacacccacattttcacactttcacacacatacacccacacacattcacactcatacacccattcacgttcacactcatacacacattcagacacacattcagacacacattcagacacacacatacacacccacacacatgcattcagacacacacccacacacattcacacttatacacacacgttcacacacatacacccacattcacacacactttcacagacatacagccacattcacactttcacagacatacactcacattttcacacacactttcacatacatccacacacattcacactctcacatacatatatgcactcatgcaccacactcacacattcacaaacacattcacacacactttctcacacacacacattcagacacacattcacacacacgttctctcacacatacattcagacacatgctcacatatgcacccacacacttttgcacacactttcatgcacacatcccacacactcccacacatacgcactcatgcacacacacacacatacactcacacacatacactctctcccacacccccagcagatagccctcccctgttaaagacaagttactattaggaagtgacttcacacctatgcataaatacttcaaaaattaaaatgaaggaattatacataaaagacaaatgaaaaacattcacccctgggagaacgacccaaggaaacacaggcaaagttcagacaaaaaggtttcttctgcttcaagacaacctcatctcctaaaagggagaagcgctcaaaaaggagatgtgtggtttcaaagaagagatgataagataacagaaggtgtgagccactggagcccagaaaagagatggaagagagaagttgattggagaccataaccacatctgaacaaagagaaaaataaacatggctgaaaatgcctttaaaaggataaagtgttgagcttgaggaagtcacacacaataaagtgaaagtttctacaatgtaaaaataagacggtaagtacagaattcaaacaaagaagatataacacatgcacaattgatgttcctgaagaagaaaacaaaacacataagcctgaaaaaaaaaaaatagactctgggctatcacaaaatacatgttccttaagcctggatctgcagctctgcagagcacacattctgggggcaggagtggggccagcaaaacagcacgatgtatgctgctgccattgttaaacttcagggggttggaaataatcagacggagcatcacttaaatatcagaacacagtagctacagagttctgatggaaaaaatgtttgacttgaggattttatatccgataatcctgacttgacgtataaaggaaacagactcttaggtaggcaagaacttgaagaatacacagcgcccacaggaggagaaagcggggatctcccgggcctgtggcagcccgagattcccattgtcccagtgagacaggaggtggggcttgactccagaggaagggctcagacactggaccagattgaggactagctaaaacagtgctggggtgaaagcagctttcaatcagacctgcccaccagtgtgccatgtcaatttactgttgtcatggcaacgcccaggagttactgcctctttccatggtacccaatgatccaaaagttactgccccttccctgcatactccttaatctgcatgcaattaaaagtgggaacccaagtgcggtagctcacacctgtaatcccagcaccttggaaggccaagaccggtggatcacctgaggtcacgagttcgagaccagcctggctaacatggaaaaacctcatctctactaaaaatacaaaaattagccaggtgcagtggcacatgcctgtaatcccagctacttgggaggctgaggcaggagaatcgcttgaacctgggaggcggaggttgcagtaagctgagatcacaccactgcactgcagcctgggtgacagagtgagactctgtctcaagaaaaaaaaaagtgggtataaatatgagcagaacagccctgagcttcccctctttgcctatggggtagcccggcccagcaggtgcagtcttggagctataacaccactgaagctgtgacactgcagcttcgataaagctgttttcttctgcctctggcttgcccttgaattctttcctgggcaaagccaagaaccctctcaggctgagccccactttgcggcttgcctgtcctgcatcaccagcatagttgtccatagcaaactcttgctctaaaaagtgctcaagtttgagagggaaagggtgctacaaaggctacaaatgacattagtagaggctggatgtggtggtgcgcacctgtggtcccagctactcaggaggctgaggtgggaggatcgcttgagcctggttggttgaggctgcagtgagccatgattgcacaactagacttcagcctggtaacagagctagacctcatcttttaattcattaattacaggatattattagaacatctgacaacattggaatacagatggcatatcatgtaaaaatacttcttattaatactaatggagatgtatgaggttgatgactgtgttgaggttatgtaagagaatactcctgttcttacaacacaaatgatacagcaaatgggatagaataataggtaaatctgagcaatgggtatatggctattccttgcactctttttgcttttgtgactttgtctaagtttgaaatcatttccagataaaaagtctaaaaagtagaagtcaagtgctccaggtaggatgataaattacacggtgagccagcacaggggcctctccagcaacctcagatgacaaaatccaggtgacaaacgctgatgaagacaaaactcaagggggtaggaaccacagcaaaggctggggacaagctctggaatcatctgaatgttaaaccgggtgacagtgacaatggaaaccacggtgtgaggaacagaagttaaatgttacaaactttgatcacgtccaaaaaataataacgttagaaagcatggaggggttgggagtaaaaatgtaacttggaacccggaacatctggtttaccaacgtggagttcccttcgttcgcaagctctttcacggtagcttttagcaggtcttccagtgcttgagtctctgtgaggtgaaacctttatttcaagtgtttccttcggcttcaccttggtttgttcttgtgaaactcaaacacaggagatgctctttctgataaacgatgcccgtgactaacattatttctactcctgtccctctttccagttctactggacccttggaggaaagttgtcctttgtgagattgaacaaagttggttatctggaaggagagtttggagcatgcttttgacttcctcttggtctcctatgttactcagtttttaaatatgaggccggacctttcttacaaaacaaaaccatgattcttctttttaaaggggaggaaggggcttagcaccccatgccgcctgcctgagatgtgggggccatgatgctgctgaacgtccctcggtctccagggctttcccacacaaccgtggaggagatccctgccgtgtggtcacctgggttgctgccccgatgtggagcggtccaaccctgcccgggcctaatcagcagaatgacagccaggcatggctttctgcatcttgagggaatgcatgtgggcagcaggaccaactcacatttcacctccagaggaaatgagatgcatgttttccaaaccctgggattccaaacacagacctgtgaatggctttcgttgatgtgaagtcttcacctttcatgcacacgacttcatgagggctgctccccattctccagagctgcgtgcatgttgctgacagttttttaagctgactttatttttagaacagttttgacaggaatattgagaagatgtcacagagtccccatatagccctcacacagcttcccttattattaaaattttacattagtgctgtgcatctgccaccactgatgaaccagtattgaaacacaagtattggctaaaggccctgttctacatggtgcattcagatttccctgattcttccctaatgtccttgccctgtcccaggaagggcccgtccaggacaccacatgacatttggtcggcatgtctccttaggtgcctctcggctgtgacagtttctccaactttccttgtttttgatggccttgacagtttttaggagtaccagtcagaaattctgcaggatgccccactcttggaacgtgctatttttctcatgagtgactggtgttatgcgccaggggaaagaaagcgcggcggcagcactccactggcgtcacatcctacccagggcgcgtgctctcaacaaggctgtccttgctgacattgaccttggcccccggctgaggtcgtgctgtcagtcttctccgctgtgaagtcactgtggggtcctaattagggaaaaggagtcaggctgcagggagcaggggaagcaaaaagaagcagcagaagaggtataagtctgcctttcttcacggtgcaggacacacagccctcctgcacagataactcacaatcttcctgcacccagctatcaccagaccctcagctgatagaaaaatgcaaggtagctccctgcaaccctggcgttatcagtaccgcacgcagccctctgcagcccaagaaccatcctataaaacctccagcaagcctttgaaccccagcagtcagctcctcttctgctgagtccgcctgtttcctcctcgcaacgtattttcctattttctctaataaatctgcccttctttatctacaactgtcttgggaaattctttgatgctccccctaccccggaccaccaccacccagatagtcatcacccccctcaacagttatcacctgccttccataccacactcttgggaaggaagtcaaggtgcacagcccacacctgaggagggggactcgcggtcccctccttgagggcaaggtatctgcgtaaattatttggaatcctttggcaatggtgatttgtctcttctttcccatgtagtttattcagtcactgatgtctgtcagcactgactcatggacacctgtgtcatattttgggtcatgactcaaccctactttattttgttgctcaagttgttctggctttggccattgggagctcttccagttggctcctgtgtccctttaaggtaggatttggagattttttttagtacttcctttctatagatttatcttgtatatttcttgccccagtcccagaatcagccatttctctgaggagccctgtttctttttattggagaacagtattagaagccaagatctgagcactaggtgtgtttattgctactggaatatgattgcttctaggccgtctcagatgacagaggagaggtatatgtatactaattaacgcacatacgcatatctataaatatttctatatgtaatcgtttgtatctgtattatgctaaacatgagtttatactgataccttccactcaaattcaataatgcatgaaccattctagtctcatcccctgctttatctgtaaatcctcagagtgagaagcctgactcccactactcatgatccatttactgaatcactcaattccggccgggcacggtggctcacacctgtaatcccagcactttgggaggccgaggtgggcggatcacgaggtcaggagattgagaccatcctggctaacacggtgaaaccccatctgtactaaaaatacaaaaaattagccaggcatggtggcgggcacctgtagtcccagctactcaggaggctgaggcatgagaatggcatgaacctgggaggaagagcttgcagcgagccgagattgtgccgctgcagtccagcctgggtgacagagtgagactctgtctcaaaaaaaaaaaaaaaaaaagaatcactcaattccagtgcacatgagctgtgggatcagattgtgaatctgtacttccatgggaagcaccataagctagagtgcagtgcttatgctcagttcccttttgcctttggtcttacccactccactcatttatgcagtacccttagggcagcacctgctctcccattgtctcttcagtgaggtaattttacacatttgtaatacagttggattctctggtcacagtcagtattccctcctgggatcccttgacctcctaaataatttttttttatttgtatacattaagagttcctctgggctataaagttctataggttttgacaaatgcctgtcaaatatccattattacagtgcagttttactgtctgtgtcccatatattcatccctccctcccaccaaccactggaaaccactggatgttttactgtctttgtggatgtctttttcagaatgtcatatatttggaatcatacgtaggtagcattttctttttttttttttttctaggcagagtcttactctgtcgcccaggctggagtacagtgccgtgatctcagctcactgcaacctctgcctcctgggtacaagcaattctcctgcctcagcctcctgagtagctgggattacaggcacatgccaccacgtttggctaatttttgtatttttagtagatatggggtttcactgtgttagccaggaatggtcttgatctcctgacctcgtgatccacccacctcggcctcccaaagtgctgggattacaggcgtgagccaccgctcccagccgtaggtgacattttctgactggcttctttcacttagcaatacacatctaagattcctccaggtctttttgtggcttgataggtgggtttttaatcaccaaatattccattgtatgggtgtacaaagtctatctgttcacctattgaaggacatcttggttgcttttcgttttgagtgactgtgagaaagctgctataaacattcatgtgcaagtttttgtgtcgacatacgtttttaaatcagttggataaattccaaggagtgcaattgctagatcttatggtaagagtttatttactttgtaagaaactgctgaactgtcttccaaagtggctgtaccatttaacaccccagcagcagggaatggccaggcctggtgccctgactgctcaccaactttaggtgccatcagcttcttttctttttttctttccttttttgttttcactttcaccattctaatctgtgtgtagaggcatctcattgttttaatttgcaattccataataacaaatggtttcaaatatctttttcatatgcttatttgccatctgtatctttctggtgagctgtctgttcagatctttttcccattgttaatcagaatgtttgttttcttattgctgagtattgaggtttctttatatattttggacaacaattgaaagattaaatatacaaatggacagaccttatagaaatagaactctgaccaataagttgcaggaagcagccctggaaactaacccattatctatagtaaccagcccaggaagccagcctgctatacctcagacttgtaagatgtcagatcgctatctctaccaacagtccaggaagccaaacaatagcctttgcaacaatcagccccaaatggccaggacttgacttataactgactccgtcccatttttttgttcccacttccaacttaggatcaaccaaaggaagtcaaatgtgctcccctaaccaatcacataggagccccacttctagatagctaccccaacttctccaggtcaatagcctccaatcggggcaccactgaggcttgccattttcaatggtgtctttcacagaacaaaagtttttaattttaatgaaatctaacatcaatattttctttcttgggtcatgcctttcgtattgtacctaaaaactcattgccaaacccaaaatcactttgattctttccatgttatcttctaagatattatagttttgcaatttatatttaggtctatgatccattttgagtttatttttgtgaagagtataatatctgtgtcaagattcatctttttgcatgagaatgtccaatggttccagcactatttgttgaaaagactatcctttcttcactgtattgtattcacgcttacatcaaagatcagttgactacacttgggtaagtcagtttctaagatctgtattctgttccacttatacactttatacattgttggattcaattagctaattttttttttttttgagacagtgttctctctctgtcgcccgggctggactgcagtggtgcaatctcggctcactgcaacctccacctcctgggttcatgccattctcctgcctcagcctcctgagtagctgggactacaggcgcctgccaccactcccggctaatttttatttatttatttattttagtagagacagggtttcaccacattagccaggatggtctcgatctcctgaccttgtgatctgcccaccttggcctcccaaagtgcagggattacaggcgtgagccaccgtgcctggcctcaattagctaatattttgttgagaatttttgcatctatttcatgaaacatattggtctgcagttttcctttctcataatgcatttatctagttttgctattagggcaatcctagcctcataaaaagaattaggaagtattccctctgcttctcttttctggagatattttagagaattggtaccatttcttccttaaatgactggtagatttcaccagtgaaaccgtctgaatctggtgctatttttccagaaagttattaaccatggattcaatttctgtaatacacatgtgcctattaagattacctctttcttcttgtgtgagttttggtagtttgtgtctttcaagaaatcggttcatttcatctaagttatcaaacttgtggatatagagttattaatagtattactttattatctttgaatgtccatgggatcagtagtgaagtcagtccggctcagacatccacagaatgaacagattatgaccctccgctgggcctgggtccagaggttttgggcattggcctcaggggatttgagaccacatttgaaaactttgcatggattgctgagatgtagtccgaacttgctgtgtcactgggtttatttccaacctctggcctccccatctttaactggcttatggtatatggtataagtttgggtaagcatcttctttttgagacagggtctcactttgttacccaggctggagtacagtgctacaatctcagctcactgcagccttgacttcccgagttcaagcaatcctcctgcctcagcccctccaagtagctgggactacagggatgtgccaccatgcccagttaatttttgtattttttgtagaggcagggtttcttcatgttgcccaggctggtcttaaactcctgagctcaagaaatccacccgcctcagcctcccaaaaatgctgggattacaggtgtgagccaccatgcccagcccaatcttgcctttcagttttacccaggtgaagtggactattgagttctggggtcccagtagttgtctattttgaagcagacatgttctcaggattggagactgcagcccaaagcatggagatctggggcctttgggcagagatgggagggcttgtctgtgcccacacacagctgtggggctcagaggggacagttgtacttcactagggtcactggctcacacagcacaatgtggacataaaagtccaggatacaaggcaggcacacctgatggggagcaattggagcacggaggcaaggttcacaaacttgtctgcctagagcaactgcagaaaagtactgacacctgggccccataacccatgtcagagatgctcactcagttggcttggggtacagccccatgttcaggtgcccttgagcaagggccaaacacaggcattgactgcactttggagtaggaagaatgaagtagatgagcagaggtgggggaccttgtcgagggatccctcctcaggaggccaaggtcttcatccaccaagtgacaatgctgccttcgcctgcgacttggaacactgacaactcctcacaggagaagctggcggagccttgtgcagaccattccagtcccatgaggtcatcctcatacgtactaacaagctaaagagaccagacaagcccgatacctcccactcagtcttgaaaacgttgatgccttaaacctcccactagacattaaaggaagcttctgcctggggccctgcatgagaagggaggtgagccattggatgtcatcactgtcagtcatccagggtacaagaggagcctcaactggtgtttgcacaggacttgactacagaggcataggtttttgccttttcctccctggagtctatagcttggcttcaatcccaggtaaatgtcagaaggaacctggaaaaacttctagaatgcctaagtgcagccaagtaaacagaaacaggtttaagaaaaatgaacaaaatgtattggcttgtctaattgaaaagtccaacagaagagtggctgcaggctcggctgaatcaaggtgctccacgatcagcatccatctgatcccccccacccatgcttttctttcctctgcactggccactttctctcacaggctttccattcaccggaggaaattgtttccagcattggactcatgtctttccagttcaggaacctcaaagagaaggaagtctataaaccacatcctgcctttcatttttggactcttttctgttccattgacctatttgtctatcttcatagcgataagacattatttttattaatgtaggtttataataagttgaaattggatagtattaattctacaactttctttttttctccaagttgtcttgcctattacaagttctttgcatttccatatgaatattagaatcaacttattaattcttacaaaaatgcctaatgggattttgattgggattgaaatgaatctatacatcagtccagggagaattgacatcttaacaattttcagtcttctgatgtataaatatagtataaccattcatttatttagatcttttttagtttctttcagcaaagcattgcagtgggttttttgttttgttttgttttctgtttttgtttttgtttttgttttgaaatggagtttcgcttttgttgcccaggctggagtgcaatggcccagtctcagctcattgcaacctccacctcccgggttcaagcaattctcctatctcagcctccaaagcagctgggattacaggcttccgccaccatgcctggttaatttttgcatttttcgtagagatggggtttccccatgttggtgaggctggtctcaaactcctgacctcaggcaacctgcccgcctcagcctcccaaagtgctgggattacaggcgtgagccactacgcccagccagcattgcagtttttagtgtacaggtctctcatatatcttgtcagatttatctcaaaatatttattttatatgtttatattataaatgggtttgttttgttttgttttgttttgtttttttgagagagagagtctcactctatagcccgggctggagtgcagtggctaatctcagctcactgcaagcttcacctcccgagttcacgccattctcctgcctcagcctcccaagtagctgagactacaggcgcccaccaccatgcccagcaaattttttgtatttttagtagagacggagtttcaccgtgttagccaggatggtctcgatttcctgacctcgtgatccacccaccttggcctcccaaagtgctgggattacaggcgtgagccaccgcacctggcctatacatggtatttttaatttttattttctgattgtttgctaatagcacatggcaaacaatagatttttgttgattgatcttgtatcctttcactttgctgaactcgcttttttttttttttttttttgagacggagtcccgctctttagcccaggccggattgcagtggcacaatcttggctcactgcaagctccgcctcccaggttcacgccattctcctgcctcaacctcccgagtagctgggactacaggcgcctgccaccgcgcccggctaattttttgtatttttagtagagacggggtttcactgtgttagccaagatggtctcgatctcctgaccttgtgatccgcccgcctcggcctcccaaagtgctgggattacaggcgtgagccaccgcgcccagccagaactcgcttattaattaaaatatttttaaggattccattacactttgtatatagatgatgatgttgtctgcaagtaaaaacagctttattgctccctttccagtatggacgccctttatttctttttcttgccgtattgcacagactagaacctgtacaatattgagtagaagtgatgaaagagaacacccttgtcttgttcccagtcttagggaaagagcattgaagcttttacattaagcgtcacgttcactgtagggtttttacagatgccttttgtcagattcagaaagtttcctgctattcctactttgttgagagtttttattattaaagtatattgaattttttatgtttctgcatttttggcttcgtcatatgatttttcatggttttattaatatgataaattacattgattgattttctgatattaagctatacctgcattcctgacttaaatcccacttggttgtactgtctttctttaactaaactattgttaggttcattttgttaaaatgtgtttagaatattttcacctatgttcatgagggatatttgctgtaattttcttttattttaatgtcttggttttggtatcatagtatgatggcctcctggaaggagtattccctcctcttcagttttctgaaaatgtttgtgtggatttggtatcatttcttccataaatgtttggcataatttgctagtgaagccatctaggtgtgaggttttctttggggaagaatttaacagtaaattcaacttttggaatagatatagggccaaattatctgtttcttaagtcaactctggtagtttgtatcttttgagtaatttgttcattttatttaagttgtcaaatacactggtataaagtccataatatgtgcctttaccatccttttaatatttgcaaaataaatttgcagtgatgtcacctttctccttcctgatactggtaacttgtgtcttctcttcttttttcttgatgaatatagccacaggtttatcaactttattaagcttctgaataactagcttctggtttcattgattttctctattattattgcattttattattttctacttcattgatttctactctgatctttattgttttctttttctgctcctcaaatttaagttgctcttctttttctggcctttaaggcgcaagatgagaccattgattgaagttctttcttttttcataatggaagcatttttaaggctaaaaatttccctctaagtactgctctaatggcatcccacaaattctaatatgttttcattttagttaaatataaatacttcctaaattatattttaatttattttttgaccattgattatttataaatgtgttatttaattaagtatttaaggtttttacagatttcctttagttattgatttctaatttcaatccactgtggtcagagaaaacacttttgtatagtttgaatgctttttaatgtactgagacttatggcccataatacagtgtatcttggtaaatgttctgtgtgcacttaagaagaatgtatattctgctcttgtgtggagtgtcttataaatgacaattgggtcaaattgattgacagtgttcaaatctatttttcattagtttttcctacttgttctatcaattattgaaagaagactgtaatgttcgtttgtctatttgtcctcgtagttctatcagtatttgtttcaggtgttttgaaactctattgttaggttcatcaacgtttatgattgataactcttcttgattaactgacatcttggtcattatggaaatgaccttctttataccccaacaatattgtttgttctgaaatctacttggatattggtataaccataccaattttcttttaactaatgttagtatagtacatattttctcatacctttactttaaatgtatatgtgtctttacagctaatatttgtttcttataggcagcatatagttaggtcttgcttttttatccaatgttaaaatccttatcttttaatttgggtgtataggccatttttacttaatatgaatgttgatatgatctattaaattctatttgtcccaatttgatttataaggcaggatttgaacagatatttaaccaaagatgatatctgaatggccagtgagcatgttggaggattctcaacttatttttccattacaaaaatgcaaattaaaactacaatgacatacagctgcacactacttagaggggctaaagtggccgccctcacctggtgctggtgagaatgtggatggactagggctctcattcactgctggtaagaatgtaaaacagtgcaagaacttcggaaaatagtttggcaggtttttttaaaagttaaacatgcacctgccatatgacccagccattccactcataggtatttttacccaagagaaaggaggtttttctatacatatatctgtatatcgatgttacatcaacttcatctgaaattgtccaaacctggaaacaactaaaacgcccaccgacagatgaagagagaaattgctcctctatccatacagtggaacatactcagcaacagacggatgaactgttgatacgtgagacaacatggagaaatctcaaaatagttattctgagtgaaaaaacagacaaaaaagggagtacatatttcatgactctatgtgtgtaaaattctagaacacgcaaactaatccgtagtgacagaaagcagatccatggttgcctggggagatgaagccacaggagatagggaggaaggagaaagggagttcgaaagccaagaagaggctttaggagcggggatttgtacatcttgattgtggtgacgcttcacaaatgtatatatatgtcaaaacgtatcaaattgtccatttttaatatgtgtcactaattgtatgccaattacaccccaaaaaagctgtttttcaaaaatccaacttaaacttagaatttaccaccaaaagaatacaaataaggactaggccttccaaaacactagagaaaaaataaaatagtaaagaaaacagctcacaaagccaaagatagggaaagaaaaaggataacaaagcataaataacagatgtatcaacaaacatgtctgttttgacaataaacactatttaaagaaaaccatccaaatatacactcctcacaaagggtacacgtaaaataaaatacttaaatgttaaaaagaaaaggaaagcaaatatatgttaggcaagcataaacaataagaaagagagttggtaaaatgagtatcagataaagccaaaaagcactaaaagagacaaagagtaatttgattctgaggaacaattaaagacccaatgagggcacagcaacgattaacctttaagcagggaataatttatcatccaaatctacaaagcaaaaactgtaagacatacaactggaaattagcaacaaaaaggcaaatgttagccccaaggatcaagctatataaaggcacactttgtttaattgtgtccatttttaatttgaatggtgagattgttttgaatgagtgggagaaaatttacatcctccaacagcgactgtgagacacagcttgaggagtgcatagggaacccttagccctccctccccacctgcccagccctactttgggccacgaggagaggaggcagagcagagactgtcttcagccatgagagtgatggtgtgtgagagactattccttctcctagtggcaaacccagctcagagctggctcttctttctccctagagcccaggtctccagcccaaggaaccgcctcaccttgtcatcccaggagggttggtgcccacttatctgcagcttcctgacccaaatagccagaccttccacaggtttgcctacaagagggctagtgcgtcctgcaactcagatgcttttccatcaaaataaatgcccatatagaaggagtcaagaataaatacccacatccaccatcgcagtgtggtaagaacattacaaggacactgatgagaatgaagccggacatcactgagccccaccgtcctgtgtcatgttggctaaggccccgtgctccgtcctgtatgtaagaagccagccgggtgcctctcagggttctgggcatccctggggggttacgccctgtgctcactctggctggaggccccgactccagcagaggccactcgccccttcctcggctcctgctgccgctctcttctcctgagtccatgaaaacactgacgccaagttacatcctgttccttatttgtcccaacactcctccaagagcccaaactactgtgatctcaggagctggaaaaagcttgccgctcagaaaggcaaacaccttgcacatcttccaccaggacacctgaagtcaagctgctccccacaagaggcacaccagtgcagatggttaaacgacaacttctgcacccactcctcaaagaagtccataatctcttgcctcctcttggtcctgggagccatgtgctctctgcactcttgccttgagcccagtcccagctctgggaggcatatgctcctggccatcacccctaatcaaatggggaaactgaggctgggagaggataagggactcagccaagattgtaaccctactaggtttgtagcccactgtgcagcgcgtcaatacacagatacagtgtattgcactgggttgcagcaggggaagactttagtaattgtagggcagccgaatgaggagatgagaggaaacctcaaatccacctgcccaggaagtttgggatgggctcttaaggggtctgggcaggtgatgggctaaagtgtggggattgctgactggtggagaagtgtggaggatgaagaaaccgcattcctgtactttactgcttccttggtcgggggtcttcatacctgttggcctcagccgtgctactagaattcaggatctgaaaaacaccttaagcaattcttgagtaaaaagacccagggccagagagtctctctggtggaagaacggggcagcaggtgctcagcctgccgagggactctctgtgcattagagctgcaggggactgggtggaagtggccctgcacacccgggtcggtgcctcgctataactctgcctgaagcctggcttggattgtcgttaaccctgtgaggtgattcagtgtggagtcaggatccaatatgggtttatttcacatgctaacaccaaatgagagccagatatttgaaaatgcagatttccaagcttctcgggagcaccctcaagtaggtcagcggctgctccatcgggccccacgtcgctcaggcttaagtaaaacgtgcctggcttcaggcagacgagtgaatgtgagtgtgtctgtgagtgtgtatgtctacgtctgtctgtctgtgagtgtgtctctgtgtctgtgatgactgtgtctgtcagtgtgtctgtgtgagatcgtctatgagtgtatgtgtctgtgtgtgactgtgtgtgagcaaatgtctctgtgtgcctgtgtgtgtctgtgtaagtgtgtccctgtgtgtctgtagtgtgtgtgtctgagtgtctgtctgagagtgtgtgtctgtctgtatgcctgcaagtgtgtgcgcgtgtccctccatctgtgtgtctgtgagcacctgggtctgcatttgagacccctgccctcaccctacaatctccctgctgccacaccccaaagctccagcacattcctggaggaattagagagacgatgctgtgccactgccctccctttgaagtgcacctgatggggacacagggtctctgccatgatccccactggggccttgcccctgaccgcacacactgtcccatctcaggagggtctcactgctgccctttcctggctgtactgatggcccaaggggatgcgggaaccatcaagaccgagtccctctggaggtgcctcatccccgcaccgcccggccctcagtgcaccctctatggggtagcactaagccatcccccaggttgcaggagggagatgaactaatctgaaacattaagtatggctttggaaccaacttggctctccggatgacaactcccttgttccagatggttcctgtgtgcgcccgcgttcgttagcatgctaatttattctgactcattccggagctggcgcgcgggctggcgcacacctctatgccagcacgagtccccgaggcccgcgattcccagctggagcggccccctccccgggggctgtcacacacgccgaggggaataaagggaagggaacagttggggatgtggcttcagtggcagcccaggcaggctataatttcagccctggcgccctgacattcacagcaagctctcgctctgtggcagaatcctctcggaaggcagcgccaccctctgaggacgttcaggctgggaggtcccgggtggatctcccgctgcagctaaaacaccagtcaggcccccacaaggaaacccagagcaagcaaacaccgaggaagaagtcgctccctcaaaggcagcgtctgggggctggtaggaggctcccggctgccggccccacccctggttgtgaactctgtgaccaagacagcagggaccgagggctacccacactccacaagcgggagggatgggagccgcccgtcagtgccctgcccacctccgggtgcccgccttccctggaaacattcccaccgtcttcctgcagctgaagcagcggaatcaccctgggatggcctggggaggagcccgcagaacgacccgcatgaggacactgagctgcaggaagcacacgcagggctggggtctccggaccgtggggcagaacttggggggtcagagagaacacacacattcgaatccctaaattcctggttcaagggacagaccaaaccccaggtgctcggtgggaccacgggagaagccggcttagctcaagaaggcacaagggcagtggccaagtcccacccccaggctgagccctgccagacgccctttacaatgtcagcctgggagtctctcctgagtcagggcagccatccacaaagagtggaccccctagaagtctggggggtgtccttgaataacactgtcatccccaaatcagagagggagttcaggggacctggggatgaggggattcaggggacctggggatgagggagttcaggggacctggggatgagggggttcaggggacctggggatgagggggttcaggggacctggggatgagggggttcaggggacctggggataagtggagctctgcccttcagcggcgcccggagggcccgcaaccccatccccatgtcttcctcaagctcctgagggcgtacttggaaaagcacttcatgaattcccacactggtcccctgaccccaggactgaggagcaacacggtgggacccggcactctccctgctgccaaaccccaaagctccagcacattcccggaggaattagagagacagtgccatgccccaaagatttggaaatgcagtcagttctccctctacccgcaagcacggcttctgacgcgatgacactgtaaatacaactcggagctgcacccggcagcagctgctgctccagatgcagggtcctcatgggcatcagccaggcacctggttttccctcccgtccaggaaatcaggaaccctccagcccttgggctggagggaggctggggcgtctccaccacctgctctcagggacaccgcagcacccctctctgtgacagagtttggtccacagaagtgatggctgcagcactacctgggcctcatgctggcccatgcggggggactcaccatagaaccagagacggacacggagcaccttacctgccagaggtgggagacaagccccactgggtagcacagctcttgacacagccacgaaggagggagtggcaggcgagggagaggggacaaagcaagaccaggcccttccttccacccctgatgaccgagggcatcaccgatgcccaagggttaggccgctgggaattccgggcaggcggctgcagtgggagagttccagaagagagccctcccagcgagtaagatcctcacgtgagagagagctcctggctcatgttgggcctgggaggctgtagacacctgacaatgggacaccaaatgacaaggtggcccagctgccccatgtgaactggaggtcccctgatccactaagccctcgagctgggccacgcccaagatgctcctccctcaccaggtgaacgccacatgtgccgggccaggcccatgtgcccacaggccctcaggcacccacggctacacctgtggcctcatctgtggctcccgggctggctgatgggtggtctggaggctggtggcaagaggcatcatccagcagccaggcctgagcagggcacaatgacagtcacgtttccatgaagtgggagtgatgtgaagccacagtcctgtgggcccccaggtgtggccagaggctggccatgagaaggaccgagctggtgacaaggaggaagctgttggtggcaaggctcgttggaacagacacgggctgtacacacatctgcatccaggtgaccactcaggaagacccagatggggaggctgtgaatgaccaggtgacaagacaccccagcaggtgagccagaacaggggcaaggtggctccggggcggtgggggctcggcaggggctccggggcggtgggggctcagcagcacagactcccctcagggatgcccctgcttgggtccatgttgtccgcagccaccacccaggggacactgccaactgcctggtgcaggttggttatgttgggtggacaacaatccatcctctctaggaaagatggccattcggtccccagcccctggccccagcccagctttccaaatgtcttattccccagcaggatccccacagaatgccacttctgccccaggagccgctgcagaggggaagaagggaagagtgagcaggtgtcatgggatgacccggtctcatcccaaacccaccatgagcccctgtgaacagctagaagagtgcggaagatgaggggccgcagccttcttcccaccacaacaagccaccaacacagaggctccccatggcctgagtcctggggtgtgagggctgcacaggacagggccctgccctgcccccaccccagccccagcgttctccccagccccactccccacccctgctccaacatcctccccagccccactccccaccccagccccagcattctccccagccccctgccctgcccccacccctgccccagcgttcttcccagccccctgccctgcccccacccccgccccagcgttctccccagccccctgccctgcccccacccccgccccagcgttctccccagcccccgctccccacctctgccccaatgtcctccccagccccgcttccacccctccctcaccggtctctggtctgtccctcctgtccctcccagcccctcccagttcggcccttggaggttccacaaacgaggttgtcaaatgcctgtccaaagcacgtgccaatcaggcccagagggttttacagcctctgaggaggaggaagaggagttggggagccatgcctccccatccaggaagacaatattccaccatcaaggacacgaccctgggtatttacagatggtaatgagactgtccactgcttgaagttaccatcaataagcagtgaaaactgctgagtttcatgcaattctccctgattgcctggaaggcatcattattttaataaaaaaactcatcagccagcctacccagcgctcagcgtgttaattacagaggctagtgccccgcctccctctctcagccccagcttgactcttctccccacagcctttgatcccagggagtcggggcaggtggatggtgccgtccagtggggaggagtcccagccctgacccctctcaggtgcccagaccacctccccaccccacacagcacaatcctggcactgtcctttcccttcaaccacaaggactcactgggccatgggcacagaccaacaccagtcaagcccaaaattctatgtggcccctaaaagcaaggggacaaggacaatgggaccccaagaacagcagatttcatgaaaaggacccaagaagccaaggcatgtccagcacagcacgcagactgggtcaggcctgtctccagctacatggacaggcgtgtccaaacacatgccacaaccctgcaaaaagcacaaaaggaggcaccacacacattcgtcctcattgtgaatgcctgcagtgcgtctgtcatcatggctgggggaacaggcccaggcttttttatggtaaaagaagtgaattgaaagaggaattgtgtttcctctccgtaaagatgatagcacaccaggatgtccccacctaggggagaccaatgacagccttcccattatctcctgggccttctgggggcaggacctgcagccgctgattctgcccaggcatcagtgaatcctcttgaacataaatgtatcttgggtcaccttgcagccagcaatgaccacacagcacagttctgggccactgatgtaaggagcggccctgggtgggtgccccaggaagtactatagaagaataagactcagccatcagtcttgcttccctctttcactctcttctgtccttggtcctgacccttcttcctgcctggaacacggatgtgatgctggaggtgaagcagccatcttgcaaccatgaggctaaaagcagaaggacaaaagctaccttgcagatgaatgaacagaaagacagaaagagcctgagtccctgctggcaccatggaccccacaccaaatttgggtgcctgctgaactccagacttcttgatacatagaaattgaaaactcatttgccaaaccatgttaacttgggttttatgtagtgcaaagttgaatgtattcctaagcaatgtacccaagaataattgttactaacaacaaaaccgaagaaagccccttgtagtgagtggaagtgaattcgtgtaaccgtgcagctccccagctcctggatcctgtatcccgcctgccctgcaaagtcaggcatagtggttggacttggtttggctgctggaatgggaaaagttccgtgtcacctccgggaagccgcattcagcgggcagtgctcagctctccacctacttctatgttcctgtttcagaaaacctgggacaggtgacacatgttgatggagaagtcaacgctcagccctccccaggagggcaggtgccctggaggccttagaggtggtgtggggccggcagtgtggagttgctgcagctgggagatggcttgttactgccacacggtgcagccgagctcaacgtgtcacagaaaatagcgggggaaaggtttaaatggatctttatcttgaaaagtaaaacctcaaaaatagtctgatattgcactggatagagatttgagttttcactgccaccctgcgctggttgttagaatgcaaggagaatgcattgtttgagtttgttatctgttctcccaggaaaatgattggccacgctgcacgggcggctgcatgtgaaccccccacgacagtcacaggcccctcgacacggtgctcagaccatctccctggaagcatccttccctccaccacccttagcaatcagctcgcctttgattttcacctggaatgactcagcgggcactgatccgtcagtggctttgcaggcacctgcgctgtcccacccatcattctcagctcccgaaaccgcatcagtcacaggcaacttaactgcagtccccggtgaccggccactattgggagactgaccaataaggactggaagggaatcaatgttggggcaagtttggatgagggggttgagcaggctgcctccctccagacatcccccaggggacccccttttcctctcactgtttgtgctcccagcctgcctctctctgggcctcctcccttcctttttcacctggacgcacctcctggccctacagaaagaatggaggtcggcaccccatctcccaggccaaggagggcagctccctgcagcgatgtcggggtatggagggcaggggccgggagcagggggcttcactccaggctacagccagttcccccaagtcggggtcaaaattacagcctatcccacggcccacccatcctctgccctcccttatccagtcaaggtccctatccagtccaggtgtgcaggtgagggattccgagctgggaagggcaggcagacagttcctgcaggctcccgctcacatccagggctttttagggaccctgccccaaaagaggtccttgaagccacttggagaatgcccagctgtggatgtgtccagacagcagccaaggacgctcaggccagcgggagccgctgagatcagccaggcccagcctagcccagtggacggctcctgctgcaccctccctcctgggctgggcctgccaactctcacaactcccactccagccacggccagacctgagatcctctcctccctgaggctaaaacatctaccacattcggctggtggctgccccagctctgcctcaggtccctgacaggccggccccctgctgctggcagccaggcactggagtgacacatctgtctgtgcccacacctcctcctggggtctcaagtcttccagaaggggtcgcgagtcttccaggaggtccgccccaacctgtgatgctcctgttgtgggcgggggagcagctatgacggtggggagaattgccagtgcaggaaggacccacgggtgctgctgtgagggtggttttggggtgccgctgtgagggtggttttggggtgccgctgtgagggtggttttgggatgctgctgtgagggtggttttggggtgccaagtgacggtggttttggggtgctgttgtgagggtggctttgcttccacctgaatgcagagctcgcctccttcggctctccctccccccgggtgagcagcccaatcccggggacctgtgctagcccctgtctcgtggcctgttactgctgaggacagacctgacggcagtcccggtaggtcagatcccgggggcacccgcgagacctggggcaggaggtgggcaggtgccaacctcgggcacaactccagtgcgcagcgtccatgcccgggtggctgccgtgttgtcctgctgtggctcagcctgtccccttcgcagggaattggctgtgggagatctactttgcaataaacccgtccataaaagtgaaatgtcgattgaaggctctgtctcgtggggaatcggttttgatgtccctgtgcatcttgcagaagcagatgctgggcctcagcagcatcacagggagctgcgcctggccagggaaagtctggaactgcccaaagaacttctgctcaccagacctgggccccaagcagcagccctgggtaacctccctctgggaaccagcgggacagaaccagggggaaggctggggacggggaggacaagggagtgaagggggctggaaggacagagagggaaaggaaacttctcacccacctccactcaccagacgccctccactcatctctgccaaacctgggcgatctcacctatgacatcttgcaatgagacaggcggcatcacctattttataggagcaccaggttaagccactggccgaagtacccggtaggagacaggctgtgtgcagaggccaggcgtgcgtcaggctaacttcaggagcctggactcagggtggtgggtagggccagaccacgggaggcacctggcacaaaacccaaggaagccctctcagggggtgccagcccctccccgcaccccacagggcccaagatcgtgtgcctcctcctcttggcatcctccacggatgatgcaccgggcctggtggagaaggcgtctctctgcggaagccacatcagcaaaggaaccaagaaggaaggggaccaaaataaccagctggccactgccggggcagggacgcccacagctgctgacagccagaaaagagagaccagcagaaggggcacacggccgggtgggggtcagagcagcacccccgtgggtcccacctctagctacatcaaccaacgccaggccaggcaggggactgaggacagtgggcgtggtgccaccgccacagaccctgggcacactctgggacaaacagccagcctctgcaaaacacaaactgcacaggggaaaagaccggcagaggcgcaaccctgtagaaacagacacaggacaccggggagatgtgaacggtagctaagtatgcaatgatgtgaagacgttgtttttcattgttaggtataaccacactgtggctacttttcaaggcggccttattgtttagcgatatttacagatacatgaatccaaccctggggatttgctccaaaccccccaggtgtggacatgcagatgctggagaggagagaggagactgcgggtcggcactgggaggctggcggagggaaacggagtccacagcactgtcccctccccgtggtgtgcttggaattctccacaaccaccttttgaggaaggagctcacatagagacccgcagaggggcctggccactctggggtgtcaggggcaacagggccccactgcccaacccatccactctgggaaggggcccttcctctgtgcagcccctccagtcctcagcctgggaccccccccccaccattgtgagccaaacactccctgaggcacaaggatccaggcctctcgagtggagggcgggagccgagcagggaaagccaaggccgcctggggtgaggagacaggagggcaggagggggctggagctgactggaggtcccaagttcagaggtggggcaccccatggccgctgtctgtccacagctctgtggcacctgtggatttggccaacaccccctccgcagtgaggggggacccccaagaggaggggccacctctgtcctgctgttccctaagccccagcactcacacacatccctgaatccctcgctgtgccaccatcagccttgcagccaccatcgggcggcgtcctgccttcctccctctgaaaggcctactttgggaggtcagcccgactcagaggcgaggctgcagagctggaccttcgggaaccttcacaacccagccacaacggcccccagcacccgcagcctgccgaaggcatgcttctatcctcagcctcgctgccctcctgcaggccggggcctccctcctgcaatgctggctgtgggtggctgccagcgaacgtccagctgtcaccccagcccccgcggcatctcctgtccccacacaacaagccaggcagggctcgggctgggaggaaggggccctgggctccccttcgtctgcctggactgtgagggcctggggcagtgtgccagcttcatcgaatgatgtcagagaagctcattccgctggagctcggagcctcaacggccacccaggaagccctcagagtggctgcggcccctttcaaggggagagaagggcaggagccatgctaggcctcggaggggtgggggtatgcctaccttggaaggcaaagacccccggactctgctccccgccctcccctcagcaccgctgtgactcctctgtgcagggggcaaactgcacctcagaagagtcccatggcccatggtcatggcagctggactcaagcctgagtctgcatggggtgacaccaggagcagcagagccaggacttctggtggccctgagctcctctgcaccagacccctgagcccatcccaggcccagggagcccaggctgggagggggaggcaggctgccactgagccatggagaccagtttcccccagctgcccagggcacggggcagccccagcatcgctttgccatgttcctaacccacaccgccaggccccgtgctccagagtgagcctgtctccgatccaatacgctctccttcctggctaatccagttggagacttttcaacctcactataatttacaaggcagctggagcacaggatatttttaataaaaattaggtacaagcagatacaggggattaatagttgtattatgattttatagttctccatatacagcggcacggaaaagacaatcagagagcagggccatttcaggcagataaaatggggcatttatttttaatggaaagataatttcaggatgcatccagccatggagaaagctgctgaggcactgcgctgggcagaacaaagaggaggctggaggctcggcggcctcactgaaaagccctgtggagagattctgggcttgcgggaccaggggcaggctccccacctagtgggtctccaggtggggatcagcagtccaaaatcagagccatgtgagccctgccagaaagaaggacccaggaggggtccagcccctcacctgcctgctgtgcagctgtgggcgagtctctctgagcctcagtttccctacctgtacagcaaggactggatgagctcctagaaaagcggctgctctgcagagctggggagggggttgtggagatggccatccacagtcatctctgctcctttcccaggagcaaacacccaactgagcatctgccatctgccctggggtcacagcttcccttccctcaagttcaatctcagtggcttgaggccaccagcgctgtccctggggacacagctcttcttcccccatctcccatccccaccccaccccagtcatatccagcaggggctgagcctctccaggagctacgaggctggctttgaagcccagagcttgaaaaaggcactatagatggaaaagaagctgtcggggctgccatcttcaaagccagaggctgtggcagctgaagcccctgcttgggctttgctggagccccggcttgggctttgctggagcacatcgttctgaagacatgcccagccctgcccctcaccccaggctcccagcctcctgcatgaagctctgcacccctggagggacgagggactagggggccactcaggagcaggtggggcactcagggatagacaagagggctgcggtgacactgtgcctgggctggtcccccggggtccagggctctcctctggcccagagggacacccgagctccctgtgcagccttgtccaacctggagctcagaggaagtggccatcatggccctcaaatcctgtcccagtggacactggcaatgggctggcccggccagacaggctcacgtgggccagagggtcaccccctcttcctgcagcccaaggagaggagcccaaaaggagatcccctcagggacttccagcccacacagactgaggatgcccaaaccaaattatggccaaaggccccggggagctgagagaagacagggagtcagggaaggcagcgtctgcaggagcccccaggccccctcacccacccagggagtgacgccctgagcccccacagccagcccccagccaggcccccaagccctgcaggaaatggtcactgtgtccactcccggctggccacccctccccagtaagagtctctaacctgacccttccctagttgccccagaaccttccagaatcaaaggaaaccacagacttctctgccatgtcttctagttcccagggagcaggagaccctcctccgcacagcccatctgagggcaaggctggagaggcttctgctcccctgtctagatccccctctggagccagcagcagatgcctgacagagagaagcagttccagtgctgagaggcctggcaaagtccctcaggtgctcaggctctgacgggccacggctcgtggagagagcagtgtgccagatcacccctactcttcttccagggaccacctccccaccattccaggacacaccaacagaccctgtgtgtcgggctcaggagctgcccaagggtctgatgtcccaggcttgtgaggagtgggccaccaagaggatgggcatgcttggctggggacccccagccaatccaggtgggattcacttaactctctgtgcttgacacccagaagtcaccaaatgaagggacccacaaaatcactcatggtgaacacggctccatagggatataggctcaaatcacaagggcccatctcagctgggaaggtagacccaggctcggctgggaggtgaactcagacttgactgggaggtagacccaggctcaacagggaaatgaactcagactcggttgggatgatggccacaggctcagctcggaagtggactcaagctcagctgaggtgatggtcctaggttcagctgggaggtggactcaggctcagctgggatgatggactcaggctcagctgggaggtggactcaggctcagctggaaggtgggcccagactcagccaggaagtgaactcaggctcagatggaaagtggccccaggctcagctgggaggtggacccagacttagctgggaggtggaatcaggctcagctaggaggaggaaccaggctcagctgggaggtgaacttaggctcagctggaaggtgaactcaggctcagctggaaggtggccccaggctcagctgtgaggtagagtcaggctcagctggggtgatggacccaggctcagctgggaggtggactcaggtttggctagggaggtaaactgaggctcagtacaggttgaagcaccatcaccagggcagccgtgacaggtgatgacgttggactgcttttgtatgaaagaggcagcgcttagttctcactagaagagacgcttaatctgaatatggactggtctttcctggccacaaggcttctgcaaatatgaccatctttccccatcagcctggccttccgcacaacattgctgttagccaagggtctcccttcgagctgcaatggactcaacctcacagaatccactggtctgacgtccccactgtctggcagctgccagcctgagaggctggcagactggccttcggagactcagggatggcgccagctgggtggcgatgccctgtggggcctgccagggccctgaaggatacagtgcaggctcccagtcagtgacccacagctgggattcacggtctggggatctggggctggaaattggggcttttcatgtggtcacctctgtgatagttacaactcaccctttgactctcacagcctggtccttgaactgcagatgtgtcagccaatctcagagccaagcccagcagctccaggccagatggcctcacccacctccagcccaagagcatcctcttaggaggggggttaaactgagcctccagagaccaccttcccgtggcacctgctcgtaaactaactcatccgggaggtgggggaccactgggttccacatatggaaacaagggtggtgggagaggcggggtgcacagggccgagctcctcagcagggtccccatggatgggacaatcaacaaatgcagagcacacctaggagcctgcaaggccgccctgctgcccgcggcccctgcagaaccaagaggcttccactttctaaatcacacaaattaatttagaaatcagagcggctcccacagctagactgcaggtttcaaaatagcttaacaaattaccaaatcccctttaagaagacaaattattccagctcctccaccagcacctggttaatgatgcatgcacttttgttaggcgttaaatattcactagctgtgggtttgcacttgtgacccgttgcctcatttctatgtgggctggctgttgtgccccatgctgtcccagcacccggggatgctggccttgggaccaccgtgcaaggtgacggcccagcggttccaccttccctgaccatggccatggctcacctctgcctgcccagggctgcccttggtgcaggcagagcccacatcccctcaccagccttccaggccgtgccatagccttggcatgtgaggcctccttgccacccggcctccctccatccccatctccaggcacactcacccactggcatctccccggggctgctgtggcctttgtccctcttcctggtctgatgcacacccagggacagacatggggttttcctgacccgagtttcaggcctccagttcctgaccagcttctccacactggccccacaggcagagtgtgcctcgcccgcagagacgaggttatgttccccgaccatgggcgttcagggggtgggagaccaggagggcactcaggcatccagcactgccatccttcttgaggcaggtccccaggctgccagagttgtggcccagactccctggacagcagagacacctggtcaggactcaaccccagggccaactagagggagctgagccctgggaggacctgcaaccctagtggggccaccagagaagtccctccctcctcttccccaagacttgacagccgggctgtgccctgaacccgcccctactccccctaggctgcctgggcgccccgcattcactgtttccactcttgacagatggggaagggggagccaggcaggaaggaatgccccacccaggggccccccagcaacagtgccacccagcccaggaccccggcttcacacagacaggctccccagctgcaggggctttcctcgccctccctctcctcacactggggctcttctgatttgagatcaacttccaaatgtctttcttgaatgttctgcctaattaacttcacattaagaggactgaaaaggacatggcagccgtgccaatccacagcctgccccaccgcgacggggagaagcacatctcactcagcctccgacgcctgccacttcatgcgtgcaggcctggctcctcctcgtccaggacagtcagccctgctccccggtgcacacacacacgcacacacacactcacacaaatgcacgcacatccatgcatgcatacatgtatgcgtatgtccacacccacatacatggacacagatatatacatgccacacacgcacacacccatatacacgcacatgcgtgcattgcacacaggcacaagcttgcatgctcacacatgcacacagccaggagcaagctcctgaagccactgagtggtgccaccttgtgctttgtccttggggaccagctgaggagccactggccaacagggaccactcttagtgcccctttttcaggcacagaggagctgaggccaagaaagggaaggggcctggttcagagtcccccagtggccactggctgggaagctctgcaagcttgggtgcctggcagtgccttccccagccgccctcacccccctgccccagccttgtgactccccttggccccaccagtgactgtgtccacttcctcctgagcccacagcccttgacacctgtccttgccatagctgggcccagccacgctcttcagcaggcaatgtggccccctccacagggtctgagctgggcaccagcgttcagtagttaggaggttccatatctgtgtcccctgtccagcctggctggcaaagtggggactcagcctctctgtagtctccacctgcttccctccaccaggcaggtctccccctcacctcccaccctcctccatcatcagcttcccatcccagcccccagaggccagcaggctggggtgccctccccagccaggtggggatgggtgagggctggactccttcctccctgccccagctgcctgccccaccatgtctggccagcatccgcttacagagcaagagatgttcagctcagcttcctgggccacccagcctgctgtcaccctcctcatcccaggagaaatgggaccccgttccctgcctcgggccccaccagacacctggactccagcgcacccaccgggacccgcccctcagctcttgtgagcctcacatgcccaggccgagccaccgcccttcccctcgacagcccacagggcccgaggctccacagaacccccccagcgtcctctgtaaggatccagcagagacacaggcagctgccctgagcagcacggaggctggggcaggcgccaggttcatgctttcacgctcactttggaaactgttggttcagcagtctggccgactacctgctctgcgcaccggtgaccttaaaaccgtccatgcttataaatcacctgggatttacatacggactggtggcaggtaatctttcagaactcccccccactcacacgcagtcagtgtggttacgcaggatcaggatcctgggtggagtggaagagagaatgaactgacacggggctgggagcctgacaggcagcatcatcagggaagtttacggagtgggaggcagggctgcctgtgcgtccagctccagctcagctccagctcagctccagctcagccaggcacccaggctcaggttggaggggccgcagaggctgctcctcctgccccgctgatgtcctcacctctgctcagcccctgcgttgatgaccaccccgtggctgggaccccacccagcctgcagccctccaacaaagagcctccagggcctgcccagcgatggggagttcctccctctggggtttgctggttaagagcaagtcttgctccatggaaaagaagttctaacggcggaatccacaccaagagaaacggccacgaacagcctctgccccacacgtcgcgtgggccccagaaccacaacgaggaggatcaaaaaaaggagtcaaatacttcctggagacattttccaagaccactcccaccccatagcagaaggaggtatgccagcccgccatgtgtcccctccactttgatgctccttcagccatcacggactctcagagccctgcctgggtcagactgtgcgggcggcagtcaggactctgtgtgagcaggaatcaaggcccagggtgggccaggatcagagctgagtgagctagaatccgggtccagggtgggctgggatcagagctcagagtgagctagaatccaggtccagggtgggctgggatcagagctcaggatgggctagaatcagggtccagggtggactgggatcagagctcagagtgggctagaatccgggtccagggtgggctgagatcaagactcagggtgggctggaatcagggctccatgtgtctggaatcaggactcagtgtgagctaatgttaggcctctgtgtgaggtggatcagggctccatgtgggctaggatccgggctcagtttggggctgagtcaaaatgctctggcatggcctcacagaggtggctggacttgctcatggtcacacagcaggcgacaggtgctggtggagctcctgggtccatgcggctcaggccccattgctcttccccacctgcagaagaagccacccaccccccttgcagcccatgtctgggctctgagtccctcagagctctacggacacagctgtctggccaatgaaaggggtggccagggtcccctgggatctgcacagcacatggggtccaagcacatggaaggatgctgggcagacaccctgaggctcagacccacatgccccagcaaggacggcttggaaactacctcaccactccctggcagccagagggagagggtctccctgatgagcccaggctgctccctgagggagggagggagggagggagggagggagggagggaaggaggaagggagggagggagagcaaaggccgcctctgggcatgttgtcccagccaggagcaggtggctgcacagagcaagggcctgtagggtgagccttggggctgccttccaaggaaagagtcatcacagacccctcctcctgtgctgcgggggaactgaggcccctggtccctcagcccagcgcaggctgccatcactatccccgaactcgagagcaggggcagaggaccctcagccatcttcctgtcccatagaagaactcccagtgggaaaccccacccccagcagaggaaacagccctcaggacaccaacacccccacggctgccagatgctctggggaggccgcaccaactcacacggcctaacagccctgccgagggatcccaggtgtttggggacggactgcacacccaccctgatccagggctgtgactgtgaagaggagctccggcccttccccagaacacagcctgcctcctggcacaacaaagaaagccgggtgtgggcatggcccactgcacaaccccacccccaaagccagggctgagccggccagcccacaagccctcaaggggcacaggcgtgtgctgcctccctgagcaccgagcaccagggccaatggccaggcccccgaggctaggagcccctccccagaactgtctgcagccctcttgcctgtggggacccctgacccatgtgaggctgtgtgtgggggaggagggggccctggtgcccccagagtggagtcagcccatgcatgaggatgccactggggagccacgtggccccactgggctgggattcccccgggtgtcccgaggccaccgcacactgcagggcccatgagtttgcagtttgtcccagtaaaaaagctgccctgagcccagacacccacgtgggtccttcctgcccgagattccggccttgttgctcctgcccttaggaaatgcgttgctgtctctgggttcctctgggtagcgaggcttctgggcctgagggaagtgtgggacagccctacagcacaggcccccagtcccgccaatccccacccccggggtcaggccctgcctcctgcatccctcttcactggccagtcctccattgccacctggtggccattgccccacgacagccgggaccgccaacctgcccgacccgagctcctccaggcaccggtgcctcctgggtggacactgggcagctgtcctgggcctgaactcgccagactttggcagaaggcagggttcaggggtccccagcccccatcctagatggggaggcgccccggtccgggcattgctggaacagcgcccttgatcttgaaaaggagcttcagtcatcaaaggggctccatccctggagggcaaatggcaataaaaagacacaaacaggcggcgttagagtggcccgggggaggcgcttcctgattgcgaatccaattctcattcctgaaggtctttaaaacccttcctgagccatgtgattgtctcaaaagagctgttattactcttataaaaaaaaacttataaaaaaattctaatcaacattggtcttaaaccgcaacgtctcagcacccagcactgcctccgcagcttcgtggggctggcgggagggacatttacgagccatttcacgccccgcggctgcccatcaaccatggggcttttgtcacccaccatagcgatagcaatggttttgtaactcaaaagttatttattaatatcggtatcttccacgtgagtgtctctggcagccagggtggcgctgaaaggttgggggtcctgtcgtgggcatacatggtggtccccagcccgccagacccgagaagcctccaagacgtcactgctttccgctgtctcaacaatgcatggcgcctgtctcaccagcaccgtgggaagccaggctgacctgccggcaggatggggcatctgaggtcccaggcagctgctttcaaggccaccatccagccctgcacagggcagcaatgcctttggccagggccacatccaggcatgcacagagctggagcacaccggccccgggcccgcagcaccaccaccctgtggaccttatcaggtcagcctctcaggggcgagtctccccacctggtgctccaggattagcaccgtctcaaagtcaggttggagtcactctcggccacgcaccatgagtgacccgagcacccctcatcttcagagcccagagggagcagtccacgggctcggggagagcctttgcggacagagcacccagtgccccacagctccttagtcatcatctgggggagtcaactcctcacgagctgggggcctccagcgggaggctgccgagccagctctgggccccagggcttccaaggagcctgtccccaggaggagcgtgtgagctgcgggaagcaggcagttttgtcaccatgagtgtgcaagctgtggggggcctggcccctccgtgctcctccccggacccatctccaaggcagcttgcctttccccattccctccagttgcaggttctggccagtgtccccatggaggtcacactggctgttggctcctgaaccacctccagctttggcctaagggcaagagcccagccccgaggacaaggacaagcgccagggccctggagacagaaccagcagggcagtcagtgctcagcccctcggggccctcaggcctccactgcagcagcggctgcaccctctccttccccagagaggggccaagatgcgatttgctgtcccccccaccgcactgagaaagggggggcccaggcaggcacccccaccccacccagacacatgtcccagcccacgtgggttccctggctggctggctcacaacttcagagcacccccaccctctgctctaggcacctccgaccacccacaggggtctgtgcgaaagtaacggtggggctccagccagctcctgcccagggtcctgtccctgccaccgcctgacctttctgttcagcctccacccggcccaccctcaggctggagggcaccatgaaggggaagacagatggcagatgctcaccccatgggcagagccatctcagcctgagggcagcatccttgctgggcagagctccctctcacagccaccccagcctcctgtcctccgcacacatttgactccctgatggggctctgccctggcacactcaggctcccaggcagcagagctgggcaggatggatgagaccagaagacaatgtgaagtccctgctcaacccggggctgccggggaccgcagggttagtgcatactcaatggaggcaagcctgaggctctctgggaaggagagaaggggatgcacttaacacaggctctttctaggggtgattcccgagcttcccagagtgccccctggatgtcagttacacgcccgagtgggctggaaggacggccttgccggggtccagggctcctggccacgcggccttttcagtttgctgtctcggctctgcagaggccacagcttatctgtgacagacagacccacctccctgccttggagactgctccccagggctttcttgcacccccatgccatttgactgaccctgtcaggagggtctctgactcaccaccggtgtacaaggtgtgagcgagcaggtgctcagacagtcacaggtacgggctctgcaggtgagcactgaccaggtggctcggggctctggagactctgaatggagagaaccccaacttctctccctttgaattgtgtgaacgtgagctgaactcgctgaccacagcagagagaaaatttgtcaaaaatgcccacctgtgagacccaggtcttgcctcgggctttggagaggccggtttgtggtttaaggacaagccgggggcagggttccccaggagtgaccagtcactggaggctcgggcggcgcaaaagtcagaaagggcagaggacaatctgggggtgactcctggcccgcctgactcgtgagggccttggtttctcctgtgcttgttgaggtctgtgtgggggatggtagggaagcccctcggaagcggaggacccggggctggcagaagtaatgacagagggaatagattgcacctcaccagcctgcccgcacccggcttccttgcctccacccacactgcaagatggggcccacgggaaggcatttgcgcatacaacccctcagcaccgcaaacactgccaccccggtcctgggagccagggctgccctggcctgggggtacagatgggcaggggcacacctgagacccatcaagcaagacttgccaaagaaggaggctcaggagcgaggtggggcaaaagctggcacaggaggcccaggcccgcaagcacctaaggaggcccctggggtaggaagggccggaggtgggagtgcgtatggcacccagcctaggacgggaggagccacagccggctgtgcagcagggaggggccctccggggcctgaggtgggaaccaggagaggccagcacttctagacagcagctcagtcgctcgctccacctctcagagttccgtttccaatattctccccccattgtctggaatccaaatattcccacttttaaaagcagcttccagatagtggtgtgcaggaggccgagcaacaccgtctttgaggaggcagccgagatgaagataagaccagagaaatccatcacgccggcttttagagccacgcaccctctctggaccctgccgggattaaaatgcacagtcctctgttgtgggggcccatgaggccggcgctcctcagccacagaaatggaactgtaactcagcccagaagcagggagatcgcctcccagataaacacccagcagctctagagtgctggcggccctgggcatcctccccactcccagccccagggcagcctggggagcaggggttctggaggaccccggccccctacacgggccccccactccctaacgcttgcttgggtccagtgggggcgggaggctagacaatgaactgaggtgccccctgaggggcacctgctgcagctcggggaccccagggacagggccaaatggccatgacatgtctcaaaggcctttgccaagcctggcatcctcgtccataaaaggacagggcacgcagccgggcacggtggctcacagctgtaatcccagcactttaggaggtcaagacgggcggatcacctgaggttgggagttcaagaccagcctggccaacatggagaaaccccatctctactaaaaaatacaaaattagccgggcgtggtggcgcatgcctgtaatcccagctactcgggaggctgaggcaggagaattgcttgaacccgggaggcggaggttgcactgagccgagatcgtgccattgcactccagcctgggcaacaagagcaaaactccgtctcaaaaaaaaaaaaaaaaaaaaaaagatggagtttgccaggggcagggctgttccaccttcaccacaccaaggtgaggacagaacccaggctgcggccagggcaggaagaactgaggtcgtttgggccttgtctggccaccctaaggagtcagcccctctgcccaggagctcagcgatgctgcctgtggccacagggtcgcctgctctaccttcagcctcagtttctcccttgtaaaggggacatacagctccttgggagccatgagcttgggccactacttgtgaagcgcagagggagctggagcacagaggcctcagtcaggcacgtgctgctgccgtggtccacgtgggaggtcacgtgcatccccgcagtggtgctgggtgggccctgcaccttcagggcctccctggtgcaccccggggtctgtgaggccagctcgctgcctttccagctcatccaccccatttctctgctccagcccttccccagggctcctgcactcagcccctccaaccccagcttggcgagctgccccttctgtcctgctcccactgccacccccagcaccagcccctcccagcgcccctgagccctatgggactcctgccctgcccctagccacacctcagccgcaggccctgcctggacatcactcacggttggttctggggccacggcgcactggacacagggttcaagtgtgctacatgaatagtgacaggatctgtgcagcaaaggggggtccctgcgtccccagaaagcccctcctgccctcagcctccccaataccttcagcaggaaggtgtgtgcagggtctctggaggctgccaccctcccatccacagcagcggtcctgcctcggggcggccagagccagcacggggaagctgacgcgtcacagggcggcttccaaacaggatcatagcgagaacgccgcataaaagctctaaataaaccccaaaaaggaaaatgggactgttttaccactgaatcaattcacctctaattttaatgctctgaaaagtattttctcttaatgactccattattttatcatatggtgagcaataaactccctccccacatttgccagacagcctcagcctctccggtgtctgccaggcagggaatcctttataggcggctctgcacacacacagcacttggctttcgtttagtggtgattttatagaagattcccccatttcgtgtaatataaagcctagaacttaattagcctccgtcagctcctcgggctgctatggagtgggtgtgttcatgcacccgcagaccacacaccatgacaaagtcgccgaccgtctcaaggcagcatccctgtggctggcatgggcagcatgccccaaacatgaagcactcaggaccccagagggctcctggcctcccacctggcaagtgggtgcaggttattaatccccagctccctgatggctctcccaccgggacacacacatccctcacaagcaaacgtgattcccagcagggagctggcggtctcgggaatgacctccatgtgggctcctggggaagcccaggcgactgtgcaaaccctgctggcgagggtgccgccctccacggttttccaggccccagggtgggcacatgtgccggctcacggtgggtctgctccaactccagtgggaagaagagatgccgaggatgcagcagcaccatacgtgggaatggggacagctgcggggggctgggagcacaagtgagggacagagccagggcaggtgaggccagacgacggacatggtgagcagggtcggacacagttcctcctacaagagcctgcttgtgccctttgatctccaacatctctcctgggtgctccacatcgaggcgcccccacggcacatctgacccctcctccagtaaacctaaattagttccttattgtgcaacctggacaactgtacatggccaacattcaggggtcccaacaaactgccttgtaaattggaggccagagcctggcttccctgtgtggtgccaggcaaggcactgcagcttacacatgacacacacacggcacacatgcagcacacacgcagcacacacgcagcacacacatgcccctgctgctcccgcctgacgccggccacttactcacacgccttctcccccagacagaagagcaaaggaggtgggagggtaagggggagacttgagtaacctcacagtaccctagatgctaggagaacaggtacccgtgggccaggcgcgtgtgcacacctgcctgggcatgacacagctatggggtgtgtacgcagggctcacatgtggggcccagaaacctccctgcgtactcagatacctcgttcaatatctgtagcatgaggggcactcctgcaggggtctggagcaattcttggcctaagtggctatttgcagactcccctctccccacaggcccggaggagtcgcagagtggctttgtaacagtgcgttctccctgcgtttaccccagtgggttctacaggctgggccttgtcaaagtgacgggcaggcgctgggcactggtgacaaaggcagtggcagcacttggccacactcagcctctgggggccccggacgtgcatacatcgcggtcctccccttatgagcgaggagacaccatggctgcttgcacctcgcgtgccggggaactgggagagtggggctcacgtgtgcatctgcccacctctgctgaagcctggggccacacaaagcctcttggggtcagagcttgctggggccccgtgggggacgtgagacagagagagaaggtgtgtgtgtgcacacgtgtgagactcggtgtgcctggttgtgcacgtgactgcgtgcatatgaaacacagacaggcgtcggtccagcggaatttctgtggcacacttgagctgcgtgtagccccctgcttctgactgtacaaagacctcacgctctcatccgagaccggaaagctgtggacggggttggtggctcctctcggagctaagctccacctcccactcctcagtctgaccctggcctccctccccagccctccccagccctccctctctcggtttttttttttttttccttatccccacactcctctcctgcagccctggcttcaggcccctccccagcagaggctgcagcagccccggtgcagtggtgggatgggcctggccggactttccagtgcccactgtcctatgccccctgcctggcaccccagcctggcccctcgtgcccacccagtgctgggtagagaggccccgtcgtgagcccatcactgctgccgccagaggctactcaggcccagctcctcagagggtttttctcgggccctcttttagtgaccttctctgaacttcttgtggctggcttcatcgtgggattgcagaaagacccgagagccccagggaaggtggcattaaatcgcaagcaatggcacttctggcacatccaatcgattttgtcgttcgtaagaaatggaaacaggatgtggcaaggaaaaggcagtttcaggaacaaggcttctcccctcgggctctggaaagggcagggaaaggctctgttggcccatgcagcggcccctggagtccaggcccaagatcccaacccccggccacaggacacggtcagcaggtccctgcctggctgccccacctctgggagccctcctgccaccccggctggcctcctgcgggctctgagcaaggtcaggccctgggaacgagggaggggccgctcctgagtccccgaagccctgggctgagtgggccccaccaagcctccttggccctgcccagcttcctccactcagagctgctggtgcatgtgccccagaacggggcaagggggaggcaggcactgccccgcagaggagtctcacccatcccttccctctgtgtcccaagacagggccttggctgctgcccagggtgtcttgcagcagcccctcccccagccagcctgtccctcaatgctctccagcaggcacaggaccagagagccacaagctgtgtgcccaccctgcacacccacccacagccctccccccatacctcctggtcctcgagcctatgcttcccacaggctcctacctggtcatccaggccagctgccatggcccaggagcctgcatccatccttccctcagccacagtgacacccaaggcggtgctcacagctcatccctgccctcagggccacccgaggggtcaccagtgccacagccagtcatgttatgttgcactgacttccccagccaaatgcctggggaccggggctagagtttttcctccattgtccattaatcatggctaccattgttgcatgggttcctggaggtctggaccacctgccatgtgacgtactaagcatgacgtcacgaatgtagctgatcagcatcattttccgcagaccaggagtgtcccagagcactggattgcaagagtagcaagaaagtgccagtggctggagcactgctgtctctcacaggcagctgggtgggcccctctctactgaggtggttgagaaggacacacttgctagacacaccgcacacacccagggccagaggatgtggtgactcggttcagtcgaggtatcgcatccggcggcgcattttccatgtgggctgactctgcgttgggttgggttcatccatcaccatcggccatgatgctgctggtttttgtggaccatatgggtgaacagagtgggaacagtggggacagtgggactgaccatccctgtatcttttgagtctttggggatggtcctaatttctgcagatgctcaggatgtgtggaatgactctcttggccagggtcttagaagcttccacttgttcgtttgggtttttttcctgccaaaatggctcataatcattaggtcaaggaaccaatgggcaggctctgccaactgcagagtacaggcagccccttcccttaggcacgagaggctgagggtcccagggtcactgcagggcgggcttgcctccaggtctccgggagcccttactctacccacagcggggttctgggtcccctgatatcactgccagctcagagcccgtacccacagctctcaaaagatcaggagagtctcctgcccagcacatagtttctgtgggccctggacactgacttctgccctttcaggccagctgctcctgacacggtggaaagatcaggagaagctgccctccccagtgggccggagggctccaggcggcaacagggagggcagcaccagtgacgggcacacctgggctgagggaactttgggcacccaggctctgggccactcagccactgccaggtgggcacccgcgtgaaccagaactgtgtgcctgcccggccagcccaaccttgccgctttcacaaggaggcacacagtagcccctcagaacctgccacggccctgcaaggagaggattcccctggggcaggaggtagtagctctcggccaggcactgactgcccaaggtggcaggcccaggacagggtgtgggtggggccctccctcccccggttctggtgccaagctcttcccagtgtcctgtgcctgtgccccatgtcccagcagctgtgtgcaggggagtcatgaccaagggcggcacccagtcccctggatctgagcccactccgtaagctgccgcctcacagcccggcaaggagcttccccctacagagcccctgtccttatctgccaatgaggccaggcctggggctcaggaggcggtggggagggaagaggagctaagccctgtgaggagctaagccgttgcacacaagtatgcattctgcccatctagcgcttggagagcatggttaatggaaagacccaactccgtagaacacggagctttcttctgagccaatatgagtgaccgcggcccaggaaaaagtgcacacacccagggagccctgagtggggggtcctgaggcagccagacaccagctctgcttcccacccaccttagtgtgacggaattgcaggcagtcatagttcaaggagcttctacatcggttcagcccagaaaggcagggtgtcttgaagcagggggctgacaggtcgtcagcggggccagagattatttcatttgcaattagttaaagaagtaaagctttgtctataaatgtgcagtcatcagaaaggaatgttttcggtgaagattaagaagtcttttaaccgatacaccaggtcacagtggcgtgtggggtgcatgacttgaccctgggctggcggccttcggtcctgtttataattcgagtcttagggtcacagtcctctgatcactaggttaacgtcactactggtcagccctgcctgaactcccgcagggaagggggagagcgaggcacgtctgccctcctgtcccatcatgactgggaactcagttgttccggtttctctggagtccctttggccaagaggagcctgttcagtcggttggggccttagggttttatttttattttacagcacgtagcacttttgcacacggacagcgtggccctcacagttcggcgcacatgtccacagatgtgtggcttgcctgcgccacagagaatgcacgcttctggtgtgagaatgaggctgtgtgtgacgtgtgaatgctcggccccggccggccgcagccaggtccctgcggtgggtcctcaggcccggagaccagggatggcgcccacagtgggaacctgggctgaccggctgcccccggggcccacgcctgcagtcgccccactgaagcccagacagacccccacacggcctcgcctcagagcccagaaccttcagcaggtcaggcggggtggtggaaggatctcccggcccctccagccagcccctaagatgctgctggaaaaacagctgtggcaggcagctcggggggccccggctcggttatggcttatgtacagccccgacagccaactggctttcagggagggaccaacttcatagataaaatttgtcatcgtatcgatggctcctgtagagaaaaaaggacttttacagcctcttggaggtcatgaataatagaggaggaggaaaggggccgctttggttagtgttccgcggggcccagaggcccccattatctcagctgatgggagctgggggggccccagcagcctatggttctcactcgtggaaaccagtgtggtcatcacccagggcccccaccacactcagggctgggggcagtgcccatgcgtcctgtattcttaataagggctctgacttggcgacggggtgaccatacatggccctgtcaaagggccctgcctcagtctgagaatgacaagctgcaggctccatggtaggggcctggacctcccactccgggccgtgacctggggcaggactctagctgtatctgcaagccggaagagcagcatctctccaggcagccgtatgtcaggggccagtgagcagacacaggggccagagcgtcacaggtcacccccatatgcccagagtctgctcccccgtcctcccacctccctccccacccgtggtctatggggccctgaagagtccccaaaggcaaaaatcctcctttgcttgcctccagtgatggggaactcactaccttactgtcggctgttcctcccatggacagctctgcctggtgggaagtccccccaccagcccctgtgcagagcagcctgtgcctgtggagccccagcccaggttccggctctcacccagagcatgcgtcagcccctctaaccccaaacccacactcctccctcatttccctcatttcctctcctcttctcctggaccccaccctcaggcttcactcccaccaacccccagggtgcctgggccaagcccacctgtgaccaccacgtggcaagtcctgtgaggacttcactccttgtccctcctgacctagcactggctctgagtgtgccagtggcaaagacctgctcatgcggcctccaccggccctggactcacccaccaccgccacccctgcctgccctctcccgtagtcctctccagggccttctcaccgtggtcatggtttatggggcctctcatgaccccatcagccaccgtccccacccagctggagaccctcaaccaagccctctcagggggtttcctgtggtcatgaagcagctgacgacccactgcagagacgagagctacaaagatgcattcccactgtagcagagggagctgggatcaggacagcctcagctgcattttcactgccccagagggagctgggctcaggacggccttagctgggcgttcccacgacagcagagggagctgggctcaagacagcctcagctgggcgttccccctacggcagagggagctgggatcaggacagcctcagcccggcgttcctcctgctacagagggagctgggctcaggacagcctcagctgggtgttcccactacagcagagagagctgggctcaggacagcctcagctgggtgttttcactgccacagagggagctgggctcaggacagcctcagctgggcattcccactgcagcagagagagctgggctcaggacagcctcagctgggcgttttcactaccacagagggagctgggctcaggacagcctcagctgacaggggtgcagccctgagccccggagacgcctggagaacctttggacccatttccaccacaagccctggtgctgcagtcggccagcctgcacgaatttccccccgggctgtatgccagacaggggaagggccagcctccaggcctctgcgcaagagggccacggccaactcccaccccctgggccaacgctggcctctcttgtgcctggggtccttctgcttcaaccagctgtggaccccacccccatctcccccacccaccggccctttcttctctggcccaggtcagcctagggcctccacaccctccagccccacccccgaccctgcctggagccatgtatgaggccatgctgaggcccagggctctccgcactccagccagaccatggtccagggagagctgggagtctaggccagcaccacgtggccatgaccagagtagccacaatctccagcccctgcagcctccactcccacgtgccgccctactccaccccggccaccttccaggaccaccccaaggaaacagcccagcccagccagctcgctggactttcccagcgctcaggagtgcccagccactggacatgctccgccctcccgctgaatgacagctggccttagttgctgtgttcccggggcactgctcagggtgggtgcaccacaaagatctggggagggtggggcatccgatcattcccagctcccggggagagatgagggtgtggcggaggtcacctggctgaacagtgacagagctgggcccaaacctgggcaccacgtcattggcaccactgcccgtgggcacatgtgcccacctgccggctgcaggcaggcctgacacaactgggctcttccctggcactgcctggcacaggcactggggaccctccgcggacccggcagctcagcactcccctgggccagccttatcttgccctgcagagcccaggctggagtgaggcgcaatggacggaggcgaggagggtgcagccgagccctatcagatacggccggaaatatgaccccgctgggacctgagccctgagccgagccatcagctcactaataaattacccagagcgaatgtccacagggtcagcccgcatcgcctttccagggagcacagagagggggcggcacccaaggtctgtgggctgaccgttccctcccctctgtcaatgagaagggtcaggaaggagttgtcccggagccccccgacctcgggcagtgcagcctgacctctgaaatctgggaggagcagctccagccctgggaagccaaggataagcgcccagattgggcacaggcgggagagggtcttgtctggctacaggacctcactcttcccaggaagccagactgccagcaggaccacccagccttcctcagtgctctccctggaacaagcgtcagcgagccaaggccctcctgccaatctggcccaccccgtttgtgtagacacagagcgcactgtgtgccatatggccctgtaagagaaaagtttgctcccccatgccctgtactgaagacggcagtgaggggagggccggtctgctgaaccccatcccagtggctgcgttgctcatgctctgacggtgggttccaggactctgtgtccatgcagccccacggctggccctgagcagtcaccctctgtgcacactgtcccccagcctggcacaccctgggctcccaggggtcctgtagctttacccaagggagatgcacccccattcctaatggagaaacacgggtctctccacacctcctccagcagtcccctgaaacaggtcaaagccccacaaaccaggcaggggtctgcccacatgtggtggtgccctgcgccagtgatgccctcaccagcctctttcagacctgcctttacatgcaccagcagacgggggggctggcgaggacgggccaccaagcctgagccaggctaccacctccgggctgtgtgactctggacagggtgcctcaactctctgagctgcactttcacctacaaatgaggggcagactcagcagcgccaggcagggcagttggacgcccacccaggacagaccctgagaaaggctgatccctcacccctgccatcgctcactgacccatacattgccccttcctgccagggcaatatcgagggtcggccagtgtgccccaaaacggcagcttgggacccattctttgcctctccctctggcaaccccaggtcaggactcacaggggcacaggggcctggggcagggcgggcactctcgccaccacggaggccccatgctgggtcagggtcttattggaggctggactctgtgatcacctcacctcccgcagccccacagtgccctccctctcccactctgccccgaattccaatccataggtttttccaagagctgcacagctctggaattgacctgggagggggcacatttgggccgggaggggtaggaacagcagcaaactctggtcttatctgaaatcatggtctgttgtccaccgggggcctgggaaacagccacccccttctgctccggggccagcggcctgtcctcgggttcactgctatttctgccaaaggggagaggtaattatagcctggccgctgccagctggcccagctttgcgatccagcagagagggctggagacgggacgaaggccacaacagacccggccctgccagcgggcggtggcgcctccagatcagagccctcgggaaggaggcctgggcgggcctggcccgttcacctgtgtgccctgcagttctgcccgaggctcaactctcaagggcctgggaggggtgctgccggccaagagggtccaggacctcactggactgtgccccacagggagatcccgaagagcctgtttctgtccctcggggagccaggagggaaccaggtgagttccagccccagggagagggggctcacttcctgcttgggtatgaagatgccagagcggagagattgccaaaggcaggtgcaggtggggaacctgccccagctgggcagcaggtgtgggcagagactgggcagagcggagagattgccaaaggcaggtgcaggtggggaacctgccccagctgggcagcaggtgtgggcagagactgggcagagcacacactgatgatcctgagtgacctgaacaagctccagagtggccacccttcccccttctcctgggactgatggtttccctaaaacggagacagtcccaggccggccctgtgtccacactgaggccaggccgcctctgggggaagcagggaacacggccacttcaaacttagcagcgggggtgctcctggccacacaggagcttccaaagggcacctgatgttgcgcgaaacagcctgggcagtgggagaaggggctgcactctcaggggaatgcaggcagccgtgccaggcatgaacccagccagccttccctgaagggccttggtggggggcatcctccgagggcaagtctacgcaggcccagcctagcaggaatggattcgttactccagtaactgaagcctagttctcagtgtttgggaatccctgagaactggctcttttctgagccgtcagtcagaaggaatccctgtcctgccctgtgtggccatgggacccccacccagcactggacgccacgccatttcttgggcactactgagctttgcagtgccctggacagttggcaaacagcccccattccacatatgggaggaagggcctgggggggtcccccgccctgtctgtctggagctctcgaggcctagggtggcccctgcacccagcagatgagcagccatcacccggtactgctgctacctcgagccctaactgcacctcgggatgtgagggcccatctaggcatggagaggggcctcagggggccaccaggcagctcctgctcctgttcctacctggtagggcctgcaggcacctgagcaagcccagtgggcggtcagcccagccaggggcctccccacaagttctccctcttacttaagtcgagaacgcatgttgtctggggagctgccagcgtggttccagtggtgagcgttgggctgggagccaaggcttttcccaggagcccagccaccccgcctggctgtgttctgcctccgccctgcagaggaaaggccagcgaggcagtgtccatggtcccagtcttcttccaccggaagaaggcacaacctgcatctgcagccccagggccattgggttaggcctgtggccaaactactaaggtgctgggagactgaggaggcccagctcctcctggggccaccaagcccgtggttgacggcctccccatggaccgggctgtcccgagagcagcaagtcagccggggccctcagggccgctgaggccactgctcagtgtcgccgtaatggaaacttctcagctggttgtgagccgcaacagctctggttcacaccctgcgacagcgaggctgtgaccgccagtggatctcggggctgatcaggcctgagccaccccggaggtacagcaccagcaggagcccaggtgggcaggggcagagagagagagagagagagagagagagtatgtatgtgtgtgtgtgtaagtggtgggggtgggggctgtgagtctccagcttctcccagggaggtctctggcttcccaggagcctggccccctgtctccagctcccaagtgagttgccctgggggaggctgcacctggaacagggaaacagggagcctggccccagcctgcactcgctcaggccccgggaccctctgcccctggaaggctgtgaggctgccgtgtgaatgggtgcagtgccaggcgaggggtgagccgggagtgtggggccgcacgctcagagccgaggaagggcagtgccaggcgaggggtgagccgggagtgtggggccgcacgctcagagccgaggaaggacctcccatgtggggtgggtgggatgtcaggatttctcacgagccagctgctgcatggggggcactgcccgccccgaggaaccctcagggaggacagagaaacatcaggaggtgggctgtgggcaaaagggcgggcggcacgggccaggcagaggcagcagcctgggaggaggcgggaagccagcgggcggcgtcctggaggacggggcaggagtgggagggagcagcagtggctgggccccagagcttggcgttatccaagccacagaaccaggcaagaaccactggcccgcccccacgccccactgcaggctggtctcgagggggagggactcggcactgccacggccgctgggctccatcagtgccctcacgtctctcagcagcttcaagatgaggtggggtctttggggtactgggctagacccccaaagactgttggagggtcacaccccagaccaaggtcctgggcctcagccctcatggccccacctcccaccagcagtacgggctggtcatgcccacaactgggagctccgggccctgactcccgcctctgtcccaacccaggctctgaaacctggcaggctgttctccctctctgggcctcagtttcccctccgccagggagctcggtgccccctctcagtagaggagctggtaagaaccccccagccccccagcaccaagggaggcgccatggggttcctgttcccagagtgggggtagagtcccctcgggtggacgcgccctccccagcagcgggcctagcgggacacttacaggtccaggctctgaagctattttccgccctttatctcccatctgtcacgaggcctccagttacacactgtccctgccagaggccccaggcctccccgcccccacctgccgagcatgccagagccactccttccctgcttccactggggaaaatgaggcccagggaggtcacaccacttacccgaggtcacagagccaaagaaggacagagcccaggacttgagccagacctctcttccagaaggggaagcgtgaagcccagttagggaggggatggcagggctcagggaggctgtctgggagcagagcatggcccacgtgaaggtgcatctctggagaggggaccgcggagctcagggaggctgcctgggagcagagcgtggcccacgtgaaggtgcatctctggagaggggacctcagggctcagggaggctgcctgggagcagagcgtggcccaggggaaggtgcatctctggagagggccccagggctcccggaggggaggtgtcatcccataggatgtcctgactgtccagacacagccagagccacctgagctctgttcctgggcacattccctccccgagtgatgccaacagtggctgatggcacagagcacaggcttggtgcggactcgggtctgtgcactgactcccaccctcacgcgagcccgcagaggctgctgctctcctcacccccatttcacagctgagcagaccaacgcccaggcagattaggagacttgcctaaggtcacacgtggtcacacaaggtgctctggagcccacacctgaagagggggaggtgctgtcccgtaggaagtcctgactgtccacattccggcagaactctgtgccccagaaggcgaagtcgcgtcctccccaagttatgctgctcagcaacagatggttaatgccacagccaggcaccctcacaaacacactgcctacgcctgcacattcacatacactctacacaaacacacacacattcacccacacatacgcagatacactcacacacacacacgggcacatgcatggacacacacacacatgcatattcacatgcacgcacagaaatacaagtacacatatgcacacatagccacacctccatgcacacattcacacacacagacaccccacacgtgcacactcatgccctctgacacacgtgcccactctcacacttgcacactcaggggaatactcacacatgtgtgcactcacacacgtgcacacacacactgttttcccaccatcccttggacagaccccaggccaaggaggggtgaatagcgagagctgctggcaggagctgggggagactgcgtccagccctgcatccctgcgtgactccgtcggcccaagcctctccaggcctgtttccccatgaggagtgaacctggctgggccccctggaatgctgctgcagggtcgcctggcaaggggctgtggccctgggcacgccagccagccccaggccgtgcagccccaggaaatgaccccgaatgcacaagcctccttccgccgggcagtgggagagcccgggctctgggtccaagaggtcactggggggctctgctccacccccaaccccaccctgggctttagcagagtttctatcccacccagggtggaaactgagtcaatggcatccagagagcccttccagccccagccctgctacggacaggcagtcaaggttgccctgccaggcagcatccccaaaacaccaggacaggcctggcactctgtggcttccctaaccctggggatcacgcagagcccacattccaggtgacctggccccaggagacggggccccagctcagctgggcctgcaagcacaacctctcccacagccactctctgagagcaggtcctgaagataagccgcccctccccgccacccccctggatggccggctcctgccacaaccctatttgcaataaaaacctgatccggcgatagcagaaaattgctctcttttgaaataattgaacccgtccagacagtgtcctcccagacatcattaacagggcactctgcttgtctgcagtatttatgcccacttggggaggtggtcatggccaccctgttatctcctgtagaggacggcacacggctgctggagtcactgcagtatccacccaaaccactcctcccacaggcctgccctgaacctctgaggcacccatccctttgggggaccctggaggagttatccttgaggaccatgtaggcccctcactctcaccctcccccttctcagcccttgggggcagggtccttggaggaccacggggagccagggaagcatctcaggaaatgcaaacacctgccctgtgaggggcaggggcggcagtaccctccaaggaccccagggcaggggagaacctgaagggcagcaggaggtccccacactgccccctatccagctgggagcagggcagggaggacctggcctggcatcagctcccagggaagccccagccccctctggcctcagtttcccgacctgaagcaagagaggcaggctcatcacccccagagcccttgaaaggcagacacctgcacctgcacagatgcctggtaggcactgcacccctctgtagggaggagtgcccaaaagtcaagaaccctgccaaggctgtgagagaaaattcacacttggggggctccaccggtgagcacgaatgaggagagcacagcctctgccgccaaagacacgggggtggaggcgaggaggcgccattcacagccaggaagcaaccagcgcaacagaggaggggacagagagacagagatagaggtagagagatagagagagaatcagagagaggaagggggacagagacagaaacagggagatagagacagaattagagagaggcagggagacagagatggagacagagagagagacatagaaagatagagacagaatcagagagaggcagggggacagagagatggagacagagagatagagacacagaatcggcgggggcgcggtgcagagagagacacagagagagagtgtgagccgtgctgaggggtgggcccccaggagcccaggggcgccccaccagcaccagcccaaaaaggtgggcatgaccctctgggaagcctttctgtggacccggtctcagagccctgacaattcccagtccccagccccagggcttcccgctaccgaaaggagacaaagcaaagatgtttcttgcagccttatccatgacctccaaacattgcaaatgacaatactaaaatgcaaccctcatgaatacccaatcatcgagggtgactttcagtgacgggacctcggcccagtggaatattatgcagccattaaagatgataattatgaagaccgtggcagcaaaggaaattgcttgcgatggcatttctgaacgagcagggaacaggatttacctgcactggggacaccacagaggaaaagtggtgtctgctcaacagcgtggccggtcgcaagcccgggaagccagcctggcttccaggaaagaattttctcctcctcttattttcattcctctgagtgccacttgtgcagtaaataataaataacgtctctgcttatcttaggaccatgttccagtaaatgaggactgcagcaggagccgtgagccctgactcccggccagagacacgacgtcagaccagaaagaatgaggaggccgcgtggggcccgcgggtgtgcagggcagagagggtaaggcgggccgctgggacacagcttctgcaagctggccttccactgggggctggagggggcagggagcaacagacgtggaaaggccatcctccaccccaggaatcagggggtgataggaggagggcagggggatcactgagggctggggggagcagcggggggcaatgggtgccttgaaggatttggtctggcagaggagattggaggcccccaggtggggcacagcttggcagaggaagtgggagccatggagggctgtggaagaggcagctcagggaggagggtgttggaggagggaagagggtggagagaggacaggtcaagactgtcaccaagggtcagtgttagggttaggggcccagacctcagaccctgaggctccatccagcctctgaggcactgccaggctggggcatgccacaggcacagcaggagctgggccagactcagcatgggcaggcctcacgccctcgcggggcagcctcgccagatgccgagcagcaggctgtgtacagcgagcaatgccccagccaggaacaacctcagagctggcccggctcccagggtgcctcagccccagttgtcaccatgtcacagacaaggatgctgaggttcacagcagcccgaaactcccactccatcttccagactcaggctgggcccatacacgtgagcagaccagcagagaaagggcccaggtaggcaaatgtgtaggagctgcccccgcctgcagcctgggaggctcggccccagggaaaaggaggccgaggccaccaaccagccctcctcacggccctggcccggcccctgccccatagagcttgcaaactctggccccttagccagagcccctctgccattgcagccccctccccctgtccacatgtcctggggaccctgtccagcagcctgcatccgagacagcgggcagacgaagagaggttcagtggggacttgcgtgaagagacggggtcaggaggggctcctgtcttgcctgggcccctgaggctgagtctggctgccctgcagtccctgtccaggagctgcccctcaccctacaggaagtgacaggcccagcatagcgcaccagccaggacagggtacaggttccaggacggtgctgctgggccccacatggctcagacctgggtaccagcggcctcccgccggggactcaccagtctgcttcccgcccccacaccaggaggacaacaggaagtgccccccctccatcctgaaacggagccggccggagcaccaccgcccagaggccaagccccagaggacctcgaggcgcgtgtggttccgagaacccccagcggtgaccgtccactgtaagagggcacccgcagcaagcagctgggagagggtggagtcaagcagagggaggcggggacaccggccacacccacacagctctggcagggcccaggacatgggggggccgtggccacctgccttcagtgccacaacccctgtaagacctgggcccctggggtcatctggacacacagtcccggtccatgaaacagcaactggaggagaacatgagggcggattctcaaatcatgactgtccctttgaggaagtgtcaggaccggctgggcctgggtctctcactgatgaatagtctcagggtccttcgggggtgcagggtgagacgagagggcgggggcgcccgatggactgaggcaggtgcccccagctgactctccattctctttcgcagacattgctgacaagaacgccacagccactgtcaggggtgagttctgagcccacatccctgtgccccactgccccctccgtgggtgcacccaccctcactccctccccgagggaggtgtcacagggccagggcctctaaggagtccccagttggggagctcttgttgcaaggagaccccaagaggctagggaggggccatgggcatggacagggtggaatctccccatcccttccccaccagccccagtcctccagggaagggtcgcgctggctggcgctgaccctgcctgccctctggccgcagtgcccggccggcccaggccacacggcggctccctgctcctgcagctgtgtgtgtgcgtcctgctcgtgctggccctgggcctatactgcggccgggccaagcccgtggcaacggcactggaggacctgcgggcccggctcctcggccttgtcctgcacctgcggcacgtggccctcacctgctggcgcggcctcctgcggctctgacgggcaggacgggcaggacgggcagggcttccaggagagctcaagcactccgggggctccgagacagcctgagccctggccctgctgcttggtgaatcatgggggccaaaaggggctgctgcctgagggctaactaggaaaagggggaccccgtggcgtgagatcggacatggggggcacagcaggcggccccgccacactagtcagcacagccctcctgtctcctgtgttgggtccatgtgagattttattagaaagaggattcgactgctaacagttgaggctccccaggctcacccaaagacccctccctcgtcccagcaggaactcctgctgctgctagggcctggcccggccatcaccgtgtgcaccctcttgaggagggggacacactgcccgtgttcaaggggctgctcggaggaggcaaacccagccttttgcgattatggcttgtggggaatccagacctcgaaaccccacggggagggaagggtctggttgtcaaggtgggtccctttgatgtgaggtgccatcctctgagcccaggtctgacccccctacccagccccgtgagtctggagaggccccagggaaggacccctcatcaggggcggcttcaggtgtagaagccgaggggacagcaaggggcccagacacccccgaccttcagaacagccatctgtgcccagctctgcaggccaggcacacccagctgagcccggggccagccagcaccacccaccagctggggcctgtgggtcccggagaccgtctgtggttgtggctttgtcgccggattgcagagctgaagggagccctgtggatgacaaacaccaggggcctctccagaccctacgtggggggagggctgaacaaagcagggaggcccacggttagacaccaggcagaactgcccaggagagacacagggacaatcagaccagcgtcctcgaggttagcctgaggcgggtgggcacggccgaccatccacccggtggttcctgtttgtcccaccacttaactgggagacactgttttattaaaacacaccgtggcttccttcagtcttggtgtttttatagaaatgagagaaaccagaaccgatttgctaaggaatcggcctcagtggccaaagcggatgtcctgggcgcctggaacctccccatctcctgcaggcctgggagtggatgtgtccactcgggcaggggctgaccaagcccctgggtcttgagggatgcccggccggctccctttgccctgcagtcagggtgtgtccctgcaactccaggtgccagggaacaggtgaagtggtctccagggtcacttccagctttggaatccagggagcccagagttgcgggtggaggtaacaaaaggggctgtttccagaagtggcccagaagggaccatggtgggggctcccccggggaccctccagcatctctccccaggcccagcccatcccaccccaccccaggaaggaggatgggcaggttcctgccccatattctggatgcagaagcagcggctcccagaggttgggtctctcagagcagtcacaggcccaggctcagccctgtgtgcttgggacacccctccagccccggttctgacgggggacaccgcacaggccgatctcccccagccgctgctgtctgtccactgcaaaggcaacgcaaggacgtgcctggctttgcggggtcccacgctacgacctcaggtgttttcgaataaacattgctcaaagatgggcaccacacccccaagagatccttcgaaatggatcctcccacctggggaagctgcatgggaagcagtgagactcgaagccactagaaaatgtacagagaggaaggcagaacctcgggaaggccaacttctaattcctaaaagcttcggacacgaaaggctcaaagcctgagcaaactgtgtgtgacccacaaattacagacagttagaaccacgagccaggccagccaacagcggagagggcagacagaagccccacacgctcctcctcatccctgttggagactcgggtgcttttgtttttattttgattttgaggaatagacacatgtaagcttaaggatctttactttcagtttagccagagtggaattagaacagggatatcattaacagccagccaggacagaagcgaaggcgtctcagaagcaacttggtggaccagcctcaggaaccccgggtcatgcctgcacttcccaccttcctgcctggggagaggcccaatcccctgagggaccctggagagcccacgaccagggccgccagcccctgcccagcacactgcaggcccagctgccccttcccagggcgatgtgtctgggctccggagacagcccagtccagggtgggtctatgtctgcatgcagccgaggatttccatcaccctggccatggggctgttccacacctgctcctgggatccagcagtgcagcccccaagaacagacccaaccggggccaagcctcaggttccagaagccacccctgcctcctgcccctccttcagggccctagatggctgtggcctggatcagggctgggcagagggtgaggcaggagccaccccaccttctgctggggacacagacaaggagctctccggactggaaagagtccccatgtccagtgggtcagggctggaaggggagacaggggaccccatcagcttagggggcctcggattctgtccaaaccccttccctcgaggacctggctgccagctggaaactcagctggtccccaaggccagagcccccttgagcttccagagcctcgatccccctggacttgacacccccgatgggcacctgccagcctcactcccgggacccaggatgatgcccccaccaggaccctccatgtggacccaggcacgtggcctccaggaggctggtgcccagccacccagagacacaagccagctgctgatggtggacagggtgggtcatgaactcagggagccaggggctcgcctctccccgggaaggtgggcgcagcagcagggagcacttggcagcactcgagccaagaaacggacagcccctcatcgagccccgggtggggaggccccccgcctccgcccccgccccagaacgagtcctctggaggtggaccctgggctttcctgaggggcagggtccacagccaagcagccccctacgccggggtcccaggttcacatcccagctcctccacttgcttctgcggggcctcagcacacagactctgcagaatgggaaggcagctccctcctctctcaggtggatgctgggcgtgggagcccatgggaggggcagaggggctgtccacacagcacccacggctcccatcacgcacacaatgctcacacgcacaggcgtgcacatgctcacatgcaacacacgcacattcacatgcacttacgcacatgctgcacacactgcagacacacctgcctagacactcacacctacacactcttcctcacactcacatgcatgcacactcatgtcacagggagtcacaccctcacactcacatcctcccaggcacactcacaatcaagccttcacacgcacaacagtcacaccctcacatgcagtcacacccacatgcacactcatgcacaatcacatcctcccaggcagtcactcgcacatgcagtcacacattcactcacaggcagtcacactctcatgcactcagtcacaccctcacatgcacactcatgcacactcatatcctcccatgcagtcacacactctcacatgcagtcacaccctctcgtgcacactcagtgacaccttcacatgcagtcacacctgcactgtcacacccacacatgcacactcagtcacatcctctcatgcactcatatacacaatcacaccctcccatgcacaaaggcactcacaatcacatcctcccatactcacccacacacagacccctgccatggctcctggcccagtcctctatgtggtacgtgtgcccccgaaatccccaaccagatgatgcccccgattctgtggagcccagattaccacttccctgaccctcagccaagcacagacaggacccacacacagtgaggtgaactcacaggcctcagaagcctccctgagcccggccacagggtctcccaggcctatggcacccacccaggagggggactcagctggggagggggccaacctggggccagaggctggaaggtgccgtgagctcctccccacacgcagcctctgcctggatggcagaattcatgcagaattcgttcagggctaagtgacatctggccacccctgggccagctggcatggagacagcatccggccagggttgggggagacaagctggacgccctccacataggctggccagtcaggtcctactgggacagccaaggggccctgtgcgaggcctggaggtgccccccgcccccgccccacacccatagtctctctgcaccatcctcatcagggagccggcacccacccagtccactgccaggctcacaggtgggcactggggcgctcacctcactacacgtggcgtcgaggggacacacgcagggctgcatgtggccagggcccaggcagagccccccagctgcttccccaggcaggcccgtgcccccgagcgcagcagggaggtcggggccagctccccctgcctgcactgtgcctaaatgacagcgctcttctcctcttggaaggaggtgcgtggggacggccgggccagcagcagctccttctcgtggatcaggctgtccagcaggtcctcctgacggtagttgtggtagaccttcaggaaggccagcgtggtgatggccagccaggccagccatgaggcccagaggccaaactgcacagagggcagggtcagggtcagaagccgttgggggtccgctgtcagtgcaaccccctcccaccagcccccaggctctgctctgcagggaaaggacaggactcagaggaaggaggaggccggggacatggggcagggccagctcctgaagaccctgcccaagatcaagcttctgagttccttcctgcagccagcatcgttttccagcacctgtggccctcccggaacccactctggtgcaaaagccctgggcactcagaccaaccctcactccaggccggccagaggccccgaggaggggcagtggccagtggcgagtgctttctcctccagcagctccggcctgtcggctctaaggagggcgggtaaacagcggaggctcctccaaccaccggaataaattgacctttagccgctgtttccaaacagttgaaggagaaacaatttaatcagaaccaggcctgagctacattaagctgattctcatttgagcgtatttgccatcagactgcactcacaccttaatccaactggcacaaattaggcctgaggcctcttccactcactaaatttgcatgaaggtgtctttgacaggtccagttcatctcggcaaagagcattcaggcccacccatgtccagcacccttggagggctcctggccaggagaagcgtcctcaggccagccacggccagcaagagccttcagaggccagcctggggtccggaattggacctgaagccagcgggccctgatcagtgctggcaggagccaggtgtctggtctcagccacccccacccggcacccctcatctgcctcatctccgtctggggcacatctgcagatttcaaggggcaaacccaattccagggttccccctccggccctcacgggccactgatgtgtccccacatgcctgcatttcagcaaatagcgtccctcagagtgggggccaccatcgccctccaccaagtctcctagggggcgggggacgcagcttatacaagggcagggtggcaaatctgaattcacaagtgggatcccctgcctccttccttggactctgtatcagcttccccctggctaggggactcctctaagcctccagctctgatctgaacaggcccacccagcgccagcaccaaagtccaaagcccttgtccctacactggacccccaggatctgatgcctggtttcgtttctggcaccacctccccccacacccccacacttcccaccccagaccccagggccttgccacttcctgattctaactcactgtggccatctcctccccaaacccacctacaaaagcccagctctcccccacctcctgcaggaagccttcccgactgctcccactgcctggtcccattgctaactaccttatccacacaggagcctgcctcctcctctggatgggggagagctcagcaaatgtccagcagtaaatggccccctcccagcattgcaagcctcccttcttgcccagagccccctacctgggcaattgcaaactgatcgtagaaggcggagttgtccacgcccagctccaagtcgatgtcctggagctcttcacagctaaaacagcaggacatagggtggagggtgaccaccaggacagccagtgcgggacatggctgagccgctggccagagagccaggagctttgccctacaattgttgggcgagggggtgggcagcagggagtctctggggacatcacggagggttagcctcgatgcctcctccatggagcaggacagcctttggggaaggaaacctccaggcccctccctgtcctggccctggacagccagaagacgccagctctgcctctgccctcctggaccctctgccccccatgccccacactctgaggatcacggggtctcagaggccaggcccctccctgtcctgacccaggacggccggaagacgccagctcagcctctgcttttctggaccctctgccccccatgccccacactctgagggtcacagggtctcagaggcaggagatgcagggctgcctcagccagacagagatggaggtggcatccccaccaacgctgcccagaagctctgcccccatcacggaggcatctgtggaagcagtgggcatcagagggcccaggagtgagccaggcctgggctcccggtaggtgtcctgcacccccaacataaaacgtgaagccaggacacattgacaggagcagggtgccagaaagagggggcccagcggccccaaatccctggaggggctgaagggctggaaacagtgtctgtgaggccaaggaaactttgcgtgtgtaccagaggttgcccacactcttgggaagcaggtggcccgagccagcaggcagagctgggacagtgcacgatgaggcacagggcacagctcagcacaggaggccctgcagggccacacacccaggtgctcctgctttcctctggtttgtgccccagctaccccagggtggaggcacggaacagacaggcagggagccccttcagctctgctgcatctgttgcagatgctggggtttcaggtctgggtttgcttaaaggaagaatgtggaaactctggagggttcctgtcttccagggttttggcctggggcactgcatggtgcccctcagggcggggcatcccactgtggggggcaggcagtcactgtgctccactctggggccccccacaagccagatgatgcccctgctaagatcccagagggaccaccatggctcaaaggcctccatccccaacccgcctgggagctgaccctcaccctgccagaagcttcctctgctcctgttcttcaccatccccgtcccttccaccatcttccaaactcctcaccatgaggaccaaagccctgagcctaatgctccctgggctctcccatgcagccagcacaggacagaagccccacagtctccggctgtgtggccacaccgagcctcccaggacccggggccatgctgcacgggatctgtcatctaagccctggtggcaagaacagggcagccagagtccctgaccacctggagccacccccagctgtatccagccctagggatgatcgctcttgtgtgacgtgtgatgctgccggctcctagggcgggaaggtgtctgacattgcagggtgggtctcagggaaggggctgcacaggtatgcacaggcaggggcacagtgcacagtgggaccagggaccgcagactcaggatgggcttcgtgagggaagatcacccacagcagggcagggtgtcaagggatcttccggggaggtgggcggaggccgaggcgggtggggcgggcgcacctgtggggtacggtgcccttctcggtgatggtgtcgcaccacatggtgaagcccacgctcacgatggtgctggcaatgaagaccaggaagaccacgaaggcgctgaccaggaggttcaggaaggcggagaagaaggagctgcagccagaaacaggaggggcaggctcactggacaccacctcccaggcgacccccgcccccaggctgcagccagaaacaggaggggcaggctcactggacgccatctcctgggcaacccccaccagcagcaccccccggaccctcaggattcctgggttgggccctgtggggcctcaaggagttgttccccctgcctgcggtccctcgggcagctccgtgtgcccaccctgggctgcaggtcacaccttcccaaagacccaggacctggaaccctggtccccaccatttcataaaagaggctgcacccagggtggaagtgaatgacacccttccaaagccgtccagccacagtcaccagcaactctggcccaggtgcttgtgtccccccaaatccatatgttccagtccactgaggggttagaaagtggggcctttgggaagagaggaggtcatgagggtgaagcctcatgaatgaaatgagtgccctcctaggagagaccccaccaagcgagctcccagcagataacgacacagcaagaggaacgggccctcagcaggcatcgaacctggatcccagcctggatcgcagacctctagcctccggaagtgtgagcagtaaatgcctgttgtttacaagaccccagcctgtgatgccgagagcttccattcacccgcaggtcatcagcgcgtggcctggacccctggtaggacttgcttgatgggccagctctgatttatccatttaaacttaaaaggccaggctgtgattgggcccatctgaccagggccagagcatggggagcgcaggaggcagggccatgaggaaggagctcacttagggctgggccacactgccccaggggtctgaggcctctgccagggcgcacacggccatggctttcagaggatgctcgtgtttcctcttctgaggataccgggcaggtggtcgggacacccaccccacccggccctcctgcctggcctgcaaacgtccatcatctctgaattgctccatcaagattcaaagtccctcgaatgggcctggggtgggctcagcctggaatgcacacggaggctccggggggtagggagagggggtagggatagggactgtccctccagtgggagccctgagggggacttcctcacgggcggacaccagcactagcagcatggctgagaaggggctgctcccgcctctcacctgccagcaggctcgatgttagcctgcatgctgtcagcacactggatctaagggaggtgacccacagaaacagcttcacagcgatcatttaataaacaaggtctccctggaatctcagccaagaaaacatcaacgctaccgtcatccgaactcggcagctgctgatgaggcaaagtggaggccagcgcattgtctgttcattcattcagcaggcactttctgagcacctgctcgccctgtgctggacacagagggcagagtgatacaaaagacgaagtcctggccccgggaggtgccccagccaacgtgctgaggataaacccaggccacagcgcccaactcagagcaggcgacaccaggctgctttgtaacatctggtgcctccaaggagcccgtccactggccccagtcccggacacactgttttggtgactgctgggctgacagcagaaccaccccccaggaacgggagggtttgagccaccccagggagtcccagacaaggggagaggacacagggacactcttaaagccatgggctgtgatccaacaaccacaccaacgagggcaggaccagcaggactcacacacgtacgcgtggggggtgaccgagcctctgcccaggcctcatggctgaagatggctggagagtgggtaccgtgtgccagtagacaagccacaacccccatcacagcgccacatccaaagctctctgaagacagaaagagcagcggcaaaagttcgccaggatgggtgtggggccattctcggtccctctccagcccagtgtgctgtgagtctcagagctgtcacacatgggactggctccatccgccctgcccaagcctgaatcaccatgtgccagtgtctcccgcctgctcttcagagtgcgtctccttctccattctctgtctggaggctgaaaggtgtggaccatggcaatggccccgtgccctctggcttccggctgggtttgggcaatggggtgggagggcgggagagcaaggtgggaatttgctaccaggtccctccactgaaagtcactgctcctctccaggtgacccacccatccaggtcccgttagccagggatggggacagcaccacctccactgaccccatgaaccccaccacttcatctcttgtcaaccagccctccttcaatgacctttccttgggtgagccatctgctgctgctgggaccctgaggacacagttctgaaccccaaaatccatctggcctgggggtgcaaatgaggggctaggggcctatagtcacagagcggaacgcagtaagcccgccccacctctgcagtcttggaccagctgctccgccccagccaaggagaaggtggtggcgaggcacggccagggtcagctccacagccagaggcaaggaaggggccactgccatggtccacacctttcagcctccagagagagaatggagaaggagacgcactctgaagagcagggtctttcagaccctgaaagaccctggtgcctgcaaatacctggcccagtgcacctgagatacggcagaggctctgggcccaggcgacccactgtccccttcccaccactgagcatgggccacaacacaacctccaacagacagaaaagccaattatctggagacttcaaacatccagcctcacccctatgaaatggcccgattttggagtcttctcccatgaccagatcgaggagttccccatgagatagggaagggaccccaggctggggccgctgccagctgacagcctcggtctgttcctctcattcctttctggtcggtttccagggatcctgcccaggctgtccaggtcgttgaagaattggatgtgtccagagcatccccggatccagctccccagaggtcacagggccacccagcccctccctcaccaaggccaggccaggacagtggtcaggaacaggagcccggcacatgcagggttaaccctgtctctcttcactgccgctcagggtgccctgccaggatgtgccatctccatggtgaccgctgtcctggaaagcccagcaatgtgaaggctcagcgccggcacgggcaggcagatgagtttaacgcagcatccctccggcccgccaaccacaaactgctgccagcccacgtgctcaatcctccctcagcacagctgccccaggcccacggctgcctcagcaaacccttctgccccgaaatggcaagcctctctgaagcacaggtgccattccattcattcatccattcattcattcattcattcattcatttactcattcattcattcattcattcattcactcattcactcagcagccaataatggagcatcaagatgacactcctctgcaaaaagctacccccagactaattttcacacttctgggcacgagctctcagggcccagactctgcatgaaagacacccccataggaagaggaagctggcacctgagacatggcctctgctccacaagctctggacgtgccatgtgcccctcaaacagacctcacacaggccttgccctcacactggcaggagggcagccgggtggcccctggaggtggagtcccctttagagggttagagcatgtgctgtcctaaacaggcccagacctctagcagccagagtctgatggggtcagtgggctcctccctgggctggacgtccagtggccgtcgatggccctgagagcccttgtccaccacatgagctccctgtaaaggcccgtctcagctccgtggctggtcctgagtcccctttacctacctggcacttgctcacctagtctatgcagctggaccaacaattgagttggaattggctgctctgtcgctggaccctgcagaccccatcttcccaggggtccagaacttcctgacatggcaagtctgaagggtggacctgttggccagataactgagtctgcacaggtatcggggccaggtgagtgaccacaaggcagcaggcctcaggacccaggcatctttctgtcagtcattcaacaaacattatctggggactcctacgcaccatcccctgtgctcagccctaaggacacagagatgaataaggtgcatgtctgccttggcttcacccagctgtgggtcccctagggtggggtcccctggggggggacccatggcctgagatggctcttgagagcgttaaccttcgcctacaaccagaactcaatggagtgctgacacgtttgacagatgtcaccccacaagccgtctgccaatggactgtgcagtgcatgaggtgggggacaggtggccacatgaccacgtgaactgagccactaattcctgatggtcaagaaggacacaggcaccagatgtccctggaaaagagcaggctgggcggaggtcagtggtgggaggattggtgaacccctgaactgaagcaaaggagctgaacctgaaatgctccgccacaggccccttcctgacagcaggagctgcccggacctgacctccagtggggtcaaggccatggtgagcctccacaatgtagcccccctcgacaaccctaaccctcaccctaacccccacaggcctgagcataccaggccgtctaaggcttcctaaatcccatatgggccggtcagcagggctgcagcagaggccacacagctggcctgcatcccagccggctccaccccttgggaggatggaacaccacaaagagtgctgggaaggcctgcagactccccaggaatctgttttctgcctttggaaggagatggtgctggcagtttgccacggctgacagacagtcaccttccgtgagatggcaagaggcagagctgctgttacggcatccctgggcctgccgcccagtgtgtgcgaaatagaccataccctgtgcgacctggactcctgtcttgcaagctctggggctcttttctcccctctccctgtcccccagcttctggtggaaccccctataaaatctcccatcactctgaccacatagctgggtcctatctagagagccaccctctgtcagccccagctggaccacaggcaccctgagggacacccaggaggtgaagaagtgcgtgagcgatgaaccaactgtggccccacctggcctgcaccctccaccctcagcttcccagactaaagggacctcaagcgttgggaggctgaccctactcgctggctgtcccactccctcttcacacctgtctcattcagggaggcttccacctgcctgccctgcatgcacagcatggactgggcaactcttgggtttggcaacatgggtgcagatgacgtctcaagcctcttcttgggacaccagccctggagtgggctgagggaaggaggacggctgcaaatgggcaggacaccaccctgcgcccggcctgaccccaccttgagcagggctccagccacacaatttgggcccatggccccacagtacctgggtcctcccaggctgacagccagctttctactgacccccatccagaaccttagtgtcgtgggttgaatggtgtcccccgaaagatatgcccaagtcccacccctggtacccgtgactgtgactttgtttggaaatagcatctttgcaggtgtaattaagctctggatctcaggatatctccctgagtttagagtgggccctgaatccagtgactggtgtccctgtaaaaagagggaggacagagcagagcaaaggcgccctgtgaggacagcggcagagggtggtgggacaagtgggtttcagtccagttggtgcaactgtgctgcagcagccccagggcgctcctacccacaggcgctgggattctcattcctcctccagagtttgcagccccactcagcatagccctggctccctcccttctccctgaagcccctcttcttcccctctctggcccctctctcagccaaaaccaagcggtgggctcacagcgggggcaacaggagggcttccccactcctgccgcccacacccctctgagcccttctcatctcccacctgcgtgcaggaagtgaaaacctacaacaaaggatgggggtgagggcagagtttgggaggagcctgggtttcatgagtgctctcccggaacctctacaggatctcgggctgctcctgggcacagcaggcctcagccaggggagtgggagggcccacagagggcacccacagagggagtgggtgggttcacagagggagtgggtgggctcacagagggggtgggtgggctcacagagggggtgggtgggttcacagagggggtgggtggattcacagaggtggtagatgggctcacagagggcacccacagagggagagggtgggttcacagagggagtgggtgggctcacagagggagtgggagggttcacagagagcacctgcagagggagtgggtgggcccccagagggcccccagggtgccactggctaagggtgtcaccgcaccccaggtgaaccaggttgtatgggctccagtatctagccggagcaggaaagagaaagaggaaaatgcaggccaggaggaggaaggcgctgagcccacaaggcacagccctcgccctgcagtctctctccagctccccatccaaggcctgagctcgaggtgggcctgggtggctcccctccagacagccatctgccgtccctttcccggggcgatggtgccgggtggggctccccagttcgccttgtcactgggacctggagagctcagtgcaagccctagaccgggctgggagttgtcgccggtcctggcgagtgtggcccggctgagcccgcccaggaaggtccaggcctgctgggtgatgacagtgcaacatctgcaacccaagggagcagatgcccggaagcgggaggtgatgcgcagctggggaggggaggcactggccttgtacgcaggaccggtggtcgtcatggtccctggatgtgtgtgtagacaaagggcggtctgagtggagggggtgagggcggattgttgacatttgcgggcctcggagctgcctgagagacggagggactcgcgcgcctccccggggaggtgggtctgggggcgctgggggcatggaaggggcgccgcgccgggagcggcccccacttacccctcgtgtcccttgcagaggaagaagagcgtgcgccaggcgtgcgcggcggccagcagcagagacaggaggctggcgagcaggctgaagcggcaggcggccggcgggccccactcctgcaccgtgaagcgctcgcgctcctgcaccgtgaggttggcgctcagccacatgccctcggtgaagagcaggcagcggccgcggaagtcgtggccgttctcggacagcgggaccaccaccacgaagctgaacaggaaggccaagaagtagcaggcgcactgagcgaaaaggaaattgttgagcgccatggccggcccgggcgagagcggcggcgggaaggccgcgggaggctgcgccgggcggggaggccgcgggaggctgcgcagtggcggcgccggcaggtcccgcgcgcccctcccgggacgcgtgcgcatcggccgagcgcgggaagcgcctgcggtcagcaccgcggacagctcctggtgcgcgcgggccaggagcccggggtccaggggccagagaagggcggcctgcgggagatgcgggaattttaccaggtcggcctggagggaccgaccctgtgccgctaaagacttcgggagccacctgtacgggcctcacacaggccgactctgggtcgtcagttcctcatcagctcgaacgaaaggagaccaggagagagagggcggggcggggggtgttggaggacacccccaaggtgctcatagtgaggtgtaggagtgcggtttgcagtccaggctgaagtgattcctttgcgggggtcccgaaatgcaatgtatgaggggaggggccagatcgtggaggagtcggggtccaagggactgggacagaggtcatcctcgaagagatggggagggtgaggccaggtgtgggcaggagggggtggaccgggagcttctgcagcgccagccctccgcggggacgtgtgttacactgcctgacatgggcaggaccctggagctgcatttgtaagataaataatgggtgtcccgagcgcctcattaagacatctttgctgagatggaaatcgctgaggcattaattaatagaattaatgccttttctagttgcctttaagactaagtcacctttagtccaattcccagagtgaggaagccttaacattgctcctcctggtttaaaattccatcagcatttttgttgcaagcattaaaaaatatttttgttttattgactaagtaatatatgctcatttcttaagtcaagtaatagagatatgtatacaataaaatagaaagccttctcctcatccccctcccctaccccatcacactaccaggggtgaccacttcaatagcctggcatctatttttctagacattttgctaagcacataagcacacacacagaattaacaaaaatgcttcataccatacatagttttctgaaggctgattcttttattcaacaaaatgtcaaggagattattccctgcctacacatacacctattttgttctttttaataactgcataagactccattataatgatgattccacaatctgcataactattcctcttaaggtggatgttttgtgtctccagtttttgctgtctcaaatgctgtcatgtgaacattcttgtacacatatgtttgcgttcttgcacaggcatttttataagagaaattcttagaagaggaattgctgggtcatggggtatgcacatttaaaatgttgacagaaattgccaaaccggctttaaaaatgttgttcagccgggcgcggtggctcacgcctgtaatctcagcactttgggagggcgaggcgggtggatcacgaggtcaggagatcgagaccatcctggctaacatggtgaaaccccgtctctactaaaaatacaaaaaaatcagccgggtgtggtggcgggtgcctgtagtcccagctactcgggagggcgagacatgagaatcgcttgaacctgggaggcagaggttgcagtgagccgagatcacgccactacactccagcttgggcgacagagcgagacttggtctcaaaaaaaataaaaataaaaataaaaaaattaaaatgttgttcaaatttaccctcacatctgggttgtagacccctcccctcgctggctgagaaacagcagttgtaggcaaatcctgccagtttccacagaatgcgctcattgctgtgtgaacttggacttgctttggcatcatgaggctgagcatatcttcttacgcttgccaccatttgcaacttcttctcttctgtggattgcatttcattttgcagtcactttaaagtcgggccttgaaggccagccacgaggtcagcaacggccactcttctcttggagaatccactcagggtttttaccactcttggagtatccccaattctccccaaagggagctcactcaggaaattcaccccctcccctaacttgggcaagagtggaagttccatccactcattatccagcagttggaccaatttgaacacatctgggggtgttacacttccagactctggccaacatgaaggagaccatgacaactgacagggaaccgccagcactggaaaccgcagactaggctggaaagatgattaaatatctgccattttcaaaggtcaaaggtgcgagactctggcatgtctgtgattagttccacttaccttcaaaaatcaaagacttatcttgtttgtattagtcagggttctccagagaaacagaaccaataagatggagaaagagagaaagagagagatttattttaaagaactggctcatgtgattttggagactggtaagtctcgaatctgcagggtgggccagcaggctggagacccaggaaaagtcaatgttgtggttcaatgtcgtggctgcagaactccctcttactggtggggggagggggattgggaggtggggtcagtctttggttctattcaggccttcaactggttggatgaggtcactgctatagtttgaatgtttgtctcttctgaaattcatgtagaaacttaatccccaatgtgacagtggggcctttagtaggtgatttggtcctgtccttatgaatagatgaattcttttcatggattagtggtctcatggattaatgggttgccccaggactgggactgatggctttataacaagaggaagagagatgagccggcacactcagcctccccaccatggatgccctgcaccaccttgggactctgcagggagtttccaccagcaagaaggccctcaccagatgcagcacctcaaccttggacttcccagcctcgagcaccatgagaaataaacgtctttcctttatagattacccagtctctagtattcagttttagcaacagaaaaccgactaagacactcatccacattatggaggatctgctttactcaaagttcaccatttaaatgttaaccttgtccaaaaatacccccacagaaacatccagaataatgtttgaccacatacctggcaccttggcccagccaagttgacacataaaattaaccatctctttattgaagaaattccaatctacggaaaatgtggaaaactccaaaattcacttttaaaagccaacattacattaataccaaaatcttaccaaaattgcgggagaaagaaagaaataggaaattacatatacaaatatggatgcagaacactttcaaataaaatattggcacactgaacacaacccaatgtattaagaaagtaagaaaacatgaatgggtagactttagtctacaaatgagagaatagctttgctttaggaaatctatcaatgatatgctacatcaacaaataaaggaggcaaactcaccttttcgtatcaaggaatatcaaaatgcacttcctatcattgaatatccactcctgataaaaaaaaaaaaaacctctatgtaaaataaaactacctaaatgtggtcaagactaccttaaaccacattataaatccgcacccgttcaaatcaggaacaacacaggaatgctcactgttgcaactattattgaccattttgggggcaattctacctaatgaaccaagacaagaagataaaagaagcagtataactatggaaacaaagaggcaaaactatctttattggaggataatatgattctatacctagaaatctcaagatactctataaaaatatgataatttgcaaattaattttgttctggatctaaaacctggcttaggtccagaaactgggccgggtgtcatgacgtctcctgtcaggctgcccttgggatggttccccttcatgccctatgatggtgtcaagtgcaccagagtgagagatgcctctgcctttcctccagggatgcccagtcctgttgtccatctcctccactttctgttggtcaggacacgctggctccttctttgactttgctgctcgttaggacctgagctcaccttgctcccgacgattagctggcaccacctggtctgtcttatctggggatcccaccagccgcattgttctcagggcacccagtcctgtgacagcagctccaaccatcatcccgctgagcttctcagtgattctgccccctccccagtgcaactttcttgctctggtaaatggagactcttctgcagccaccctttctccacccaggaatgcaacctcggtgggtgctgcagcctttgtagcacggacactcgagcacgcccctgtccctgagtccttgccccctctcccaccatctgtcctggctgttctattttacagggttgagtatccactttccaaacttcttagagccacttagacgagttttctgtcactgctgcaacaaaatgccacaacggcacaaatggattgtcagacagttctgggaggtgagaacatcccagggtcagaagtctaaaatcaaggcatctgcagggctttgttctctctggagtcttcaggggagaatctgtttcctcgccttttcagtttctagagggttctgcgttccttggctactggcctccttgctccatcttcaaagccagtaacaccagtccagcccttctcatgctccactcctctggtctctgcagctagaagactctctatgttgacattagacccatctggaaaatccaggatgccccgcaacctgaggtcctcaaccttaatcacatgcacggagtctctttttccataaaaggtaacatactcatgggttgcaggaattgggatgtggacatctttggggcattattctgtctgctccaccatcctaggaacaagttaaccctgcctcccagggctcttgcctggtgttaaacctttgtattccaggacacctctaccttttggataaattctttcttacccaacatttatgttctactcccctgccccaatccagcacactgtggtccaggcgcacacatatccctgccgcctgttggtacgtggtcttcagatcctgcagagccatcggggcacgctggcctccctctctcagcagaactcattctttgacgttggtcaccagcaggagagatggagtagcccctccttagaggccatgcattctccttgcaaagcaaacctgtgaatcatcttccaacaggtgttatgggttgactgtgaccgcagcaaagacatgttgaagtccagaccctcagcaggttagaatgtggtcttatttggagatggggtctttacagaggtaatcaagttaaaagaaggtcattagggtgggccctcagccaatgtaattgatgtccttgtaaaaaatttggtgatagatatgcatagaagtagaacaccatgagaagatgcaggcagagattgggatgatgcttccagctagggttttaatgtgtcccccaaaattcatatgttggaaattcaatccccagtgtgacagtgctgagaggtggggccctcaagaggtgactaggtcaggagggctcatgaatggattattgccattactgggaaagtgggttatttaccttggaaatggattccttataaagaaagaattgaacccctctttctcttgcatgtgtgggctctcctgcccttctgcctccaccatgagatgacatagcaagaaggccctcagcagatgctggcacctggatattggactcccagcctccagaactgtgagaaaataaatgttgtttaagctgccccatctatggtacttagactcagccgtcccagaaaactcatacacaaggaagtgcctgtctctgacaggaaggagcaagccccttctgtaggcccagaggcttccagaaggcatgggagagccccaacctctgagcatgtcatcacaggtggggttccctagaaagcaggctctaaggtggagaagtacccagtgaggtttgttggaaggattctgtgagcacagatggggaagaaaagaaaaacaggagagggcagaggggctcctggccgagacacagtctcagtggtggctcagctgaccccagggtcaagggcctgggcctttgtaagcacatgttgatcagtcactggaagcagctggcctgggacagggagtgacctgggatgaggcagcatcagaagaggctggcagccaggagccatcgagggcagctcatatggcagtttggggaataagttctatcctaaaggggcccaccatggaggcctgaggccagcatggcagccttgccaaggctgagggtcccatcacctcaggagctatgttgctcttagaatttaagccctggactggacccccacctgtccctgcctccaaccgtaggggatgagactctctggacaggctgccaagcaggcccactgcccccacacccagccttgagtggagatgagtcaagctcggctcccatcatctttctccaggaatttgtagcacccagcaacagccatctgatccatggctctgtgattcctacattgcctctgcctctcgtgcttctgagataaggcaccaaccagtgcagttcctcccctacccaatacagcacctggggcaccacggtgagagggtccctgacacggcagggctatcacttctgcaccagccacagcaacagggaccgcagccagtgactggcagtggttagtctagccccaaatcccatgtgtgtctgcctcctaggaccacccctagtttaggagaactgacgctggacctcgaggtttgtagacaggaggactgagtgtgcgggttcctctcaggagcaacacctgtgagccaccaagagcagcaggactgggccaagggagaaatgctcggtgacacagaagcaatcccctgggaacagccccttcagagcgaccccacagaggagcaggagctggacctttgtacctccacactgacccatcactggacgcaggctgcctccaaaattaaatcccaaagctttaaaaggctgataatgcccactcctggcctgccaaagctggggaccccagggaggagggagccccgtggtcttctggcgggaactggcacagtcagtagaagctaagatcgccgcacatgctttgacccagatccaccacttctgaaacacgggggctcaacagaaaagcctcatttcataaggacatgtgtacatgaatgtttattacaacggtttgtaccagccaaaaatggaaaacaaccagaatgtttataaaccagggagcaatttaatacattctggcacctccttataatggaaagttttgagctgttaaacgggagtcgtttctgtgagtattggcttgaaggattatctgtctagtgctatatttaaaaaagcaaattgtcaagtcatgtgtttgtattaccccattttattttttatagtctttaaaaatttaatacttttgctatttacaaaatctcttttaaagcttaaataactttcaattcaatgttttggatattgtgaaaggtgatcaaccttttccccttatatgggtggcaattgtatattgaacttcttttactttttaaaaattttaactttaaaatattttaaattcacatataagtggatttgcttctggaactgctcttccttttgtctttggtgtattatacaaatagcacattttttcatatggacattggcgatttatttcatcttttttgatataattatttttattattttactttcagttctgggatacatgtgcagaatgtgctggtttgttgcataggtatacatgtgccatggtagtttgctgcacctatcaacctgtcatctaggctttaagcccctcatgcattaggtatttgtcctaatgctctccctccccttaccccccacccctcaacaggccccagtgtgtgatgttcccctccctgtgtccatgtgttctcactgttcaactcccacttatgagtgagaacagctggtgttcggttttggacatgaactcattcttctttatggctgcatggtattccatggtgtatatgtgccacattttcttaatccagtctatcactgatgggcatttgagttggttccaagtctttgctattgtaaatagtgttgcaataaacatacgtgtgcatgtgtctttatagtagaatgatttacaatcctttgggtatacacccagtaatgggattgctgggtccaatggtatttctggttctagatccctgaggaatcaccacactgtcttcccaatggttgaactaatttacactcccaccaacagtgtaaaagtgttcctatttctccacagcctcaccagcttgtgactaccatctgcacacatgagtgaggggagagagaccctgtgctccagccgctgtcactggggctaggggaggacactcccagctccctctgtggaggagatgtccacctggaacttcaggggtggtatggctccccccactgacccccaggctgcagagctccctcctatccttgtcctctgctgcagtaccgcccctacctcagggatgctttgcttttctccttcctgccagctcccagtcagggcctgtctgtcctgttgcctgaggcctggaaggatccaggacagctggctttggccaggtgtgggaaagagtccagaaatacatagtacagggcccaggtgcacctggaacttctctaaagcaggaggttataaatagaacactccagaaagagtctcctcagcaggcacttcctcacccccaccacatcccatgtgagggaagctgtggattgtgtagaagagccaggccagcaggcagtgccctaggactcgaggcagggcccatggatggcgctgcaaggcctctggtcgaaggggaagaagggcatggctggaggaagaagcaaggctgaaaaagatcggggctgggaaggggtcagtggagattgagatagcaaaccacaaaagatctaatgtcttcatgtttcaccccattttcttggctcctactgagggcaaacataagatcatataaagaagactgctctccatctgaaagatgactgaggggcactgttcaccatctcacttgctgcactccacctgagcatgacacaacggagtcctccgtgcatgggagagaaatgagtggtgccaaccactccagaagaactgccaaatgaaggcccctgcagaggggtgaatggatggagggtggttgggtgcatgggggataagaggatgaataaatgaattcatacatcagtaggagagtgataaatggatgagagggtggataggtgactggttggatgaatggatgaatggatgggtggatggacgagtgggtgggtagatggatgcatggatggatgtatggatgaataagtgggtgggtggatggaggggtggatagatagatgggtggatggatggatagatggatggatgcatgcatggatggatacatggatggatggatgtttgggtgggtggatgaatggatggatggatgttcgggtggatggatgggtggttggatgtttgggtggatggagagatggatgggtggatggatggatggttgtgtggatgaacatttgggtggataaatggatgagttgatgggtagatggatgtgtagttagatgaatggatgaatgagtgagtgggtggatgaaggggtgggtggatggacggatggatagatggatggatggatggatggatggatggttgggtggatggatggatgtgtgggtgggtagatggatgggtaggtggatgaacggatgaatgagtgagtgagtgggtgggtggatggatgaatggatgggtgggtgggtggatgtttgagtggatggatggatggatggatgggagggtggcagggaggaaggaggaggaaggataaataaatgtattgattactcacacattgatgactgtgtgagtgggtgggtaggtggattgatcagtggagagatgaggggtgaagaatgattaacaaatccttacagccatattttggagaataccagcagcctgattttggcaaggtgatcactgatatgggaaatcagaatgttgatgtgctgatttaccctgagaagttaccatttacaagactaggacactaacatccctactcaaactgcatttgctgtcagcagtgttatctgggaaggcaccattagaagtcatcttggagagcatggaatcagatggggaataagattatttcatgataacaagctcaagctaagaggagctgccttgcatctcccaataacatacacctgtccaggtgactacaagcacttgatgtctaaaacagtggctccctctccctggacagtgctgggaagggcatggtcaacagtgtctccctttttctgtgatcccatggctgtctttatgattatcatgctcctttatgattaacacattatttctctgagtttattctgttgcttttccagcttcttcagtttaaaatcttaacctattcatattctattttaatgaatcaatttaagtctatacattttcctcttgataacactttggccatatcccataggttttgacatgaaatgttcttatagccatttggctacagatagttaacagtttctatttttactttaacacctgctaaaataattagcagtgtatttccagctatactcattttgatggactttctttttgccattgatttctaattttattgctttgtggttactgaagttagccttagatgttaatttttaaattgtcaaaattctcttagtcatctagtacactttttttaatgttcttgctgtgctaaaaaaaagtttattatttgttgaatatgtatttctatgtgtctattagattaagctttaattgcttatatttatttatagtctattaaattcttcagtttctggggtaggtctcccaccatgactatggattcataattttctttttttacttaatgtattttttcattatatatttcagtttatgactcttatggagtcttcttcttttcttttttttttttttatttgagacagagtctcactgtgtcacccaggctagtatgcaagtggcacgatcttggctcactgcagcctccgcttcccaggttcaagcaattctcctgcctcagcctcccacgtagctggtactacaggtgtgtaccaccatgctggctaatttttgtatttttagtagagacagtgtttcaccatgttggccaagctggtctcgaactcctgacctcaggggatctgcccgccttgccctcccaaagtgctgggattacaggcatgagccactgcatctggcctcatgtattctttatgagttgttccatttgtcaacatgaaatatccccttttgtctcttttaaacattttgccttaaattttatcttctattatataaatattgctaggactgcttgcattttttggcatttttgatagacttttttatgcctttaatttttaactttctaggcaactttaagtatgtcttttgtaagcaacatttcagctagaatttgttatttgtttctgttcaatctgagcgtctctgtctttcaacacgtgtgtttagcccactgacatttattatgatttctgatcaaataaaatcttactttgtatttcctggggtttgtttcccccctttctcatcttattttagaaattaggtttattttattccatttttcctcacctgtctttgaaatagttacattctatttccaattccttttgattacctatagatttagaaaatacacacttaagcatctgtttttccgacagtgtcaagaatttgtcagagtcgagatactctccgaacaagatgagacccatcacataatgtcgcttttgtccactctccacatctccctcaaatcccccatgttgatcccacatggaattttagtgctagattgttatcatttttagcaatcaatacctatttgaacttaacaatacgctaacattattgtacttctacttcctcgcctgtgaaatgtgactggcagcaccaggctcgtggcatcatgaggattcagtgagataattcccgtgcagcacttagcacctgagcaacagcaggaatgagaaccgtcagtcagcatcagctcccgggcgcccttttcctcttgctacagcacatcttctggcacttctttcagaaagtcgggggactacgggagctaaatggttgtttgtttgtttgttttttgaatcagagtctcgctctgtcacccaggctggagtgcagtggtatgaacttggctcacagcaacttccacctgctgggttcaagcgattctcctgcctcagcctccctagtagctaggattacaggcgtgcaacaccacgcccatctgatttttgtatttttagtagagacagggtttcaccatgtcagccaggctggtctggaattgctgatctcgaactcctgacctgatctcgggtgatccacccgcctcagcctccccaagtgctgggattacaggcttgggcctccctgcccggctggttttattttctatctgcatataaatagtggattgtccaaggatttcacctcacaactggggagattttgcagtcttaacctgttcccccaatgctgcggatgagaaggcaggtgtcaatctgatccttgttcctcttagataattggggtttcccctccccctacccacccagctttagctttatcactgacgatccacattgcactttgatgtagcaaggaatgaatttgggggttttggttatttgtgtttatcctgctaggcacttggtgggctctttcagtgaggccagcacctgcctttagctctgaaaaggtagagatgaaaacatgccctggctgttgtcccacccccagcacctcccctttattctctccccctgaaatcctaggagagggatgctatggcctctagatcgtcctccacatctcagcttgcctattgtgcttcccaactccatccctttgtgtcacattccagtaaactccctcagcatcctcgcccagctccctgcttctcccacagatgcccactctgcctcccatcactggagccattcttgcttttgttcttgatgactttttttcattgcaagacctctcatgggttctctgcaatacccactggtctcattcctctctgaggacaccagttatacttgctctaggtcctctctggtggctgtatttgttctgcttctctttctccttgtacatgttcacacctgtacaagtgtacatggtatgggctttcctcggaagttgagcaagacttgactgcgaggtcaccattgcggtgaagcctccgcacaggtcctctgctggatttgtctgccacagcccttgcaggaaaggctgaagcttcagctgagacgtgaacagcactgacatcagtgagagtgcgggccggaccaggcctagctggggtcacttggtaggggctgggcacggatgctcccactcctcccaggaccaccagataccagaccatgatcctgtctctttgaactgagacccatagtcactgatcctgcccaaggcagagccttcttcactgcagcttgacccaaggtaggggaggagggcagtgcgtgctggtgtggccaatcattgcccaactgagaaagcttcacttaaaggtacgtaaaggtacttcacttaaagtaggaggccaagaaaatggtctgcacaggtactcagggagatgcagaagcttggacacagtcagaaaaggcgtaagtgttcaccaggaatgctagcttggagaactttcgcccttaatgtggcactctctttttttaaaggaaaaattccatacctcaggaaagcaagataggaaccaaacatgaaaaattgtaaacccttactatcacaggccaattgcaaagcatcaaatatgtgcacgttggcaaagaaattgttcctgaaaaaagtgcaaattgctacttcactgcatgtaaatgaaccactaattgcttcttgcaaacaatatttatgcaaatggccccgcactctgcaaagctgcacagattatccatttgcatgtacattcgtctctgcccttcctttcatctctcagcgagcggaagaactgcagacaccagctagctggcgagcccccaccacacacacacacacacacacacacacacacacacacacacacacacgctgcctttctctgtgttcctgcaggtccctctctgctacctccttccctgctctttccccatcatctctgccccacagctccacaggaagagagttaagtgtcccccagtcctgccttgcatatataatggtcctgttctcaaagcctctctgcctgcacatgaacgtaaaggcctaagccctccgccatgctgccggagctaacagcatcaggctccttcagcaaagcccacagacaacctaggaacttagagaaaccttttgcaaggcacaacaccattgttctaatatgtaaagactttctagaaatcaataagagcagggcctacatgttaatagaagaatataatcaagtaagataaacaggtgcagaaaataaaatcaactaattcttaaacatgtgaagagtcttaaaatcattcacaatcaataaatgcactctaacactctctaagaggacttctgagcaaccaaagagaatggaacctgcctaggtctgcatcacccccaaaatcctccagaatcagtgcaggtcaacaggaaggtcaagtgaaaccacacaaagacaggaatgccccaacttcaagtcaaccgcaggggaaaaaagggaaaaagaaaaacatcccagcaagcgatttctcacattctttgcagtaggtaggagcagtccaagaataagacaggaaagagagaagaggaaagctagagaggggtgtaggagtgctctaaaaccggcagaaatagcaccgttccgcacgtgtgaaaacacggaacaagtgccctttaggtccgcctgctaactgcagagatgggcccgaaaagcacacacaacctgaagtggcacctgtgaaatgcagaacttcaggagaagcaaacgaggaaaagaagggagatgtgctctttaggcatccagcagccaagccaaaaaggaggaaaggggagaagtcccaggtcctgtaggaaaaggtgaaccagaaaatgcagagggcacacatcccccactcccagcacacactcacacacagattcatgcgagaaactagacttcgccacgccgacagaacagactgtgctgaagcaggaaccttgtaaaccacccaaactcacaaaatgatcagaagagtattgtctatttaaagctactacaaaaatcaacacacctcatttgataaaaatccccactcctggaaaaaaagaagtaggaaaaaaacagcaaggccacactctaaagtgaatgaaatatactcacagaagcacctggggaataggaaaacccaccctgagtcagaaattcaaactcttggaatataagtagacaaaagcagaaagaaataaaaagggttggctgaaaccagaaaagaaaggaaagaaacggacaaaattgtctcagaaatgaaggctgaattatgagatgcccaagaaataatagacttaaataaagaaaggcaataaagtagaaaagtaactaagagaatgaaaatgagaccataaaagaaataaaaagggccacagagaagtggggaacatgggaaacaagcaaagaaggaatcatacatgcataactggagccccagaagatgcgaaacaaagcaacgggacaggcatcatacgtaagaccttagtccaagaagatgcctcaaaattaaaagacgagtgtatgtattgaaaggcccacccccatagatgccgagataattaatcagacatgaccaactctgagaaaatatctaatgaaattattatgtttcaaaaacaaattaaaaatagcttacaagagcaaaggagcccgcctggcatcagatttctcaaaagtaatagcaaagcagggcaaagtggagcaacattttccaaacattggtgaaagaaactctgcaccaaggattttttattatagagaaaatatgttggtatttctgcaaggtcatggctttctgagaaaaaattactggtaacctgggttaacggatgcctggaagggaaaccagcctagaaagactcagataatgaaacacccaggggaaggcccagtggctcccacctgtagtctcagcactttgggcggaggtgggaggatcacttgaccccagaagtttgaggctgcagtgagctatgatgcaccactgcactccagtcaaggcaacagtgtgacatatcaactcaaaagagagagagagaaaagaaagaaagagagagggaaggaaggaaggaacgaagggaaacagagaggaaggagggaaggaaggaagggaaacagagaggaaagagagaaggaaggaaggaaaagagaggaaggaaggagggacggaaggaaggaagggagggagggagggagggaaggagtgaggggaggggagaggaagggaagggaaggagaaagagagcaagaaagcaagaaagcaagaggccaggcgcggtggctcacacctgtaatcccagcactttgggaggctgggagcaggtggatcatgaggtcaagagatctagaccagccagggcaacatggtgaaacccgatctctactaaaaataaaaaaattagctgggtgtggtggcaggcgcctgtagtctcagctactcgggaggctgaagcaggagaatctcttgaacccgggtggctgaggttgcagtgagccgagatcgcaccattgcactctagcctggagacagggtgagactctgtctcaaaaaaaaaaaaaagagaaagaaaaaagaaaggagagagagaaaggaagagaaagaagggagggagggaaagagagagaggaaggaagggagggagggagggaaagagagagagagggagggagggagggagggagggaaagagagagagagggagggacgggggagaaagaaagaaagaaagaacccagggaaaaggttgacaggtttatctcccttttggtatgtgtttagatttccaagccagatgaaaatcaggaccgttactttacatcccaaagaactgtaaatctgggacctttcccttctcttctcagagaggatctgttgacattagaaaataaggtttatcttacactctcccatgggtgtaacagttcctacatcagctctaagactcataatcttcaggtttccctcctgtagagcaaaacccccttttgcacaggcagcctcctctcgctatcaccacattgtcccaggtgggcagcagtcacgaggaaccaatgccaatatgttctgtaaataaaaagtgggtctccctctaatccagaaatgttatgctcactcgtaggattgtcagtggtgttggaagcagagcgactccatcttgagtgagggctggaaaatgatgtgctcgcccgtaggattgtcagaggcgttcgaaccagagcgacttcatcttcagtgagggctggaaaatgagacggggatttgctgagctgcatcctcagaaagtgaggcattccaagcctctagatgtttacagttaagggaacaaatgaataatgtttactaaacagacccagacttgggagtgttcggctatcccaatatctagagaacaacggcattcctaattttgctttaaaggtaataatatcaatccttgcaaaatatagcaattaagaaaattaattctttatcacaaacccttgtagcagagcgcatctccccatatataccagcattgtacctagggtggacgcgttcctcctcttactttcgggaacgctctactctgtctacgaagtagctgtccttttaccactttacttccttaataagctcgcttttactttgcactgtgggctcgccctgaattctttcttgtgtgagatccacgaaccctctcttcgagtctggatcaggaccccttgtcctataacaggatgaaatagataagcatagatatacaaatatatcaatatctagtgaagcttcccttcaaatatcaaaactatggaaaacagttttaacaatacaagaacttagaacattctgaaccaggagcccttgtcttatttttttatttatttattttttttttgagatagagtctctcactgggacgcccaggctggagtgcagcaggagtgcaatggggcaatcttgactcactgcaacttctgcctcctgggtccaagtgattctcctgccccagcctccctagtacctgggattacaggtgtgcgtcaccacacttggctaatttttgtatttttagtagtgatggggtttcactatgttggcctggctggtctcaaactcctgacctcaagtgatccgcccacctcagcctcccaaagtgctgggattacaggtgtgagccaccgcacccggcccaagagcccttcttgaagaatctactagaatattaacttcatccaacccaaaagatgactgtgctccttcagcacaaggagcatcataagggcagagggtgaaaggttcataactaatgttgtgtgcagtgacaaggtaggaatatcgcaactttgaaacgctggagaagagagagggaaggaggaaaatagcatcagctcacttacggtgacacaggcaatcagggggacagttagttactgcccaaaactaacaaacccacggtgaaagtttaggtgagaaaacaggaaactaagggcacttaaaaaggataagcaatccttagaataaaaatacaaacccctgagaaaaataacaggaaagaaagagcaaagcttacacatcacatggcgaatgtcacgatatacacatattagaaaatattataacagctgacgctgaatgcatgaatctgtcttggtcctgttaggctgctctaacaaatacctacaactgggaagttcacaggcaacacagttcttggggctgagaactccaaggtcaatgtgccagcagattcgatgcctgtgagggtgctttccacgtgtcctcacaaggcgaagcggcaagcggttccctcgggccttaacaagggccttaacagggcactaatcctgttccaaatgggcagcccttctcacatcctagtacaacaccttgggagctgggtttcaacataggaattttggggggacgtgaacacttagaccatcacaaagtcatgggcttgattcacttaccacaggaaaaaaaatcactttggctcacaagtgacatccaactacatgctgtattcaagacacagctgaagtaaagtgatccaaaatgctggaattgaagggatgaacgaaggtacatgagtcatataaatgcagcaagaaaagaaatggggaccacgctagcaggcaaggtaaaattcaagacaaaaaagccttaggcagcacgaagaaggactttttaatgcaaaaagacaagattcacgcaaagatcagttatgcaacaagtaactcagggccagatgtggtggctcatgcctgtaaccccagcactttgggaagctgaggcaggcagattgcttgagcctcaggagttcaagaccagcctgggcaacatggcgaaacccagtctctacgaaaattagctgggcatggtgggcatgccttggtcccagctactaggaaggctgaggtgggaggattgcttgagtccaggaggttgaggctacagtgagccgagatcatgccactgcactccagcctgggtgacagagcgagaccctgtctcaaaagtaaataaataaaaataactcagcaaccaccttcaaggagcaaaaacacagaaactgtaaggagtcatagcagcaaactagcaataggaaacgttagcatatcactcccggagcaaggcggctcaagggaacaaaaaaataagtaaagtgggtcggcttgtgtccgccaggaagcaggcaggcgctgaagtcaggatgtaagaggtgcattaggggcagcacctacggaaggtgaaggtgaagcaggcacaggattggacaggcagagccgggggctgagacgtatgtctcacaaagtctcaacaaccctgggggaggtttaaggcaaagactgcatgaaaggcccaggtgaacaaaactggccaggtcctcatcccatgcctgcccctgccattgcctgaggctgcccaggaagaacaaggcctgctgcaagcattgtggcagccccggaaggggctacagctgcaggccattggctaactgctcctctccagcagagagacaaatgcttctggaaaggagatctgagcagctcacctccctggctgccacatagaacacagaagatctaaacaacacagcggctccagtagagccagtgggtgcattttatattcacacacacacacacacacagacacacacacacacacaatttacagttttagcctggagatggatggtggtgatggttgctgagcgatatgaatgtagttaacgccactgaactgttcacttacaatggttaaaatggtaagctttatgttattatatttcacacttaaaaacctacactaagataccttctcatatggatagaaattacaaagcatgacaatatactctgttggcaaggctgtgggaaacagtaactcttatacattactagtgggagtgtaaactgctacaagcctttaggaggtgaatttggagttgttttttttttttttttttgagacagagtctcgctctgtcgcccaggctggagggcaatggcgccatctcagctcactgcaacctccgcctcccaggttgaagcgattctcctgcctcagcctcccgaatagctgggattataggtgcgtaccactgcacctagctaatttttttttttatttttagtagagaggggtctcaccatgttggccaggttggtctcaaactcctggcctcaggtgatcctccggcctcggcctcccaaaatgctggaattacagacgtgagccaccaggcccagccggaatttggagtatcttaccaaactgtggcctgtagtcacatttccacccggctatcccacctctggggagccacacggaaactgcgtaagcccagagttattcattgcagcctatatggggaaaccctgtatatcaggcaactggagagtagtggataaaccataatacattcatgcaatgaagttctatgcagctttgaaaaagagtgataaagactcctaagaactcaactctgtgagtggcttccagatgaactttttacattataaaagcaaagagcagaacagcatctatagaatgctctctttgtgtaagaagtaaatggaaacaggaaattaaacatgcagctactcttttgtgcaaaaagaaacacagtgatatggtttggctctgtgtccccacccagatctcatgttgaattgtaattcccagtgttgaaggtggggtcctgggggcaggtgacaggatcatgggggtgatttctaaaggtttagcaacacctcactagtgccatctcctatagagttctcaccagatctgatgtttgaaaagtgtgtagcacctcccactttgttctctctctctcctacagccatgtgaagatgtgcttgcttctccttcaccttccaccatgattgtaagtttcctgaggcctcccagccatgcttcctgtatagcctacagaactgtcagtcaattaaacctcttttctttatattaacaaattacccattctcagatagttccttatagcagtgtacgaatggactaatacaagaataataaacgagaaacatataaggttgtttggctatagaggcttggataaaccaaaggagtggaaaagatgggggaatgggaacagggtagcaagtgggggagagacactgtgggcacttttattttctattgttctgacttttagaaccatgttaatgcttcacatgctcaaacataaataagtaactaaaatttattaaaagaaccagagctgcttggagaaataactggagaagggaaaaatcataatcttgaactacagaagtaatcaaaaaaatgagagggatgtgtcaaaagaacacaggggtggccaaaagtagctcccaatggcatcggctgggaaatctgtacaacaacataaataataatcacattgaactaaaatagctaaaatcagaattcatgggtctatactgctataaataattgaaggaataatgaataaatatataaattataaaaacattcaaaagaaaactatggtcattagaatttttaaaatcagtgaatagattcatagaagttaagacacagctgtagagaaaattactatctgtaaaggtctgaagaaatcatccagcaggcagagcaaagaaatgaaaagagggaagatatgaaagagcgtcaagaaggaaagaatgaagtttaccttatctctaattggagctccaagagagaatagaactgagaccatgtttgagagaccgtgtgccggtccccaaaaccacccccaaacatgagatttgctaaaaggattcacaagacccagcacattgtcatactcatggctaagatttatcacggcaaaagaatccacagaaaaatcagcaaagggaaaagtctcatggggtgaaatctggaggaaacaaggcacaagtttccaggagccctgatatggtttagatctgtgtccccacccaaatctcatgtcaaattgtgatccccaatgttggaggtgcggcctggcaggaggtgctggaatcatgggggtggatttcctatgaatggttgagcaccatcccccttggcactgtcctcatgatgatgagtgagttcttatgagatagagctgcttaaaagtatgtagcccctccccactcagtctcttcctcctgttctccatgtgacgcacctactcccccttctccttccaccatgattggaagcttcctgaggccacctcagaagctgagcagatgccaacatcatgctttctgtacagcctgcagatccataagccaagtgaccctctttcctttataaattacccagtctcaggtatttttatagcaatgcaaaaatgaactaatataactcctttcctaataatagtcacataagatgaacttaattcccccagcaacaaattgtgatgacacaggtgagttattgtctaccaaagcagctcatcagagttgcagtacccagggattccagctggtcacacaggcaccccctgcctagcacataccaaaactccaggctcccagaagaaaagcaggtgtttagcataaactaactttactatttgcacaaactgtttagagacaatgagccactcactcttgtcagttctagaaatgacaagcaccctcctgaaatccatgtttggccaaggccatccttgtgagtagcctttctaagggtgagcagtctcaggcttgccacagtcattcttttcttcacagatacaatggctgagaggtttccagaattgatgaaagacagggattctcagattcacaattcctaataagttctaggcagaataaataaaattaatcacattcctaattatatctcagtgtataactgcagaacatcatgacaaggagaatatattaagagtaaacagcaggccgggcacggtggctcatgcctgtaatcccagcactttgggagcccgaggcgggtggatcacgaggtcaggagatcgagaccaccctggctaacatggtgaaaccccgtctctactaaaaatacaaaaaaaattagccaggcgtggtagcaggcatctgtagtcccagctactcgggaggctgaggcaggacaatggcgtgaactcgggaggtggaggtggaggtggcagtgagccgagattgcaccactgcactccagcctgggcaacagagtgagactctgtctaaagaaaaaaaaaaaaaaaaaaaaaaaacagagtaaacagcaaaaaccagaagtattggtttgctaggcctgccataacaaaataccacagactgggaggcttaaacaacagaaattccttttctcagtcctggaggctggaagtccaagctcaagctgtcggtgttggcaggtttggtttgtgctgaggcctctctccttgcctggcggatagccaccttcccagtatgctcttccatggcctttcctccgtgtgtctctacctcttcttataaggacaccagtcagattggattaggatccccctcagtggcctcgtttttaacttaattaccttttatagaccttatccaaacacgattacattctgaggtactggggattgggatgtcatcctggggagtggggcacaatttagcccatattggcagataacctacaagggaactataattcagctgacttcttaacaacaacaatagaagccagaacagagtgaggaaatgtcttcaccatgctgagagaaagtatgtgtcaacctggaattttatacccaacaacattgccagtcagggtggcaactatattttttaaaacactttcaacaaacaaaaattaaaaattgaacaatcacattccttcactgaaagaattcctaaaggatatttttcagagagaaacaaattaaatccaaaggaaggagtgagagtcaagaagtagtggtggggtgctaggcatggtggctcacacctgcaatcccagcactttgggaggccaaggccagtggatcacctgaagtcaaaagttcaagaccggcctgggcaccatggtgaaaccatgtctctactaaaaatacaaaaattatccaggcatggtggtgggagcctgtaatcccatctactcaagaggctgaggcacgagaatcgcttgaacccaggaggcggaggttgaaatgagctgagatcgtgccattgcacttcagcctgggtgacagagtgagactctgcctcaaaaaagaaaaaaaaagtagtggtgaggagaaaatataaaatatgtaagtaaatccaaatgagattaatcgttattaaatgatgataaggacaaattttgtgatatgaaaacaagaaataagatgaaactaaaataacagttcagaaaaacacatacagaatagtataattaccattcaaatattccaacgtccttttaatattctagaggattgtatagattttgattgcgtttagactttaagccaagtatgcatgtatctactaaaaataaaaacagaatttggaaagaaaaaggaagaaggaaaaaaatgcctcagccccacagaaaacagaaaacgagggagaaagaagccaaggaaaatcacaagaaataaaaatcacaaaataaaattgcagaagtgaatccaaatgtgtcaataaatatgaataaactgaacttgcaagttaaaatagagcttcgacaaaaccaaatccagctatacgctttcctaagagatgcaaaatacagaaacaccaacaatttaggtttcaagaagaaattttaaaaattagcaaatactttattctctttaagtttatgaagttatattaataccaaacaaaataaatgtcaagtaaaaaagcattagtaaagattcagagattaccgtagaatgacaaacatagctcaaatatataaataaaaaaggttcagattacaatgaaaaattgacaagttgacatcagagtggaagattttccacttcacaactgaaaatcataaaaactaataaggatcagaaagaagagaaaagcacagtgaagcagcacagtctaaggagatgcagctgaagtaatgctgggaagggaaatatgtaacctaaaactgcacatattgtaatataatagatagttaaaattcttgagttaagaatctaaatcaagaaacacgaaaccagccacaccacaaacccaagaaaggaatggaaccataaatgtatgtgcagaaatgaatggaacagagaacaaaaatcgctaagaatgactggccaaaactagatttttttttcttttttttcgaggcagagtctcactctgttgcccaggctggagtgcagtggcatgatctcggctcactgcaacctccacctcccgggttcaagcaattctcccacctcagcctcccgagtagccgagactacaggtgcgcgccactacgcctggctgatttttgtatttttagtagagacggggtttcaccacgttgcccaggctggtcttgaactcctgacctcaggtgatccactggcctcggcctcccaaagtgctgggattacaggtgtgagccaccgagcccagccaaatctagatttttgagaagcaaaatggtaaaatagactaacctgtctgtaagtactgttttagctgaaccccacaagttttgataagtagttattatgcaaatctaaacattttctaatttcttttatgattttgtctttgaaaatgaattatttatacgtgtgtttttcatttgacaactatggattttgttactaccttttgttactgatttccaagtttaccacagtttgatcacagaatatggccccaacaaaccactttttggtatttttgaaatgtggccaacttttgaaaatgccccatgggtgcctagaaagcatgtgtggcctgggattgagtgcagttaccccaggtgtctattcaaacaaacttaattgtgcttttcacatcttccctatccctgttcatttttatagttgtcagttatttgtgactgccgagcacttgaaatgtgactggtacaactggcgtgagaagctgaattttaaatgttattcagtgttagttcatggaatttatttatttttttattttttttgagacagagtcttgctctgtcgcatcggctgagtgcagtggtgccatctcggctcactgtcacctccacctgccggcttcaagcgattctccttcctcagtctcccgagtggctgggattacaggcgccaaccaccatgcccggctaatttttatatttttagtacatgttggtcaggctggtctcgaactcctgacctcaggtgatccacccacctcggcctcccaagtgctgagattccaggtgtgagccactgcaccctgccagttcatgggatttaaatagttccacgtgcctagtggctacagggctgcacagtgcacagggcaggcatcaaagctgctgttgaacaagcggcatggggaactttggctttccgcacaggatgcattaaattcaattcctgcggggcgtggtggcttgcgcctgtaatcccagatacttaagaggctgagacacgagaatcacttgaatccaggaggcggaggtggcagtgagacaaggctgtgccactgcactccatcctggtgacagagcaagagagtgagactctgtctcaattaaataaataaattaattaaattcctattctataccacatacacattaaattccacacggatcaaagactaacaggtgaaaagcaaaactataaaacttttcaaagaaagcttgggagaatatgcttgtgatattgacgagcaggatgatttcctaaacaagtcacagtgttaacaaacaataatggaacatactgataaatttgtctggattaaaatgtaaaatgtctgaaagtcaaaaacagactacaaagcgaaaggcaaacacagacttggagaaaatctgcaatgcacgtgactaataaagaattggaatccaggatacagaaagaactcctatgaaagtcaattttaacaaaaaagacatccaacccagctgaaaagtgagcagagggtatggtcaaggtcattgtgtccccagctcttcacacaaggcacactgggcccctgccaccctccagccctgcctgactcctcccgggagaggactgagccaccagacaggcaggtggcaggcatgggtctccacctctgtgtcatggaagaaatctcttcaaaggccatgcgctcaggacctgggctcttttctcctctctctgccctcaacctttgcaaagcagcaaccctggagaggctgccggctgtgcctcccgacgcgcctccaggtagaaggccccgccacacaccctgtgcataacttggtcccctcctccgcccttgctttgcagtgtagagggtgatttcccaacacctgtagactctgatgctcaggcttccccatcctactcagatgagggacgccagagggtctttgctgatttcctgaaacctcagcaggaaggcgcaggttagtctcaaggagaagaaccaggaccggccaacgcacccgtacagcactgctccaggtgcacgaaatgccaactggaaaacagagaagctacttcccagccaccggcctgggagcacccatggagcacgggggtcagaaactcctacttcctccacgggtggggcaatgggatgcagctgtcatgcttgatttattccagagggagctgtcaacaacaaatagcgcacaatgtcggcctgcgctcttgcgttattttctgcacttctgtggaggccagtcgtgtcgcaccactgaataacgtttccagtggaatataccacaaacggccacagagctcctcttggtcttgtttatatgcctgttttctgaatgtgcttctgtgctttgtacagaaaaagagtaagatatttggctgccaccagggccaatgtttgccccatgggagtgacattgccactggtgagaacaaagagccccttgcaacacagtcacgtctggatggcctccgccattgcgctggggccaggcaggcacagaaatggcagcagaccagggccttcaggcccagctgcccctgacttagcctgaggccctgcagtgccaacagcagaggcccccacggtgcgaggcagccgtgctgccagggcgggctccagggagctgagcccatgaccaccagccccaatctactgtcctgctgcctcccacagctacgcagggttcccccaggagcccaccccttgctgccgtgaccaccatcgcttcctagctgagagcccacccttgctggcctctgcctggttcttgatgaattcagccccatccatccttccctcctggcagcctgttagtggctctggggaagctggcactgattaatgacagcaacagacgacacccatctgcccatcaggtgaaaactcgccgctgtcatctgtcctgtcagaatctacgagcagcatgggagcccgcctggctgggaccccgcgtccctggccgccccctggcctgaggttccaagcagggcctcagactgatgtggggacagatgagaccggtggggccagaagggctagctctgagcctgccgggggctgaccaggagccctgtccccacagggcagctgcctttctcagaccactctgaggtgagcagtggaccccgaaggtgggctgggtcccctgccttcacctcctcccctgtcaggccccccgaatccgactgacctgggtcagctctgccacctgccctgttctctccagcgcacccagggcctcgactgagccactgcccagggtcctgctgtgagtggaccggaaccagcacgggctcccggctaccacctgcccaccccgccaagctgtcccactgggacctgacagggaggagcccacactggcacgcctgacaacagccataacctttcctgtgctgcagagagggaaactgaggctcagcaaggccagacaatctgaccgagcactggcctggcctcctgaccccaaaatctgtgcccctggggaaagagaagaaagaggtaaacgcattctacagcgcaatccccacgccaaggggtgtgttcccctgcggcagggccctggggtggacatgaacacccaggtaccccatggcctgctgacctcaaaggggagagggcccagctccagcagccctgccccgcaccaccccagagggagcccagagatgggttgtcacggccaggacactacagggagggccaacgggaccaggggcttcaagccgacagcttagggggtgttttctctgcagaaaacccctctgctccccagcggagaagctgtgcctgcacctgggatctgctttgcatgtagagggggcagtagccccacacaggaggggctgacagggccagagcacagccgagacgccgcggcaacccacagaagattccaggacacaagcccacagcccacggtggactgggcaggggagcagtcgtgggctccacacgtcccagaacgccaagctgcctgaatcggggaggggctgggggtcggcacacacaggaggcaaagggcatggaggggcatccccaatcccatcaaccccgaaagcccccgggggccggcctaggcgccccatggacctgcagttgatggggcctggtgcacgcccggaggatgggccctcaatagcagcatgaacaagtagcccggagccaggagatgcacctgccgccccagggaagtccccgccctgggagggttggggtgtggcagccagtgggggtagcttcagcttcatccacagttgaaggatgtctggaaggtggggaaggaagggcctcgcccgcaggactggccgggcctgccaggaggttggttcagtctcgccctgctgggggatgcatcctgagtggagggggctttccagcctgcaagggtcacacaggaagcctagggtcactggtgatgagaggacagggctccaaggggctgggccatgtgaccctggccccacatcccctctgaggggctgggccgtgtgatcctggccccacatcccctcaaggggctgggctgtgatcctggcccccacatcccctcaaggggctgggctgtttgattctggccccacatcccctcaaggggctgggctgtgtgatcctggccccacatcccctctgaggttgaggtgcgaggattccacgcgtgtcccctctcctgccccgcatcctcacccgtgctctaccagcatcccagccccggctcttgcacccatccctccatcctttcttccctcccgcctccttccattccaactgtgtgagctagcttgggcaccgtgagtgcgtaccacccaccgggggtttaaaccacagacacctcaccgtcctgggggtggagatcaggcgcagtgctgcactggggccccgggaagcagaagacggctcctggcacatctcctgggtgcatctgtggattgctggggcccccagcagctctcccaatccccagaaacccctcctggatctgctgtatccacctggagcctcttggtgcacagcggcacacacaatacctccactctccaccccgaaggatgcccactgcagcggggtcctcatccacccagcctccagccaccccatcctagggccaccggggtccccagccagcttctaattgtcacccacggccagtgctcttggctctggaggaaggagatggaggcttcgcttgacgttcattcctcatgggtgtggagaggccccctccagggccccttcccctcaccccacccggcaaccagaaccgcgaatacttcacacggtactttgaatttaatggttcacatgggctcctctctgagctactgccttttattttatgactaaattaatattatacatacaagagcacatttaagacacccgccagaggagcaggaacggtggtcgtgtgggaaaggatacatttttacgcacacgcgtctccgggccattaacgggccgcgcgtccatctgtgtccacagctgaccttaatcctgtcccagcgcctggggcctgaagctcgtggaatcacccgcctcacgtgtctttgcggcccactaatttgtgcgtgttcaggatatattgggtttcataatttttatatgcaaatcaataaaaagccctttgctatctcatttaaatcagcgaataattaaccaggctgtccagcccacctccattctcctcaaatccctggaagtgagaggggccagcactgaccaggagagcagggtcccagggccccctctggacagactgcccacacagtgggcgctgggtctgctggacccaggaggcctggggggctgaccacctcctccgggacatggtcagagcaatggcctgagccagccctgcgaagaccctggctccgagagagcggggacagtgacagtgcttcagacagtcacccactgaggaacgggcaccacccgtcgcccgagacctgtgtcgccacccactgaggaacgggcaccacccgtcgcccgagacctgtgtcgccacccactgaggaacgggcaccacccgtcgcccgagacctgtgtcgccacccactgaggaacgggcaccacccgtcgtccgagacctgtgtcgccacccactgaggaacgggcaccacccgtcgtccgagacctgtgtcgccacccactgaggaacgggtacgacctgtcatccgagacgtgtgtcaccacccacgcactctgcactccaaggctccacacagagaaacaagggcgtcggggatgctaagtccaaatgcgattcaggggagcccagctctgggagtggggcatcttagggcaccttcattctgtgattttgctttttttccctgtttatggatgcgtaagagtgagctatgataaaatcctatgagtaagtctgatagctctcccatgcatgtgaagtggagcttctatgtgataaagcactgtgtcatagttttacaggcagcattttttctttcttagaggtacataaaacaacagcgcaccttataatcagcggcattcaacaaaatggttaaaaaataataccccgcagtccagcagggtctatgcaagaggaggaagaatggctcacattagatcagaccctcaggtgactcaccagtctgctacaaggactaagggccaaaaaaaccgcatgaattatctcaatagacacagaagacccatataaagttcaacacctatttataatttctaaaaactctcacaaggctacaaataaaagagaacatctttaacctgaaaaaacctactttccagaaacccccaggaaacatcagacttcacagagaaatctaagacacaatctcttccagactagaaatcaagggcgacccttatcaccactcagtttaacataatctcgaaagtcccaggaaacactgcaaacaaaaaaaaaaaaataagaaatgaagaggtgtaaggactggaaaggaagagataaaactgtcacgactggtggataacgtggccatctatgtagaaaatgtcactgaatcaacaaactactgggacgaacagttacaagataaacctacaaaaatcaataatgtgactctatggcaacaataatcagccagaaaataagataccattcagcaactgaagcaattaagtggataggaattaaattaccaagggacgggctggccgttcgctaagaaaattctggaactcagtgaaaggacccagccaagccactgaaaggagaaggcagcatggtcagctcgggagtgaccagcagcacagcccacgacgtcgccaaattagcttctagattagtgcaacgcaaagcaaagttccagcaggcattttaaagacacccgaccacagccctattctcggcacgtgatggaagaaggggcgtccctgaatgacaggctgattgaaaagccaagagaaagggctcactccaccagaatgaagataaactatgaagccatggaaatgaaagataaaaataaaagccagcacgctgccggtgacggagcaagcccaccctgaacagactcagggacgtgtgggaactccttaggtaaaaggtgactcctacaaatcaaggagaacacagcgtaggggaaagtggctcgttatacggagacaaaaagtcacgccggccgcagatggactaaaggggaaactgacaaacacagcagggaggctaggcagggctcggggaggaggcgcaccctcaggaccgtgttcacgcaaccctagcaccaaagaccaccagtaaccaccctccatgtccgcaccaaagtcaacaaaagaaagatgccccctgaccacagatggagagtgggctgaagggagcctggggaccccgctgggctgtcccctgaaagtggcaccaagcctgctggaaggcatcatctgctgggcccgaggcccaccccagacaacgccagcactctggacccctcctgccagcactcagccaccccctgcccactcagtcttaccgaggtgtgcatggccgacagagttcaggcactgactttgcagctggagacagggccttgacctcagggactttggaggtgttgggaccggtcagtggggacccattctgtgggacttgggcatggagagcaggtgcgggccaggatgtagctggggccacgggctgcacggggggggcctcaggggcaagtccagggattgttccagcccccactcccaggtccccctggagaccccacttccctgatggccaaccgcagtcccagcttcaaacaggttctttgagggggaggagaagcaatctccttcatataaatgtttaattgggaattaatatggatgaggctctggagtgatgaggctgtgggtttaataaatattaacaaggaataggcctccccttcctgtgctctgtgctaatccctctgtgtagcatccattattcaccgtgtttctcaacgccaaccccggggatgggggtggggtccttcctcctggggctccttccatggaggtactttgaatccctggcctcgggggctgagggttctactacaggatggatggatcggctttctgtgggtgtggaactctgaccacaaggacactcactggcccatcttccattggcacagacacacactcactgaccaggaaatctatattccagccttaccttcagccccactgggctcctgccactgatgccacctccaccaggaagcccacctggtctgcccacagggagcagcacccgtccctcagggcagccacaatcctctctcctgacctggcaggggctcggagacccagcgaccccgcccagcccgctgcaggtgggctgctgtgaggggacccagttctctgattggactccaccaaggggtccagaccctgtccacactgctgcctggccgggccgcaggtggagctccggcgccctcgtgtggcccgtgtgtgcaggacctcagccgtgctgccccatgggaggatccagggagccgagcacaagatcagcgattacccaggtcacagtcccaggatgcacagagcccgcgtgtggcactaggagcgagccccaccctcggcttgggtttgcacggtcccggcagtgcactcgcttcataacctgagaacgtccctgtccacacagaggaacagccctcctgcctgagcttccacccctacactggtcaggccccctctgctgcagctgcccccggaattccttgcagggattgaggggtggagcccgggacctctgctgcccaggcccactgaatattgggcagcccaaagccctgaccctacctcccccttggctcctacacacccctgggcacgtgtgcctaggggcagcacagcccctcccatccatgggatgccaaccccctctagtgatgcccaccacgtgcggggtctcaaaggcccagtcctgtgccctgcccaccctcctcatccctagtgaggatggccccccatccctggtgcgcacggccccccatccccagcatggatggctttgtggccttaacgggaccctccatgaatctccatgggaagtacaagacccatcccctagtgcctgctccaccctcggaggggcaggaccgatgggtttctgtgcccactccacccctttatctgttcctcctcccctggggccccaccaaagccacgaggaggggaggcaggggaaacagcccccattggctcctgagttgaccccagcaaagcacccacacagaggcagaagcggggggtcctaagaggccagctgtatccaggggcttcaagatgccccctgcactcactcagcaccaccctcaccccacccagccgggccggacagataagggcctgggccacgggtcaggagcagagggtgctgggggcacagacctgtgagggtcgtgggggtgaaggacctcaggctggaaagaccccaatgagtgagaaagccagatccccatccttcccagcccccaccgtccccactgcccccactcaccccccgcccaggtatcccctgagaaggcaggctggggagacagggagaggacagttagggtgaaggggaccagggctgtgctggggctgggccgctctcactccatcccttaagccccttcctctctccagcctgccccctccacacccagcctgcccactcccgccacccctccctggcatcccacagctgtgaccacagctgggacaccacggagcactcaccacagcactcggagcagccaaaccctccccttggccacaaggaccttcccagtggccctctccagtctcacctgcaagcacccctctgcttacgctcacagaggagtgaatgcgtgaaggccccacggggtgaatgaatgcgtgaaggccccacggggtgaatgaaggagtgaaggccccatcaggtgaatgaagtagtgaaggccccacggggtgaatgaatgagtgaaggtcccacggcgtgaatgaaggattgaaggccccatcaggtgaaggaatgaatgaaggccccacagggtgaatgaatgagtgaaggccccacggcgtgaatgaaggattgaaggccccatcaggtgaaggaatgagtgaaggccccacagggtgaaggaatgagtgaaggccccacagcgtgaatgaaggagtgaaggccccatcaggtgaaggaacgcgtgaaagcctcatcaggtgaatgaatgagtgaaggccccatcagggtgaatgaatgagtgcaggccccacagggtgagtgaggagtgaaggtggctctgcagcctgcccggggcctggtgagtctcacaagccccgcattcgcgcggcctggtctttgtccagcagagtctgagcagagtcccctccgtctgccctggccctgggaccccctctctcctcgacccaggggaggagtccatgctcagcccagggctgctgggagatgaacccgactgcctgtggctgcacccctgtgtcagccaccactgcgggtttcaaggctgaagctccacttccttcctcccagaaagtctcagcacaggactccatccgggatccctcaaggtcggaacggccccgggcccacagggtgggccttgtggagacatttctgccaagatggaactgagagccgtctcggtggtgggagaggacagcctgcctggggctcggggggaggaagctgttctcggggccttttctgaccagctctgagcactctctgggaccaaggcctctggagcacggaggcctgggggctgtgctggtcacccacacacaggacagcccctgagccagagacagccatgctcagaacccagagaccagaggccccaaggggaatggcaccctcccccacacccaacctggtcaagtcagtggagccaccgcctggcctggggctgggcagcccacggtggtcccagaggaggagagttgccatgtagtgacagccccacagaggggcacatggaagcacccggaccggtccgaccccagaaaggctcaggcacttgggtgctggaagaggtgggagaggcaggactgggctgcatggaggacgccatccacggccgcccctgggcagtcaccatggtcctgggcagttacacctaccacaggggaccactggctcagcttcctccccacagcgttcactcctcaaaatccagctctggcgaccgctggtgcttccgcagacttaaggggaattgtgttatgaaccggaagggaatttctctgctttggaggctgggtgtggtggctcacgcctataatcccaacactttgggaggccaatgcgggcggatcacaagttcaggagttcaagaccagcctggccaacatagtgaaaccccatctctactaaaaatacaaaaaaaattagctgggcatggtgacgggtgcctgtaattccagctactcgggaggctgaggcaggagaatcacttgaacctgggaggctggggttgcagtgagctgagatcacaccattgcagcactgcagcctgggagacaagagtgaaactccatctcaaaaaataaaagaaagaaaggaaagcctaaaggaagcacaggaggccgtccgtcagtccggaagcccaccccagagcccccttctgggatcttgcattgtgcagagaggtggcaaggccccgtgcccctcccccacctgctacccacccgccccccagcctcgtgtcctgacaagctggcctggagggtcagggaagggtcttgtgtcaggttgctttgggtgctggtgcccctccccaggacagggaagggcaacgaacaaaaatgtgggtgggaccggcatcctgatgctatcagggtgacacggcccagaacatattcccctttatggcctccctagagagccaggccccatcccttcccctccaccagctcctcacgctctggagggatcacagacctaaggagagccaggtccccaccccagggggctctaccaggggagttcaaaaagaaagagaagaaggaggtggcattgtgggaatattaccatcgtacttcgccttgaaggtagatttcagggcaaaagtattaatggaacaaagagaatattctatttaggtcagaagtgtaattcaccctgtcggcaagcccagggttgtgtgtttcacccagacattggtctccaaggagagaaaccctctgcgatccttctaattgcacttgtgcaaatgctacacgcacgtctccctgagctgactccaacactcattcattcctcctgtgcctgcaggaaagccagcccgggcatctcagaatatgaagttaatgtaggagaggccagtggtccagaatgtgtaccaggattctccagagaaacagagccaattggatgtgtgaacgcctatcttcgtatgcatatgagagagactgattgcaaggattggctcatgcgattacagcactgagaagcccccagatctgcagtcagcctgcgggagacaaaggggtcagtggtgtcagttgtaatccaaggccaggagaagacccacgtcccagctcagtcaagccagaaaagctcactcctactcagcctctttgttctatttgggtcttcaattgattggatgtggcacccacactgggaagggcaatctgctttgctcagatggcaaatactgcccagtctgtgaggctccccgaggcccagccgaaagcagacctctccccgggctgcccccacagccaccctgtgcaattgggcacctgcaacctggacttggcagcagtcagcattggagccatcgactcaaaagtctcagcacgtggattaggaactgagcactagaaatccacgctgattatttcatgagacttgagcccttctctcgctaccagccaagcagcacccaggcaggcccagaggacagcaaatcttggagctagagaacgcccagcttgagcatgacacaggcggtcatcacggtgctctattggttcctggtcttcagggttcattttactggcgtaagaggccaggatggttgcttttgttttctaaaacccttaaggagcaaaatcccacacaatcttggaggaaattaaatttagaaattagatgctaggcttggcagagaccttgacagggccccccacagggccagactgacacatccattgagaccacatcacagttattaaccttttgctccaaaacatatggaaaaaagctgctagaaacacagggagaatcttcctaaaccacagtcacagtgggagacttcaacacacctctctcggtaattgtcagatcaaagaatgagtaaaggaaaaaagaatattaatagaacaattaaccaccataaattaccagatctacaggacttcacactcaacaaagaaaggaagtgcattcctttcgaataacaaacaagtgaaaaaaacagcatgttcaagatccccaaggaaatcccagtaggtccctgaaggggaaattgtgaaactctgatcacagtgcaataaaacagggaactaacaacagatcaccttctttaaagtcctcacctcttgtcagcttagacgtgggatagacactacgtctgacacgttttctacttacaggctagatgactctgcttcctcatcggcggaatgaggaccaggctgttacacgtctctgtattctgcaagttaaaggcagtgaaacacttaatatccacagcacacagagcgtgacacacacagacagcactcagcgaatgttagctgccaatgctagcgtaagacgagatacacactcttctgaatgactctgagttagaggaaatgaaacatcaaattagaggctcaactaatttgataacaagagcaccacacatcaaaaaccctgggacgcagccaaagtggctctcaaaggacaaagtatagccttaagtaattcttttctttttttgagacagaatctcgttctgtcacccaggctggagtgcaatggcgcgatctctgctcactgcaagctccgcctcccgggttcacgccattctcctgcctcagcctcccgagtggctgggactacaggtgcctgccaccatgcccggctaatttttttttttttttttgtatttttagtagagacagggtttcaccgtgttagccaggatggtctcgatctcctgacctcatgatctgcctgcctcggcctctcaaagtgctgggattacaggtgtgagacactgtgcccagcctagccttaagtaattctaataaaaggtaagaaaggatgaaagtgtgctttcatttaagaaactagaagaagaaagaaaatatgactcaaaagaaatttaggagagcctggaatttaggagagcctggaatcacaccctgattcctccctctctatctcctccccagctgtagtgatgtcacttgttattgtattgttgggctgtattattgtattgttcctcacaaatagggaacacatgttacttccaaactctaacagaaacaggctttacatgccaggagtcaaccccaggcctccacagcacaggtattcacactcttcatgcccactcacatgcagggcctccaggagctcagccagcaacttctcaagatcagggacattggaggggcagccagcttggaccaggcggagggaccaccacgccaactccgcaacccaagccttcttccgcagggctcttcaaacatcttccctactattttattctgaacctttgtaaacacacagccaagttgaaagaattgtacagcagacaccatctacctccttctagagtctcccattaacgcatatatggtccaagctctgccctggttgctccctctccccaccagctatgcgtccctcggccgtctttttaaatatgtttcattttattttgttttattttttgagacagggtctcactctgtcacccaggctggagtgcagtggcgtgatctcagctcactcctgggctcaagggagcctcccacctcagcctcccgagtagctgggcttgtgtttacaggcgccaacaccaacacaccagctaatttttgtattttttgtagagacggggttttgccatgttgtccaggctggtatcaaactcctgagctcaagtgatctgcctaccttggcctcccaaagtgctgggattacaggcatgagccactgtgcccggcctcctatttttttttttctttttttgagacacagtctcactctgtcgcccaggctggagtgcagtggcataatctcagctcactggaacctctgcttcctgagttcaagcaattctcatgtctcaaccttcctagtagctggaattacaggcacccgccgccacgcccagctaattttttttatttttagtggagacagggtttccccatgttggccaggctggtcttgaactcctgaccgcaggtgatccatccatcttggcctcccaaagtgctgggattacagccatcagtcactgtgcccggcccttagtacattttaaagtaaattgcagtctactccctctgagcccttcagcaggcagattatagggtgttatatgtaaaaatgtttgtttagaaatagaatgctcgttccccagtgctgcaaagaaacagcacttgaacataaatttaattctctcagtaaggccatttttactttctgcagaaagggtgcccatcgcaaatgcaacaatggcgagagcacatctgaacaaaggagggaagcaatttttatcctgtacacagtttgtccctggtactgtgtcctgtctccattggctggagccaggcctcacaatctaaactaaaacccaactggctaaaagtttaaaacttttccaaataggtaaaagtaatggaaagacaaaggaaaagaagaagttgcttttgccaaatagggaaggggcataggctgtgagctgggatatgcctgcgagcacgtccggtacagatattttggttaaagtacaaagacatggaatgtattacgtgcctgtgagcatgtttaacagctacataggatagggcttcacaaagagttactagcacaaagcaaggagtcttgaaggaagttagtctctaaaagaaactattttttttaacacgatttattctttaacaagaagggaaactttgaagaggaagttttacttcctacatagggaactgaagttcaatattcatttatgatttactggggtcttaccctgtcacccaggctggatggagtgcagtgtggtgcaatcgtgggtcactgcagcctcaacctcccaggctcaagtgatcctccctcctcagcctcccaagtagctgagactacagtcatgcaccaccacaactcggctaattttttttttattttttgtagagctggtgtctccctatgttgcccaggctggtcttgaactcctgcgctcaagtgatcctcctgcctcagcctcccagagggttgggattataggcatgagccacagcacctggccccttttctctatttttttttttttctttgagatggagtctcactctgtcgcccaggctggagtgcaatggcgcaatctcagctcactgcaacctccgcctactgggttcaagcaattctcctgcctcagcctcctgtgtagctgggactacaggcgcccacgaccacagccggctaagttttttatttcattttattttttaggagagatggggttttgctgtattggccaggctagtcctgaactcctgacctcaagtgatctgcccaccttggcctcccaaagtgctgggattacaggtgtgagccactgggcctggcctcctttttttctttaaagtaaaatttacatgtagtaaatagtatttggccataaagggaatgaattactgatacatgctacaatgtggatgaactttgaaaacagtaagctaagggaaaagaggtagacataaagggccacccactacacaactccatccacatgaaagtccagaagagagaaatccatagagacagaaagtaaaggctgggcacggtggctcacgcctgtaatcccagcactttgggaggccaaggcggtggaagccctgaggtgaggagttcaagaccatcctggccaacatagtgaaaccccatctctactaaaaatacaaaaattagttaggtgtgggggtgcacgcctgtaatctcagctactcggctgctgaggcaggagaattgcttgaacctgggaggtggagggtgcagtgaccactgcactccagcctgggtgacagagcaagactccatatcaaaaaaaataataataatagattagtggttgcctagatgacttctaacaaacgcatacacctacgaagagggagaacaccaccaccaatccagaatgttccctcatgccctctcctggcaaagccccacccccaccctaccccaaaagacatcccctggtacgatttcttgcctgttctagaacaccacataaaaggaatcacagcaggtcctgttctgtggaaggtctcttttgctcagcatcatgtttataaagtcatccatattgctgcacggatcgctggttcatattgatattcattagataacggttggaccagtcctcccaccctccctcccgccatctctctctctctctctctctctgtctccctctctctttctttctttcttgagatggagtctcgctctgtggcccaggctggagtgcaatggtgtgatctcggctcactgcaacctccgcttcccaggttcaagcaattctgcctcggcctcccgagcagctgggattacaggtgcccaccaccacgcccggctaattttggtatttttagtagagacaggttttcaccatgttggccagtcttttaaatgaatccaacgaaatctaaatatcatggtgatttaatcatcaatttttaagagacaattttttaacagacttaaatgttttctcctttgccttgtattttccctccactttgcccacagaattttatgccaacatgacatatcttctgctccaagtcctccgctggcctcactgtgcttttccgtaatggaaatatgtgtataaattgaaatgccacttttcattctttacttcataagtctcttatctttaaatgtttctactggattcattatttttcaattattagcccacagttcctcaaaaccactgattgggatataaataatctatattatacattttgattaaaaattgttacacagaaaaaggaagttttcattggggatgcatctcccgatgaaggggacgggcttttttccgtgtagcccctgtttccatgggtgacgacgacttgttgaaaagactcactatcccgcgtggaatgtcctcctgctttttgggttttaggggctagcactgagcgtctttgttcacacgaacaagtctacgggacaaaggaggattggggcagcacttccgcaaacctgagacgggccaccgggaatcgctgctgcggtcgggggctgcgacgccaccagccccagggtggagagcggctttctgggcgtccgggcaagtccatgctccgggtggggaggccgaggggccgaggaagtcgagggtctggacattcgctgccccggagccgcgtgagcccgccccgccctggaacgtcctcccaggcgttctcgcctttgcagcccccgcctgactgcggaccctccactccccactctctccttccatccccgcttccctctccctgcccctcctcctcccccgtcgtcagccttgacaaaggagggcgatgccaccgcttaccgccagagggcgcgccgcgccccccaaacggacactgaagcgggcgccccctggccgagcggggcgcaggggaagagggggcggagggggagaggaggtgcagggacagagggggcccagggggcttccagcctcctgcctgggtcctggtttggttgcccccgcaccacccagcgcttgcccaccctgcctcagtctccccatctcccagcctcggggctcctctggctggctggggcccaccctggggcagagccgctgggtctggggatgggtagcatcaagatgcctcgaagtcctggcctggtcttcaggctccctataattaggactccacccccacccctacaggagcctgtccagaaggtcctgggcgtggctggggtgtcgtggacacctgccatctttcctgaacgctgcagacacctgcgtcccactccagtgcaggtggcctgggccccttcaaggaatggctgggagtgggagggtgggcctggggtttcacggcccacacctgaggccagtcacaccccgactgggccaggcagaagctgcacaaacttcacactggaaaggtggggccaagggcagccccagcccacctgccagcacctccccatccccagcatctgccgggcacagtgggggcacacctaacctccccacccctacccactcttgacatataaggcctcagccaggaagtccagaaggagggcgtggacggggatctgcactggaggcctctaccacctgtgaagccatcgggcctgtgggccgcagggcaggactcccaggtctggagggccctcaggctggcctccatgaggtgccgcgaggctggggtacagagctgagtccccacagccctcacctccctggcccctgcccatcacagcctagctcctcctggagccacctcacctccctgggcctctgtttccccctccgtagagcagaggtgttgacggctttcgcttggaaggctaagccagtctgtctttgcggagtccacgtgctgccagcacacagtccatgctccggagtcagcatcccaccacatggtggaggggatgttctgaaacccctctttgaaactcacagaacctggggacaaagcggggcagcgttttgtcagtgagaagtggccgcaggaggggcccagtgaccagcaccaggtacaggagcagacccacggcccggcccacaggcaccagacaccctgggcacaaccgggcctgggttccctctgacatggggcacctggacagatacttgagcacagccaggccttcagatgacagccatccccgcaagcatctgaccacgtgcaagaccccgcacctgagcttcccaaatgagcccctcctaaatgccaactccagaaaccatgaaataattgtccactgtttacgcatcggagccgctggccatgcagcaaagggaccaagctgctggcgcgcacaggttcatctcccagtggctcctgctgtcgagggctgcccccctgctcccctcctgcagggcttgttcccagcaggtgcatcctctagctgggcctggagacccggcgccacgtggcacagcggtgactctacagcgccctcgtgtgcggctctaggtgctcccacccgcctctctcccggctcagcctgggcacctttctcctggtcgctgtgtcccagcactctccccttaggaggcttgggctggcggttgtgaacgtttccgaccgggctgtcctggctccccaccaagtgtgtgtccacccctcccaccatggctgctccccacgttggctcagggagcccctgaggaggtccatggcgtcccaagcccaccaatgcccaccactgctttcagcttcctcgtgctcgccagccaccaggttggtggtctcttcctgcccactcttattttgtgttccaggggaacatgctgccaccaggctttactgtggacagtgtcctctgtgtctccggttgtgcaatctcggtggctcatgttttacaggggggttggggagagccaagcccgtgatcacttctcccgcatccttctccatatggagaggttacgatatctagcctcagaaccacagtcgtctcatgctcaaggcctgtgggccaggaatcccgagctggtggtattgagccaggaatcccgaactggtgatatgcactgttgcttttccaaacagaaaaagaacaaaaacttgtagtccaacccagttgactccttaaactacctcttcgaaactcacagaacctgaggacaaagcagggcagtgtgtttatatgaagttgataaacttaaaagacagctgtgaagccatgaaaatccatggaagaaccctaaatgcatattactgagtgaaagaagccagtctgaagaggccacatactatatgattccaactctaggacatcccagagaaggggaaattacggagacagtaaaaggacccgtagttgccagggttagcgggggggaagggatgaatcgcagagcatggagggtgtttacggtagagagggcaaaccggtgcagccactgtggagaccagaatggcgatatttcaaacagtatttcaaaaacttatattagaattgccacatcatccggacatttcacttctgggtattcgcccaagaactgagtgcaaggacttgaacagatatctgcacacccgtgtccacagcagcatcattcaccaacacacgaaggtagaagcagcccaggtgctcacggatggatgaacctggtgtatccaggcctggcgcggcggctgggcgaacctggtgtatccaggcctggcgcggcggctgggcgaacatggtgtaaccaggccgggcgaggcggctgggcgaacctggtgtatccaggcctggcgaggcggctgggcgaacctggtgtatccaggcctggcgaggcggctgggcgaacctggtgtatccaggccgggcgaggcggctgggcgaacctggtgtatccaggccgggcgaggcggctgggcgaacctggtgtatccaggcctggcgaggcggctgggcgaacctggtgtatccaggccgggcgaggcggctgggcgaacctggtgtatccaggcctggcgaggcggctgggcgaacctggtgtatccaggccgggcgaggcggctgggcgaacctggtgtatccaggccgagcgaggtggctcacgcctgtaatcccatcacatggaaggccaagacgggtggaccgcttgaactcaggagtgcaagaccaacctggccaacaggtgaaaatccatcaatacaaaaaatacgaaaattagctaaacatgctggtgtgcgcctgtagtcccagctactcaggaggctgaagtgggaggattgcttgagcccagggaggtcgaggctgcagtgagccataatggcgccactgcactccatcctgggcaacagagcgagaccctgtctcaaaaagaaaaaagtggcgtatccatcaaggggaatattatccagcctcaacaacaccaacaacaacaacaaacacaggaggtcctgacacaggctgccacacagctcaggcttgaagacattatgctgagggaaagaaccgacacaaaagggcaagtgctgcctgactccatgtttgtgaggctcccagagcagtcaaaaccgcagagacagaaagcagaatggagggtgccaggctgggggaaggagggtgtggggagtttgtgtttgctgtttcagagtttccgtttgggaaggtcaaaaagttctggagattggttgcacaacaatgcgaatgtacttactgccactgaacttgaactgtacctggaaacatgggaagacggtgtggaaacaagcccccagtcagctggtctggcagctgatttgatgcagatcaagagggaagtgaggaatcgatagggaagactgtgatcacccctaatcggcacagacagataggaggtgttaagggggttcagaagaggttaagacataggagagatggataagaaggttttccgtacttccgatcgaaattccagaggggctgggcacagtggcttatgcctgtaatcccagcactttgggaagccacggcaggtggatcacttgaggccaggagttcgaacccagcctggccaacatggtgaaaacatatctctactaaaaatacaaaaattagccaggcatgatgacgggtgcctgtaatcccagctactcgggaggctgaggcaggagaatcccggagaacctgggaggcagaggttgcagtgcagccaagattgcgccacttcactccagcctgggcaggaaagcgagactctgaagaaagaaaagaaaagaagccgggcgcggtggctcacacctgtaatcccagcactttgggaggctgaggcgggcggatcatgaggtcaggagattgagaccatcctggctaacatagtgaaaccctgtctttactaaaaatacaaaaacttagccagacgtggtggtgggtgcctgtagtcccagctactcgggaggctgaggcaggagaatggcgtgaacccaggaggcggagcttgcagtgagcagagatcatgccactgcactccagcctgggtgacagagcgagacttgcctcaaaaagaaaagagaagggaaggggagggaaggggaaggaaggggagggaagagggaggaaaggagggaaggagggaaggaaggaagggagggagggaggaagggagggagggagggaagggaaggaaggatggaaggaaggaaggaaggagggaaggagggaaggagggaaggtgggaaggcgggaaggaaggaaggaattccaagaggtggaaataaataaaacggggagagcccaccagctccctgacaatatggctgagaattttccagaactgataaaatatggaaacttcagcctcaagagtgcagcactctcaagcaggaagaataaaagcagcccatacctagctgtcccgtggtacactcagaatgctgaaggagaacttgctggaggcagaccccgcgaacggcaagaacaggagcagatgaccgtctctgaagtgccgaggcagaggcagcagccggacccacacgccctgctccactcccacttacgggtgtgggagaagcatcagatcagcaaaatgactgcgccaccacccagctccttagcagagcaacctccacagaatacagctcagaaagaggggacgcctgggctgccagaaagagtggggtgcaaacatgtgcaaacctcaacgagtgctggctgtgtgcaacaaagccctgtggaaagtggagggtgataaaggcaaggcagacctgagtattgggcagtcgtaatgatctgtgagccaggaggggcgtgatcaggaggaggatggaaacactggctatctttgaattctaaatatacttgttaaaattctaagagtgactattttaaaatagaaatagagcatataacttccacttaactctccaaggaaaaaatagaatgtcagactgagccagagccatggaagagtgctcaggcagcgggagctacacgtgcaaaggccctggggaaggagggaagaggcgcatgcctggcactgatgtcagtgcggctggaggcagacgggcgcagaaaggggtctgagacgtggctgaaggcagcaggaccagacaggatggggcctcagggccgtggttctgagcttcattccaacagcaggaaaagggaggcatgtttgtaacctgcagggaggcgggagccatggacaggattgcatctgtgacttgccagcatcccgccggctcccatgggagcagactgccctcaggccccagcggagggagggagaacagacagaacaattttggcccctggacatggtggcggcaggggaggtggtgagcaatgcaggaagggagacttaggaagcagtgcctagctcctcggtgtggaggcagtgaggggagggaagaacacggagagaggctggctcggggcttgacaaagtggtggggtgtcccacgggaggcaaaagcagatggtgggggcgggcgagagagtcacggttctttcagcctcatcaagtgtgtgtttctgaggacgtggagggcggtgggaggctgacggtgcacagacagcgcgggagcgggggcggggggcagtcttcatagatgagatggggcacggcccctccggagaggaggcctctcctcggggagaggaggggatgacagaggcagaggtggggcagccagggaggtaggagggtgctatggactgaagtgtggcccccccaaatccttatgtcaagccgcaacccccaatgtgactgatttggaaatagggtctttagaaggtaactacgacctttacgaagtcataagggtgggccctaatccaacagggctgtggccttccaagaagaggaggagacaccagaggtgggcgcagcaaggccgggagaaggtttcatgagaaaccagctctgacactggtggcaccttgatcttggacttccaggctccagagctgtgagaaaataaaggtctatcgtctaagctgcccaggctgaggtcttctgttacggtaacttgggctcactcatccagaggggaaccaaaagcatgtggggtcctggcacccacaggcaagcgctgtcaagaaagaggaagcagaaagcatgtgcatggctgctccttcagagcctgcagaaaactgtgcagacagggcacgggcacaaacccatgtgagcagagaagcatctctccgggtgcacacccgcactgctgagatgcacctgcccccgcagggctcagatgttccctgtgagagcagtgccatcccccacgcctcctgaggctgcctgggtcccataatggccaccgtgccatctcctatcccacaagccctcctaaccctgcctctccctcgtcaagaggcaggggctgtgtcccctccccttgagcctggccaggcctttgggtctctgctgacagaggatagcagaagtgagctgggttagcttggtgcattacagttgctcacgcctgtaatcccagcactttgggaggccgaggcaagacggtcacttgagcggaggagttcaagaccagcctgggcaacatagtgagacccccctctctacaaaaaaaaaaaaaattgttttaattagccaggcatggtgacacacatctgtagtcccagctactcacaaggctgaagcaggaggatcgcttgagcctaggaggtcaaggctgtagtgagccatgattgcaccactgcactccaacctgggcaacagagcaagaccctctctcaaaaaaaaaaaagggactgggtgacttgcaaggctatgttctgtcaactgacaaaaaatagaccaacactgtagatcaggaaacaaaagagaaggagggcctcaggaactgcggttcaggagacacagatctagcaaggagctcaaacgtgtctgtgcgggggaggccgggcaggggcttacaaaggtttgctgtgagtctacacatccggaagctgttggcatggtccatgaccgacggtgggggcttaacagcttaggacagctctggctgatgatcaatctagtcaggtgtgcctgtctccaggagaccagtgatcaggcccggtgtgaatggttcaaatcaaatgcagctggttcacgatccggcccaggtcaacagatcaattctatctggcgagttggacggggtccagctcctcttgccctcccagttcctttttagatagccctgacataaccatctccattacggattttcttttcacagctctggagtccacgcacctccatcttgttctcctgggaggctgacttgggctccagccaccatgccgagtgaaccatgacagaggtggccctccagcccccactcgggcaccccggctgatgccacgtggacagagatgagacagtcctgctgagccctgcccaaattgcagatttgggagcaaaatgcatggtctctgggatttacgtctgagggtcatttgtgacgcagcaacaaacagatgcattttgccggtggcgcatccgcccacgacggagcctggctcagctctgcaggtgcgctgcaccacccctggtgtcctggcgtcactggtacctgtttctctctcaaagctgtcctggtttggaagatgagtggtacagccatcccatcaatgcgaaaccaaaggccccctgaggcagcccccacaattgaagagcaggctgccctcagaaggggcccaaacccctgccattggaccaaactggctgatttagtttcctgccctctaaagtggaaattaagaaactgacaatgaaaatgtcccctttaggctgggagcggtggctcatgcagataatcccagcactttgggaggctgaggcaggagaatcacttgagcccaggagatggaggttgcagtgagctgagatcgcaccaccgcactccagcctgggtggcaaagcgagaccctgtctcaaaaaaagtcatagcttgacttccagagtcttcctgtctgcccggtgctggtcggtggtctctggaagccctccagctgccaccttcctttctgtccctccccgggagggatatgcaggcccagaggaggtgactccaggcgggtggtcccagaggaagggggctccacccttcccctgagtagtggggaatgtggcttcacccttcccctgcatagtggggaatgtttgggatctgctgggaggggtctgccatgggggcagtgtgggaaggtactcagaaaccaccagcaccccccaccctggtggccctggattctggtggggccactggaagcccggacccatgcaggtctcagcaacatcaccccctccacagtgagatccgtgtcagagtgacccgccccaaccagtcccagggctccctgcttctcagaccctccctccttcccagcccagagcccctccctccgaagcttcccttctcctactccacccctgctgtggggagaaaagacctgcagagtaccccaacaagccctctgcactgggggaggggtgcacgtccactcacccagaaggggattgggaaccagaagccaggtgagcctccctgagatcacagggcctgattccgggaccccagtgtccaacacctgcccccccagggtgctccacagcccctgcctacacctcaacccccctccacctccacatctgttcaggtgatgtccaacaccacccgaatcttactgaccactggtgagaaagggaggggcgaggttggcctctgcatggtaaagctgggtaaactgaggcagcacgttctgggcagcccaggacgcccaggttcccgccagcccacggcctctcccgccttgcacgggcttcacagtttgccagcgagggcacaaacgggggctccgcgggccggcgactcaccgcgccttccctaccccgccccagtttctcccatggagctggtctgcaggcccggcatccacaagccccaccgcactgcaccgctctgcaggtcgctggcgcctgttctggcctcgctgggacccccacccagacgcaccccacagccaactccaccggacccacgctgcccgagtatttttagcagagggtcagatgcctcttaaacctcagctgagacgtgaatttcctccctgacagctgcggccaggagccgcacgtcctgcctggcgggcgtgggcggttctgacctcggaggcacagctgcagggtctgcagtcctctgggaacttcctcctcccaggtgccccgatttgggctccctgggtgcctccgccccaggccgcccaccaggcgctcacttgcccggtcctccgtctggagcccctcccgatggccgtcgccacccactctccttctctgtctggaagcttggagagcaagagcagaggcctgggttcagattctcagggatctgggttcaagtcctgcccccacccccctgcacttgggaaagctgctacctctcagaacccgtttcctccactgtgaagtggaaggaaaattgcccacctgggggctgttgcgactataaccagccagcggtgcctgcagcacccacagacccccaggcgtcttcagggctccctgtgccccagccagcgccaggagcctgcaggaccgagaggggccctggcagggctgcacagatattcagatgttcagacctgaggcccaagacctgcctgccaggacagggacgctcctgcctggggatgctggggtcccagaaagtgagaagcagtggcccagcgccctctgctctcacttcctccccaccaagcacaagtactaattacgcacacctcagctccccgggggggccaggaggaaatgcccggcagagccctccgtcctaccccgtgcagcctgggtctccctccacgggcccagcctcttccactgctgctttcagttacccggctttgtaggcgcaaacaccctgtctgttttcttctttctcaagccatcttagctgcttttgatctgtattcttccatgtaaaatgtagactacatttatttatttctttaaaaaaaaattgaagcccaaatgagactccaattagaattgcattgaatttattatgtccccataattctctggggagaattatgtgtttataacattacgttttcctgtccgttctgttaggcttgctaagtaagctgacatgtgatctgcaaatgatggcagatgactgtgtgaggtggccttgggaatgtcatggctcctctccacagcactctccttcacattccagaaaattctctccaccaggcatgcctttggccagccctgggacatgtactgccccttgaggtttccagtactctgccctacctttataaagagcccctttgttaaacactgctgcaagtaacctgctctaaatgtgggtctctttcctgctgggaccctgatagatctaagggtttctcccaggaattcaaggaaggtttaatatcagaatctgatccgtgcaaataccatctgaatagatgacagggcaaaaagtgtcccaatgtctcaagtgatgccatcggtgactttttaaaaatttctgggcaaattagaaattgaaacaaatgaaatatttctaatttgataaaattgttcaccaaaaacccaccagaaaaatacatttatggaaacagttgttgccaggagttcgggaaagaggaaatggttggatcggtggagcacaggggggtttttagggctgtgaaactaacgtgaacgacattgtaatggcagagacacgacactgtgcatctgtcaaaacccacagaacttcacagcaagagtgagccttaatgtatgcaaattttaaagctcagtcaagaggctgggggtctaggacggaaggcgggccgtgtgtggcgagagcctctggctgtatcacagacccagggagcagctgtattacagacgtagggaggggctgggggatggggctgacctgggtaccctcacaaacgacgaagtctgtgaagccaaaagcaaatggacccgcacatgagccctgtaccctggcagacacacgcttctgccgcggggtacaggtgagcagtccctacactgctccccctgcacactgcagcttagcgattaggtccatggatggtgggtggtggggcaggttcctcactgtggggtgggagctacagacaagcaggggcaagggccagaacgacccacacggcccagggtcagggtcgagacagcagcaccagctccttcctgtgggctccctctccatgcgggcggagtgacggttaactttatgtgtcagctcccctggccgtggggtgccgggttgaacgttatttctggggatgtccgagggtgttctggatgagattagcatttgaatcagtgggctctgtaaagcaggccgccctccccagggtgggtggtgtcacccaatccgctgaggacccgaatagcgcggaaggcagagaaaggtgaatttgcccccctcttcctgccacgctgcttgagctgggacactcacctcaccttctctggccctgacactgagattaacgccattagccctccggctctcagggcttcggactcagaccgcactgcaccaccagcttccctgggtcttcgcgggcgtgggacctctcggcctgcgtggtcacctgcgcccaggcttcagctggcatttcccctgcttgaacttctttctcgtgccgccttgtgagaaggcacctgcttcccttccaccatgattgtaagtttcctgaggcctccccagccatgcagaactgtgagtcaattaaacctcctttgtgggctgggcgaggtggctcacacctgtgataccagcactttgggaggctgaggtgggtggatcacttgaggtcaggagttcgagaccagcctggccaacgtggtgaaaccccgtcctactaaaaatacaaaaattagccgggcatggtggcacgcacctgtaatcccagttacttgggaggctgaggcaggagactcacttgaaaccaggaggcggaggttgcagtgagctgagattgcaccactgcactccagcctgggggacaaaacaagactctgtctcagtaaataaataaaacctcctttgattataaattacccagtctcttgtagtatctttatagcagtgtgagaaccaactcatacacccactatattgaaatacggttaccaaaataataaagtaattgttattggatttcttgttaatctactgattcaggccaggcatggtggctcacgcctgtaatctcagcactttgggaggccgaggcgggtggatcacctgaggtcaggggttcaagaccaggctggccaacatggtgagacccctccccccccgccaccatctctactaaaaatacaaaaatcagctgggtgtggtggcgtgcacctgtactcccagctacttgggaggctgaggcaggagaatcacttgaacctgggaggcggaggttgcagtgaaccgagattgcaccactgcactacagcctgggcaacagattaaaaaaaacctactgatccagatctagcagcagctctcatgaccaacagtgttgaagcaggaacaaaaatgaggcttcaagacgccgaagcaactgaaacacgatgggaaaatacacaggactttgctgacggtggagtcccaggttctgtggagaccgctaggtcctttggccacattcactattgaggaacactcactttagcctagaggctggtgaaagtaaagatgcaacgtttttccatccaagttcagggacacctgaatcccatgatcagtaggttctagtttagaacccggctgcagagtttacacctgagtgtggtgattacatcttcaccgtttcctgatttttatcccatgatcagtagcttctagtttagaaatccggctgcagagtttacacctgagtgtggttattacatcttcaccgtttcctgatttttatcccacgatcagtaggttctagtttagaaacccggctacagagtttacacctgagtgtggtcattacatctttgccgtttcctgatttttagaaaaaaaaaaaaaaaaaacctgtgatctgaaccaaggtaattgatctccctcccttcctacaggtgtccacgcccttggggaaggttataggggttggatgtgcttttgaccccaagggctccctacgtagcccaggccagcctggggcttggaggagggcgggtgagctgatgagaacctcctccatgctcagcttccacctgctggcatctgtgtgcccagcacacaaagcctgggcaacgggcgactcctgtgagcagagcttcaccctcttcccctctcactaccccccaccccacctgcagcccctctcctccctccccttggttcgagatgaccccaactcccccggagatttctactgggatctggtttggtttttgctttttatgatcccctaaacccatcttcacctccctgctagggctccccaggttgactggggaggaccccacattccccatgattccacgcagcaaaaggcacttctggcaggaacccgcatcccagggcaggccctggggcaccttgggctggggaagactgcggccccaaaatctccactccctgcgctgccatctgaaacaccaccatgatggataatgtcttacctagggagaaggcacctgtgctggaaaaggagacccaagagacccgcctggaccgtgtgggtgagaccatcgcaccctcctgccgagggagaaggcacctgtgctggctaaaaggggtcccaagagaactgcctggacagtgtgggtgaggccattgcaccctcctgccgagacggtgggccctgctacagagcctgatgcccctgaggagctgggaccactgtcctcccaatacacatacacacacaaacacacacagagacacacaccgacacaaacacacagacacacagaaacacacacaaacacagacacacacacagacacacacaaacacacagacacacacaaacccacacacacacaaacacacagatgcaaacacacacacacagacacacacacacagacacacagaaacacacagacacacacaaacccacacacacacacagatgcaaacacacacagacacacaaacacacacagacacacaaacacaaacacacacacacacagacacacaaacacacagatgcaaacacacacacaaacacacagacacacaaacacacagacacacacacaaacacacagacacaagacacacacacagacacacagacacacagacacacagacacacagacacagacaacacacacaaacacagacacacacatacacacacacaaacacacagacacacacaaacacacacagacacacacagcacacagacacacacacaaacacacacacacccttcacaaccttcctgggctcttagcattttctgtggggctgtcaaggcaggaagatccaggagggaccccagggcggggagagacaaactctcccagctcaggaaggcagtgtgctttcgcctaaataactgagtgagctcacactaacaggaagtgttttgattttgcagtctgagagttaatcccgtcgctggccagacatgtttgcttttaggttctctggtggcccacaggtcccagttctgaatggaaacatcccgaggcggcccctcccctcctcaaactgcaccctccccgggcatggcgctgcctgcaggctgtagagagggcctgggctttttcacaccttggggaggtgtagaccagggaaaggaagaggagaaggatgtgggcaaccctccaccaccagggagctccaccaccactccgcaggccctggcgtggcaccgtccccgagggctggcaccgggctggtggcaggcctcagcatcagagggtggctgagtcgcacacaccgcccctacccctcttcccgagactgagcccctctctctagccccagagcaggagtcacccccagccccaccagccactgcccatgaagctggttggaattgccctcagcggccacagaggccccagcggggtccccagccaggccgacatgcactagcagctcagaaagaaaggccttgtgtccagtgacctcccccaacctcggaatgtggccgttctctcctcccatccctacagtagggctgaggctgtcccgagtacaaaggccttttgtccccacaaccagcccccacccgccgaggtgacactggagctgggagagtggcagcctccatggcggccacagtggctcccagctcccctgcagcagggcctccctcctcccccagggccgggcagagggcacctgcagggcatcttccccggcaccccctggctgcagagcaccctggtgagaacgatctaatcggagagcccaggcttatacacagcttctctctgccagctgagaatttacgtttctgattaacttgtgttacccacaatacactgtagactacagaaggccaggaccctctgaggtggtgcagtgcccccagtcttgttctgggtgagggctccacggacctctttatttgtcaaaactcatacactttagttctatgcattttactctgggtaaactgtatctcaggccaggcgcggtgactcatgcctgtaatcccagcactttgggaggccaaggtgggtggatcatttgaggtcaggagttcgagaccagcctggccaaaatggtgaaacccgtctctactaaaaatacaaaaattagccgggtgtggtggcaggcacctgtagtcccagctactcaggaggttgaggcaggagaatcgcttgaacccgggaggtggaggttgcagtgagtcaagattgtaccactgcattccagcctgggcgacagagcaagactctgtctcaaaaaaaaaaaaaaaaaaaaaaaactgtatctcaaaaatacatggccacaaaaaaatacatagtcattgttttaagacaccagaaaatacaggcaagccgaaagaattctgaacaaccaacggccgctgcccgaggccagttgctgtgattgcaggtactttccacctgtccagacgcctccacgcgtgtgacacacacgcaatgccaaccacacaacgcaggccgccgtgaatgccacttacatctgtcagtgacaaaacctgaccgtgtttccactaactctgacacaatattttaaatgactgcacattatgctgtgtgcataagccaatttgtgttcaacaaatccatgtattgttggaaattaaccacttctggggttattctttcagaattctaaacagtagggccacaaatatcctgatagcttggtctttgagcacctttaaggtgctatcttgaggtaaagacccaggattggtgttgctggggcaaaagacactcacctgcattttaaagggttcttttttgtttttgtttttttctgagatggagtctcgctctgtcacccaggctggagtgcagtggtatgatctcagcttactgcaacctccgcttccggggttcaagcgattctcctatctcagcctcccaagtagttaggatgacaggcgcctgctaccacacctggcaaatttttgtatttttagtagagacagggtttcaccatgttggtgaggctggtctcgaactcccaacctcaggtgatccacctgcctcggcctcccacagtgctgggattacaggcttgagccactgtgcccagccttaaagggtatttttaatgccttatggaaagcaggggttccaataggctttccagtccagtctcttccttgatctttataactccaaagagcctggcagacactgagcctgcgggggaacacgagaaccattctgccttggaaataagactaacctactggatgcagaccagaatgcaatacaccttgacagtgtaaaactaatccctggacttccggccgggtgccgtgactcaggcctgtaatcccagcactttgggaggccgaggcaggtggagcgcttgaggtcaggagttcgagaccagcctggccaacatggcgaaaccccatctctactaaaatacaaaaaaaaaaaaaaatagctgggcttggtggcacgtgcctgtagtcccggttactcgggaggctgagacaggagaatcacttgaacctgggaggcggaggttgcagtgagccaggattgtgccactgcactccagcctgggcgacagagcaaaaataataataataataatacctggacttttactttcacgtaggcaaggtggatcccacagggaaggtcaccacaactactcacaataactgaggaggccagacacattgtgaaaaccttactgcgaaggcatcagagagctgcagaggctgcgaggacttaacgaactaaaattccagagaatggagaactgtcagataagcaggtgacccacagccatctttttacctggggacatttgcctatttgggacactgggctaaggattgggcttggcccaggcagagagctacagccggggaagaagaaaccagcaaagattctcactgtcacagggaggaaagtggcaaaatcggagtgtccagggccacaaccaggcagcggggccctcagccccaccccaagacacctgtaggatctcaatgctgctgcaggaggaggctcaggagcaagttgagcagctctgtgaggctggactgcacttcccacagcctttcaaagtggggagatcaagacccgccaggctctcagctgaaatctggagagaccaatcccccaaaccagggcaaaccagaggaagcctgaaccccatcaaactacacaccagtccacccgggcccatccctcactgggttgagggacctgcccctctgtccatcctaactgcctgaggtttttgctcccaatacaagccaggtggctccaattagaacaactaatgtgcaaataacaactataattgccaggccgggcacagtggctcacacctgtaatcccagcactttcggaggccgaggcgggcggatcacgaggtcaggagatcgagaccatcctggctaacatggcaaaaccctgtctctactaaaaatacaaaaaaaaaaaaaattagccgggcgtggtggcgggtgcccgtagtccaaactactcaggaggctgaggcaggagaatggcatgaacctgggaggcagagcttacagtgagccaagatagcgccactgcactccagcctgggcgagagagcaagactccatctcaaaaaaaaaaaaaaaaaaactataattgccagacaaaatataaacaccaaaatgtaaactcactaggccaggcacggtggctcacgcctgtaatctcagcactttgggaagccaaggcaggcagatcacctgaggtcaggagttcaagaccagcctggccaacatggtgaaaccccatctctattaaaaatacaaaaattagccgggcatggtggggtgcccctgtaatctcagctactcggaaggctgaggcaggagaatcacttgaacccgggaggcagaggttgcagtgagctgagatcgcgccactgcactccagcctgggcaatagagcaagactccatctctctttccatatatatatatatatattttatgtatgttatatatattatatatatatataaactcactgcattctgagtgaccaaaaccagacagaggttgtagggagttgactacaggaaatggaatgacccgaagaaccagaggacagagtttggggtgaccatggcagctggactgtgagggggaaatcccagaaaggagagcgccatagagagggattccccaaagactgcatgaaaaactcagctcagatctctggcagaaccctgagctatgtgcacacaggacagatcccagcaattcacatagctgaagagagatttacctgccagccacacagaggaggcagcgtttaccatttgagttcagtcaggttaactgcttgatgacacaaaaccaaaacagttaataatctggagagaaagatacggaatcgcacatccctacagtgtagtgttcacaatgcacagggtcaaccccaaatcgacagacacaccaagaagcaggcaaatgtgaccgagaatcaagaacgtgaattgatgggagccagaagacaaaggaatatatccttaaagtgctcaaagaaaaaacatggccaacctacaattctacacccagaaaaaatatccttctgagatgaaaatgaaataaagacttttcagacaaacaaaagccaggataattcatctttgatggagctgcaaacggaatattaaaggaaatatatctaggcatgaggaaaatgatcgcagatgtaaacatgaacatgtagacaaaaatgaagaataccagaaaaagtaaaatatgtgggtaaattcaattgaatatagactgctcagaacaatacttgtagtatcttatagagtttagaatacaagtaggctgggcgcagtggctcacacctgtaatcctagcactttgggaggccaaagcgggcagattgcctgagctcagaaattcgagacccgcctgggcaacgtggcgaaaccccatctctactaaaaatacaaaaaattagttgggcatggtggtgcatgcctgtaatctcagctacttgggaggctgaggcacaagaatcacttgaacccaggagacggaggttgcagtgagccgagattgtgccattgcactccagcctaggcaaaagagtgagaccctgtctcaaaaaattaattaattcattaatttaatacaagtaaaaccacgtgtataacgaccacaacaaaggaggtcggggatatttgcaatacaagtgtacggccacgtacaaaagacttacgtccaaaacatatgtaaagagctcctacaaatcaacaagaaaaggatagacgactccctaggaagtgagcaaaaagatttgaagacactttaccaaagaggatagtccagcggtcagcaaatatgtaagaagataccccaatttccttggttatcacgaaaatgcaaatcaaatcacaaagtaatatcacaacccacagactggtcaatatgaacaaggtgaacacttccagttatcagcaaggctgtggagtaaccagaaccctcacacattgctcatcacgtgaaggttgatacaaccactatacaaaagtgctggatggtaactattaaagctgaacacaggtagacccactgccaagtttcacccgacagaaatgcttgcacctgttcaccaaagacaggtactgtgtgagcacgttcatggccacacaaaagccaggcgccagaagccactcaaacgcccattcgttgtagaagggatagatgagtgggggggctgctcaccccatggaatggcgctcagcagtgacaatgactgatgtagaatctcgtgcaacaagggcgaccttgcagactgtacgctgagtggaggaaaccagacactgtgcgatccccttttaggaagggggcaaataagatgcagttatctggccaggcacggtggttcacacctgtaatcctggcactttgggaggccgaggcgggtggatcacctgaagtcaggagttggagagcagcctggccaacatagcgaagccccgtctctactaaaaatacaaaacttagccgggcatggtggcacatgactgtaatcccagctactcaagaggctgagtcaggagaatcacttgagcctgggaggcggaggttgcagtgagctgagattgcgccattgcactccagcctgggcaacaagagtgaaactccatctgaaaaaaaaaaaaaaaaaaagatacagttatcctggggatgctgacggggagatctgggggtagacacagttatcctggggatgctgacggggagatctggaggtagatacagttatcctggggatgctgacggggagatctgggggtagacacagttatcctggggatgctgacggggagatctgggggtagatacagttatcctggggatgctgacggggagatctgggggtagatacagttatcctggggatgctgatggggagatctgggggtagatacagttatcctggggatgctgatggggagatctgggggtagatacagttatcctggggatgctgacggggagacctgggggtacaggggctggggatggtctaattccgtctggatgtcggttagaggagtgtgttgagtttgtgaagacgtccaggcggggctggctgcatctttccatatctccgttatatgtcagtgaaaagtcagctaaacacaatcatgtatttaaccagcacatttgggaagcagaggaaggagggaacgtgggaggaggcctgagtggtgcttctcattgccctgcagaatcagcagaccttgataattgtaaaatatgtggttacataaacataatgacccaggcacttaatgttttccatggtcatttttttaaatctaaggagatcattaaggaaccagtatcttttgttgtggtaaaatatttatctgaaatgcagcaactctttccatttaaatccgaatgaaataaagtttgatattctattttgaaataaagcctatcatcgtcttatcccactccacttctcagctactcttctcttcttcagccctcttctctgtctctctacataagtaccaagcaagacatctggaataaggtttagcaatttaatgatggttatttcttagtggttggatttatttatttttttctttcttttttttttttttttttttttgagacggagtctcgctctgtcgcccaggctggagtgcagtggtgcgatctcagctcactgcaagctccgcctcctgggttcacaccattctcctacctcagcctcccgagtagctgggactacaggcgcccaccaccatgcctggctaattttttgtatttttagtagagacggggtttcatcttgttagccaggatgatctcgatctcctgacctcgtgatccgcccgcctcggcctcccaaagtgctgggattacagacgtgagccaccgcgcccggccagtggttggatttaaagtgacttttagagactcttttttgtacatgtttgcattcattcgcgttttaataacaagcatttttcaagttaataaagctattctgttgtgctccatcactagctgggtgacctggagcaagtttctcaccctcgctgagccttggtttttgcagctgtaaaatgcagatacgaatattaccaaatgcatagggtttttttagaaagattaaattagattatttttcaaagtgcgtatagagtacaggaggcccttaatacacaatagctgctattattattgccaaacataaatagaggagaaaacaacaaagagactcagccctcccttcaggaggtgatagtctggcagaaagaggcgagagctaacacccagatggagcctcatgagcagcctactgccctgggcggccacaggcatgtcgggagggtaagcaggagcccgacggctgaagccttgggggaactgaggggtgggtcagaagtgggggaccgctgcacatgccctgcagactcagagggtctgagtcagcatcctgtcctgagggtgttgccggactggggagttggggagaccctggcctgctgggccagcggaggacctcctgtgggggctgtctgcaggagcgtgatgggttggaaagccctgctgtccacagagactccaatatgaggaatgggtgccttggacctggtgctgtagacagtgacagggtttggctctgtgtccccacccaaatctcacctcgaattgtaatccccatgtgtggagggagggacctggtgggaggtgactggatcaggaagtggtttcccccaggctgttctcctgacagtcagggagttctcttgagatctgatggtttaaaagtggcagtttcccctgcgctctctctctcctgccaccttatgaagaaggtacttgcttccccttcaccttcccccacgattgtaagtttcctgaggcctccccagccatgcggaactgtgagtcaattaaacctctttcctttataaaatacccagtctcaggcagttctttatagcagtgtgaaaacagactaatacagacagtatcaggagaggcttgagttcatccagtgctattggaagactctgttggatggaagatattgaaggcacagccaaggtgtggaggctcttgagaagacaaaaggtgctcagcacacacgtggagctctctccagagaggtttgctcaactcctgcagacaggaagagctgccctgtcctacagccctctgcatgcgtgatgtccaggcatctcccacctgcatcatttcaccccctgacagcaagcaccttggggtggggttgtcagataaaatacagaactcccaggtcaatctgaatttcaggtaaacaacaaatacatttcagtacaagtgtgtcccatgcaatatttgagacatgctggtgccaaatattgcataggacattatattagcccattctcacattgctataaagaactacctgaggctgggcccagtggctcgcacctgtaatctcagcactttgggaggccaaggtgggcggaccaattgaggtcaggagttcgagaccagcctgaccgatatgatgaaaccccatctctactaaaaatacaaaaattagccaggcatggtggcagatgcctataatcccagctactcaagaggctgtgacaggagaatcgcttgaacccgggaggcggaggttgcagtgaatgaagatcatgccattgcactccagcctgatcaacaagagctaaactccgtctcaaaaaaaaaaagaactacctgagactgggtaatttataaagaaaagaggtttaactggctcatggttctgcaggctgtacaagaagcatagctggggaggactcaggaaacttacagtcatgggggaacaggaggaagagagcaaaggggagatgccatacacttttaaacaaccagatctcctgagaacttactatcaggagaatagcaagggggaaatcacgcccatgatccagtcacctcccaccaggcccttcctccaagactgcagattacaatttgacatgaaatttgagcaaggacacaaatccaaaccatatcagacatacttatcctaaaactgtattcattgtttatctgaaattcaaatttacctctgtgccctgtatctttatttagtaaagctgcaacccacttgggtgatgctgtgcccttgcttacctggtaccaccactgccaatcctgtgcccagaacatagcagactttcaattaatgttgaatggatgtgggacaggtggatgggggatagatggatggtgggtgaatgggtggatggatggatggtgggtagatgggtggatggatgaatggatggatggatggggtggatggatgggtggataggtggttagatggatggatggtggtaggtgaagggatgaatagatggatggatggacagatggataatgggggtgggtggattggtgggtgaatggatgatggatgggtggatcggtggatgggtgagtggatggatgggtggatggatggtgggtgaatgggtgaatagatggatggatggacgtagggggttgggtgtgtgggtggaagagtagacagattggtggatagatgggtggatgcctagatgggtaggcgaatgaatgggatttggattcagtaagaggttttaacactaagctgtcttaaatgcccaaatgacagggccaaggtgggagtaaatgaagtgccagctgatgggaaaactcccagctctgacacctctcaccacccctgcgactctcctgctcagattctgaatctgtaaaatgggaatgcttagtggtgctccagcaagaggaagctccatgtgctgcaacacaagttatatgtcctgacatggatgccttgctgggggtggtggggggtgattcgcctgcagacgtcaaagccctgcctgccaagatccttgacttcccagccccaaccaggcatcactcaaaggtgacctctccactcccagcaccaaggagttgcctttggaccctgaccaccctgatggccaaggctaggctggccagcacctccccagcagcccttcagaggcctccacagccctgtgtccagtctgacacaagtgtgtcaggtggtcatgagcaccgttcccttccagcaaggccacctcttcctgtggggaagggcctcaggtaggcaggccggaagcacctgcagaccccgcactcagaaactgccaccccgcttgttgaaccttgtgttttagaaagggtcttcctttcacagcatctccctctccccagtcctcctcccagaggctgtttaagggtgggcgtgggacccccagtgtttccagggttattcctagggatggacttcttataaacaatattgcccctcttcccagggccccagggcaaggagcagcgagcctggacctgcagccactgtagccccagcctgggggaggggacagcacaatcagggtgaagtggagtcagaggtgggtgttgtggaggggggagcggcgcggggacagctgtcctggcccggctaccttccctgccccctgtgacatcagcccatcaattccctccctcttttgccctcactaggtcgggtctctggccctcgcagccacaaggttcctgactcctgtgtccttgtgaaagagccacacacagcagcagggggactgcccccgccaggaccagcccaggattcctgctggattccgtgtgtcaggaccacccattctagcagaggagcaggaagcccagagaggcaaatcacgcgtctaggaagcagagagggatccccgccccagggccgcctgaggagtgagagagctgaggctgaggtctgctgttactagagctgaaacctacggacctacccagctcccgttttcgccgctggggagacccacggggagatcaaggggcctgggggggggggggccctcccaccttggacgttggttgccacatctgcacgtgacggggagaaacgtgtcattccaggaggacaggagggcggggcagctgaggggggatccccagatataggggcatccccaggacccacccccgtcctgtggaggcaggaggaggggccgcacccctgggtttgaaaggcagcagccgccttccagagggagcgctggcgggaccttaccgcacccccttcagagtagccccctccccccattgctgccctggactctgcggccagcaagctggaggttcctagggctatgggggacaggaggctgtggctggctgaggactttgtgtcaatgttcccactgcctctggggactggggacagccaggccacacgcgggggcagtgggacttagcacctgagcctgctgagctcctgaaagccctggaggttctcggttccccgaggtggggcagggaggagggagcccctggtgtggcctggttctgctgggcggaacactcaacactcccttccctgacgaagaggcgagagctgcttcgggaagaaccacctgccctcaccccactcggtctgggacaggcagggcactggcctgccgggagcccccgcccctgtgcctgcagcgctgctctgcgccctgctcccttactccacctccttccacctcctccccttcctcctcctcccaaggaggaggcagatggtggtggaaactctgcttcctccattttccggagcgtgactcagcaccgcagctgccgcctcggcccccacgcagcagcgcgaagcctgccctcccctacagcggagcccggggactccccagaacacccctcccgcaactcatctggagaacgcagggctgcgggctgccgagcccaccttcccggagcccccagcccagcggacccctcctaggcagctaatttcccgcccacccggcgacggcagaggacgtgtgccggggcggagtgcgggcaggtgggcggggctgcagccccagatctcagggacacacagaggcgaccacggggcttcttagcttctgggtggccgccccgcccaggagactgggctgagcgaaggggaggggaaggcctaggaggcaccccaagaaaggacccatcagaaaacacagggaagtaggaaaataagagaaatttccagaagcaagaggcttggctcatgcggaatgccgcagagccaggcctcaacccaccggagaatctctgagaacactgactgcagcccaccacggtggccccgggtcctgctctgagctcctgtcggccctcgtcctccctacatcagagcctcccctgggagccccagagatcctctcaactccttctcgggacaaaggaaccctccctgctgagagcccctggtggctcctcccactcccccactcggctccctctctcctcctcactccctttgtggtgggcttggcccaggagagtcccggcacccccagctgctctctgtaagcccctgggggtggccagctggggtgggctccccactcctgcctggccgtaatcagggagccgtgcctcgggatgtgggcacacactcgtgcacacgcacaccgtctcagcaactgggctctcctgagagtccccttcccaacccacaaaacaagacctgccagcgcccccaccccttcctcccacttctgtccccctccccatagccctaggtacagctgcagaaactgaggctcaaaggggtcaagtcccttcactccatgtggcagagctggggtggtcaagagaccccagaccccagctgaagcctcccgccctgacatgggaagccgctcctgtggggcctgagcaggtgcccaggaccaacgggccagcccaggtgagaggcttcctgccaggaggccctgagggtgacctggccagggacaccagtgctcaaaggtccgggtgggtcccagccccagctcaccctccgtttgctggcagtggcccctctactctcccccaggactcccgacagctctgcagagaggcctcatccccacccagctgggcagactccgaccttgccaccgggtgccttcccattctcctggctgccagccactcccctcttgcagcctcagtttctgcatctgtaggttgggagtaatgagattccccagccggcccgctgggaaggctgggcatcctgggggagggagggggaagggaatgccaggagctggctggagccaggtcagggaggcatgggcccagccccagccgcagcagccactctgtgggcccaagcaagccccgggccctgggcctgtccatctgtaagcagggtgatggcactgccgggcgaagtggctgagggtgggcccagcccagctgccctccctaggcattcatcaggcccagcgctggggcagggcacccagcccacaccacatggatggggatgaacctccagctgggctgcccgacagggacagaggcaaacagggctcccaggattccggggccagcacaactctgtggctgccgtagtgtcagctccaggccccagaaaggactgcaggggaccaggctgctcctgggtgaccccagatgtcctggctcttctctaggggatcttgggctgaacaggggactgaggccccagaggaaggcaacacagggtcaagacggatccctgagggtccccagtcatttgtaaattacctctgccctctgcaaagtgtgaatgctgattcctcggcctctgcccaaacatatgcactctctcaggttcacgctcacacatccccttaccattcggcagaccccaccggctctgccccagctcaccccctccacctggccctaccatcctctgcccctcaccaagggggaccctccaatccaatcccataaatcagggtccccgagctgcactcaaagcctccgtcacctttccgtgcttgtggaacaaaccccccctccgtcttctgactctcacccctcccacctcagtgtgtgcagaggagccttccctgcacacagctgaagtggccctgtgtcccctaccctggactttggccaggccattgaccaggctgctgcctccacccatgccttggcatctgggtcattttttattgatggtagcttggcccgacttgggggcttcacacacacctcccgtccagcagccctaggaggtgggactgttatcaccacccctatctcagcaggcagcagagccaggacccagaccggcccagccacagcaccctcccactgtaccacgggactgcgctgttcacagggccactcctgacctctggggagtccctccaggtaggccaggccaggcctgtgctctgtaatgcagtccacgcagggctccctgctgcccggggcagggcggtggtccgacagctcccacccctcagggcccgtgcacccgcaatgcccaacctgcccagcccacccagcccagccaccgtcagagggaggttggcgatgactcaggccttgagtcagcagcatcggataaggatgcagccaaccctctgccagcataagggatccccagacagccccgagctctgctagctgggcttgtggggacccctggctggaaccgaaccaggctcatcagcgctcaggagcccgggagccacctccccgggaaaattcacatgcacacacacacgcacacgcgtgcacacagaggaggcctgccatcagggtgggtggggctggactaacaccagcccagggaagagaagccagagatggtggggcgcggtgggcagtgaggcggggtctcagctggaggggctcactctgactgtggagcacccatgtgcctcctaaacagaaactccacacaggccaaggaaacagagctaccagctgactcactctcccagcaaacaccagctcctccccgagccaggccctggaagagaagtcaacatcacgagctgccatctggggggtggcaccaggctgtgaaggatccacagactggcatatgcaggaggaaatggggcgggcgaggagtaaggaccccaaaaagcaggggtagggaagggccctcccagcgccccactgtaataggggcctcatcaatgccccatgctcactgaataaagcactgccagcgaaaggtgaaaagaggaacaaagaacattctcctggacgccacccacagaaagccacgtgcaggcttggccctcaccttggggaccttggacacggagctggttatgtcacatctggctctcagagctggggcagcgtctaggaggcctgatgtagaaagcactcagctaagccctagttaccggcacacgggcaccagcgccccctctcagcaaactccacgtcttatgaaattagcactggatttccacttcaattggaaaatatggccaaggtaagagatcaggaacgacaaggccaagctggggtagccgagaaagcagagcagacacgggggcggagaggtggctgcaagcatctgagtgcaggaggcacaggcccctgaggtcccggagggcagcacgctggtgcagagccgggacagcctggggttcactcactggagaggcagggtgggcggggcaggtgaggatgggggctggagcccatgacatccccttggttgctgagcatggctgacccctggccacacccggcctggacgttgaagtctaactggggagccaggcagggagccaggcaggaaaccggatgcaagtggagattccaggctgaggcgctgtgggaaggaggggagctgtcactctcccaaggcgggaagtgggaggggctgggagtctccagggaggggaggagggcctggaggagttccctggggtgggggtcccagaagagccagcagcctgtgcggcggcatgggaaagaccccagtgcctggcgaggaattggcacagccagtgtatgtggagtcagataggggtttggggtttggggttatttttaacccgtaagtctccctgctattctacaggagaaagggaacgctgtgccgggcgctcaggaagatgcaggcaggaggcagcagtgtggggagggacagggagggcctaggggctgggtcagagccttgcccaaggggctttagcggggaagtgctggccttcccacccctcctctggaatctgtcacctcccaccctggaagagctcaggagcaaatggattcctttccatgaaaaaagcatagtgcctggggctaagcaaagccaagactggcagataaggtgccccagatgagcaggcagctgcctgcagtggggcgcggggcagggccaggaggcgggagggcggcagggagcagggacagccatccggcctttgggatgggcagcacccctggaggcgtggggaaggcagagcgggctgcctggcctgcaggccaggtgaggggagaacgcaggccagaatccagccataacctggctgcaggtcccatccaggtgggaagaaagagtctgatatacttccaagctagcagtgaaactaggaggttctgtaagaactggggaattatttaccctaactcaggaatgctcaccgtgaaaccaagccctcacctaggggaagggccaccccagcagtggccactcctaaaatcctcacgtcccccccggacaagtctagcctccaggatggaagaaagtcagccaaccctaggattatcacgtctgggttgaactgaggggtcttctgtgcatgcagcctgcgctagtggctggggcctccgcaatgttgggtgtgcctgggatagctcagagtaacacggctatacggcactcagggttggaaggggagccaggctcctctggctctgagctcaagcggtccaccctcccgagcctcccaaagtgctgggattacaggcgtgagccactgctaccttaataaactaagtgttaatgttgaaaacccaaggagcagcaaaggtcctcaaagacacagagacctgggggaggggtctgcgggtggctgcaatgggggaggggaggggtggaggggaggaggggccctggggaggcagcacagactggtttgtagagtgacccctccgtggcttcctggtgacccttccagaataaatcccaagcatgcatcctcctacgtgcctcagcctggggctgccactccctgcctcccaccgtccactccaagagcctagctcccctgggtgcctgggtcccccaccaggggtgtcaaagcagaaggctggcatcagtgaccagcacacctgaaggccctggagccgtggggcagggagggaggtgttcagggaaagatgggagggtagaggggagagtgaaggagaagggagaaggcccgcaggggagggcagacagtcgcagtggtgtcctcattccagtcaccattccattcataaatacttctgaaacccgcccccctccccaccacacacacacagacacacacacacacacacaaattacctccggagactttggagacctacaaagtcttggcactacatctcttcaaaacacagtccagtggccaaaaatcacctgcaagacattctagactttatttccttccctccaagatcatcaggcaagatccaattcatcagcctacagggcctgccctgagccctctccccctctccccttctctgccgccccacccctgcctcttctgagtctgcagggttcaaggccagaagcagagcaagtcagaacacagctacacgcaggcagactatgggttggggtgcgggtgggtctcaggcacttccctgctctcaaaggagcacctccagggagcccatctggtgctccctccagctcctcaaattcccaacaccagggttgcaaggcccagtgtcttctcacctcgttaggtggagaaccccttctttaagcaaaagatggcacggacccccgacataagacagttcaaagctgagcggctctccccatcatgcaagtaacctgcgtgccgccacgggaaacagcacgcatcccatctggactcccaccagacaactgaggcaaccgagaaggaggctggggagggacagctcgagggctcactggaggtcagcagggaggtggactgcgtctcccgagggccagcactggcttagcctgctcagtgaggtgcccgaaggaggcccaccagctctgccagcacccggcctctgcacctcagctttcagcggataggtttgtgcaacgaaatatttcatagaaatcaagaaacatgagtgaacgatgcacaccaccgcgtggatgagtctcagagactgtggagcgaaagaagccagacacaaaggttgacatttacacgcaatcctagaatgacggctctatggtggcagagaggagaaaagcagttagctttggcaggtgcccacggagggggctatgcaatggaactttctgggccctggaggtgttgcagagtttgctatgggtggtggtagttacgtgggtttctatgaatgtaaaaactcttggtgtggtagacccaagctctgggcacctcacgcatgccatgcagcagctcgatctgtgacagcgagtcctgtgttccatgatatggctgcaaacacttgacagagtgaatgccgaacctctgctcctaagggaaatagagggccaggttcctacgagcctctgctccagccttttcagcaaccaatcagtacacaatagagttatttatgtgtttctgttaatatatgtcactaaactcccggccaagagcactacaactcatgcctgtacagagcctgtccaacacatgtattttctccataggacacatcatctcaaaagcaagtattgatcttattttatctcattttcaagagatgcagactgttcttaagcaagtactggttttaggtttacaaatacattttagcgagtaggcaaatttgcaagtacagaatctgtaaataatgagattctactgtatgtgtgtgcaatattcaaatgaagaggacagagcttcctgcctgacacaagcccctgactgactgccccacccaccgtcccttctaagagcagcagcctggtcccagctcttgccttccctcctcagaccagggataagccctgaccaatgtctacctcctgcagccagacacagacaggctgactcaggtgctcttggagtttgaactgagaaatgcaagagaagcttgcaaaatgctgagaggctccacaaggggctgctgaagccccagcaggcaaagctgccagctacagagcaaaaagccaagggaggggcagggatgttggaggaaggacctggctggaggtgactgggggcggtcgtgtccttgtcagcaagcatagagcagaacagctgcccaaggtgccacagctggaagggtgagtgggtggatgggtggatgaaagggtgggtgggtgggtggatgggtggatgaatgggtgggtaggtggggggatgggtggatgagtggatgatggctgggtaggtggatgggtggatgagtaggtggatggatgtgttggtggataggtgggtgggtggatggatgaatggatgggcagatggatggataagggtgggtgcatgggtggatgaatgggtgagtaggtgggtggatgggtggatgagtggatgatgggtgggtaggccgatgggtaagtggatggtgggtggatggatggatgggtgggtggatggatgaatgaatgggcagatgaatggatgagggtgggtgggtgagtggcaaatgggtgggtaagtggggggatgggtgcatgagtggatgatgggtgggtaggtggatggatggatgggtaggtgggtggataggtgggtgggtaggtgggtgggtggatggacaaatagatgggcagatggatggatgagggtgggtggatcagtcggtgggtaggtggttagatgggtggatgagtggatgatgggtaggtggatgggtagatggatgaagggatgggcagatggatggatgagtagatgataggtgggtaggtggatgggtggatgggtaggtggatggatgtgtgagtggataggtgggtgggtggatagatgaatggatgggcagatggatggataagggtaggtggatgaatgggtgggtaggtgggtggatgggtggatgagtggattaagggtgaataggtggatgggtaggtgtatggataagtggatggacagatgggtgggtggatggatgaatggataggcagatggatggatgagggtgggtgggtgaatgggtgggtaggtgggtgaacagacggatgaagtgtgggtgtgtgtgggaatggatggatgaatgggtgaatgggtacataggtgggcaaggtgggtggacatgggtgagcaggcatgttttcacttacttcattctgtaacaatgtcagagatcatctcagggcaccacagtaggatgcaaaataaaatctcaaaaggggaaaaaagataaaaagcattctgggtgctgaactgatgaaggaaatgaacccatggccaggctgctgctcaggtggaccccaggaagcccttctgggcctgcaagtggccgcctgctgcatgcagggctgtcctgactgcacggcggcgccaacatcaggctgggaggatttctctcagaacgcccacacctgcctgcctgtttctagcagaactcaagctgtcggtgccaaggcctgctctcccctcatcccaatcttccagcaagaggcagaggcaagctctccacaggcctacagtggcagggccactcttgcactctgtgccagtggccaggaacatgtggctccgcctgggtgtgtcacagtaccagcctgtacctgcacgaccctgttctcaggcatctgggtacctgcagctgggggccggcacttgtgtacccggctccgaggaaggaccgacacccaggaggggaggctccaggcaggccatggcttccaggaagcagctccggaagccgcaggcagtggctgcaggtggtgtgtttctgaggccaaatcggtcctctcttcaaccccagggccaggaagcaagctcagaatagggccaggatggagtctgggagcgctggaggtacagagggttgagggtgagccactgaaggagaagaggagggggcctctgtatgtctcagaaaatcagtgctcaagccgggttgaaccctgctgccccgggcatggtgggttcaagcctgacggaaaaccccctttcagtgtccacatttccaccctcccagacctctgacctcggcctccactccacacacacacacacacatacacacacacacacacagacacacactcttaatcagggcccaaagccctcctctgcactccctgccgaccccagggacttctccaacctctctccaactaaatcacattcaccccaccttcttcaccctgctccggcctgtgctggcctctctggaccaggtgtgcagctcggaagcacgactgggtgcaagggagacagccccaggcaggagcggccctgggggcgctgggcctccctcccccatcagggcaggaaaggtggacccctcgcccacacctgacctcctactccagcctctgagtaaggctcaggactctgactttcccccaggcaggtggacaggggagggggctgcaggtcaaagctcactccccaccaacctcctcacattcctccattcactggatcaacaaacacacccactgcccagcaccgctgccaggcatcagctcccaacgcagatgagtcagccccgcccgtgccctccagggtggggtggtaccagggcaggcaccaatgttcgggtccaggagtgcaccaggagacccaaagcccagcttgagggagggcaggaaggccttctgctctggaaggggccctggagcccggtgtggagggccggaggccggccttccaggtgcattccaagaattgcagagtgcctgtctaggagcagcggccgcccaggttggagggtgtccagtgagcgcctgccttggctggctcctcaggcacacccggggctgtggcctgcagctgctcctgcactggggctgagccagcaaacttccggggctggggctgctgggcagggcaaggtccgcacagggagcagacagacgcagcctgcaattcggcgcttatccccaccggagcggaggcacaccaaagccaaaggacacgcagctggcctcaaagcagaagctgcatcggggctgggaagccattcaggagcccttttctctcccctcgccctcaccctgagccctggccgccacggcccacacagcaggccctccggagagagatgtcaggactccgagtggagacactttatccgcatgttcttgaccctcatacagcccttacgggtacttattctattttacagatggggaaactgaggctccacagagtcatatccgagcctgaggccgcacagggagtgctggcgccggttctcagggcaggggttgtgtctgctctgtcacatgtcacacgggggctcccccaggcctgccttcctctgccctccctctagctgccagtggcccccaaaccccaggcctggtgcgctgcttcctgcagctctgactgagggtcagacgtcagaagggacttccagagctggggtctggctctcatccaaccaggctggctttcagagccgactatgggcacgccccatgctggtcaatgtcggcggtggggggatgggtgcccccctcaatctaggagacagatgaggccggacagcagaggggtggcagagaaaacccaccccattgcgacacctccgcggccctcatgcagctgtctccaccaaccggcgaagtgcggctgcccaagaccgccgagaccccatcaagggtggaagggggtcaggcagggctgcggagaggaggccacatgggtggcctggttgatgggtaggctctctctccccaaagcctgggaagagccatctctgctgagggatccccgaacgcggggactccggatccggctggctggaacgggagtcccgggccggggcagagagaggtgagcggcgcctgggaggccagtcccaccggaggataggggtgtaggtggacgggaggcggtggagggcagggacggggcggacagtgggggctgaggcgggagacggccccgatctgcgcgtcccacccccatctccgcccaccaggagccaggccagcagggaccgcgagggggcggccaggttattcacgggagtggggagaccccttaaagcgccctcagggaccggccacagtgggcggggccacccccagccacccacctccccccccaggccccgcccccggcccgcgctcgctccccacgtggccgctgacgggcggggcggcacctcctcttcctcccgcccgccccgcccgccccgcgcccgccaggagccaccgtccgagccttgcggagcgcggcagtgggcgccggctgcccgcagcccctgacccggccccggacggagcgccggccgcaccaccgccctctggccgttgcctcaccgggtaagtccttggcctcggggtccgcttggagcttcaggggaaactgagtccgggaggaggcaggggcgtgcttgggtccaggagcgaggttccgggctgcggcgtgtgtgcccaggtggcggcgggcggtccggcggcgcagggtacagttcccgggcggggaccccagggcgcccctggcccccccggctccgcgcgccccgctcgggactatggtcctccgcgccgaggcaccgcccgagcgcgcactggccgcagagtggtgggcccagggtcggccgggcctactcccagggcaggcgggatttccgcgcctcgcggctgccacatcctgaccatgaatcagccacagttgggaaaataaacttcaacttcgggtccgccgcccgggtggcaccccgaggtgcgcgccggcctgcggccccaccctgactgcttggcttccagctgcccacgcgcaggtgggcgcacagggagcccttcccaccccgcaaccgctggcaggcttaggggaatcagcctccatcacagctctctgttccttttgggtggggtaggatccaatccctgtacgcccccagacccacccgtcaaccctctaactggggagtcgccccaggagtgaccatgactaaggaggggaaggcggggtgaccagctgtgtccctgaccgtccccaatgccccctggggagcacaggcgtggggggtggtctgtctgtctgggccttctggggctcaagctccccacccagggctcccgcagctcagctgtgaccacagcattactgcccactccagctggacacaccaggaggcagagaggcagagaccctgcccaggcagggaaccaggaacccaggaaccgggccagaggtcaggcacacccagaaggcgctggacgtaggaaattcccttactgccagccctgcccctccgtctggcactggaatggagcaggatactcgccctcttccggcctcagtttccacatctgcactctgaagggtgggacagcagctcaggctgggacctgctccctgccgccctgcactgggaaggtggggtcccagagcagtgcctcagaccccgagggtgccacccagccaggggcttttggggtgtcggtgctcagcccccagtgcagcaaatagtagcattgggttccaggcctggggtctgagacctcacactgctcccacccctaccagggcagcagcaattttctgttctaaaagccaggttggtgcagtgggccctgcccaggccctgccctcccatccctggactgtcatgggccctgcagcccggcaaaggggatgtcgctagtggggacggaccaagtggccaggtgcgactgtagcctccacagccagggctcctgagttaaccttcaggtgagcgcccactttgtggaggagctgacggctgtcaagcgaatgacacacaccgcacatgtggggacgtggaagctcctacctgaaatagactctgcgccttccatcaaagtgcagttacttcctgggttggaaaagttatgcggttcatgcaggctgcgggaggggtgggtggtgactggaaagtgatgcggtgctgcctgtgggtgtggggcaggacgcagctggcccagctctggacggggacagtgaagtaagctcaagcccctggctttttgctggtgcctggaggtcaaatttccctgtagtcaggaatgagacctgactccctgctgccagcccctcccctacctccatcttgcaaacagcaggtgtctgataggtgtgtggttcatggcccagtggacacattacattggagaaggcacacccacctctgttttcaggatggtggacgggaaggccgggaggtggaggccacataggagccagtctctggagggtggtccccaggggccacagcagacccaggcctagtggacacctaaagtcaaagactaagttctaccaacggtgggaaggagagagggcaggggcacgggctccccgtcgctggaggggtgagcagggtccaaccacctggccccctgttagagaggcttccactcctgccagcctcaccctaggagggagagtcctgcctggtctgcctctgagcacccagacagcctgggtcctgagctggggtgaggtctgctcacacagctgccccccagcccagtgccggtataccctggcaaccaccaggccaggagagcagggcagaccggtggtgcctgtcctctcctgaggggccgtcctctctcacagccctttctaagctgtaattaaataaggaaccacaggggttgcttagggtcgcccctctgagggctcatgtcagtccccgagggccagcctcaggccgggtctgtccactcaccattcacgccagcctgggcagggtctgtgtgctgggtgagtgggtgaggaggaaaggaatgagccagcctgcggggtccctccgcacggtctcccaccctcatccctcccagtgcgacgtgggtcctgcaggagcgttcatttcacaggtgaggcgcgggacagtcggtgccattttacactcagtgccatccattctgccaggaggtgctgataaagcccctactgtgtgcatctgcccttgtgcccagagcctggagcccagccccgctcagcacggtgccaggcaggtgcagggcacttactgggggtcagggtgcaaatgggctggccccacagagtagctggaggccgaggccccccagcccttgttgctaccactggggtaggctcagggtgctggcactgccactctgggaataggacaggcctgtcctggtcaagtagccattaccgggcctccaaactcgggggttggtggggcaggaataggcccgccctccaggcaaccacctgtgtcactccagagcagcccatgcagacagacaactgcccaagggccagcctggaccccggagccctcccagccagtcggcctgggtcacagcctgggtggaatgaccagtgtggtcacagcccagatgggatgactagcgtgaaggccctgaggaccttgccacgccaatggccaagggcaagggccaaggctgctttcctctttcgcctgcagcttttcccagaggcagcagggagggagagagaggtaccaggagagtcctgagagaagggccagcctgggctgccccgagcctctgtgccctcagttcactcctgttctcaccccagaagggtgactggccgtggctggggcaccctccatctccctcagccccaacctctgtctgttggaaatggcatggagacccagaaggagcagatgggcaccactggaggcctggccaggctcctggccgccgatcaaggcctttgcagggtcagagggacatgggaagatgctgccaaggcccctggccctggtgccctgggcagggaccctgtgctcccgtgctgtgacagcgttataccaccccacctgcttcctgtgacctggacacagtctgagcaccccaaggtccaaagtgggagaggtggggtgggggagagggagtggggtggattggagggctgtcctactgttacagggctctgccccgggcccacctcacagtgaaggcagaggcccccaggcagcccttggtgggccagaactcaaccaggagccacactgggggcggagggcaggctgtctgcttcccattttgcagacgagggctagtgtcaaagcctagctttgaggctaacccagggcacagttgaggagggagggagagggaagcagtggccgctgagcacaccagccccgggtagtggcttttctgtatcatctccaagcccccattcagctgctgtgggcagaggccagccccagcccctcgctctgcccagcgagtggccagctgcccaacacgcatggagtcccagtgggcatggccagtggtgcaggggtttgttcgtgcctgagctgtcctggccctcgccgggtcgggggtggacgtggccagctgtgcgaggagggccagcatcccactggcctccatctccccatctgtacctgggtccttgcaggccctgggacatggcctcggtgtacagcctgcctgccccaccctctgtgcccccgggtccctgttcctgctccaggcacagctcagactgtcgcctgcacccagcctacgctgggaggaggacacagggtgggggtgagggagtagccacctgtccccacctgcctctgcttccaccttgtgcacagacatgagtggcctgagaacgggagccccttggggacacccagggcccctgcctatgcttccatgtgcagagggcccccccggctgccccttccctgggccaggccaggctgtggaggtgcaggcccaacagtgaggggctgcctgcaggagctggcagagccatgggccggacccaggaggggccacacgggcggtgctggcacagccaacccaggtcagagctacggggccctggagaacatcctggccattttacagatgagaaaactgagtccagaatgggcctggctgtcccaggcccctggcaccctcgtgtcccagcaagcattgccaagcggcatgttgcacccacgctgaggatcttgtttgcccagttgggcctgacgggctccctggcactggctgcctggagcagaggtcaagagacgctgagcaggggctgggaagattcatgcaacgtcctagctccgtcccagccgccaaacaggaggtgggctgagtgggaaggcgggcggtcagtgcgtggttatgcactggcattacaggtggcatctcgtcaatctgtcagtaagctgtgggggtggcattgacacactcatccgcatttgaggacaggaaccaggagatcctatgggtcacaggccggtcagcggaagagcccagtctcaccctgaatcagagccgtcccccaccctgggccctggtagcagcccctggccgtgctgggtgcgcaggctcagcctctcccccactctcaatctgtctttgttctccctgctcctgggaaggcagctgctagcggggatgtaggctgggggcagggaccatggagcctggctcgtgggcaggcagcgggcagccgtcttgtcttggcacaggcagggtgggggctggacaccctggggcccagctaggcacacagcaatcaggacctgaaccctgaagccggggcctggctccaatgagctgctgcccttccccctcccaggttgagagaggctttttctgaggacagaggagggacctggggcctcggaggaggcatctctgagtatgtctggtccggggggaggaaacccaggtgggaggattctggtgacgagctcctggccacctgccctcattgcccagcagaccccctgcagggtacgtctggggcctgcgataggccagccctgggctcatgccacctgcagggcctgatcaggccctgtgcccttcccagtccctaaccacagatctgtacacgtcactcccagccacagccatggtaggtgctggcaggccctcaggcccaggaagtacttccatgtagccgctcgtccccccatgcctctccctgggcccccagactccagcccagacccctgagaacgccagaggtgaccaggccctcagggagcaccccgttggccctgctgtttgtgcagtggagacactgtggcctgtagaaggcccattcggtgactggcgagccgcccacccacccaggccctgcacaccctcagtgcaggtggaagcgagagctgggcttcctggcgtggggcctccgcccttcctgtcctcccttgcctgggctgcgcttgccgactctcctcccagtgacccctcctcccagtgagccggggcatttcctgtttgctgcatccccctaccccccctacagagtcaccctcctccctgtggcttccacagggctctgttcctaacccaggaagatgtaccttccccaggcccattgtctgccccagatcctggggacacagagagcccagctgtagcctggctcccgggccagtggtgtcccctggcgttcagtgctggccagcccggaccccccagccacctccaccgacacttgccagagtgccatgaaggacccctggcccccagctctgctctctgggtgacccaagcaggggctaccaccgctctgagcccagcttccctctgtgagatgttgctgtcttttgatcattttgcttgctttcttcctcagtatgaaacgaccatattcatccgagatgcagcttcagttagtgattgggcaggtgtcccggtggtatcgcacccaccatgtgattgaaatccgtcaccatgcggcctgcttcccatctttgtcttctgatcatgatgctgctgagagcgcctttctgcccacctgctcccagggggcccttctgtcctgctgtgggtcctcacagtggcccgggggccctctttgcacaacaagcggagttcaagatcttggagggctttggaggcaggagccttgcactccatccagatcttggggactgcaggtggcatgagggctggagtgcttcttgggtgtgagacgggccaggtgacagtgaggacacagccagccctcaccaaggcccagtgcgccccatgcccctggacacgtggcagtgggtggacccccatcctcacctgccttgaggccccctgtgcacagaccctccctgggccttgccggcagttggtgagccaccaggtcagtagaggtccctcaaggggctgttggcctggtggggaaggtgacacatgctggaggctcaaaggagctgggagtctgagtgtgagggaggggaatgggggtcatggtagggcaggttcagctccaggtgcctccaccgccctgcagggcctgggctgcccagaaccccggggtgctgccaggaacgcgtgcagtcctggagatccatgggttgccaagcagtggaaaaattggggctctcggaggagctaaaaatacagtgtggcagcccctgcctcctagttccggaatcctctcctgccgttctgcccacccaccccgtggaagacaagctccctccctgcacccccaccaccaacgctggctcagggcccagaagcacccagccctgtgccagtgccagaagggcgacaccacagctgcctgcccactcccaggcagcagccccccacaggtgctcatgtgcccagccagtgcctgccctacccccgccactgcttcagggtccccagagccccttggtcccaggcacagtaggcagtacctgccaccccagggctgccaggctcagggcttggcctgttcctcgtggggagcctggacccaggcagacctctcccttccctaccagtggggacttcacaggggagggggctgtcccaggcagactcagaacatgtcacagcgggggcctccaggcccattggtgctggccgagggcataggagctcccacactgtgctgtggaaggccctcctcgcctggctcctgggaggcaagtgagggagccgaggcctgggggcttcagtggctggctcaggtccctcgcgtgctgggattcaagtctgggtaccctaaccctggcctgtgtgccgctcagaaccatgggcccatgcaggagcccccagctactctccacagctcggtgctgggcctgcctcaggagcccacactccctggctctggttttctgtctgcaccgcaggggctaggcacatggctgcaggtctagtgaaggccagcatggccctgtccccacccacaccacacactcagcttgactgttgactgctaggcggggcggtggcccggtggcttcccgagagtcagtgcagctgccctagcatgtaggcattcggatggaggtgctggcatcaccacaccaggctggccaggcccaggcccagagggggaccctgcctgccagagctagagtcaggggagaggcatggccccgtcctctggaagccccaggctattggttgacaaaagcaagtgctgaagaaccatggtgatgtcccactagcatgggtggggtgagcccctcagacctcagagtcttcatctgcaaaagaccctgccctgtgcagttccattggtgctggtggactgccggggggggtggatgggacgccccttcttggtgccctgacccttttgctgtccaaggcatggggtctggcctgagccatgggtactgggccctgcagagcctggatggtcctgccctgcctcagccagagctggtgccggctgtagaaaagattgcgaagaacgcaaattcctgtgcctgtggggaggtggccacgccctacagccggggctggggagctctgaggacacattcctgcgctggtggccccgccaacccactttccagatggagagcagaggggaagggtagcctgcccaggggcacacagctcagcaatgagactcccgcccccttcccttctcagttggcactggcaccttccagcgtattgttccccatagccccgtgcccctgagatcagtaaactgtggattccttctggaatccttgcagaagtggacaccaccccccagtgagaacaggcaaggctgtttttgcagagctcgctgtagcagggagtcggccaccgccacccgcgtttagcagagactcacaggcgggcgggggagtgggaagcctcatggttttctcatatggataattcactctatacatagaaagctttttatagacacagggaaggctcggggatgccctgagagaggctgctggctggaatttgggctcctatgagatgagacaaaaatcacagaagctgtcagttattacccaggtcccagccatttggggccagtggccagattgcgggtcagagtgctgcatatatggtctggccgtggtgtgtttgcaggttcagcctcatgctgaaaagcagttggaacattctccggtgtagagcctgacggggggcctgggtgagatcgggcagccttggcagcaccacagaaggaggagagcagctccggcctcagcctccggggcctcagccggagccctgtctatgccgggccgcagcccagcgagaccctgttacactcactgcccccagacagcacccggtgggacacggccagctggggcagctcagacacagagccaggcacccaggcacgggggtataggaacctgatgggcaggagggccagtttcctcccaccgtggctccaccccactgaccaagggggatcctcttgactggggtctttcaggggcttgcacagggcaaggagcgctgggcagtgccaagaggggcagtactcaggtcagggagcatcttctgtgtccagggacaccctggggcctggggcacggtggctctcggcggcactgcttgtctctaaaaggtcaggattttttgcatggagggacccccggggctcttggctggagaggacactctggatgccaggggccgggcctgggagagttcataactccgtccactcagcctgtgccaaggggacagggactccggccaatggaggcgggggaggaaaggagggtcagttctggggcctctttaggcagcaacagccaaggcgggtgggaatatatgcagaggcccggctgcctggctcttcatggtggtgggagcaaccctactgccaccaggaggggcgttggggacctgaggctgcctgggagggacccggctgtctctggcagctcagcggtcagcagcgatgagaagccaggggagcgtgaggagcagcccaggacagggcccagagtgggtgggcagaggtggccggaaggtcttgcgcatctgggtgagtggacggccactgggtgaccaagagggccgggcctgggagggtggcttaaaaccacagtgcaccgggggctccgggctctccgttctacagtgcccagaccaggaccccctgcagggaggaggggcatcccaaggacagcctctcaggatgctcctggcagcctggtgctggaggtgcagaagaagaaactgaggcccaggcaggatgagtgactgggccaaggtctgctggtgagggcccgggctggggacatgcagatcagaaccctggcttacacctgtcaggctgcctcctggaaggagcccactggccccctggggcagttggacaggtggagggctgaggggcggtgcggggagtaggggctggactgccggaaacaccaggcttggtcgtggaccaggctggggagtgggcctgagacctcaagggcaggtgctccaggacactctcccaaggcaggaggggaggaatagagcctcctggggaggcaggcgcttgggtgctcgaccccgctcagctcccgtgacctcaaatgcccttcagcctggggtcccctgacttaccgggttgggcagcacttgaagcaaagccatgtgggacctccagtcacagcccagccgtgcccaggtgtgggactgtgggcacagacccagcttctctaggacccagccgcctccagttccccacctgttgtgggaggtataaagtgcctgccttggaggtggtgggaagccgagggccagggtggagagtgctgggccggggtggaggctcagagcgtgtccctgccaggcccggccccctagctccctccccgaggctccacgctgctgttctcagacgctaaatataagatctaagccatacatggttgcaggagggcctgggatgcccctgaccttcgaggccagttcccagggtctgtggttggggacagcggctggggggatgtggtggcgtggagctgatgtcagaggtgcaacccgcctgtcctgctgttctgttttggggaaaggcacgtgttggggctcttctgggctgggcctgttacctacccgggtgttcccagggctggagtcagacctgttgcgactgaatcctggtaaaaccctgagtgccaagggtttccgtcttcctgttggtgtgggccccctacccacatgcagacgggcagactgaggcccaggggagacctgggagtcgcccctcctccccagccacgctgctgacgctgtgggcaccccaggcatgcctgaggtttggaatctccctgtccatattgtccactggggcgggggaagtgccctggggtgagataaggcagcctcagatgcgccgttttgtcgcatcattaccgtgggtaatgttccagccaggggagcctcccgctcccccgagtcctccccaagctcatccggtcccgtcactctgcaggggccgtgctggcctcgtgctgcaggtttctgagccggctcctcccctcccagccctgagcctcggggtcctcatgcgcgcagtagggcccttcctgcctgccgcctcggttgctgaaattcggtcagggatgggtacagggaagcctaagatatagtgggggacacagtgctacccctaaccctcagcatggcacgtgagcaggaattgcagcagagaaactgagaccgagggaagtggccccgcctgcgctggtggccaggaggacagcccccatcccctccccgctgacggctccctgccctctgcctgcagctcggcaagatgtcggtgaaggagggcgcacagcgcaagtgggcagcgctgaaggagaagctggggccacaggattcggaccccacggaggccaacctggagagcgcggaccccgagctgtgcatccggctgctccagatgccctctgtggtcaactactccggcctgcgcaagcgcctggagggcagcgacggcggctggatggtgcagttcctggagcagagcggcctggacctgctgctggaggcgctggcgcggctgtcgggccgcggcgttgcacgtatctccgacgccctgctgcagctcacctgcgtcagctgcgtgcgcgccgtcatgaactcgcggcagggcatcgagtacatcctcagcaaccagggctacgtgcgccagctctcccagggtgagccgcagtgtgggagggccgcccaggcggacgctggggacctggtatgaggcttcaggcccaaaaggccccgggaggcctggggaaccaccaggaggaagcgcagccaggcaggcaaggagggcttcctggaggaggactggcttcctgggctcaggaaaaacatccacattcactccgagtctgaggcttccaggtcaccccagtccccgcactgctgcaccagcggtccccctgtgcccctctctgttgtgtggctctgccccacccttcctccccgtcctgtgctggctcccaccctctgggctctctgccctcgtccacacctcggcggcaggagtcactgagtcagagatgcgaatccacccgagtggctccctacatacacctgcctagctccaagcccttcagcctcagcccagacagagcccttgaggtctggcccacacctactgatggtgtcaccctccacctcccagcgccttccctagcgcctccctccccgccctgtcccctactccagcacccaggggactcgttcccggcaggcaggcaggcccttggtctctgcctctgctcgtgttttctgcctttgcgtcctccaaggtcctgcgccgctaagcctttaagccccagctcactttcctgtcctccaggaagtctccccaggctgtgcccaaagttagtcccggtcccttgagagaaacccttgctgtgccactccatggctgctgccaggtcctaccgatgcttggggacgagctagggtgggcagtgatgggcggggctgggcccatgggggcggcagttacctgtgcaggcaagcaagccagaggcgcctcgtttctgtcggacccaggggacagaggcaggtgtaggggccagccattctcagcccgtctccccagcctgggcctggcagggcccctctatggagtcttttgtgaattgttctcagcagggtcagatgagagacacccccagaactttcacagctccagatggggtgggaggcaggggttcataggaatgaggttgtgtctgccataaacacagtaagtgctgcattgggagaaaagctgggcccagagccagtgacaggatggggcagctgcctccaagcccttccctgcagggtctggccctgtggtccaggagcagggccaggacaccgaggagtggggcacctcgttgggtcccagcccactgctgtgggccacagacaagtgcccggcaccccctggcgtctgcctgccaggcccagagccccagccctgagcccagctgcacaggcatgggaaggggtgcattggccctgctgagcctgcccactccaccctggcagccctggacacatccaacgtgatggtgaagaagcaggtgtttgagctactggctgccctgtgcatctactctcccgagggccacgtgctgaccctggacgccctggaccactacaaggtgggcggcagggcctgggcctgggcacatggggctccctgcctgggtgtgccctgaccccgccctccccacagacggtgtgcagccagcagtaccgcttcagcattgtcatgaacgagctctccggcagcgacaacgtgccctacgtggtcaccctgcttagcgtgatcaacgccgtcatcttgggccccgaggacctgcgcgcgcgcacccagctgcggaacgagtttatcggtaagcacctgccctgggccgcatgcccgctcctgcccgcctcttggccagtgcatcccatgctgcatccacctggggaggtgggagcgccacaaaagctgcccccgacccagggccccagaggaaggcgccatctcgggcctgccaccacctgccccttcaatggacacaggcctcagaacgcctgggggtcaaccctggaccgttctcatttgtgagactggccaggcagtggagccggacagggggcctgagacctcgttctagccctgccagttctggcagtgagccctgagtaagcatcactgtgtgtccagcatgatgtctcccctccagagcctcaggtctctggtgtcccatgagtgcagcagggcagggtcaggtgctctgggtggcagaagtgaaatggggaaggcggggagtggcctccgaaccctctgaccctgtccgtcccttcccagggctgcagctgctggacgtcctggctcgcctgcggtgagtccccactgtagcggtcctgccggctccccctcctgctcccaaggccaggcccacctgccctttggctcccagccacctcacctaagcagcacctccagatggcagggaggtggctccctcggagtaaccccaggggtccagccagaagccaggtctcaggctagaatccagctcactgtccctggcagctgcccacagaaactagggttgcagcagccatagaaaggacagaatgagctcatatcctttgcacaccgtggatggagctggaggccgtgatcctaagtgaaccaacccagaaacagaaaatgaaatgccaataagagggaactacagggtggttcacgtggacgcaagatggagacagggacacgggctccagggcgagagttgaaaaactacctacagggtacagtgttcgtcgctacttggtgtcaggcccactagaacaagggtccccaaccgccaggctgcggaccggtacctggcctattggaaccgggccacgcagcaggaagtgagcggtgggcgggcattcctgcctgagctgcacctcatgtcagatcagcactgcattagattctccagcgcacgcacgcgcgcaagggatccaggctgcgcgctcctcatgacaatctaatgcctgatgatcgggggtggaacagttttatccctaaaccattcccgtcaccccagtctatggaaaaattgtcttccacaaaaccagtccctggtgccaaaaaggctggggaccactgccctagaaggcaaatcgcctacgttacacagtgtaccatgtggcaaacacgcacatgtacccccgagtctaaaataaaaattttttaaaaaagaaactagggttgccaggtactgtatgggacatgcagttcattcaggtttcagatacacaacagacgatattttggtgtaagtatatcccagatgttgcatgggatatacttatgccaaaagttattcattgtttgtctgaaattcaaattgaacaggtactctgtagtttcatttgctaaatcttgcagccctgctgggaacccacatagctgagaagctctatccaggcctcagtcaggactgtactcaggggggtgtccttacacccagggaaatcagcttggaggagcccagggctagaatgcctggtgttgaaatggcctcaggggccaggcgcggtggctcacgcctgtaattccagcactttgggaggccaagatgggcagatcacctgaggtcaggagttcgagaccagcttggccaacatggtgaaaccccatctctactaaaagtacaaaaattagctggccgtggtggcatgtgcctgcaatcccaactactcaggaggctgaggcaggacaatcattggatcccaggaggtagaagttgtagtgagctgagatcgtaccactgcactccagcatgggtgacagagcgagactccatctcaaaaaaaaaaaacagaaatggcctcagcaaagtttgcccacatgggtgcctgtgccccaccagtgtgggctgaagggggccggccctgcctgcggagggctgtgctcattgaccagactgagatgactggcaagtcctaggcccagtgaacactaagtttcctcctgctcaggccagagccccgcccctcctgtatccatgcagccctgtggacccacctcaggtgtggtcttcactgtagtcacgcagcgcccaggggagggccttccctcccccaaggtcacggcccggttccattgtgtgccacctccccaggccttggtgcacgttactcgatgggagtgggcatactcgcccttccccttccccaggggcgtgcgggtgcctggtgacccgggggcagcctggcagggcgcaaggcactgacctgggagctgccactcttaggtcgctatccctggctatgtgggtcacatgtcagccacagctggctatggcctggctcagagtcccaggtgggctgagcggggctggtacactggcgctgacccaggctgccccgcctgcgtgttggtggtggcagcagcaggcttagcccacctggcccctcctgcacagagacctggaggatgccgacctgctgatccagctggaggctttcgaggaggctaaggccgaggacgaggaggagctgctgcgagtctctggcggggtcgacatgagcagccaccaggaggtctttgcctccctgttccacaaggtgggctgggggctgcagggcggagggcagccctccagggcaggctgtggccctgaggtccagaggctgggcctggaacggtcctccctgccctggtcagaccctgctgtgacctgggccatggtgccagctttggggtgagactccagggagcagcaaggacccaggggttggaaagggaggtggcgcctagagcgggcagcctgggggccgggctgggccctgggggcaaagccagggccacaggacccagaaggacggggctccaaagaccagtgcggcccacagccggccttactgtcctgggccccagctgcccagtccccatcaggtgggcttcagaggcctcagggcttggtgaggggctaagaggctgaattctcgtcaagctcaggccttcccctcattccctgaaccttgcagctctcatctgggggcagttgtgtccccaggtggcatctggcaacatctgaagacatttttggctgccacggctgggcagggggtgctgttggcattgagtaggtagagaccagtggttctgtttaacatcccataatgcacaggacagtcccacatgtcaccagtaccacagtcgctgaaactctcatctctagggatccgtgggaatagagggggtgatggggctggacaccctggcagacaggccacagtccttagtccaccagggaggggccggctgctgacctgcaccccacactcgcccgtccaggtgagctgctccccggtgtctgcccagctcctgtcggtgctgcagggcctcctgcacctggagcccaccctccgctccagccagctgctctgggaggccctggagagcctcgtgaaccgggccgtgctcctggccagcgatggtgagggggcggggcaggggcgtaggcacagcctggtgggcagacactgaggtcttagaccatgggggggggagcctgcccttggccccaacccatcctctgcccaggggaggtggccgctttttcctgcctcttcctcaagcccccatccctccctctccggctcccttctcccttgaccctggacatcccctactgcagcccaggaatgcaccctggaggaagtggttgagcggctcctgtctgtcaaggggcgacccagaccgagccccctggtcaaggcccataaaagcgtccaggccaacctagaccagagccagaggggcagctccccgcaaaacactacaacccccaagcccagcgtggagggccagcagccagcagcagctgctgcctgcgagcccgtggaccacgcccagagtgagagcatcctgaaagtttcgcagcccagagccctggagcagcaggcgtccaccccacccccacccccacccccacccctgctccctggttccagtgccgagccccctccccctcccccaccaccccccctgcccagtgtgggggctaaggccctcccaacagcacccccgcccccacccctgccaggcctgggggccatggcccccccagcacctcctctaccaccacccctgccaggctcctgtgagttcctgcccccaccacctccaccactcccgggcttgggatgcccgcccccacccccacccctgctgcctggtatgggctggggccctcctccacccccacctccactactgccctgcacctgcagcccccccgtggcgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtggtgagggtccccagacccccaagggaagcttcccctaggacgggggctggtctctgctggggagaggggcaggtggcacatggaacttgtgtgcgcgtcctgcccgtgcgtggccagggcagcctggcccttgctctgggctcggcgcctgtggttgaggtggggacgggggaggagcagggcaggggctacctctgaggacccccctccacatgctcccgtgagccagtgcatctggggtgccatggtgccctggggccctgctacaggtgctcaggtagggaggtagggtgcctgctgtacgctggacctggacctactgggccccaggcaggacatcctttagaccctctgggaggctccagcccctgcctgctggatcgccaggccccggggctgcgagagcctcactggccgtgtccccacccgacagagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggaggtggggacggggaggggactcagaccggggccgcctgcctggccaccctccggtaccagcctgttgggtggggggttttctagatcactttcctcgatgccaagaagagcctgaacctcaacatcttcctgaagcaatttaagtggtgagtgagggaggtagcccccatcccaggccacggagcctcgcctccacctgagccttctgacttgggcccagcagtgccctctgcaggccgccatgggaagtgcacactgcatcccctaggcaggattgtaggcgggtaatagccccatgctgccccagctaggggctgtccaggctcccagggacagagcgctgggacctccccccacaaggccacagacaagtagtggctaaaccagtgggccctgactctcagcccccgagtcctttcctgctgcgggtgtccagcactggcccgagggagctggctggacccgacccatcctgcatctcctgagcagggcccatggagggtagcgagggtgggagtcagcctgggtccccttcaccgcgtgaccgtgggcaacaactcgactgttctgtgtcccccctgccctggccaccccatgactacgtggggaaaccctgccaggtggggtcccaaagaggctgggtgggggtgactcatgattcactcacccctgcccggtcctctccctgctccagctccaacgaggaggtcgctgctatgatccgggctggagataccaccaagtttgatgtggaggttctcaaacaactccttaagctccttcccgagaagcacgaggtaagaggaccacccccacaccccacccccagttagtgccaccaaccaagggagaggctgtcccgggggctcccagcagggagacagagaagggaggcatcccagccctacctctgccctgaaccgtgagccacagggagccatgatgggcactggaggggctgagcccggcgggcagtccgggagggcgggaagctggcatggggggatcccacatgccgttctcctcctggcagattgaaaacctgcgggcattcacagaggagcgagccaagctggccagcgccgaccacttctacctcctcctgctggccattccctggtgagcatggccgccctcagaccccagggcctgggccccaggtgggaggagagcaggaatagggagcagggcccagccagggaggagaagaggctgtgccaatggctgccccgggctccaggagcagcattgcagcggttgggcttctaaacatcactcgagccccacccccagtccttcccctcaaagtgtggggctggaggcctctggaggaattggatcctgctctgcgcaggcccgggagggtgcctgttggatggggcaggcggtggaaaccccctccctttgcccaccacccaagccagagccctgtgctgagtgcccctctggcagggacaggtggggggtgcaggccactgatccctgtctgtgccatccccagctaccagctgcgaatcgagtgcatgctgctgtgtgagggcgcggccgccgtgctggacatggtgcggcccaaggcccagctggtgctggctgcctgcgaaagtgagtggggccaagcggggcacgtgtgcaggagggacaggcctccgaaccggggcgggagggctgctcggggcccctgctactgccagtatcataatggctgctaagagcacctaagggtgccagccttcaccaccactccggaaaccaccctgctgccaccacctcggtgcacacacctactggacgcacagacacacgcatgcccaccgccactcgggcacgtgcacacacacaagcacactgccactctccggcacgcgcacacacaagcacaccgccactcaggcacgtgcacacacgcatgcacaccgccactcgggcacgtgcacacacacaagcccacaagcacagtcacacacatgcacacaggacacacagacacacgtacacacccccccaacacacacaccctcacatacatgtacagacataagtgcacacacacgggcaccatctctgaaaggggaatccatggggacctgccacagccactgggcagggagagggacaggtacggaccagtgaggcacagctcacgtctgtcaggcacactgtaggtgtccactcccgtcggtggagggtttgcagcccccaggccctgtcctgtgatccttccggtgctgggctgagcctggggaggagccagggagtgcaggggcactggcaagcaggaccacaccccaccgccagggcatctgggggctccgaaccaagagcccctctccagccctggctgcccctgcaggcctgctcaccagccgccagctgcccatcttctgccagctgatcctgagaattgggaacttcctcaactacgtaagtcaggggcagctccccatcccacctggtgccaggggctggtgagactcactccctgcccctcccagggcagccacaccggtgacgccgacggcttcaagatcagcacattgctgaagctcacggagaccaagtcccagcagaaccgcgtgacgctgctgcaccacgtgctggaggtgggccgtggtggcgggggcataatgggagggcttcaagtccccccggacctggggtgtagaggcgtagaggccatacccccatgcccaccactcaggccgccggtctccctgtctcagggctccgtctagagccagcagcctcagtcagagccacgcccccacccctcccagcaccccttccttcctgcagcactggctcccctgcacgagccttgtccctccccaggatacctgtccctgatctgggggacagtccctaggaaaagcagaaacatcacaaagtcatagccaggcccaagggaaagatttgagggtctggagtactgggggttttctggaccttaattgctaagggttagagctgggggagtgggaacagggtcatccccaggtggagagtatgaccacagtggatctcactggacgtgtcccattgcaggaagcggaaaagagccaccccgacctcctgcagctgccccgggacctggaacagccctcgcaagcagcagggtaggtagctcctgccagcccgcccacctcagccaggtgggggcctgacttctgtccccaggcagtgaggtggctgcccgccagggctgggtctcacagctgcagcgcagccccggcgccacggagccctgcccaatagaacacttcccttttgggacaggaccgggtctgccgtggcctatccccttctgacttaagcgaggaaacaggcctagagtgggcaagggctggccaggtcagggtcacaccacgggcaggtctaatacagccccttcacaaggtggaccttcacgacagccgtgagcaggctcgggcctccctcattgtatagatgaggaaacggaggcccaggaaagcagtgtcacctcctgggtcacacaacccaggcaggagggcagcctgggccaccccactacacagtccgggcccctagcacggagttcttcccgggctccacctgccctggaaggttctctggctcaggagctgctcagccttggggagaactaggcaagcaggacaggctgaccgttagggtccccgcccagatgctcacagggggctgagggtcagctggaacaggcactcaaccccaacactgcacgtgcagcctcagagtacagcctgcagggtgcacagtggggtgccggggggtgcaggggaggggctcccctgtcccagcgaggctgacgtcagccgttgctgtctctgcccggccctcctcacctttcaggatcaacctggagatcatccgctcagaggccagctccaacctgaagaagcttctggagaccgagcggaaggtgtctgcctccgtggccgaggtccaggagcagtacaccgagcgcctccaggcaagtgggcacctgggcctggggctggcgggagaggctgccctgatagagtgagctgggcgagtggctgtgctgtctcctggctccagggtggatcctggggcccgagtttccccaggtgtgcatggtcagggcacaggcccctgctccttgtcagagaccaccgtcctcagggcctgtccctgtggccgtcaccctcccgcaactcagggcctcaccccgggtggtgcccgcgcggggctctcacgggactgtcacgtgcccttgcccccaggccagcatctcggccttccgggcactggatgagctgtttgaggccatcgagcagaagcaacgggagctggccgactacctgtgtgaggacgcccagcagctgtccctggaggacacgttcagcaccatgaaggctttccgggaccttttcctccgcgccctgaaggtggggcagcccggcgggacacagcctgtctggctagagtggggtcccgaggcccctggccttcctccggcaggatgggcagaggcacctttcgtcgggccgacacagccatgtgggccctgcgctgctgcggctcagggagggggacgcccaggcccatggagcccctgagggatgccacgctggggtgacggggccacatctgccagtgcaggagaacaaggaccggaaggagcaggcggcgaaggcagagaggaggaagcagcagctggcggaggaggaggcgcggcggcctcggggagaggacgggaagcctggtgaggctgggccggctgggcggggagggggtgactctgggatccttgtctgtgctccagcctccccaccacccccagccctctaggtgggctccagggtcccatgccgctctctgagtgccccacgctcctcagtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctggtaagaccctctcccactgcctcctcatggtccccttgccactgtccctaccctgtgcctccaggaagtcctcctgacttcactggaaagccctctcctctccctgggccaccctggaggcccctaagactggggacagccgaggggacaggtggtggccgctcagccctcatccctccctccactcactccagctcctccactgtaaccgcaggccctgccctcagtgctgaagcagcagtccagcccgctgggctccagagagatgaggccaggcccactgaccgatgcccttgggctcagagggtgctagaggtggcaggaaaggcaggcggcaaggccctggtgggaggaccccattcctggggtggctgcctcagggtgctgggaatggcatggcccagtgtcccccaccctgccacagtgtagacagaccaaggacgctgaggccgggtcctgctctgagacatcagaggaggctttctggggaggaggttttgcagggcgttcaggtagacagcggaatggaggaggctgcacctgggctggctcgggggcagggtgcctgcccttcactggtgtgtccctccatccagtggccaccagtaaccctgcaggagatcccgtgggcagcacgcgctgtcccgcctctgagcccggccttgatgctacaacagccagcgagtcccggggctgggaccttgtagacgccgtgacccccggccctcagcccaccctggagcagttggaggagggtggtccacggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaaggtaactcagggaggggccccgggcaccgtcccacgccagggcgctggcacccagccggtccctccccttccccattgggcactgcaagttccagcggcacccaggagaggtgacttgggtgcggcacgggagaggaggcggcagtgcgtccaccgcagggcggctatgtgggctgccgcggcccgtgcaactattcctccaacctactaattccgaccttcacgccacctccgttagggagtagggggcggacaccgggcaccaggtcccaggcaagtggctgccatgtggcttagtggccagagaaccgggcagccctcagagggtgttggcatggctgtcccgggccccccagccccacccactccgagtcagggttgcttctgtgtgataagccgttgagtgcgtttcttttatttggaagcagaggttccccctgattctgatgataataaaacaaagaaactgtgtgtgatccagtaaggtatgtacgcagccggcgctccgtgggggctaacagcagctgcagggcagtggggctggagcttgctgcccacacccctccgggacactaacctggcttctctccagcccgcgtggtgcgtcagtgtggccttgccgctcccgcagccctggtggtgggcttcccgccccatcccctccctctccgcaggttacctgctcaactggtgcctcctgcaggcaggacgcaacctcagtgctggccccgggcatgcgggcctcgagagggcaggtggcagggccagccggactcccttagcaagcaggatccgggccctggggcgtgggcgggacctcctggctggcaggacaggctgaggttgctcctgtctggtgtcctggcgctaactgcagttccagtaaccctgtggctttcctgctctgtctgttggtggagggctatcttcactctaagtgtgtcaatggcgtggggccttctggggcatgtccccaggaagtctgtgaggagaccgggacagtcgcaagggcagatgctgccagggacaagtacactgcaacccccctcctgttggacagtgtcctcccaccccgaggccatgggtgggtctatggagaagcagattaccccccgcacaccgagtcttctggggggcgaccagccaaaggtcaatcagccaggtccgtccacagggctggagaggccaatgcatccagctagacaggaccagcctgcactgggtggaggaggggctagagcagagaaccagaaggtccagcccggccgatcatgagctctgtgagcccaggtcgtggcgtcttccagcacctccagccttgctcagagccagcccggtgtcggtgcatcacaaatatgctgaccgctgggcctggggcttaggctcaaggtgcacacctgaggtctgctggtgcccatcagaggcaagagcagtcgtgaccccggagaagcttctccggacagcttgtcctcgctgttggggcacggccttcaccctgggttccagcttttgcttccagggtcatcttccgagtgtggctctctggtgtgaagcacccacgtgtactttttagaaaggtgctggcatctcccttagaggctggaacttggacttgctggccctgagtgtgaggaacagtggagcatgcaggtctggggcgggcggccacatctgacaatggtccagtgaaagatggacgtgtccagtgccagctccacgctccacctggttccctcctgaacctgctacacgtgcttagcctccacccgccccagctcctgccacgcacgtggctgagggcaagaggaagaagtcctcttctctccccaactttttattttttattttttttcaagacggagtctcactctgttgcccaggctggagtgcagtggtgcgatctgagctcacagcaacctccaccttccaggttcaagtgattctcctgcctcagcctcccgagtagctgggaccacaggcacacgccaccacgcgcggctaattttttgtatttttagcagagacagggtttcaccatgttggtcaggctggtctcgaactcctgacctcaggtgatccacccgcctcggcctcccaaagtgctgggattacaggcgtgagccaccgtgcccagcccccacctttttatttagaaaatcttcaacaccacaggaaactgcatagatcagaatgaacaacaccttctccccgaaattacaaccatttgccaaaaataccaaaattgtgaccattttgctacattgcccccctccaactgaggcatctgagagtttcttataaacatcatggcactggagccctaaactcgcccacagacacctgagagcacagccgtcttcctcagtcccccccgggcagggtgcgctgccgtcctcccagtccgcccccaccgggcagggtgcgctgccgtcctcccagtcccccccccgggcagggcgcgctgccgtcctcctagtccgcccccccgggcagggtgcgctgccgtcctcccagtcccccccgggcagggtccgctgtggggcgcttcacgtccacatgcttctaatactcggtcccagtgcagatgtgccacttgccccaataattccttctctagttgttgctttgttgtttttgcaaacaagattgtatccagagtcacatgctgtgtttggttatcatatcacttcagtctcttttgttctagaacattcctgcccctttttgtcttgtatgacattgacgttctggaagataacttcactttgggtttgcctgattgcgcccccaagtaggtccaggttgagttttggggcaggagttctaccccaagggatgccatgtcctccccagctgggtggggacgtttgtggcagcagcgctgaccacggctgcgggggtggtttctgaacctccactgcacgaacaccacgctgtctggttaataagcaccggtggtgacctgtggaaccaaccgctgcagcgcggttctgtgttcgccgcccctcgtccgagcgttcccccctcccctccctttttccatcacgtgagttttgaacgtgcagtaatccttcactgccactgccgtgcatttgatggggaccagcgggggccctgagcgcttcccatctttggcacaagcccctgttcctagctcaccccagacttgctgatccccccatccctgcacgggccttggtcttggccatttctccaggttccctgagtggggaatggtgctgagaccctcctttgagtgattgttttggatagtttttgttttcttgctgtctgtttagagtagtggttctcaaaccctgcttgggccatcccactggggagctgggacaccacctggcactgtggtggcagtgggggtgacactcagacaagggccatcgagggcccctggaccagaaagcgaagagggcgttgggggcaggaggcctgtggggccatgtgtgggggccgtctgggtggcgggagctgttggggcagggctgagcgccctcagcagcccactggagaaagcgctgctggggtcctcgtgtggggcccagggcccgacgtggaagcaatggagggctgcagggggtggcagtggggatgaatgagtaaggacagagtgcagcctgggtctcagacagggggtgggggacaggccacagagattccctatctcagcagagaggagacaggctcaggctgccacgccttgccaaaacccagcctggccaggccagcccggcaccttccacctagataagttgtgctgctccagagaaagagcctggggtcagagtggacctgcgatgcatggcacaacctgctggacagtggcgatgaggggttcagggacctgggcacccagaagcgggcacctgatattgtacccagcaaaactgctcctaataatgtcattttttctctctcttacaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctagcccggtgtgcgactgtcgtgttcagaggctgcgggagtgggcggtggacgtgggctcccacaaacatggtgagcgctggacaggccccgtgtgaacactcactgttgaggggcccccaggccccgtgtgaacactcactgttgaggggtccctgggcccccaggcaccgtgtgagcattcactgttgagggtcccccagtcccccaggccaggggctgtccctggagccctcaggaggcagtaagaaacatctagaagagggcagacccagtggtgaaccgcatccaacagtggtgagatgggtgcagctctacaggggcgtaatttacaaaccaccagactccctggttatgtgtgtgctgcggtggtgtttgctctccagcagatcaagtttgtgcaatgatccattttgagaatctctccgtcaccccaagaagtcctctcgcacccatcagtccgaccccttccccgtgctcctccccagccctggcagccactcacctgcactccagacgctccagatgtcatgcatgtctcctggcttccttcggctgttttcacgcgccatcctcacggcaggctgtatcaggacttcattccatttcatggctgaagcacattccattgcatgcagggaccacattttgtttgtctgctcttctgtccatggacatctgggttgcttccagtttggggcttctgtgaatcctgctgctgtggacatttgcgtagtcctcgtgtggatgctgctgtggacgtctgcgtcgtcctcgtgtggatgctgctgtggacgtctgcgtcgtcctcgtgtggatgctgctgtggacgtctgcgtagtctcgtgtggatgctgctgtggacgtctgcgtcgtcctcgtgtggatgctgctgtggacatctgcgtagtctcgtgtggatgctgctgtgaacgtctgcgtagtctcgtgtggatgctgctgtggacgtctgcgtagtctcgtgtggatgctgctgtgcacgtctgcgtcgtcctcgtgtggatgctgctgtggacgtctgcgtcgtcctcgtgtggatgctgctgtggacgtctgcgtcgtcctcgtgtggatgctgctgtggacgtctgcgtcgtctcgtgtggatgctgctgtggacgtctgcgtcgtctcgtgtggatgctgctgtggacgtctgcgtcgtctcgtgtggatgctgctgtggacgtctgcgtcgtcctcgtgtggatgctgctgtggacgtctgcgtcgtctcgtgtggatgctgctgtggacgtctgcgtcgtcctcgtgtggatgctgctgtggacgtctgcgtcgtcctcgtgtggatgctgctgtggacgtctgcgtcgtcctcgtgtggatgctgctgtggacgtctgcgtcgtcctcctgtggatgctgctgtggacgtctgcgtcgtcctcgtgtggatgctgctgtggacgtctgcgtagtctcgtgtggatgctgctgtggacgtctgcgtagtctcgtgtggatgctgctgtggacgtctgcgtcgtcctcgatgctgctgtggacgtctgcgtcgtcctcgtgtggatgctgctatggacgtctgcgtagtctcgtgtggatgctgctgtggacgtctgcgtcgtcctcgtgtggatgctgctgtggacgtctgcgtagtctcgtgtggatgctgctgtggacgtctgcgtagtctcgtgtggatgctgctgtggacgtctgcgtcgtcctcgtgtggatgctgctgtggacgtctgcgtagtctcgtgtggatgctgctgtggacgtctgcgtcgtcctcgtgtggatgctgctgtggacgtctgtgtagtctcatgtggatgctgcgagttttcgttgctctggggtagattcgtagcggaggaacaactgggcgacacgctaagtttatgtttaactttttaagtaactgcctaactgttttccaaagcagctgcaccatttttcattcccatccatgctattgtttttcagttaaatagctccactcctccccctccccaccctccacagaactgccagtaaaactggactatggagtattgggtggggtcacctacaaggtcatctgcagcaagtgagaccatcgcccctcctgcctggagaggtgggactggggaccctgtgacaggaggagctgcccttcctggagcctggtttttctttttcctctgtgctccatgagaagtcagtttagtgggctacagccagcaaaggaaccaaaaccaacaggagctctgggggtgccttgcatggcgaggctccgtggctgcacgcgtgtatgcaggtggctgtgggtgtctgtgtgtcctgggccactgtgtgcgatggtcccactgggaggtgtggcccccaaagagtggaacccacaggtggacacacccatgcaccctcgttcttgcccaaggtcacacatcgagacagcagggcccagatggatggccccaagctcggtggctcccgtgctgcccacacctggggacaggcccactgtggggggtaaggggtggaggtgttctaattcgggctgagccgtgtgactggcaggggccccagctgttgggcctgggcaggactgtttttagaaaagccccaactccctgcccctacccgggcccgtggctatttatagtccgggcctggagaagtcagtgagtcactagcgttcgcctctgcagggtcagtccaagcccccttagtgaggtggtctagcatgtcccccagtcccccaagcctctatctgacatctgctagcccagagccccaggggtccccaggaagggctcagagctggtggccccccccaggccttggcagcacctccttgtctgatgggactttgtggttcctggtggacatttaacattgtcggtttctctcatctggaaacaaacctccatgacgctcttggtttctcctgttgcagtctgcctcttccctacctgcacagctctctgctgtgccccaaattccctccttgacacccccagacccactgccccaccctcaggtgcagccccttctcagcaggctccaggttctgccaaatctcagagccctccaaccctgctccagccccttcccaagctggggccggtggtctgttcacccccgaccagctgtcacccccaaggtggcactaggaagttcatgcatgaagactgcttttccactgaggccccactgactgcttggaacccatacaacggcattttccccgcaaggatgctgagggagaggaagtgtcgatgtgcccagtggaagaagaggggactggggacatgggtgcagggggcaggaggccaggcttcaaacagcccctctcccccaggctggggcacggtcaggtgccaagagaggaggggtggggaggctgcaggcaggggtgggcagtggtgtccttggctgcacctgaatcactaactcagtgtgagcgacctttgctgtgacaggcccaagctccactccttcctcacagggagtgtcccgtctccatggactccctgtcactagccttggagttgccctgagcccaaggggcctcgtggctccaggctctttggcaactgagagccgtcagggagggaacaaaggaccccgcctccctgctctgaagcaagaacctgattctcttttccgcccttggggccccaggacccttctcttggccaccagggctggcttcctccaagcctcatctacttgggaggggtggggcgggatgggtgagacaggacaaccagccgggaacacgggagcctcgcagaccatcgcctccctctggggcctagtccctccacaggctgggccgggaaggtctggtgtgggacctcttgggaacctgggccccacggtggcgtgcatccctgggggttgctcccatgccagccaggtgacgctgacaggatgggtccctttaccccagacttgggtgctgagggccggagctccatgctggagcccgcctgctcgctacagccaggcccgagccacagcgcgcccgggcgggacgcggggcccctgccgtggggcagaagtgcgggcagttgcggggacacaaagtcctcggagaggacgcgctgcgcggctcttcgcggccgccagggggcgcgcccgcgcccagggcactcggggttccacggggggcaggtgcgctcctcgagagtgcggaccctctaggtggggtgcaggacgcagctccccttttgcaaaccgcactccttccctggagggaacgaccacccctgcagttgctggaaccccgaagtcctgggcccggcaagggcttggtggggggtgaggtcgcggtgcacaagccctggtccccgacgggctagcgagaaactgcctccgttggcaaattcgtgggggcggctccccaggccatctgcctgcctggccgttggtccgtgcggcccctcacccctaaagtgctcgagactcaactgggcttcccgggcagcggcgagggggcggggatgtggcggccggaggtcaccggggcgtcactgcgcccgccctggccctcccccggcccgccccctgccccgccccctgccccggcccggctccatttaatggcgcggacgccggcggcggcgggctcctggccgggccagcgcagcggaagagccaagccagcatgtcggggacccgagcctccaacgaccggccccccggcgcaggcggcgtcaagcgggggcggctgcagcaggaggcggcggcgaccggctcccgcgtgacggtggtgctgggcgcgcagtggggggacgagggcaaaggcaaggtggtggacctgctggccacggacgccgacatcatcagccgctgccaggtgcgggctggggcgccgggtccctcccccaccgcccagcgagcccccctcccccgacccagacggcccctgtcctcccatgccctggccggtcactcacccgcttggatgccttccttccgggagcacctttcccagggccaccccacccacgcacgcacacgcaccactcacacaacccccgacccacacacaccgccctccttccacccacccctactccaccaccccggcagcgggccagggcacagctataaatacaagtcgctgagttggggacacccgatccttagggggtggcgcatgccatgggtgtgacgctggaccctccatgggggaaccagaggacccagccccaggatggtttgaggacccccaagacaccccccttcctcatttacagtgatcacctggggcctgtctgggtctgggatagggcttacctggctccccgcaaggtctgcaggtggtggagggggtaaaagctgcctgctgggtgggggtgaccccggtgagtcagccaaggagaggcagaggtggaagggggccaggccgtcctggggggcaattggggccgcgcctgagggagggtgcttgggacgatcctagccagacatgggagagggagggccacagacttctggccagggtgaccccgtggctggcagtgccaccgaggaggccagacctgctttgtcccccagggcccagggctgggcctctgccagccggcagctgctctcagcgcccccatctgttctgactgagctgcacactgggcactctctcgggccgccaccctggggctacatgccccatgccagggcagccaagtctgctgcccatgggctgacttacagctccaggcacaaaggggtcaactttgggatgcacgcgtctggggtttggagcctgcctggggctgctgccaataatggaacaagggcccccgcaccgtcccttctccgggttctgtggcctccttcctgagctccagagaggagggctggggcccaagacgaagggagtcagcccagcaccctgtgtggctcagggctgtccgagcccctcctgccggaagggactgtggcttcctagaaagttcttcctggaacagtgggggacctccccccttgctctccgtcctaagcagcaggcaagcacatccctcgctccagagatcccccaggtcctagaggtggtcctcagcccatgctccctccacactgcctctgccccgccaccttgtcctgggccgccagggggcatgtccagcgctctactgctcttcaccctccagggcgccctcagcgtggggcagccccggcccctgaccctccttagacctctctgctcccgtgaggcccaggcccctccctatgagctgccagctctggtgggcgccatgcacttctgcagggcgggctggggcccccacaggtgctgtacacagcattcacctggctccgcgctcccagctgtggagatggttctggatctgggcactccctgctgtgccccccacccagtccccccacagccccgctcactcgcagctgcacacgggagcacggaggatgcagcaggctggagcccatcccgcactccggccaccaggctgcccccgccaggccacccccaccaggccaccctatagcctgagggagcccctggctctccaagtgagtgggaataaaagaggtttgtccctggagcccacacctgtccccctgcagcctcctcacgagccagtgaggcaggatcatcctgaagagctccttcacaggggaacagaggctcaggcgtggaggaatgagtcactgccacatttggagccctcactggtgccacgtgcccaccatgatagcccagggcctggccctttgtccccacctgcgagtgcggggaccgagctggatctcagcggggcgccgctctgcaagggaaggtcagggactggtcttctttggggccccagccccaggctctctgcaagtgctcagtgacccctacctcacagtgcccatctctcctcctagcggtgggggttctcccctaccaccgggctcccagcacctcccctgttcttgtgcacaccatgtctgaccaccccatgtcgtcagaggctggcagagggtctggctggatctccccagggaagactgcgtctttcttacttggagtgtggatgcctgaagccagatgaaggtacccgacatgggggtctccaggcgcacagaggccaaacctcaccctctcactcaaggggctgagcagaggacagagcgagggccgagtggtccaggtggtcaaagtgcacgccgtgggcagagcgggctgggccgcatctgggaggcaggctggctgccaggagggctgaagctgccagccctggcaacaagcctgttctgctccccagtccccaaagggtcacctgggcctggggccaccctgggttttggctatgctccttccctggctgcccaagcctctggacacccaggctctggctctgcctgctgctgacgcctgcaccagcagagccatcacttcgagcccagctctcaagccccctggtggcccctggcacttggcaagagttgctgctttgctcaccctggacatggactttccactctgcccagaggtgatctggggctgcccaaagccccgcacggctcgcctcattcttttcccatcccggtggtttggggcctgtggtcagagtgcatctgggggcccctgagagtgtcgtcacctcccacagcctcccgccttgggtccacctttaggacctgtttcctgggcggcctcccttctccaggctgagcctacattttgcatcccccaccttctgaccacacccccacctcacacctcggctgtctttcctccattccagggcggctctgggtctgttcggctgcactatgccccctggccccactatgccatcttcctccttgcctgctcccctggctgcttccaagcctctctcccctccaggctgagtctcctctgagccaggtctgccctccctgctctgcggccacatcacatcgtctgcctgtctgtgctggggtcctgtgttccctctcttctctctgggcacggacaccccatcctacttccgagggggtccccaggtacctccgcctgtgcttcctcccttgcgtccatggcgtttccttcccctgcgtgctgtccagctcctacccctcaaatgggcagctgaaggcaggtgcacctgggtctcccctgccccctgttcccaggctggcagtgcccggccttcaccccctagttcctccttccatctccaagatacttcctctggataactgggctccctgccgaggaccacagggctccagcgcgccctggtcagggtttagaatccccgtccttctgctgcagtgctgacctcagggcactgggctgtttatgtctggccatgcccagtacacgggctgaaggggcctgccctgggtctccatagcgcactcccagcctcccgtgccctccaggtctagctagagccagtgtccagccagcagacgggtggaaagctatggccatgtatgcaggggtgtgagatcacagggtgtttctctgtggtgtggcagcgccaggtgggagctggcatcctgtgcattgagggcccctgtgctgtggctgttggggctctgggcaccctttccaaggggccatcaggtaacgctttgccttaggctccagggtgcaccagagaccttctgggagtcagaggggcagctgccttggccagggaatgcctggggttgcttccagaaagaggtcttccccctaccccacctctgcactgttgatggtgctggttactgggccgtggctccaggacagagggtccctgcagttacacacagccctgcctcattgcaggaacaccagtcccgggcagctgagacctgcacacctgtagcagtgacctcggttctgtcccagacctcaccccactaccaaaaggggcagagaacaattcctttgggttgaaggaatgaatgaatggtgggagcctgcaagcagagcccagaagggagtgaagcagtgtaagtgggtgaacccactgcaccacactggtagtcacaggtgtgtgcacactgggcgccagggccccttgctctgtgccgggcacagtcgtcgtacaaactgccattgagtgccagtgccaagaggttgggcccaggagcctcacggcctctgaaaagcaccgccggcctccccctgcgcttgccactctgctgccttcactgcctggcgtgagctcgctgacagccaggccctgggccagggctggggatggacacagaggcaggagagctggtcgctcccattccagggggagaggtgcaaacagccactccactgtcccctcctccccaagcctgcatgagagctgaaccaggaggtggtatagcatgggcctggcacagctagggccgagggggaagcgggcagagtgcagtggcgttgaggcacggcgccgtcagacatgcagtccgctaacgctgtggggaggagaaggctctggagcatgggaggtagcgagcctcgtccaggtgttgctgcaggtagggctgacgatgggggctgcattgcaggggagaaaggggcctccttgggaaccctgggccaagcagacgctgtggccagaggagtcatccatggcagtaaagggcctatggactgcagggcagagaagggcagtggcaagtgggccgggagtggagggggccctggcaggtcaaaggaggtcaatggacagcccccaagccaggcagatggcaggtggcatcccaaggatttagggacggggtggacaggagcaggacgatggctgcagggcaaggctgggacccgcacgggtgacaagctcagtgcaggggcagggcatgcgccatctgggcagtgtggaggtgaggagcaaggacaaagcctgtgtgtggagacgccttgcacgtgtcagcagcatggcgtcggcgtgggagggaggaggtagcgtcggcgtgggggaggagcgtggcgtcggcgtcgtggggaggagcgtggcgtcggcgtggtggggaggagcgtggcgtcggcgtggtggggaggagcgtggcgtcggcgtcgtggggaggagcgtggcgtcggcgtcgtggggaggagcgtggcgtcggcgtcgtggggaggagcgtggcgtcggcgtcgtggggaggagcgtggcgtcggcgtcgggaggagcgtggcgtcggcgtcgtggggaggagcgtggcgtcggcgtcgtggggaggagcgtggcgtcggcgtcgtggggaggagcgtggcgtcggcgtcgtggggaggagcgtggcgtcggcgtcgtggggaggagcgtggcgtcggcgtcgtggggaggagcgtggcgtcggcatggtggggaggagctgtggggtggcaacccagaggcaaggaggtgggcagaggcccacgaacctggccctgaccctcagctcgtccccagctcacagcacagccctcccctggctgcctccaaggagtctccagttactgagtggccactccgtgccagctcagcccacccctcaccttcccagtgcctgtggaggcccaactagggtgacgctgggagaggagagggcttggaggagccacgggtcaaatgcaggaggccacacctgcctgcccaggaggactgcaggagccggatccttaacacctggaggggagcgggtgggtgcggtggcgtacatctgtaactccagcactttgggaggccgaggcgagcggatcacttagggtcaggagttcaagaccagcctggccaagtgaaacccggtttctactaaaaatacaaaaattatctgggcatgctggtgggcgcctgtagtcccagctactggggagggtgaggtggtagaatagcttgaactcaggaggcagaggttgcagtgagccaggatcacaccattgcactccaacctgggcgacagagtgagaccctgtctcaaaaaaaaattccattgtttaaagctgtccaggctgtgtattttgttttggcagccctggagactatagatagatagatgatatggagagaggtgtagagagatatttacttataaatatatgtacatatataaaatgcctggagggaccagcaatggtgggaggactggggagtggccccgagaggtgctgcgggtgtgagggtgcgcacagcctcctggaggggaggggcctgagtggggcagtggagatagggctggccacagggccgtgccttccctggcccccagaggggtgagttgggtggacccgcagggacaaagcaggggtcagagctgtgtttggttcctgagtgggccttgtccaggatggagagagcctcttttcctaaactccctgccaccagggaggcagctggcacggatgtcccctagggactgtgagtgacaagccagactaggcagagagtggggggggggggggggctcagtgtccgtgggggctcagagctgtgtcctgacccaagcctgcaccacagaggggaagaccccaagagaaacctggaggcaggtagagagcgccagggggccaccaggctcccttggtgcccctaactctgggcccccagcctggtctgagcctttgggtacaggtcactcaaggcaggtgttctgcaccatccatcttcatatcgtctctctcactcgcacccttgcatcactgtgcttctgagagttgggcgcttaccttaatctactgtccctgacctggcaaacagtggaaaggtggcatgatgtggccctgcagctgctacacctctaggcgccatcattcatgccatggctctgtgacagcaccccctagagttgtgcagtgtgcaacatgggtgactgtccatggcagctcacagcatgtggctcagcccattggccatgcagggggctcctttcctaggagcagcagggctgggcttcctctccacctgtaggggcagcagtgggcatcttaggtaaatgcaggactctgcagcccctagaggaccctgagtggtggctgaaggatggatgtgcccatggccttcccagagctcaggtgcctcagctctgctttcagaggagcagggcagccgaggggtgcctggcagagaggcctgccggctggacgtggggaccctggagcttggcctgaggggctgtggtgggagccgtgcctgagcagggctgtcccgtggcacacactcgccctggctcttctgcccatcacttatccccatgaggcaggaaagacagagtgagtgcggctgccctgggggctcggcactggggggatggtgacaggactcggggctcagggccgggctgcctggaacaagcagaccctgaggggccccctgcagcaggatccatggacccatctactgggccagcaggggccaggaaaggagaagagggagaccggtggggctggaggcaccagtgcgtctgtgcaagaggaggaagccctgtgagagggcagcagcctccggactgccctgcacaccgtgctgagaggcctggcgtccacctgcagcccaaggcagctccaaaagaaggtcctggtgcttctccaggaggcgaggctggccctgatgtttggtccctcctcatcggccagcctcatggtcagccttggctggtggctcccatggcaaggcagaccctggcctggacctgaaggctctgcctttgtgcagagccccagcctgacggtaccagttttcctttgttcccctttgtccagccctccttggatgcctttgctgtgggaatcccaggctgaagctggaggaaaggcaggaggacttcttgtccccagcctctcaccacgtgcctgtgcagcctgacgtcctgagacctcaactggtgatggggaggacagactggtgtctctctggggccatcgtcctgggctccccagaactgggagcccctgcggatcagcaggccccaggctcagcgtcctgagctggctcctgctcccaggggtggcctggcactggccctgcggtcattggacacccactggcctacgacaagccgcgcctgttcctaggagcctgtgtttgcccccaacagagccagggtgtgcctagcagggcgttcctgggcctgttgacgtgggcactgggcactctgccatggtaggcagcacttggcctgactgccaggtcatccctcgacgcctgcccccccgcccaggcggggctgtgtacaagggataggcttcccttctctcagtttccctacctgtcctcagagacctcacccctgactgcccccaaaaggcagcagatgcagtcgtgggcatgaaggtactccatgaccccagcggagaggaattaccacatatgtgccgaggcaaggacagagtaagagtgggggtctccaggagggtgctgtgacccccaaacccagaatctgttcgagtcacgccagggcctgccccgtcccgatggactgaacctgtgcgcccagggctgactcagcgtctgctgagcagcacaggctgagagccctgcccatccgcccaggctgcagaagtaccctgaccctccacccccaccctgccttggcgcctggcagcattagctcccacaaggcctccaggtgccctcagaccaccctccctcctgccaccaggcttcctgcatctctccacctcccaggatccccacccagttcacccagcaccgccccgcccagagccactgtcctgaactggtttcctataaggactgggcccagccaggcagggccaggcagaagtcagggcgtggaggtggggactcctgccctgcgaaggggcttcagggctctgagtgctgcctaatctgccagtgtgtgaagttacgtcccaggagggtgagccccctgcctggcatctctggatctgccccccctctgtccccagggttgccctgccacgaggcgccggggctgtttccgtgtaactcttgtccagatgcatcgtgaggagctagtgcagagggagggggccgccatcacggagggtcctgcttgggcaggcggggaaaggctatgtgagacaccccactgccaggcttgtgagggtgggaggggagctgagacccctctgccgggcagagagcagtggggtgtggctgggagaatcccccatgcgtagacaagttgagggcttttctgccgggaggtgaggcaggaaggtggggctggatctgggctctggggtcctggggacagagtgggccccaaaagggaagtagtgaaggagagaccagaccagtctgtggggcagggtatccgtgtgtggccccccgcaaccccaccgggaccctgcttaccctccaggtggagctcaaggagagagggcaacaggaagggtcccccatgccatccagtggctggccagaagtggggctggagacctggccttctctcctggggcagagaccttctggggctccctccaggctctgtcacactgggcctacaggggtctcttatggtggcataaagaccaaaaggtgctgtagggatatcccttgccgttggtgggggcctggcttcaggggcaatgagccatcatgggccatcagagatgctgcctcttcctcagctgtgaagcggggcctcctgcctgcacgtaggggagccctatcagccgtgccttgggactggagtgtccctgtatccatcatgccaccagcccacctgccctgcaggagcagagggtgggggcagcaggggacacccactggacctgtgccctgctgagcagagccaagcaaaaggcaggagggctttggttcttgccccacctggagagggtccctagcttatcctctagcttccactggcacaagaggcccttggggaagcgaaggcagtggcatccagggcgtggcacagtttgcttgtatcatgtggctgtctcatggcaggagggggattggagcctgcacatgctagtcccaggccctctccccaccatcagcaggaatccccccagagaggggagcctgtggctgggtgtttcccagaacagggctggctcagaatggctttttctttttcattcttagacgggaggtgcctgcccaaagggaagggtttctgctaaagtgggtgagggcaggtttggccgtgggggtgctgaattcatgttctgtgggagggttaggcctcctcattcctgcatgagaggagcgagctccagagcggggcccgcagctgcagagacctgcaccaagccacctggaggtgttggcaccagcctgggccagaccctccccgacccaggcccctgaccaaactgctgccctccttccaaggtgcaggatgcccacatcccagtcccgcacagacgcatcagagctggccaccaaaccagacaccccaaaatccaacagcagtgccctgcagggacagacgaagccccatgtgggtcagtccatgtccggggggtcctcagtacccaagtgccttcagctcagccgggtttctgttccaggggggcaacaacgccggccacacggtggtggtggatgggaaagagtacgacttccacctgctgcccagcggcatcatcaacaccaaggccgtgtccttcattggtgagtgccctgccccgacctgtgtgtgagcaggaaagggggtgtcagccagcccaggagccccacgcatgggggcacggggcaccagagcctggtgatgactgctctagcagtaggctggaccccagcctccacctgccccaccaggcactggtgcacagaaacctgcatagcccgggcctgggctgggaacgcagctgagaggacacagggctgatgggaggaggggcagagtcacatccaccgcgcaggagcgggagtgcctgatccctgatccctgatccctgatccctcacatgcacatacttcctgtgtgggcatggagaccacacgcccatgtgcccgtgactccatgtgcatacctgtgagtgagtatgtgcttgcgacaggcctggcttctcgctgcgtggcgaccaggctgtgtggacaaggccgtgccctccccggccctgccgagccatgtggccgtcctcttgcctgggctgctgtggccacgtggcaggcctggttccagccccttcccagtccgtgctgcagagggacctccttccacatcgcctgccccctcctgggtccggacacagctcctcccctgcagccacctgtgaccactcagtgctccaagaggcgagccacctctgtccccagggttccgtggctctttccctccttctctcggtcagaagcctgctctgtgcaccctggcctcagctcttagcccaaaacccccttgctcagagaagcttttcctgatcccagtggccaagccagccaggccccttcttgtactttcccttccagctgtttccagacttcagcaaggccatccttgtgatgtatctgaccccttcccagcccgtcaggaagtgggggtcaggcgcctcaggtgtgtgcccagcagatgcatgggcctggacccattcaatgtgagcagagggaggaagatagcgcggaggtggctgccgcaggggccatgtgtggtcaggggctgagctggagtgactcacccaagaccatcccctggggtgcagacccagtccctggccctcccagcagtggggccaggacagtgtgggggcggtccctagttcacagcagggaggccctaagcagtgaggtggcctgcccgccatgtcgcaggagcccctagccctggcagactgggcagtagcgctggctggccgctccgggttgtgctgcaggaagcccttctccagccgccagcctcgtcctgcccagccctgggccccacatggcaggaaacaaggccaaagaggcaccgcttagcaagcggcaggacgtgccagggctcacacagacaccctgagcttgcaacactccgggcctctgccgcgtgtttatttcaggatgccgtggcatttgggtgaccttttgtgctcaccatggcttgcgtcgtctccgggtcactctcgtctggactgaagtcccgtctccctcagctgagcctgtgccatggccagcctcagcgggaactggcaaagggaaaggggttccttggggaggcagcaggggtttctgaaggcttcatcttcaagcaaggggtttagagctcaggagtgtatttgtgtttttttgttttttgtttattttgagacagggtctggctgtgtcactcaggctggaatgcaatggcacagtcctggctcactgcagcctcaacctactgggcccaggggatccccctgcctctgtctcccaagtagccaggactacaggcttatgccaccgcacctagctgatatatatatatatatatatatatatatatatgcatttttttttttttagaaatggagtcttgctgtgttacccaggctggcctccaactcctggcctcaggcaatcctcctgcctcagcatcacaaaatgttgggattataggcatgagccaccatgccccaccagagcggtgcatttgtgacaatcgatgaacctacactgacaggtcatgatcacccagagtacatagtcacctctgggttcacacttggtgctgtacattctaccagtctggacaaacgtatgctgtgtatctgccactatagtatcgtacagaattttttactgtcctaaaacccccgagctccacccatttcattcatctctcccccctcaaccctcggcagccactcaccttatgctgtctcctcagttttgccttttccagaatctcagagttggaattgtacagtatgtcgccttttcggattggcttctttcactcagtaacatgcatttaactttcctctatgtcttttcatggcttgaaagctcatttcttttcagtgttgaataatactccactgtctggatggaccacagttgatttctccttttgtttactgatgggcctcttgactgctgccgagtttcggcgattatgaatagagctgcacatctacgcgcaggtttctgcagggacatcaatttccagctccttaaataccgaggaatgtgttttgcatccatcaccaccatccacctccagaactttcttatcttcacacactgaaatgctgaaatatcaaataactccccagtctccctctcccagcccctggcgcctcccattctactttctatctctatgaatttcacttttccagggacttcatataagcggaatcatcctgtttgtgtccgtttgtaactgccttatttcactcagcataatgtcttcgaggcctgtgtcagaatttccttccttttttaaggctgaatactcttccatcgtatgggtagaccgtgttctgcttacccattcatctgtcaatggacagctcttggctactctgaataatgctgctatgaacataggtgtgcccatttcatgctgggttgttttttgttgttgtttgtttgcttgtttgttttttgagacggagtctcgctctgtcacccagagtgcagtggcaggatctcagctcactgcaacctccgcctcccaggttcaagcgattctcctgcctcagcctcccgagtagctgagattacaggcatgcgccaccatgccaagataattttttgtatttttactagagatggggtttcaccatgtgggccaggctggtttcgaactcctgacctcaagtgatcctcctgcctcagcctcccaaagtgctaggattacaggcatgagccaccgcacccacccatttcatgctgttcttaatgtatgttttccagtgtctgggacacaactctgtctctcatgcctctgtctctcatgcaggcaacggggtggtcatccacttgccaggcttgtttgaggaagcagagaagaatgaaaagaaaggtaggtccaagctcctgcagacttgccctgtcccagacgcggtgccctgagcggttgttggctggagccttcctgagggtttctcccacggaggggactggcaggggtgggttcccaacatagctggcccagctcatcacccgccggctctacccgcgcagaaagcgagtgagctgggcaacccagaggcctcagatgctggtggcctcagcatcacggggccaggtagcacctgggaagtccaggaaggagccagggacctggaccagacacccagtgggaagtggggactgctggcctaactatgcctgcagggaaggatgtggctcctgggggctctgcggagcatctggccaggcacgcagaggccagacccaccagctgggggtgtgggcaagtcagacctagtgtgggcagggacggacggcagcctgagtgggtctgggaggacgctgagctgcagcctcaggctcaagggcgggacgggtgtgaaaagagcaagaatgtgattctggggacatgggcaccagggggtacccagactgaggccctgagggggcaggtcaccttcagagtggcagcagctagggaggaaagccgggcactcacaccagctctggcttcccagcctggagtgggcgaagcctgcaggcacgagagtgggcatcctggcggcggggtggagtgagggtccgggagtctcagctggggaggagacaacgaggggcgggtctgccgcttgctgcgcaacagaggtggccctgtcagcctcctccctgcatgccttacctggatgggagccgggcgagctagcccagctctggcccctcacgtgtgagctgcagcgcacctgtgaacactgacccacctgtgtgccgtgtccccgcaggcctgaaggactgggagaagaggctcatcatctctgacagagcccaccttggtacgtttcccactggagtacagggaacagcccctcctgcccccaccattgccagccggccctgctcctacatggccaccgagatcagggaagtccccaaggccttcttgctccacatggctccattagcttgtacattacccttttcaaagagcttcaagttgggagctgggtcaggggtcactagcccatttgcaggtggggagactgagccccagacactcatggtcacaccccagtttgtcctctttgaaatctcaaccacccccttcccaggagactcaggccagcaggaggtgaggtccatgtatacacatctgtcctctgcttctctcctgtctcctgctgccctcacctggcccgcccgacagtgtttgattttcaccaggctgtcgacggacttcaggaagtgcagcgccaggcacaagaggggaagaagtaagtctgccgggacactctcaccctcggggagtcttctgggcccgtaagccggtagactgtggggcgtgtctggtcctgggcacaacgaggagggtacctcaacccactcaaagcccctggagaatggcaccgtcaaaattccacagcgcatcacccaacccccggacgagccagcccgtctctctctggggttgcacactgtccttgccggctgccactgccacgcggctccccccaggagtgcataagccctaccgtcacctgtcacacccaccacctttcctgactccacacggccccagggaagacacgaggaacactaaagcagtttagtagaacctcagatgtgccaaggacacaggagtgaagcagatgagtgtcctgcctcagagaggtgatggtcacacacttacccactcacactctcacacaggcacacactcatgctcttacatacacaccacacgcccacgcatgctcgcacagttatgcacatgtgcacacgccacacaagcccacacacccacgcaaatgcacaaaagtacacacagccacacatgcacacactccacatgcacacatccacccacaggcacacaccataccagtacatccatgctagtgcgtacacccacacacgcacacactcacagctcagccagacacaggcagcaatggtgggcactggagtcatgagccggcgggggtcatggcctcagtgggatgcctgagctcctcagggctcctgggttctcatgggtacccactccccatctttcagtataggcaccaccaagaagggaatcggaccaacctactcttccaaagctgcccggacaggcctccgcatctgcgacctcctgtcagattttgatgagttttcctccaggtacctgagccgtctgcagtccccggggaggatggggagaagttgccggaagggactgtggctagtggggagggccctgaggaccagcatggaccatgacagggggtgatgatgactgtcccttgtgcagattcaagaacctggcccaccagcaccagtcgatgttccccaccctggaaatagacattgaaggccaactcaaaaggctcaaggtgaagtcggggccgcagtgtgggggctgcggaagtgctcctccagggaggctggatgtcctacctggtgctcgttgaacacccttggggcacacctgatactaggcattgttatgggctggccaaccttcttgggacgcaggcctcccctgccccaggccacaggctcactctgctgcttggcccttccttgcagggctttgctgagcggatcagacccatggtccgagatggtgtttactttatgtatgaggcactccacggcccccccaagaagatcctggtggagggtgccaacgccgccctcctcgacattgacttcggtatgtccgggagggtgtgcgtgccaacgacctttcgtgcctgccagggaagacccagctgcggagagccgtgggaaccgatgggggagggaggggcagacccgctttccaaggccacagtgccatccatgcccgcggaaatgatcctcgtgtccttagtgttcctattgtcagcaagggaggggagaggagaaagggctgggctagagatgaaagaacagggtgacaaggtcaggggtggggccagggagcctggcaaggtgggtcagagccagcccttccgatggtctgtacagccatatcccgtcctcacccccacgggcgcaccagcttaccctcacccccgaggcggcctggtcacctcaggccatgctgtgggcaactttctccctcctctcaccccagactcttttgtgagccacatggcccagcacacagcacccattcggccactccaccaggacaggccaggctggcgaccccacggagggggccccccacggtttgaactgcccactgccctttactgagaaggcctcttgggccgggtggaataatctacagggggtgacaggtagccccctaaacctgctctgtcttgcagggacctacccctttgtgacttcatccaactgcaccgtgggcggtgtgtgcacgggcctgggcatccccccgcagaacataggtgacgtgtatggcgtggtgaaagcctataccacacgtgtgggcatcggggccttccccaccgagcagatcaacgtgagtccccagcccctcgggaccccgtgggaggacagggaggccaggcaggggtgccgggggtggggtgagcagtgccagggtggaggctctgcggaccttgccagtgccatctccccatctcccaccagggcgcttcctgccgtgcaggccaggggagagcttagtaagaggcgctggggtgggcctgttcccacggccacagcacgtgagctcacacggggtgcgcacatgcccacacgtacacgtgacctcgttcccctcggagtgtgtgaggcccacaggcaagtgcggacgccttgcagttcctcaggacaccctcattcggggtagctggtggactcaccttggctcagagaggacactaagcatcttccctcagccttgtccccaggttggggggtcctctgtcacaaccaagctagaattggggctgaaagccaacccccacaaccctgcccagctctccagccccaggaaggtttctggaagctgctgtggccccagaatcctcaggagaccccagccttcctctttcaccctcaacctgtgacccttggtagggcaaggacatggcccttgtgcctgagcaggaggaagggcaggtgctgggaaagccaacacggggaggggcggacgccatccagagaggcttgagagggtgcagggatacatatcgggagatacacacacccctgacccccaaagccaagctgcagggccaggcccgcctcccccagctgcccatggcaggaggggaagacagcaaggctgcccgtgccttccccagctcacaaagcctagtggtctggtgtgttcaggaagagcgctcgccggctcgggtggcattgtgggccaggccttgcccattgtgagcctcagctgctggacaggcttaccaggggtgtggggatgtccgggagctggatgtaaggactgtcggtggaggcggggcaccctcagggattctgagagctgtgtgcagggaggagggggagcagcagggccaggctgcacaaggctcccacgacagctcacatgacgtcctccctgttctcatgtaggagattggaggcctgctgcagacccgcggccacgagtggggagtgaccacaggcaggaagaggcgctgcggctggctcgacctgatgattctaagatatgctcacatggtcaacggattcactgcgtaagcaacccatgctgccatccccactgggaccgtccctgactcccgacacctgcagaggcaagcagcacttgacgcaggggctgagggccaccaagtctccttggacaaggtttccactgatctcgacccttccacaaagcacggcccagaggttagcggtatggaggcctgtgcagggtgtgttggagccagccgtaggagcacaaactcccaccccagggctgatgccgtgaaggatgagggcatcccggcacttgtgagaggttaaaatgcttcatgtggagagcggaagtacccaggacgaaaggatgcactgtcatcctgctagaaggacggcagcatgggtgccggcctgttgaggcatccgctctgcaggcccctctgctttccacagactgacccaggctgcccagctgttcgggctgtctcccagggatctgaaagaggctttgtgtgaggggtgggctcacagcttcctttccagctcagtcagacaggccaaggctgtgagtcgcacatctttcaccagggttgagagcatcagccaaaattcctggagaattaaccagacccctgctaggtgggtatagagctaatccggcaacgggaagcagaggaaccgagtagctgagggtgtggcgtctgggatccgtgaccctcactttccttgtgcgcgatgcagggttcacggcgcagcctcatcacgtgctagggccagcatggaggacaggcagggtcagcagtgctcagcagacccatccatagcctgctgcatctggcgccccttcaggctttgcccacggagggaggaaaaacagagcccatggcacagggcctggtgccgaagatggaccaggaagggaggctgccatcattggcatcagtgggtgggtgggcagggaccaggaaggtgactaggacaagggtgccatgctcacgggctggacacagggcagtgctgggccctaaacacggctgtgctgtggggaaagtgcacgtgtggggacgggaggggagaagtggagcctgggggagcaggggtcccggggggcactcgaggtacaggggacttggaaaggcagagatgaggtgcagggcgtgagcagaagcccccaccctctggcatgtttgtcaatggcgcttttttgggatcacttaatctctcttttccactcagtgtaaatcagcagtccctaacttttttggcaccagggaccagtttggcgggagatgattttcccacagacagggcaggtggcaggggtgtggcggcggatggtttcgggatgaaactgtcccacctctgatcttcaggcattcgattctcacaaggagcatgtggcctagatccctcgcatgcacagttcacaatagggttcaggctcctgtgagaattgaatgacaggaggtggagctcaggccgtaatgctagcttgcccgccactcatctgctctgcagcccaattccaaacaggccaccaaccagtactggtccacagcccagggactggggacccctgctgtaagtaacagaagcgagaggtcaaaagcaagcggaagaaaccccagcactgctgaccacttcttgggtttgcccggccccttggctttccacaggctggccctgacgaagctggacatcctggacgtactgggtgaggttaaagtcggtgtctcatacaagctgaacgggaaaaggattccctatttcccaggtatgtgaagtggggcaaccgttctgcctgttgggccgtttcatggtattggaatagataggacctgtgacttctcagagaggggtgagttcccacgttcacaggacacagggcaagcagcttgtctccagtgaccagcctccatcatggcttttgcctctcacgggtttctccccacagcgttccccaggaggcctggctgggcaggggtggctgtaggccccttccagtgttttgggaatggctcagggggacagactactcgcctgggaccctgggggaccttcagctgccttgaggaaaaggcccacctgcagggagccacgggaggcacacaggagttagtggatgcggtcggctctggaagatgtaaagctctatgcggacgtacaggatgactatttcatctgagaaaatacgctttgtggcgagatttttaagacctaaccgggatccctgctccatgcaccccttcttctggaaagcatgaaggaggtgccattttcctgggtttcacaggtttcagtttcgtgtgcgtctggatgtgccccctcgacctcggtccagggtcatgttctgaccctgttccccacaatggcttcctcctcagcagccctgggcgagctgctcctggctggtctccactcagcagatctttgtaggccacacagggccacttggctacaggagccatgtgtgtccttgcaggcggtgtccctgaccctcctgacccttgacctttgagaggctgcacttgtgaggactgcaagctctcctcatggtggtccagggtcccagggggacacgcaaacactgcctggctccaaggctcaaacacacttgcagcgagaacccgtattccagcatcttccatctgtaagggtggttgtcttctaccaggagccacagagtcctgcacagggccgggatccctgccctctgggagttgatgctcttggggtgggaggacacagatgcttcaggatcccttagtgcttcaggattctagagtctcagaatttccaagccaaggcttggagtgcctcagctgatgtcacagtggaggttctagcagagtgggtagcacatatgtgtcatgtccctctggtctggaaggcgtgtagtgtctgagccccactgctgtcccctgcttaccacccaacactgagaaaatcaaactgggccacgtgcccacttgctgccttccttgcagctgagtccctaggcaaggaggccctggatgggggtggccgtgtcaccaaatatccgcttccctggtgataggaggtctgtgggccccactcatctcctgtgtgcttcccccagctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcaggtgggtgccctgcatccccagccaccctccctgcaccctggatgccccaaggggcccacatcccagcgcagggcttggtgagcaataagaaaaccaagtgtggtcaccaagcgaatatattgcatggcaggaggggaggacgactcggagctggggcagtgtggctccgggctagggtgtgggtgtgaccttgccgggagcccctgcctctccgcatccagaacaacagatgggacacatcccagccatatgagtgtgtcatgtttaccctcataacccagaggtgtttgcacctacagagaaagggtctgcagggagagtcactaagtaactaacgttgccatttccaaggaagaagggaggagactcctgttttccgctgcgggaggatcagtcccccaacatgcactaccttcataacttaaaaattagaactgcctccatttggagagaaaatagccccttttaccatttgaactacacagaaagatacgacactaaagacaactttttctgaactttctgcctccagtgtgtatcataacagtcttttctgctctctcagtcaaatgggttggtgttggcaagtcaagagagtcgatgatccagctgttttagtcacagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactgaatgggagcagttgttacatgtttgatttgactttgtctttattgcttttaaacactgaaagacaacaattcactgtgacaggagtctggaggatgtagcttcctaagagctgcccatgttttttgggtaacaaagccaagccttgtgtttactcagaaaattaaatagaacaagcccatataagagaccaagtcaattaaatatggtttgttttgagacagagtcttgctctatcacccaggctggagtgcagtggcgcgatctctgctcaccataacctctgcctcccaggttcaagcgattctcctgcctcggcctcctgagtagctggtattacaggggcccgccacgacgcccagctaatttttgtatttttaatagggatggggtttcaccatgctgcccaggctggtctcaaacgcctgacctcatgattcacccaccttggcctcccgaagtgctgggattacaggtgggaggcaccgcgccagcgtgtttagtttttaaaatgatattaaggccaggtgcagtggctcagagttcggagtaagtttagaaaaacaactgcccttccagtatcctttcaaagacagggaatcctacagagacgccagtctggcggggttagaccctgacttttgagcactgtggctgtcagctggtctcgctagcccaggaagttcagcaggctctactgacacggcaggggcctgggggcataggctgggttatgagattcctgtgactccagggatgcaagcaacttttctagacagtaccaagaacagccctcagtgacttgagcggcaggaaagccatgcaactgcacggctctgccccaggccacgggcgcttccttcctcaggccggagtccctcagcagcactagccaccttgagatggggtgggacacacaggcagaagccagcctttgagtattcccagatgctctcctttcataacacagcaagagagacaaaaagggagccccgaggcaggggtaagctcctggggagagggggctgcgggctttctctactcagccctcacatctacactgggccctcaaagtcaagtcatctaaattgaaatttgagagctgcaaaataggttttcaaacctctgttttgtagtagctgctaaatcttccaccagaacacaagttgtcatcgttttctttcctctcgggatggaaggcaggcgtttcacagggtaaaaagacaccaacgcagaggggaaatacttctcccccagcaccaactcactcacttccacgtgaaccagagacaagaggctctggcgtctgagcggtgggttagtgcagacaggcaggtcaatcattcgggtctccacccccttcttctcagtagcagatgtttggagggtctgagtggttatagtaaggggctctctccacttttcatcaataacacagccccagtgtagatggggtcagagtggtctctgttgaatacatgggtaaaagacaaattagtgataattgtagtgaattcttatcattttatgacaatatttattcagaatggcatccattctgaataaaagtgggactttctggtacagaagcagggctcagtcattcttgacagtttctagctcctcacctcctcccagttgcccagggtggtccacccagatctctgctttatacacctgccagctggtgaccagctccctatgggacacctggatacaacctactggactcagcccctggcccccacacccctcacggactgtgcagacgtgccacagtgaccaccacccagtcacagcaagatgccatgaagctgatgcctgccggctcgaaatcacaccccacaggaaatgcacttgagtaacaacaccctggacctgaatacagatttggtgcacaggccgctggctcgctccccaccatctggctgggcctgcctgttccccgtggctccccctccccactggcctgtgaggaacgctgcctcctcgctcccgcccggttgagtcacacacctgctctgcagtttcatgtgttctgctgtgctgcctcctccagctctcacctgacccttgcacccaaacctcactctcctggtcaggactctcccagagagaccatcatgataggaatgaactgatcactgctcagacaaaagccacaggctgcctgccaaagcctagaagcaagctgctggtgagaggaatgccagcacagctggatacacaggcctgaggccatcagccagggtcaggaggcatcccacgagagcacacactgtaaccccatgcccaccgcccccagagccccatcagggaagggccaaagtttacagccactctccaggagagacctcaagacgaattagaggaaaactatgacaatgattttgtttaatgataattttcctttttcctagcactctggaaagctgccagtttctttacaagttaaccatcaatctgatgcagggcaggtgagccccaaaattggggcttaaccctggagggttcatggcttcacccaggaaggcattcaagggtgagccagtggtgttagccaggcaagtttgttaaagcagcagaatcctacccagcaacctctgaggaaccggcatgtggcctgggggacagccccactccataagctgcccgatgttctgtatctgtccacgatggtgatgagaccctaggagagttgcaagtctgaacacagggaaatctttagaaatccccacgatccataagattgaaaacaatcctcctctctgagaacttcatctatttctgggataaaccaaatctgtgtttagtcacacgtgactccaactgagtaactttcaagtcatttccctaaggcagaaaaaattctccattatgccagcaaagtggcaaggaagagccaagaatgcttgatcccatccccaccacagggaaccctgcacggcaggaggagaaaggacatctaagctggagactggtaaggtttcagccacccatggctaggaaagcatacactgcctctgagggggcgtgggcagctgcaacacgggagtcacgtgggaggggtttgcgggactccaggcatcacctcttcacaccggaggcaacaccgatggagtcgtgagaacatagtccaggtgtgtccagaattggtgggttcttgatctcactgactttaagaatgaagcactaggtcctcacagttgactgttacagttcttaaaattgttatgtctgcagtttgttccttctgatgtttggacgtgtttggagtttgttccttctggcagactcacggtcttgctggcttcaggagtggagctgcagaccttcacaaggagtgttacagctcttaaggcagtgtgtctggagctgttcattcctcccggtgggtttgtggctttgctggcctcagaagtgaagctacacaccttcccagtgagtgttacagctcataaaaagtgtggacccaaagagtgaaagagcaaagccccaaacatgtggcagaacaccaacacgttcccactgcctgctcgggcggcctgcttttattcccttatctggccccacccatatcctgctgattggtccattttacagagggctggtctgttttacagaaagctgattggtccgtcttgacagggcgctgattggtgtgtttacaatccctgagctagacacagaagttctccaagtccccacagagcactgattggtgcatttacaaaccttgagctagatacagggtgctgattggtgtctttacaaaccttgagctagacacagagtgctgattggtgtatttacagtcccttagctagacataaaggttctccaagtccccaccagattagctagatacagagtgctgattggtacatttacaaaccttgagctaaacacagagtgctgactggtgcgtccacaatcccacagctagacataaaggttctccaaatccccaccagattagctggatacagagtgcccatgggtgcatctacaaaccttgagctagacacagggtaccgattggtgagtttacaaaccttgagctaaacacagtgctgattggtgtatttacaatcccttagcttgacataaaggttctccaagtcgccgctagactcaggagcccagctggcttcacctagtggatcccacaccggggctgcaggtggagctgcccgccagtcccgcgccgtgcgcccgcactcctcagcccttgggcggtcgatgggaccgggtgccgcggagcagggggccgcgcaagagcccacggcaggggggagactcaggcatggcgggctgcaggtcctgagccctgcctcgcggggaggcagctgaggcccggtgagaattcgagcgcagcgccggcgggccggcactggtgggggacccggcgcatcctccgcagctgctggcccgggtgctaagctcctcactgcctggggccggtggctccgattgcggggcccgccgagcccacgcccacccggaactcacgctgacccgcaagcgccacgtgcagcccgggttcccgcccgcacctctccctccacacctccctgcaagctgagggagccggctccggccgcggccagcccagagaggggctcccacagtgcagcggcgggctgaagggcccctcgagcgcggccagagtgggcgccgagagcgagcgagggctgccagcacgctgtcatctctcacagggcgaagcccacgccacaggacgggtcggttctgtacccgccggggcaggggagagccgcctctggtgagcagaaccccggagaagggacgacgcgggtgcacctcgcggcatggggacaccaagtcagacgaacccgctgtgcaagaacattttccacacagcggcgcatacccccgcccgggggcgctcggcagccgcacgcggccctcagagcgcagcccccacacgcctttacttctggaaggcggagaccgccacagtgaggagctaagccagctgaggcaacacagaaaaacccccgttcctacccaaaaccaaaaagcggggcgcggaggcgcgcgcctgcggtcccagctaccggggaggccgagaagggaggatcgcctgagcccgggaggcgcaagctacagtgagccgagactgccactgcactcagtctgggtgacagagcgagaccctgtctctaaaggggaaaaaagagctaggaagaagcgggctgcctcttaacttcggagaagtaaatgaggaactataaccagtgtctaccgtttaggaaccaaacaaaagctgacaggaatcccgccaccgacccagccgccccagactttgccctggcctatcccgcgccgctcctcaaactagacccgccccgacgtcgccctggcctatcccacgccgatcctcaaacgaggcccgcccccgatgcacaagctccgccctcgttgcaccgtcctgaccctcggcctcgcccccgccccctggctcttcccgcgcagccgaatgccgcgacctggctcccacccttcgtcgcttcgcgccgcataggaaccccgcccctagtctctcctcccgcctatcctgagcggcgcgcgcacaaatctctcccacggacccgcccaccctgatcctcaacctggcccctggcctttcccgcggcgtcgagtccagtacaccgacgcacgagtcccacccccgatctctccctcggcctatcccgcgccgctccgcgcaggagtcccgcctcccacttcgcccgcagcctatgacgcgccgcgtcgctccctctcctcaaacccgctctcgcccgcggatgggcgcgcagctgtgacgtcacggcgtcgttggtaaggggctggcggccggggagctgcgtagctcccggccccgcggccatgcccaagcggagctgccccttcgcggacgtggccccgctacagctcaaggtccgcgtgagccagagggagttgagccgcggcgtgtgcgccgagcgctactcgcaggaggtcttcggtgagtgtcgggcgggctgccgagggtccgctgcgtcggggcctggaacgggccgggcctcagcgtcccctctgaggcctgagcggggggctggagggccctgctttctggccccgcgttcccggaagctgggaggccgcggggacacaagctggccacgcccagggctggggtcagtgagggggatgtgaggaccccagcgttcgcccaccctgtccaacagcctgaaagaaaagggtccctgcccctagcccccgcgccctcttccacgatcccggttagtcgccgccctgcagtgagcggcacccgcctggtgctttctcaggactgtcccgtgcaggatgtcctgggagaggttggggagcggggcgtcctgcatggagtcaacccgaagagtgcccctcctgtcccaagaggtattcatggagcgcgcggccctgccaggcacggcggctttctcgggagaccaaaggcaggcaagacagatgtgccccgtctcccgggagctccccagcctagttggggagaccagcaggaggagtcgccacaggtggtcggggcaggcacaggtttgtgcaggcgcacctgcagggatggcacggaaggcttcttggaagaacagtctgagcggaatcctgtgggggcgagtaggagttagccaggcagaggaagggaaggaagagggcgaggcagaagccaggcagcaggagagcgaaataggactccgtgtggctgcagtgtccagttctgggtgggatgtgagggcagtgagctcccaggccttctctggctttctcctgtggatttcaggcgtgttgatcttattgatcatcactctgactggggtgattaataccctggggcaggtaaaaagtggagcttaccttgcctagtgattgggacacaaagtctgcacctgtagagcagttagaggatgacccggggtgtgtgatttacctggtgccgcttgtgccttgggaatgagggaaagactctgcctcccgaggttcctctgtgcggtgtctccagtgtgctagggctgtgaaagcgagtgctattctgggccatggggaggtaaggggaatgatgccgtgggaactgtggcaggaccgcaatcgtgtgccctctcaggacagttgaaaaattcaaacactgtgcaggcaagaagaggaagatggaaatggggcctggctcagtatggccctttattcttcccgagtgtcctgacctgggcgttggcaggtgtgtgccactcaccgggtcaggtcagggaggtctgctgggtgcagtgggccttccatggtaaatgcaggacacctactttgaactgtgtgacagtttccaaattccaggccacagctgttaccctgatctcttaacctcgaattgtccacaaggccttgaggacaaggattagcctcaccacgtgtctgtcccattcctttccccttatagatgggggaaggtgtggggggccaggaggaaggtgcagggtgttgtgggctggcatcagctactccatgtgagttaccctgtcactattattgctgcccacttcatgtagagccacatagagtttctgggatctctgcctttactgtgttatggtgaggtgcaaaacaaaaaacaaagcatttctgggtctggccctgggcatctgatttttcaaagctccccaggtgactgaactgtggcctgatggaaaaccactgctcccagggatgggtgggtgttctagaacaagaggtctggaaggttctgggatgcttgtcttgccagcaactctgtagcaggtgaagggggtgtgctctggccagaggctgtaggcccagctccaagcctctggctgcttccttggcaggggacgagttttgtgaattagtgctccacagtgcagagctccctctgtgcattccacagagcctggtttccaggtggggagtgctggggaagcagaaaagggagaaaggggacaagcttagtgaggcgaggccagccgtgaattgcagaaaatgagccgagtgataggagagggaacccttgcatcagacacaggtggggctgcagggccagagccttcctggaggagatgacagctaagccaggtaaggaaaggacgcacaagcattctcagcatagaggcagagcaggacccagctcgccagggcacaacacaggctggggttactgggagacagagggcacacaggaggacgatggggttcatgtgaggctagaaagactcaatggccatgcaggggcttcgttggtacacagtgaaggacgtgagaatgatttatcttcccccagagaagaccaagcgactcctgttcctcggggcccaggcctacctggaccacgtgtgggatgaaggctgtgccgtcgttcacctgccagagtccccaaagcctggccctacaggggccccgagggctgcacgtgggcagatgctgattggaccagacggccgcctgatcaggagccttgggcaggcctccgaagctggtgagtggcaccagcagccctttgtggctgtggcactgagggcaggtggtggcacgagcatttttcttgatttgcaaggtcaggcttttcctccctgggtaagcaggactctgacccagagcttggccttctggctcagaaggctcctgttatcaggaggtctcacattcaagactggaagttgttaaacagcttctaagtactgggccaaaaaagcagcagagactccccgggtatcccgtctgctttccgcctgcagccccctcagatagtcccacaaggctggaaacatgccagtcccatccctatgcagtgtggggtctcagagcatcacctgtgttgctggttagaaatgcaatccccgactctacctcaagtctggttggtgtgtctaggaggagcccaggcacctctttgttaaccagtaaggcagtgggccacactgagacccagatgggacacatggagttctgacaagcaacaggggaagaatggtccttccagcactagcctccaggtagcagagggacctggtaagggaaagagcactgaacttggagtcaactacaggcatatctcaccttggatctctgtagtaaaacgggggtcctgtgcactgtaccaggctcacgggttgtcagaaggatccagtgtaggtggggatggggtaggcaggtcagagccctctgccctcaggtatgcatggaggcaggtagcccggcagtcccggaaactccagtctccttgcagcctgacggcttggcgtttcttcctcacagacccatctggggtagcgtccattgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggagtaagtacttcagtccctggagctgctgagatcccatagccccagcaagccgtgatgggggacgggtgggtcacccatgtgggcccagaacacacacgtgtggcccctgatgcagtgccatctggcattgcctaacgggacatggtggcaatagatgcttggcccaactttagtggttagtaatcctctctaagggaaagctgaacctcacagatgacctgctctgtatccggctctagtccctgtcttcagccacttcctgttctgatctttgagcacccccacctcctcctcctctggtctttgagccccccctccccccgtccgaggagcccctggttggtgacacaggtgcacaccgcagcttcaccacagtcatgcgtgccgtttggttgtagaccctctcaggcaggaagtggagtgtttgtgtagtctcccatttgtgggtgggtttgctgcagctggctggatcccgtccttactcctaaggtggggaggggcgttctcaccctaggggctactcacctggtggatgggagtggacagtgtggagcctgtttgccctgccccgtgagaaagatgacttcatccagacacatgtggaactggctccatagacccaaagcaagcttagtccaaacaatgtctgaaattgtccatctaaaatagaaaccacatgttacatctcgagtcctttctctcgagcctttcttcagtcggggcagaggcccagactcattggagacggagagccctgggcagggggggcagcaccagggagaagcgccgcgtgccagtgatcggctcccatggcttcagcatgggcaggagtggggtaacgcaccccatccaggttgggaatcatctgcagggctagctatgaatgtgggatactctgtctttgcttttcacccgctgagttcatcttctttcctagaagtaaactgaaaagggcagggttttctcattgtctggtggccctctcaccaaagcagaagtgaacatagccatgggcaggttcagcggagaggtgggtcccagagcgctgcgtggctggcctcccactcctgccctgcacaccatccttgagggactcccttgcgcccatttcctcctggcctctacctactttctgctgctgcttcctcccatacccacagagttcacgttgagctgagtgggccactgtccccactgtggacacactcttttatcgcagctacagcacaggaggtgggctctgccctctttcacaaataaatgacttgttccaggtcacaagccagaagtggcattcccaggccaggcagcccagctggtggcacccgcagtctcctaccccctcccctgccatttcctacttcaggaccaggcgtcgcaggagtgggggaaaacagggatctgtccacacggctctggtttaacacagatgcagcccagcagcctttggcgtcctgctgatggcctgcactggcccacgcctggcccgtcctctgcagggctctccagctggctgccggtggcggtgaggggctgtcttcgcggctcacccacaatactactggcaaactctgcaaaccaagtggcaagcagttctggctgccttgttgactccacggccctgtcgtgtttggggtagccattgccagtcccgtttcctcgcaacatctctcttaatcactttctccctgtgttttgccgggttccctagcctttacctttagagctttcttttttttttttttttgagacggagtctcgctctgtcacccaggctggagtgcagtggtgcgatcttggctcactgcaacttccacctcctgtgttcaagcaattttcctgtctcagcctcccaagtagctggagttacaggcgtgcgctagcacgcccagctaatttttgtattcttagtagagacagagtttcaccatgttggccaggctggtctcgaactcctgacctcaggtgatcctccggcctcagcctcccaaagtgctgaggtaagccacaccatacgcgtgagccaccatgcccggccctacccttagtcttgatatatcagaaaagcactgtttgatgtgcttcagtgtaaaccattgtggttcggtgaattctggcaggtcatctggaggtttctttggagagcttctatcctactggaaacccaggttgggccccatgtggattgatcggcagtgggaatcagctagggctgctgtaactgagttcgcagacccagtggcatagacagcaaagaggtactgccacgtggctttggagaccagaagtctgagaggaaggtgctggcagggctggttccttctgaggctgcaatggaaaacctgtcctggcctctctcctggcatctgctggttatctttggtgttccctgtagacagctgccccctccctgtatcttcatgtcgtcttccttctctgtgtccttctcttcacgtagtctttttaggacgctggtcgtgttgccttagggcccccatgtcagtgccgtcatctagactgatgatgcccgcagtgatcctgtctccagataaggtcatgtcctgaggtgttctgggttaggactttgacgtttgaatggtggggggtggtggacacaattcagcccctgacagcagcttttctctcccctccctgacgctgtcgcagctgcagtgacatgtacgagaaagtgctgtgcaccagctgtgccatgttcgagacctgaggctggctcaagccggctgccttcaccgggagccacgccgtgcatggcagccttccctggacgagcgctcggtgttcacactgaactgtggggtcgacgggaggggtgccttttacatgttctattttgtatcctaatgacagaatgaataaacctctttatatttgcacaagaggactcttgtctgtcagcacttctgagggtggagtttgtgaccctccacctgggagggccaaaggagcagtcagtgggcggggcctgctgcacctgctgtctacccgccagctcctagagaccccactgtgcattgtgtgaggccccttactcgccccctgctacaggtgggaaggctcagcccagagcacgctcctccccagctcgcccagctggtaaatggggagaaaggacccaggtctggctccagggtacacaaccagtgtactagaccttcacggagagaggtgatactcgcgccccatccccagacgccactgtcatgcacgcctgatccatcacatcttggtgtccactttacttttttggtgcctgtatggtcaggccccgtgtgattgataggcccctgccctccaggagctttgctctagcaggggagatgggcccagctgtgctccctctggagtcggtgtagcttgtgtggggccttgaaggaagaggagttgacaggagaggaggcggggtggcctggaggacagaagagggcaggctgcttgagtgctggtccccacacaagtcgactgaggcgggtcccagcccctccagggatgagtgagcagttgagccacagcccctctgagaagctctggactagagtaaaggttgtttggggcagagggtgggtgggagcatgtgctggggacagttgagaagagcctttgctgttcctgggaagctgttagaagagcaaattatgctgattcttagagaaaagtcagtggtgcccaagtggtgggttggagccaggcccagagtgggatttgctgccctggggccgaggatataccactcccgtgtcacgggtagagggggcgctcagagaggtggtcagcatggtaaaattccagggggcaacttagaaggggattgcagaggactggctgggggcttcctgcaatgaggacggccttgaccgcctgctgcgagcatcgggagcaagtggccacggtcagccacgtgctgactccttccaggtttccacaacagactgccacccaagccctcatttctgttactcctgtcgctgccccctcgggcctgtcggctcttcccttcacatcctctggccacatccctgccccacaggaccacactactccagccagcctgcctccttcccctatagggtcactacatagcgccttccaggctccctgcttctgccctgcacctggcagtctgtccttatacagcagccagatctgtcactcccctgtcccaacactccagtggctaaacatgtccttaaaagtaaaagtctgtggccccacagcctctggcttcacccctcctcccctatcccaaggcttgctctgccccagccaggccttcctgctgttctgagaatgctcagcatgtttcccctgcacccccctcgctccttctgcctggggagctcttcctctggacatccatagggctcccccggattcagctcagagaagcatcccagtgccctaatgtgtaggacaacccctccatcacgctccctctcgccctacctaactttaccactggacgtaatgcatatttaagtaaatatgcaaatgtacttattctaactctactaactgaggtgtcgcttccgtgaggggtgggactttgcctagagcagtacctggcatatatgtttgcagtaaatattgttggtcttccagctgtggtggagcaacaaaaactggcccatagatgactatatagagagagagacatcggacagcagccattgcaggatagtaacgcctgagagagggaacaaacaccaagagcccagggcagctgcaacactggagtagaaattgcctcagtgttcccctaaggctcctgctgaggactgatggctcctgtgtgtgaggaaactgcctgaggctggggaaagagccattggaagaaagcgggaagcaagtcacattcccagcactaagtgtggggaaacatcattcatggagaacagggtagaggactcaaaaggatattgatgccatattcaggctagattagccctagactagagactgctctgtgccttcctaacacctttaagtcaagcctcaaaaagaccaaacggttgcaagtgctttaatagcatccagaacaaaactcaaaagtaagggggaaaacatatttatttacttattttttttagaacaaacgaggccgggtgtcagaggctcacgcctgtaatccaagcactgtgggaggtcaaggcgggtggatcacttgaggctaggagtttgagaacagcctggccaacatggtgaaaccccgtctctaaaaatacaaaaataagccaggcacggtggcatgtgcctgtaatcccagctactcggaaggccgaggcaggagaatcacttgaacccaggaggtggaggtaagtaagccaagatctcaatctcaccactgcactctagcctgggcgacagagtgagactccgtctcaaaaaaagaaaaaaaacaatcaaacatgcaaagaagcaggaactataccacacaatgagaagaaaagttagtctgtagaaacagacccagaaatgacacaaggtggtagaataattccgtctactaagtagacagggacatcagaatggccattattaagaaggatagacgaaaacaggagcatgttaagaaaaggaatgaaagacataaaaatggcccaaacaatttccagagacaaaaatacaatgtctgagatggaaaatacactgatgagattaaaaccaaaatagacattgcagagcaaaaaattagtggacttgaagccattgcaatataagctatccaaaagggaacagaaaaaaaatgaggaaaatggcagagcccctctgagttgtgggaccacttcaagcagcctactgtgcctttaactggagacccatggacgaggggcatagcagggtggagacaacttttggaaaaaataacggcaggccgggcgtggtggctcacgcctgtaatctcaacactttgggaagctgatgctggcggatcaccagaggtcaggagtttgagaccagcctggccaacatggtgaaaccctgtctctactaaaaatgcaaaaattagccaggcgtggtggcaggtgcttataatcccagctacttgggaggctgaggcaggagaatcgcttgaacccgggaggcggaggttgcagcaagctgagattgtgccattgcactccagcctgggcaacaagagcgaaactccatctctaaataaataaataaataaaataatgactgtaaaatttcctaatttggtggaaacataaagccacagatccaggaagctcaacaaaccccaaaagaaacatggagaaaattacatgaagcacatcatcatgaaattcctccaaaccagtgacaaataaaaaaaagcagccagagaaaaaagacactttgtgtttacaggaacaaagaatggcagcaagacttctcactagaaactgcaagcagacagtgaacaacacctgtgggttgggcaaagaacttgaataaacttatttatttatttttttgagatggagtttcgctcttgttgcccaggctggagtgcggtggcacgatctcgcctcaccacaacctccgcctccctggttcaagcaattcgcctgcctcggcctcccaaatagctgggatttcaggcatgcgcctccatgcctgcctaattttgtatttttagtggagacggggtttctctatgtcggttaggctggtctcaaactcccaacctcaggtgatctgcctacctcagcctcccaaagtgctgggatttgtaatcccaagcccagcttgaataaacatttatccaaatttagttttgaaagaaaagaatgtcaacctggaattctatacccagtgaaaatatctttcaaaagtgaaggtgaaataaagacttttcagacatacaaagctggaagatttacaaaaattgtcaaaagaagtttttctggcagaaggaaaatgacaccagatggaaactgcttgtacacaaagatatgacgagcacctgaaatggtcactgtttgggaggacacaaaaggcagggttttttctgatttttaaaagtgcctgttgtcccagctactcaggagattaagctgggagaatcacttgataggggttcaaagccagcctgggcaacatggcaagaccctgtctttattttattttatttattatttttttttttgacagtgtcttgctctgtcacccaggttggagtgcagtggcctgatctcggctcactgcaagctctgcctcccgggttcatgccattctcctgcctcagcctcctgagtagctgggactacaggtgcccgccaccacgctcggtgaattttttgtatttttagtagagacgaggtttcaccgtgttagccaggatggtctcaatctcctgacctcgtgatctgcccacctcggcctcccaaagtgctgggattacaggcatgagccactgcgcccagctgaccctgtctttaaatatgtatatatataatctctttaaaagacaattgcctaggccagctgcagtggttcacacctgtaattccaacactttgggaggctgaggcaggcgaatcacctgaggtcaggagttcaaggtttggccaacatggcaaaaacccatctctactaaaaatacaaaaattagccaggtgtggtggcggcgcacgcctgtaatcccagctattgaggaggctgaggcaggagaatcccttgaacccaggaggcagaggttgcagtgacccgagatcgcgccattgcactccagcctgggcaacagagcaagactatcttaattttaaaaaaggccaggcgtggtggctcatgcctgtaatcccagcactttgggaggctgatgctggcagatcacctgaggtcaggagttcgagaccagcctgaccaacatggtaaaaccctgtctgtactaaaaatacaaaaaaaaaaaaattagctgggcatggtggtgggcgcctgtaatcccagctactcaggaggctgaggcaggagaatcgcttgaacctcggaggcagaggttgcagtgagcctagatcgcgccattgcactccagcctgggtgacagagcgagactctgtctcaaagaaaaaaaaaaattttttttaattgtctatacagatgctcctcagcttacaatgggttacatccagataaatccatcacgagttgaaaatattgttaagggccaggcgcagtggctcatgcctgtaatcccagcactttgggaggccgaggcgggtggatcacgaggtcaggagatagagaccatcctggctaacacagtgaaaccccgtgtctactaaaaatacaaaaaattagccgggcgtgttggcaggctcctgtagtcccagctactcgggaggctgaggcaggagaatggcatgaacccaggaggcagagcttgcagtgagccgagatcgcgccactgcactccagcctgggtgacagagcgagactccgtctcaaaaaaaaaaaaaaaaaaaaaaaagaaaatattgttaaggagcatactgaatgtgtatagcttttgcaacattgtaaagttgaaaaattataagtttaaccattgtaagtcagggaccatctatacataaagaactcctaacacgcagcaattaaaaaaaaaatccaaaaatgggcaaaggacttgagtaaacatttgtccaaagaatatataaaaacagcacacacatgaaaagatgctcaacatcactgattatcagggaaatgcaaatcaaaaccacaatgagataccacctcacacccatcaagatagctactatttgaaaataaaacaagtgtcggggaggatatggagaaattggaacatttgtgcactgccggtgggaatgtgaaatggtgcagccagtgcagaaaacagtaggcagttcctcaaaacactaaacataagcctggcacagtggctaatgcctgtaatcctagtggtttggaaggctgagacaggaggatcacttgagcccaggagtttgagaccagcctgggcaacatagtgagactatgtctcaaaaaaatgaaaggaaaattaaaactgaacacagaattactgtttgatccagcaattccacttctgggtacagacacaaaataattgacagcagggacgtgaacaggtatttgtacacaagtttgtagcagcattatccccagtagccaaaagatggaaacaacccaaatgttcatcacaggacaaatgaataaacaaaatgtggtctatacatgcaataaaatagtattcagccttaaaaagaaataaaattctgacatgctacaacacaaatgaaccttaaagatactatgactgagtgaaataagccagacacaaaaagacaaacactgcatgatctcacgtatatgaaatccccagagggctggggagctacattcattcatttattcaaaatatatttattctaaatgcaacacagtatcctggattgtatgtgtatactggaatagaaaaagaacatcagtgggaaaactggtaaaatccaaaaaataagccaataaaggagataaaatgagacaatcggcaatacttatttaatacaaaaaaaggaaaggaaaggaggaacaaagaacaaatggaatgtatagaaaaagagcaagatagtacatttaagctcaaccatatcaatagttgcattaaatgtaaatggtctagacaccttaattaatgggcaatgattgttagacttttttttttaaataacaacaaaaaccctacatgctgtcagccccttctgtagctctttcccagacttgctagaagcaaaaggatgaaataattatctgttgtatgataaagtcagcctttgaacagacattcactggaagtgacatcttctgggaaggcaggcctagcccttatcctgacatgccccagtagcactctcagctcctgggacctcgtctacaacattgaggcccccagacccagagacctgcagagccttcagttacccacacctgctgaaacatgggaggtctaagtgctcaagtcacttttattatcttcctcccttccaggccggccttgtgctggaaagagcatgatgtgggcatgtgagaaacaaactcacccatccacacccgaagaatggactcagagacctcagagaccggagaacagcaaaagtgagacttttaatgatagtcttgcaagattgggtgcctgatgagctggcacacccagcacagtttcaacaagcaatttatcccctagtgtgcaggtccctcccccggttcttcataggctgagtactatggggtcacaaccttcctggacgtcacctattggttgttgggcaggggctttaggtgttttctttagagttgtcttgctgcattctgttgcagcccacaatgcattgcaatcctagttagctcaggggctcttcaaatatttgacttctgacctaagtagctgggcaggctgatacgaacagacaaagcgagctattttggaggctagtaaactttcattttagactaaactttggttcaggtgagggaaactaagggacgggggctggcggtgacaaacaggcgttggctatccaagcaggggcctagtatatcctgttgcttccgtagtttgctgacctaagctgattttaggcactttgtcttggaaatggacactttatgcattgtttccttcggggtacctctgacacaggaaggagagcttcctcttggttggcgtattcctgttacaacctctccagacagccctcgctgttcggcaggccctgttggggctgcaggatcctggccctctccacccgctctggcctcgctggccaggactggactgccccttgcaagggcacctgcacctcctggagtttcctctctgagatgtgcatctccttgcacatctcacccctcactgacaccctccaccccactcctgggatgctgcctcctgctgtagatggttctgtctggggctgctaggagggtcgggaaattctcagagggtctccatttctgcgttcattttgttaggtcctcagccacttgtaacggggacataacacagggtcatgtctgtattaatgccaatgacgttgaagcctctctctctctggactatagaactatccctaagaggccaggtgtggtggctcacaccttataatcccaacgttttgggaggacaaggcaggaggatcacttgaggcccggagttcaagaccggcctgaacaacatagcgagaccctatctctaccataaaaaaggtaagaaatggccctaaggcaatcctatattgtcagagggggccgtgctgggagaagcagcccatgcttctcagccgggctgtctgggagatgctgcgtctgcctgaccatttccataccttggttactttcagcaatgctttgctcaaagtttgtggatattggaagggcattgctgtattttttggtttctaagagtcacattattgatagatctgaaatccagatgcctctcaccctcggaacatcatttactgtgtcatgtttcgtgtatttcccgaaaagcggtatcagttttgcggcctgttagaactgaagcaataagggatcacccagaggagagcttcgggctgctccagatgtggctgttcttggctcccacagacccagaacatcctcgccagcctgtgctccctatggggcaccccctccagtggaagtgagggcagccacgcacccctgggaatgccttagagaggggccaattgccatcgccaggggcctgactctgcaaccatccacacctacggggagtccatttgagagatgaggaagctgaagctccaggcccctggctcgtgctggtcacccaaccacccggaacctggtcgccaacccgctgtcagttgctcggcagtggactcctctcctggctcagggcgcggttccggcaggcgtccaccaggtggcagcaccggcacattctgcaggctgttccggctcagagctcgatgtagtgctctggggtaacctgggccccagcctgtcccctcccgccccctgcagcccctcctcccaccgcctgcagcccctcctcccgctctgtccagcttcgaacaggccactcaggcctcccagccttacttccaccgtggcccaggccatgaccttggccccaactctgggccctgccctatctgtccttcctggtggtctgtctcattcactgccctacccaggggaacagcacctggggctggggggcagatggccacgtggtccaatggtctccttcatggctggggtgaagctgggtggggtcaagggaagaagaggtggatcccaacgggggcagggccagccagggcctcccatctcccctcaggccaggcctctggagatgggggtggaacaccttccatgggaggctgcccctgggaacaggcctgtatactcccgcctcggcccaccacacagcctgtccccaaacctgttggggtggcggtgcccaccaggaggagctggggaggaccagctgctctgaggatgctgcttccctcccaggactccccactccctccctggccacccactcttccacccagcaaagtgagccaaaaatttgaaaagcaacttttattgaagaatttggagggaaggttccatattatattataatagtaaaaatactaaagttgaatgttgtaaaaaaacgccgtggtgcagcggcagcggcagcgtctggccaggaggcgtggaggggcccagggatggccacccccacagggagtcagggagggcctggggcgacagcggaaaggttaagcgtcgaaaaggtcaagtgctaccgtggagagatcatctgagggggaggctcccggtgggacagtcaccaagaactgtgacacagaaggggaagggggagggctttcctgtcacaaagattaaaaacccccaaaatgcatttgaacaacataatacacaataacaaatttaaaccttgctcctctgtcccactgggtaaaccctggcccatcccccatccctggtcccatcccaggggcccagcctccgatgacgtcctcagagacacggccttagtgctggggggctgctgtgtgcctgccacccccaggagagggtgctggccagcataccatagtgaggttgcatctggtgccaccaggttgaactgaggcccagggccccagagagatgacagatagctggtgacagacagcccagggcggctggctgacagagtgaggggacacatgggcaggacctgcccggccccccaatgccacattgcgcatagctgcagaagtccttaacatttccctacgtgaatcggattgttctgagggctgaggccacacccggagaacaaactggatgaaataaattaaaacccgcaggatagttttcttccctaccccgctgcgggggagggtgctgcccacagcacaaaaacgtctttccatctgggctcgagaggacagcgtggcttctctcaaatgcacccgagaaataaaaaccattaaatacagatcatggcacgaggccgcctctccatccctccaagctatcgtccagcgcagtccaccgccgcctcaggccgtgccgctggccgagtaggagaactgggggaagtggggcctgcgctcgctgtccacacactccatgctgtcatctgtgggtgtagacagctcagaccccggtgccccacctccctgccacctccacccacccacagctccagtaggaagccaacctcttaaagcacggccagcacgctgccatactgccaggaaactgagacagggccccacagattgacacagggacctgggccctcagagcactgcctcccaccctgatcattggcactctccaaaaggaacctttttaaatatttagattttaaaacatctgaagccaaaaaagctgaacactgcaggcctctctgagtgtggagagaaaagggagtgggcgggggcaggcagtggcccctcaccttggtcaggtggtgtgatggtgatcatctgggccgtgaactcctcatcaaaatacctggtgtcagtctccgacgtgacctggggcttgaagggtgggctgagctgcagaggtgggcagacgggacagtcatgagcttcgctccccactcccagcacaccctcaagtgtgctcaagaccttcaaagcacctggatctccaaggggtctccaggcaggactgatgtcagagagcagcaagccaccagccccccacagaggcagctctgggagggagggacatgaggggtgcaggagcacggagacaaccctcaacagctgagacgcaaagctgccctcacagcagccccagcaggcgacaggaggtagtgcagcccagctctgagagaccctccctgctaccaggaggtgataactttatttttcctttttctttcttgttttcttatttttcttattggtcttcttgtaaattgggaaagagggagactgtggaacaaggtgcacaggatgagcccaccctgcctccatggctcagggactacaggaccacagcctgctggcatctggctgcagacaggactctcaatgacccaggatgaagggtgactataaggtgatgtgcacacgtgaggagctgccagagagcccctcaggtcccacagtcaaggaccccctcaagcactgccccaccccagagtctgggctgggcaccagcattgtccattgtcaattagcaaggtctctggtcaaggctgggcagaggttgagcactgcccaggccccccatacccttggagggcagggcaggagggtggcaggcctcaaggcaggaacggggaccaggaccagggcaccctgtgttaatgggagaacaggtgcccagctgggtcccagggctgcccagcccgaccagctgcacacagcctaggacaggcattcaggggaggggcaggctgggaacggggcagaagcacacctggtgacagggcacccagcatctcagagtgcaggcttccgaacccagctggcagaccccatcagctggggtgatggccagggctcctagggtccctgaaagatgagcacccaggatggcgactcatgcagaaagagctgcctccctccagggcggactcccccatgtgccagaaaagtaggtgctgtccctgtccctgcacagccagaaatagggctgggctctccttgcggcagaagggattgaggtcaaacaggaggaactcgtggaggccaaggggcagcacccctggtccaccaccagccagccttcactgcacagcgtcagggaagggaaccccaaggctggcactcagagtgtgacacacctccgaggggaggaggaaactcagagtgtgacacacctccgaggggaggaggaaatgaggaccaggccagtttcctggtggaacccggcagtgccagagcctctgagcaccaggcgctgaggttggtgcagcaaggccctccttgtaccaggactgcagcaggctcctgaggtgagggcgagtgtgtgggaaatctggcgagcgtgccacgtgcatgcgtgagtgtggatatgtggggagcatgcgtgcgcgtgaatatgcggggagcagccgcaccttcttctcgtacacgtgctgccacacgataccggcaaagaagcgatgctgcatgatctccttggcgtcctcggagcccccgccaagcctgcaggcaggaaacaaggccacagtgtcggtaccgccacctgcccaggccctgggttcaggccccttcctcctgtgatgtagggcccgccagacaggacgttccggggccagggaggggagccggtggtgcagcgtccctgagcagctgtgggtagcaaagcaccacagagctcacggcagggcaggggcttcctgagtgggtgggtgcaggctgcagggttggggacagaggcccaactgaccccggcctgcccgccactctgcttgggcctgaggctttggagatcagccctggccaaggacatcaagctttggctatcagtgtagtctgggaggtgccaggaccgcctggcgcaggggcaggtgcagcctggggatgaggggatggaggtgtagcctgtagctgggatgggcggccctcacctctgcttggggtccttcttgagcagccctgaaagcaaggacttggcctcgggaccaagcgtgcgcgggaagcggatctcctccatgaggatgagctcaaaaagcttctcatggtcctggttgtagaagggcaggcgaccgcacatcatctcgtacatgaccacgcccagcccccaccagtccactgcacggccgtagtcattgtcctccagcacctgcacgggtggcagatgggcaggactcggcatcaaggggtgtccgggacactgccgggggaggtgtgacgtgcttggggcacagagaggacacagcattgcgtgtgctcaggacgtggggacgcagcaacgcgtatgcacgcaggtggggcgcacacctcgggggccaggtactcaggtgtgccgcaaaaggtcttcatggtggcaccgtccttgatcccctccttgcacagcccgaagtctgtgatcttaatgtgcccgtccttgtccagcatgaggttctccagctaggggaaaggtggcctcaggtcagtgccgccaggcccccagggccctgcccccctgcctgcccgccagcgcaccttgaggtcccggtacaccacgttcttctccgagtgcaggtagtccagggctgacacaatctcagcgccatagaagcgggcccggtcctcggagaacacacgctcccgggacaggtggaagaacagctgcgggaggcgcaacctgaggcacagccgtggctcgggcctctgcccccatggcctgcagggctggggtttctcagaccgggtctcggcattgcacagggaagggaccagccaccagagggcacgggggcctggaaagtctcagaagccctaactcagcaggaacaagtcaccccacagcaggcagctgcctgggcaggcatcacaccacccacccagcagggagcaccgtctggtgccatggagagtagccgaggctccgggaaggaccggccccaccatgggcggcccacaggccgcgaagtccatcccccgcagccccagcccctacctcgcccccgttggcgtactccatgacaaagcagaggcggtcgtgggtctggaaagagtacttcagggcctgcaaggaaggggagctggaactgcggccccacaggcaggacggcagccccgcaccacgctgcccgacaccacgctgcttgataccacgtcgcctgataccacaccgcccgtagccccacaccacactgcccgacaccacgctgcctgataccacaccgcccgataccacactgccccacaccacacaccccatcacactgccccacaccatacacccccacatcacactgcccccatgccacgctgccccacaccacactgccccacaccacactgcctcatgccacgccaccatcaggctgggccccggcagcccctgaggtgccaaggagtgtttgaaaggtgagcaaggtggcctgggctcaggtcctccagggtgagttgggacctcagcaggggacagtgctcccagcaccagggccttcgcaaagggaggacacaccctcccaggcgagacccaccctcccgccttccaccacaggcgactgtgcttttaaagcaaaggccccatctgcaggagaatcgtccccaaacacagtgacctggaactaaccaagtggctggaccctggcccccttcacagtaaatacctcctgggccaagtccccagaacaggttctgcaggacagagcccgggcctcaacaaaagcctggcaggcagggctgcagggcatggggagctggggcctcctggagcctcggcagagtgcaaggaagaccagggccacctgccccacccacctgcccgcacacgggagcagcgagcacagcccctagcccacactgggcacctccacagcctgaccctccagggcaggcctgtctcaccagcggcggagtccacggtgtgtaaagccctcacgtgcccaagaagacaggacatcgtcccctagagacagccccaggagtcgctacctggccccagcccttcagccccatctgggctcccactcactgtgaggaaggggtgcctggagttctgcaggacgcggttctcggtgagtgtgtgggccacctcgtcctgtaaagcagggctgggtgagctgccaccccgcaccctcatctccaccctgccccaccgccccggccccaccttggccacgatgacttccttcttgaggatcttcatggcgtagtagcggcctgtggccttctccttcaccaggatcaccttgccgaaagtgcccttgcccagcagcttcaggtactcaaactcgttcatggtctatgggcaggcaccagggtcagcaagcggcgctgccaacagtgcccagctggtcggcatgcgtggggtggcatgaggggccccagagtcggaggcagagccaggagaggcgtccacttcacacctggtggcctactgggctcagcggggagtccaggcttacagggaacacatggctgcggccccagctcagagcatggggttcagggaagggtggggtaacattgcccaagcctggcagggctcagcaaccccagttttcctctgacatggggaagaggacccacctgggaagcagctgcgccctacatggaaaaccggcctaggtggagatgccgtggagtgctgagtgtctcctgggccgagctgggaccccatgacccacccagccctccacagtccaaggcagccccaggcacaggcagaagtggggacaggcctcaccacgcggtgcttgggcttggccagggacacctccatctcttcagcccctgagttgtcactgggtgagcccgaccggaagtccatctcctcctcctcctgcttcttgaggccgtcagccacagtctggatggcggttgtccactcctccctgcaggaggtcaggtgaggctgcaggcctgtaccagatcaggagctccaccccacgtctttcacccacccgccagcctcacaagcgtggttccacagctgtcggggttcccagagacagccctgaggaggccaccacttgacctggtctggccacatacactcagggtcacgaagccctcttggacgtgggggacacccaggcttagccccccagcaggactctgtccccacaaccggactccaacccccagcaggactccgccccccagcaggactccgccccccccaagcaggactccgcctcccaagcaggactccgccccccaaggaggactggccctctccaccgggtttttctttttttgagacggagtcttgctctatcgccctggctggagtgcagtggtaaaatctcggctcctgcagcctctgcctctcgggttcaagcgattcttgtgcctcagcctcccaagtagccgggattacaggtgtgcaccaccacacccagctaagttttatatttttagtagagacgggggtttcaccatgttggcaggctagtctcaaactcctggtctcaagtgatctgcgcacctcggcctcccaaagtgccgagattatagacgtgagccactgcacccggtccctagccagtttttatctccagcctcagtttccccacccaaaccccacaggcaggactgggccagtttccaaactgggctctgaggagggcctgggagcactggggagtgaggatggctacaggcagaggtgccagcaccccgccatccccgtgtccctcctaagcgctggggctgcccaagtgcctggcctggccgccacagcccacgtaccgctcctcaggagtctccacatggaaggtgcgttcgatgacagtggtccactgcaggcagcggatgatgaaggtgttgggccggggccgctccgtcttcatcagctggcactctgcgggcaggcagagcctctgtctgcgtgcatccccctgcccctcccagggccctcaccacagcccccgctgcaccagccagctccccttgcataccacccaccaggtcctgggaagccccatctcttcctctctccaagcctcagtttctcgcctcacagagtggggctaggacccctgttccagctcagacactctactccaggctgaggcagccacacagggcatctggcccggcgtcaggtcaaacccccaccatcgtccactcctacagtccttccttcagtctctgagccccgccgtgcgccaggcctcagaggatgaggggtatggagatcccacagaggggctggcatgaggggggcaccccagaaacctgcttgtcccacctagtgtagaaatgtcctgcttttttcccaacctcaccctgagtacctgggaaatacagccacctggagcacacccacacctggggcacacccacacctggggcacaggcacacctggggcacagccacacctggggcacaggcacacctggggcacagccacacctggggcacacatacatctggggcacacacacactggaggcaaagccacacctggggcacacgcacacctgaggcacacacctggggcacacgcacacctgggacacagccacactggaatacacagacatctagaacacatctagacacctagccacatctggggcacacgaacacctggggcacacgcacacctggggcacagccacacctggggcacaagcacacctggggaacacatacctggggcacagccacacctacagcacgtacaccctgagggctgtgggaacgtgcggggccctgagaggtgtgagtgagtggagtgtgtagccgctggggctccgtggcaggctctggcccagcctgtgcaaagcaggaggaggctgaggggccagtggggggcctctgacattccagcatcgaggccctggcaaccacaagggggcctggccaggcagcaaggaagctgtcttccaggcctgggggccaggagggggctcgggaccagcctggtggggagggtggcctgtgtcaacacaggccagagaagtggaaaccggtgtgaagccccggcacacccacctcccactcgctcctggatggtccgatctgccccagtatgcaatccccagggccagagtctcgagcccactgccccggaaccgttccccggagaaaagccccggacagaggcccagcacagcccctggcccctgcccagctctgctccttggccaggcgctccaggccactcacctatggcctaatctgaaggccccagccttgccagctgctcaggcaacacctccagctggtacccacccgtgtgcctctccagagagctccccacctcgttccttcccaatgcctcggcctggcgagcacacccacagcacccacccccagcaaggccctgtcccaggtgccaccaggcacgctgctggcacccagcctctccctgatccctgaagcccccagccccaaccgaggagacactggggagggtgtgggacaagtcacagtgagtctcctgcatggttacgaggctgtcaggagacaggggtgtctgccttcctggtctcccctcacccctggggtgccctactctatcaggctgccctgctactgctggcttgaggctggaagagccagggaaggagacctcggcttacaggaaccaggtcctggtaaaccccaccccaaccccagcccctcagcctggggctttgcagggcaaggcctctgcccctcccaactagaagcttcagggcacggtttgctggccacagaccacctagcagccagggtgccagactgaccccacctccccttatacgtgcaggcaccaagggtgggagtccttccctgcccagcctggggacggattccctgcatttaacctcctcccagaccctggaccagaacctgggggtccagcaagttcaagggagtcggaggaccgcaggcctcaaagaaaggagggcagagctacttggaggggaggggccgatgcagcacatggggatggaacctaaggccagcccctggtgggcacctcgctctgcaccacagacctgcctgagacagatcccagaggcctgcagttacccagccctgccacatacagatggcccacaactgggccctaattagccactcagtcacacctgcatgcccaacccgtgtctctggctgccacaggcagagctgggctccaggacagggacacagaaaatggggaccatgctgggaggcccacgtgtccccagcctcccacctagcagggcgcctgggtctccatgccagggttcccgtctgacatgggtagggtcgcacctgcccccgctacaggtaaggaataaagccacagcagggcggagcagggagcgtcacatgtctctcatctctgtgggatgctccggccaaggtcccccgctggcctttctgcacctgcccctccatgggcaaggaggcagcctcacagaggggaagcaaaggctctgccatggggtctggaggctgagagcctgtgcagggagaggcacgagctcttcctcgagtgatggaggcttcagagctggagaccccaatggactcttgccccctcacccaaggggtttcccaaggagaggccctgatgggctctatctaacccccttggaggaggggcccccggggcagctgtccaccctgagactgggctctgctgccacttgtccggaccctccagcttccagagcatgggcaccagggaactgctccagggtcagccagccttgggactcggcccagagacccccgcccagccagcctcggcctcaggactctgcccagaaacccctgcccagccggcctcggcctcgggactcagcccagagaccccggcccagccagcctcggcctcgggactcggaccagagacccccgcccagccagcctcaggactcagctcggagacccctgcccagccagcctcggcctcgggacttggaccagagacccctgcccagccagcctcggccttaggactcagcctggagactcccacccagccagcctcagctttgggactcagcccggagacccctgcccagccagcctcgggactcggcccagagacccccacccagccagtgcttgttgcttgccagcccaggacttggaggctccaggggacccccatcgtggggcctggtgggcaaagagggctccagccaaccccccaaatctgaatcccgagaggccaaggggatacttacgcgccacagagaagttgttgaggggagcctcacgttggtccacatcctgcggccgctccttgtagccaatgaaggtgccatcattcttgaggaggaagtagcgtggccgccaggtcttgatgtactcccctacagacgtgcgggtggtgagagccacgcacactctacccgtcagaccctcgccaggcagccaggcaggaactgggtgtgccaggacagatgtgcctgggatgcctgagtcccagggggcaggcgcggtacgggagctgtttcttagggccagcgacagaaacggccctgggtcaacgggaaggcagactcgccccaccacagcgcccctctcagaagagccaccccgagctgtgtctgaaaacgggctgggccagctggacgcaggggatggagtaccatggacaggaggctgggaagaggtctgggccagtctgcacagccttcctggaggaggcagccctaaaccagccagtccccagcaggcaccagcagcagctcgggccccagctatggccacaggggctgcggggctgacagcattccccaatcaaccagggtcggccaggtggcgacagcaggtgacagtggcttgtgtgggctgcccagcatggccgccccccccgccccgccgccacccaccaggaggatggagcatggcgtccacagttagaggtcagcaccactcagactgagggccgggctcgcgggacaggactgcccactgccgtgggatcgcactccctgtctaggggcctggagcaccgtcttggggactgccgatgaagccagacacggaggtggcccagccagctgggcaggggccccagggcacagagggtgccaagtccccaggctgagacccacactcaggccctgccgccgtcggccctgccgcgtcccacccgtgggtcattcaggtacacgggaacattctccctcaagttttgcagcatcagccgtacgcaggcgttcacacttcagaatcagagcagctgtcctcggtgatagcccagcaagtaccatttttcatactgacactcggaaaaaaatgttccacttacattttgccaagcaaggagtttgaacaacagggaacttactaattaggcaactgcttcatctgaggggtcactgggcaggggttagggagggggccagggtaaggggttggggtccctgagctctggggcctgggttttcatgccacactgagccccagacagggacacctggagggatgtgggggacaagcaattgtcccatcaccagaccacccaccacccagtcctgctgggtcttcgtggtgagcccagacgcgtccagccctccctggtgcacagggaagtcccagcagggcagcagccccaggggagctcagaggacatgggtcatgggcatcccagcaggcattctactttccagggagccacgggggagttctttaatagaggtgagccaccaaggctcgacacatggccaccccccggccaggtgacctctccctcctaccccggccccagctgcccaatgcccttcccaccagcaccacggggcgtggtctccacaagaccagccctctctctgcccaagccagggctgctggggggatgctggtggagggtggggacaccccacccagcagggcctgagtgtgggaagaggctgttgtcaggtctggggtggaccaggaaggggacagccacagcccactcatagctgcctgacacctctggaggacggccaacacccagttgcagggaggatgatccagggcccagaatctgcccctgtgcccaagagcactcatcaggagaccccacccactccgcaagccctccatgcccctgccagtgggctgccgagcaggcgtggtcctgccacccttgggtgccggctcctgtccctgacctgggatctcgcacacccccgagtgtgcacatacacgcacatacgtgccacgcagctccaccccgcctcccacgtcccctcccccagccacagggcccctgcaggtgcagcgggcaggcaggggcgctcagtgagagcagagcaggctcagggggctgcatgcagcccaccccacccgtcccccatcctgggccaccccgctgctcacgcccacccgcctgcatgccagtctggagctgtcggcccctgatggagtgcctcccatcctgccagctgccactccccgggacgctaactgagcgggaagactgatgagcgcccaggcccggcacccctgaaacccatcttatccaccaactgctgccagcccccaccgtgcccagcatggccccgtgctgcccccgagcacgcagctcccgtgcccaaccccagccttgcccctgaccctgctgccacaagcccagccccaggttctgtgagctgcatctggggggttctgggagctggatctgggggtgcgggaggggcaggcccaggggcggcgcttaccaggcgtggggggtgggagaggacaggtgcccagccccgagcattcctggggagtcctgggatgggcagaggcccaaatgggccctgggctttcagtgccttcccctcgcctggccccacagacccagggaacagacggcgatcagggcctaccccaggagacgggtgtgagtgaaggggcctcacgtggcctttgtcttcggcatcccagcccagcacacagacccctccaggggaggagcaggatccccagggacccggggtaaggggtccagagacacacagttctctttcttcatctctcgcctagagggtcagctagaggatcacttgggggggtgccagctgcagccagggccgtggcgcgcatcttaacgagttcagcccagacaggatgctgggtgggcggccagccccgacagcagatgcggcagggccccactactccctgatccaggactggggtgacacaggacggggcaggtggaggagacagccacccggggcccagcatcactgtcctcatggccacaggacgcctgcaggcctgcacctgcctactccgggtccctcaggagggtgggagcacagacacatcagccagggctgccctcccagacccctcacacaaagagaccaacccacatggagtcttctccttcactatcctgagggtccccaggggaactggaacctgtcatccaggacttaacttgagttccccaccctgttgtggtcctcagatgccccccactcgaggcaggagtacagtccacttgaagagtggcctctcaatccctgacaccccaggaaaagtgccctgcattgctgggggaactggaaccaggcagtagggacctcgtcctccacaccgaccatgggaagcacccgccacagaggggccttccatctccccaccatcagccagctggcatccccccaccccaccccagtcacccccccaacaccaccccacccacctgcctgcacagctgagggcaccaaacacagagtgggcacagacccccaggttgccacgccaggccctcactccagacgggtacaggcaggcaacaaatggggaggccagggcacgccccaccccacacacagccagagtcatctcctgccagcagccactcccaagggcaatggagaccgcccagcattcaggcccagggggcctcttcagtccctaactctcacacccccatgctgggctcaagaacccccaagtccccacccgctgcacatgtttcagacccgggacctggagcaggcagggtcccagtgcaaccccggcctgggcctcagggtctggcagggaagacggctaggtgccccttcagaaatgtcagcaagtccggatgggggaccccacaccactgccagaagacctgagtggggggccgagtggaggacggcactggggactggtcccaccttcctgccccatggctggtcccctgggcaagggggaagcagcagctccggtcccaccctcctgccccatggccggttccctcggcagcggggaagcagcagttccagtctcaccctcctgctggccccctgggcagtgggaggcagcagctccggtcccacccttcagggttctctcaaggccagccctgggccaggtgggagccaccctgacccttaaccctgtgacactgcacctatccaagaccaggtcctgtgaagccacaagggcaggggctcctgtgcctgatgaaacccgtaaccctccccaccagccagcacatccatggcccagggctccaggcatgggaggtggctgccctcggtggggggtaggcagttggccagactcctgtccctgcccggggggacagcggagaccaggctccctcgactcctcctgcacctcctgggccccacacaaccccagccctggtccctctggcatcccgatgtcccgggtggccctccggcaggagtgaccttccatccccaaccccgctcatccccaggaaggggctggagcacccccagggaaagagggttccttcccagaagtcctcctggaccaaataccggggttctgagaggaagctgctcctgcctggcctcccccaacccaccccaccaccaccacggggaccacatggacagtcacaggcagcccaccctctccacgcctcacacacgtgtcccaggccacactgtgggtcaggccccccaaagcggcacccacttagacatgggggccaggacccacgcgccatgggcaggactgggtgggcccctgagggccagctggtggccctccacgtcccgggactgaccacctcctgagccaccaggtgtgtcagcccccctaggccaccacgtcctcagctccctgaacattctctcaaagtccccagttctcaggaaactgctggataaacacttcgcagagacggtggtggcagcggctggcagggtgccaggcggcaccgagctgcttctccacagcaaagtgagcccagcaggccctgggagcgggcgccagctgacagcggccaccgtggtccccactgccgacacatccatcgccccgacagctgccgggggcccatttaccttctccagcacattgagcagacggctccgctgacggcagcccatgaggggcccgcaacccaccctccccgcctgccaggagaccgcacagctcaccgcgaagggcccggcctgccaggcctctgcccgggcccgggagtacacacccctttaccagcagccctcgaaccctgtaaacaaccaggctggggtgggggcaggggaggggccacacaacggaggccagctgaccccacttggctggagcccccaggtctgtgggtgaaatacatccactgctcctcccggcacaagcccttctgagggggcacaagtggccagtctgcacaaggagaggtgtctgttcccgccaggcagaggactggcgctccacctgcctgggcctcgcccagcccaggacccattctgctctcccagaaagcccaccaggcaggcagggcgggcagggctcatcatgcccatcagctccctgggaaaacggagacttaggggaggtgaccctcagaggcagatcatgaccagagagaccccaggtcctgccgccaaggcaggggttgtaacttgacacaaactgcaaattcttcacctccttccgctccaccatggagcaggcctcagcccgacacacacaccccgggaggaacatggtgcgggcaggcggcaccaccatgaccccgtccacctcgctgaggcacagccggaggcgctggggcctctcttcctgccactccagggaagcacctgggtctcagctttccattctcctggggctctactgggtggggtactgggcctccctggtgctgcccctgacagaccacctgggcctggatgtcctcccccacaggcactgcccgtcacccacccctcgggccggcaaaggcaccccacctgccacacacccatccatcgcagagcccagcacatcccaagaccctgtccctgtccctgtcccccacctcatttttggtctgccccaaacaagccccacccatgtcatggcccaccctgcctactcaggacccctgcagatgaggctgcagcccctccctggcgcctcctactctgcccccgcccactctccccataacttgcagcaggctttgccaagtgccctccacccagtgggttcccagggccctcaccctcgctccctgcgtgggaggaagctgggcatggggacagcacacagtgcctgctgcgagggagggctggccacagtgtcccacgtgtagacactgccctcgggaaaggaagtgggcacgggcacaggctccttccggggctcggccgggggcacgcagccatgcccacagcccctccctcctcccgtctctcttgggcagggcccctggcggttgaagggctccagtgctggcctctcaatccctgacaccccaggaaaagtgccctgcattgctgggggaactggaaccaggcagtagggacctcgtcctccacaccgaccatgggaagcacccgccacagaggggccttccatctccccaccatcttgtttctgccccaacttggagccacgcctggggcaggagggcccccagagcacggccagctgtggagggtgctccttctgatcccccggcctgctgggacattgtggccctgacccccgtggcctcaccccacacctcaccaagcttgtgcagctcagcgtctccgcgccctacacctggctgctgtgcccctggccccagtctgtggggaggccagccagaccctggccagccgaagggcctctctgcattctccaggcccagggagcagccacctccccgccaggcctgcccagggggtgtctccacccctgagctggacaaccagctgagggcctgggcaggtgggcccgccaggttacagggtatgggtggggtctgcagtcaccgggcccgcctggggggtgtgtgagcccaaacacagcgccccaaggatcccaccccaaagcccgcaacattggcagcagagtcacccatgaactcccaaccccctcaattccaacgtttctgaaatccaaacctatcattccttaaggttcaaggaaaacacacctaaaggcggcatggcagggaagggaactcccgttggagatgaggaagtaaggggcctagggttcgcctaacagccccatcctggcctggagccccagggccctctgccaacctgcccggggccccagcgctgggctgggggaaccttctcctgaggccatgggactaggcacaatggtccaagcagacagaagcagcaggcagctgcccacccagggtggcctggggagcaggcccagagccacagccacagccaccagtctcagctatgggagggcccgagggcagggtgctggccccaagccgggccgggtgtgcccaggcagaggggacgccagcgggggccgcgccagttccctccgctcagcctcgtgcaggacttctaggaacccggcctgatgcaacccggccaggcttctcctgagagtggaaggtgtacgggggtctaggccccagcacaggaatcattccacccacattctgtccactctcctgggcctcagtttcccttcccggagtccagccccccacagggcatccctgcccagagagggccagtgaccaagaaacacacaggaagaagagctgtccactcaggagccaccaggcgtgggggctaaggtccagggctggggccagcagtgacccctcacccccactcaaggccacctcggcttcctcttttgttgtttttgaagtgagaactcaacaagctcccaaaacaggaacctccctgatgctggcggcctccaccacagccatgccatgacctccaccagcctgtgcctcctgcccctctcccgggtaggcccagggctgttgggacccccactctctgcccagccctcccaccaggagccagcacacttgcctccccatctctgtccctggcctgcccacgggggccgttccagaccctcaacgctcccccaggggaggcagagcttggcactaaccagcccagggcccgcgggtctcacactgaagccacctagacgcagcctggggttgaccctcacctgacagcctgggaaaaactgaggcccaggaggcacaggcagccctggcctggagcccaaaggttcccacaggctgaggggagagtctgcgggctccctccctcagggtcctgctgggcccctcatcctggcggggtaatgagcagcctccatctgcacacaaacaattagccctgcggggccctccgcagcagctgctctctggagtgggctcagagtcccccacagacctcttctcaagggtgtttactcagcaaagccaaggcctcctccaggatgaaggggagtggcctgtaccctctgaggtcccccacctcacgcagggaccccaggaccagctggatggctgagcagcagctggggatgcagtgaggttctatgtcgctcaccaaagcgaagtaacacactggggtaggaaccactctctccctgcctcagtgcccccccgcagggacagccagtgccaggacttcaaggcggggagagggggtgggaaggaggcccagcctaggcacctgcttggggtcagagaccagcctccatactccccaccgggacgcctggggctaactcagcaggagtggtgagggggctgccctgaggcctggactggggggtctatgccaggcatgggcccggggtagggcatggcaaggactcagatgtccggagactggaccctccgtgagccgcatggacacacggtcccgtgtcacccgggcccggccaggcacccagatccgtggcttggacacgctgcccacacactcaggagcgtctgccgcgtaacccacgcgccccaggcagcttccctcgacccccgcccactcggccttggcctgctgggtcacagcctgccgaaggcagccaggcctgcagctcttccccggcccctctcggacagcgaccagcctgagggagtccaggtggtgcccctgcggccggcacccactcctggcctaggcccagccctttctcgagagcccagagcacctcatcctgggtcccagcatcccggccacccgcctcggccctctcctgacccacttggtccagccatgtggacggggggacgctcaggaagacagccgcgagtggacaaaaacaggctccaggccggggctgcaccagggcagctctccacggggctaggctgcagccaggctggtgcacggccccaggagtactggggcaagcgggcaaggtgagcaagctgtttggggaaagtacctcaaaagagccacacagcctctggccaaagcctggcacggagctatcaaaggaaggaaaactgcaggctggaggccgagttcagccagacctgcgccctggcccaggattgattttttaaaattgtcagccttcaaaaatcaggagacttcacacaacagaacaaatctttgaaaatgcaaacgtctgagcaacactgagcccaccagaccaccaatggccagagctgagctgggctgcttatccagtgagacagccgaaacaggaggggacatctggccccctgtccctataggccccaccagcctcctcactagctcctgcccttaacagcctaagctcaccctccaggaaccatctccctgttagatgtgcagacccagaggcctcgcctgggtccagccacaggtccacacaggcctgcagccggaactcctgtgtccccatgcccggtcccttctgtccctgaagctcctctgactcagagcacacacatcagaacaacagaaagcagcctgggccacttcccagagatgacgctcacctcccaaggagcaggagaaggagcctgcagacactgccaccccacccctcacacacagggcatacccgtcccctctcatctcaatgaccacatcacccctgaaggcaccatcacgccacgtgtggccagcccaagtagccgtggtgggactgtcacctggggattcagctgagaaccaaagtgccccaggccacggtcgtggggagtcccggcaaaggggacaggtgcgggccagcctctgagacaagcaccctgacctgcaggagcaaggctgggggggagtggaacagggcgtctgcaaggggctgcggccgggcctggaggacagtcactgcgtccctccctccctccccacccccagccaggcctgagcactgtgaagcacgggtggggtcagcccagcacagccctgctagggacaggaaggcagctagtacctctaaccagtgttgcgggtggggctggccctgccaggagggtggcacagcacatctgcaagacacacaggggaccccagggacgggagtggcgaaatgcggcaggccccggaggacaggctttcctccgcaaggagcggccggccatgcgggtggacgccacctgctctcggcaacaagaggggctatgcctgccaagggcatatgtcatatccacgccacctcccatcctcagcgcccactacactggggatggaggaggaagagccgggggtagaggtacaggaccctctctcctggcctgaggctaggggccagatgacagagcccagaggctgctgaggctggccggaccccaactcagggccgcccacaagccattctccactccaccaggtctctctcccaccaccgctccctggtgtagatggggaaactgaggcccaaggagctcaatgaccttgctcttggaaagggtcatggcgatagagtggctaaccagggttcaaactcagctctctggacgccccactgggcctgatgtcctgtccctgccaggcccctcctgaaggcacgacatcagcagcagcctgaaaatcacctggcctcgggggagcactcctgcctaggcccagctggctgatgggtgccccagtaactggggcctgggcccctgggcagtcaaggccctggcatctcctgggtcagcccgagatccaacagtctatcaacaaacacacatttgccaaggataaagaagcagcggccccaggcagcagactatgtgacacagagaggaacagggccagggtcggggcagggggtccctgacaccaaagagggctgtgaggtgaggagaggacctccaggcacaggtggcaggactcctggggaacaagcaggggacagcacacggggaggggatggagaaggcaggatgcggcaggaggccttggggggaagcagagccagaagctccccaaggaccacaggcgtctgcagcctccttgtcttcatctcgaggccccgcgtgccatcactggtagctgcccactcaaacactccaaacacacagccagccacacccctgattcccccagcatctcatctcggtcactccttcaccccacccccaggctcctgtggctccttaggcctgctcttctgtgagctcctatacatcccacaatgccccatcttgtgacacctacttttgccacacctccctgtctgctccagctgtgtttggggtctccccactaccagatgtgaaacccatctgctagagggtgtacgtaaagccggggggctgctggcatgagatcactagaacttaggagggaacaagtctggaaaaagaagtcaggagagggcggaccgattccgcctggggcagaagagagtgacttggccagaggacctggacctgaacaggaagcccaccctagcaggacagaggagcaaaacagccacccagactccaccgcaccccgctgagcaacggagggtgggtgaggcagaagggcctgcacagggttggaaggggtggggctatgtccccagctcccatcccacccagctgctggccaggcccctcgggcagcacctcctccataggctgcaaggccaaatgagtgaggagggggacacaggggctgggggacttggctcagccagctctgcagctccaaggcaaacatgccctgtgcccaggcggtacggattccccccacccccaaagctcaggcctgaagcaggcaccaggccaagccaagcagccctgccctgccctcaggagcccttgggcagtgccctgggccgccagcgtgccagaccctggaacagcccagtgtcctcgctgccttccaggaaagccaggagagaggctggcagcagctcccccgcctgccagggcccacaccaggaagccactcagatggccggccctgcacagggcctcatcctcctggcctccccgaggccgtgccctccatgccatgggaagacatggggcccaggacactcaccctaggccagcccaggagccccaggggaggcagcccctcccacccagcagggcacaggcactcacagaccctggggctactacccccatctctccctccccaggcccagccctggcagcgggtactaacctcgtttgtgcagccaaccctccttcacaatagccacgtcgctcatggtgcccgaggctcccgcgacgctcacgcgctcctctcaggctggcgctccccgagcccagctggcctggccacagcctctgggagaagcaaaggaagctgaatgtgaggccacgcctggctaagggcagctcctcgccctgggtgagccagagacccactgcacgtgcctgggggctccacccgcacctgccttcccaggtgggctgccatccctctaagctctctgacccccatctgcccgcctgccttccctctccccaaaacactcagggctgccaagtgtcaaatccatgtaattgaacacagttccctggacctgggcctctccttattctaggcttagagcctccagcccctgccaccaccacccgcaacagccaggccctgagagctgctgccttgctcacctccccattcccacctcccccagccgttggacaaatcacccccatccccaaaaggccttcccagcctccctaacctgatgcaccagctgacaggctgcctcctccaggcagcccctttgacttctttgacccaggctggctcggccttccctaagcccctggtgacagatggccccgtttgctctccctgtccatggtgttcctacccatggatcctgggacagggcacagggctcctccctgctccccagactaggaaagcaaagaaattcaaacatgaggaagacaggaccaggatgcaggccactggcgcaaacgggagtccagagccctccagcgcaagcccaaaaacctcctgggagaaaccccaggcccctcctaaaccacagcgcccctgccggtctgaatctggttcattcatttggccaacatgtaccgggcgtctcaggttttgccaggcccagtgctgggcgctggagacaaagagaggttcagacaagtccgtcagtgaggagcacccagtccagggtggttacagacccataattacagcagtcgggaggcagcaagtaagtgggggagcactggacaggcccccgccctgcagcggcccaccagccaaccctcacctgagcacactttatccattgatcctgcatggcttcctcatttcccctctgatggatgaactcctaggcatccctcaaaacccagttcccacatcaccaactacaggcatccccagaaagagcacttcgcatgctcttcctgtgagcagtcctctgctacccttccagatgggccttcctgaggggaggagggtcctctctgggacctccaggccaggcagagacccctgacgacctctgtggaatggatcccaacatgggtctttccacagccagcttagacgctctccccccaggccacctttctggcctcccgaggcaagggctggacacccacaaagggttgctttgcactgattgtcttaagctacacttagaatggcaggaaggcccactgccttgtgtctaatgccaggacagggaagaccacaccttacccaaagagggaaatgccccaagtacttagcaggatggaaagcaggccagactcgaggaaggcaccgcaggactccgagggcagggctccgagccgcgcacgcctcaggcacagggggctctgacgacactgagtgggcgtggcctggaggcagagggctggactcaaagacctctggatgtccccccacccccacacgggcctgagcccctccaaggcctgctgctgacagagtcagacagctgtccagagccatgtgtaaaaatacatctgtgctcacacagggtggtgtacgtctgcacagaaacgtatacaccaggccagcacagggctgcctgtgggggcggagggaccccgacttcccacagcctccgtacctgccgcctgcctttaccataagcacatattcttgctactattattaagtcacaacttaaaaaaaaatactctgttttcgaaagggctcctccatctgcctccagaaccctggtgtatgagaagtctacacagctcccgggagaggcaaccggacccccaccaacggactccgtccgcccttcgctcggatgagggactcaaagcagtcaagaagtggccacctggagcaaggccgagagacccaggagtgaatgtggggcggcctctggctgcagagcaggggcccaagctcacccgctgaccaaggcagcactcagaggccgtcccgacaggaccaagctcgctagcgccccaggatactcaatctaaggggcaagccccagctgccctccaagccttggcctctgggatgggcgggcaggacctccagggcccacccaagacaggaagcagttccggggcccaggagggtcacagtcctttgtggctagcctgggtaccccgccaccacgtacaacttttcgtccgtgggaaacgaagtctccttccggggccctcccacaaacttgaaggccggccgcggcgagtctttctccaaccccggggcacctccgccggctgcctcgctggcccagcgcccggggagccccacggcccgcaggggcaccccgagccccagctccaggcccggcggcgtcccttctctcgggtcccggcctcgcccggcggagcggcctccccaaggtcatgagggaggctggggccggcagcctgcacccccggcgcccggcgtggggccgccctcccttggccgggcccgcgcgccccgcgccctccccgcccaggcccgctcggccacttcctgctcccgctcctccattctggcggcgccgcggctcgcgccccggcccgaccggccgcgaacaaagcggcccggcccgcggggaggaaatccaggcccgggcggccacggcgggcggggactcaccgggccgccgcgtccgggcgcgagcgcgggcctagccgggccgcggcctccggcgcccgccgctccgcatccccgcgggccggcgctgggcggggccgggctggaggccgcggcgggcgggggcgctgctcggggccgggcctcgcgtgccgccgccgctcggtgcccggtgcccagcgctcggtgctcggccgcctgctcccgtcttcgggccgcgctgcgtgcgctgggccagccgcctgccgcgctcggtcctgccgccgccgccggcccgccctctccccgccccgcgcccgccccgcgcccggagccgcccgcccacatccgcctccgccgcccggggcgtccccaccgcgcggccggcggcgagggcggagcgcgctcggggagcgcgcggccgggctgaggggcagctcccgacgacctggggcctgggctgggccgctaacggagcccggccaccagccagcccgtcccggggccacgccctctctggcctcagtttccccgtctgtaaagtgacccggcgcttctgggctcgctctgccgtgaccctagcagaaggggcccgagacaggtcagggacgaatcccggacttctgcctccgcgcgcggggcgggggtggcttaggttgactttcaggctgccccactctggggggcgtggagggggcggccaagagtgacctaaaaggcccaatcccaagaccttgtgcctctgggggaagtgcgggaggatgccaggacaggaggtcagttggaggtgggcctccaaggagcaggaaggctccgaggggagtcaaccattcacctaggtactggcagctacactcacaaaagggggactttgctggggagtgggagaagaggggcacaccttgcctggctcccaccttgagctgggagcagacaccagacagaggaggagcggtgtctagggtgggctgtgacagctgacagcccagagccctccctgctgggtggacttggtcagcccggacacccagtccgaagtccactgggaggcagatggcccgggtatggaatgagtaagtgggacacagacccctttctcctggacactcacaggagagtgcaggtgactgccaccccgaccccttcctagccagaagttcctccgacaactgcccctcccccattccagaggcccacagttgataataacccttttgtgaaagacagactcttgtgagttaccttcctgaggctgctaagtattggggttgggggagcatttttattttcagccagagtgagttcagctggcagcaggggagggggtgggaggagatgcagacagaggcagcaggttcggcccagtgctcaggacagagtctgcagccaaaactcgggcttcatccctgcctcttggggctgaccaagagaaggactctctccccctgcatgagggcactcgctcctcagacaggggactccccattcctgcctctcgcctgagcacctctgctccctcccagctcagactttgtaaccccaggaagggcccacctccagggggccaagtcagaggcccagtggtctgcgccgcttgggtgggatacctgacacaagggttgcccccagagcctgggcgtctggtgtctgtctctcacccagcaaacctgcaccatgagccacctggggctccctctgggactgtcccacctgcccactgctccccgaggaagagttcctggtatctgtccaccatcctgggctctgccatgcaaggatggaggaaggaattcagggaggaagcagagggtaagagggccatgagacaaggccagcaagtggccgaggcttggggatgtgggagggagcagggcaccctctcatggaagaggcagtgacattgcgggctgttcttgaagtggttggacctcttgcttattttgcactggctgtctccaaggaggcctcccagtcttcccagcctggtgccctggcatctgctggtgcctgcaacccactgtgggccccacactccagtcctgtcttcaccttggcatgaactgccctcccccaagacggggatctcccagtgggcagggccatctccctctcctccagcgtcccagagggaaagcagagtcctctcttcaagaacaccccctcccaccccagacagaatggtcaggagagaacccagccccacggctgctgctgggactgctgaggtgctctgtggccagatgtttccgacaaaaactgctgcaccagggaagggcccgacggctgcctcctcccagagctcaggggcctcctgccctgtcaccttctgcagctgctggccgggggcaggactcgagggccctgggctgtgtaggtcccagcagcagctgcagggcggggcctcagggcagctcccaggccagatggccgcctgagtctgcagaggttctgcctgaaccaccaccgccgcgacagtggctgtgtgacggtgtcctgtcattcctgcacttgagacccagccagtcacaggggctctgaggactacaggctggccaggatcccagcaccaactctgggcggtctctgcctggaacagccccccttccctgatcggtgtggggcaggagggacttgaacccagacatcccgacctgagagggataaggagcttctctcccactgtcccctccccttcatctagcccattcctagctgggccctccttccaggtcctaccctaggctcctgaaggcagcatcctgaccctccctgtgtaccacaacccccattaagtgtccaggctctctctgtcccgccagccaggcagggcaggctagggtgcttgctcccagcctgcagtggggagctgtcagcctgttgcccagagccccagtgtggcaggccacccctacttgctctgaaggttcaggggctgggggtgtgggcaggcagggctggaatgttgccacagaggagtcaggattagggatggtgggaccatcgtaatcactcacagaagcaaccgtcacacattcactcaacaaacatttactgaacacccacttgcgtcctgccaacttttaagcaccaagtgaccaaacagccccttccctttcagaaggtgctggaatatcccacaatcacaggacacccggaatgggctggaaaggagggtatgcagcagaagggactgcgagggaacttagcgaaggtgggcaggaatggccaccctgactaaggagtggactttcagcagagacagggatgaagagaaaccagtgaagggttctttggggaagaacattccagagcctgagagcttgctgagtgccaggccctgtcgttaatgttcacgaagaccccgggatgcactctgactcccattttgcagatgaggattactgaggttcaaagaggttaaaggtttggtcgtgctcaaggttgggaggggccggggcagggctgtgatccaggcagggcaggaagggagcagtcacatctgagttcacccttaacttacttgaattcagctattcctgctggtggctggggcaaggcagatgattatttaaatgcgtggagagaggggagttgaccttcctcaggaaggggtccttagggtggatggccggcggcagtgggagccaggcctctgccgtccctaagctagtctcagtggctgtaagtgcagtgtcattccaggggtccaagctgcagttgccaggtttaggaaataaagatgcagtccatccggtgaaacaaggaatgatattttagtataacaacgaggccttccttcccagacttcagatcccactgtgggctccactcctcctgcacacacatacctggccgggtcctgtcctttgtgatccagcccctcttccagcaccacccccaccccactgcttggccttgactggggtgactcctccactacattctccatttcccggactccaaggcagagaagaatgagaccggctgaattcaaatcgtggttcagtgacttactgcctgatacatggctctgggtaccttacctaaactctctcaccaaaaaggtatgaaaataagagcgtctagttaatgggactgttgtgaagatgatccggtggtctagagtaccttcaaacctgctcagtcaagggcagcccaggttgtgcccctgggaaaaggctccatctgcctgggagggaccctaaccccgccaaacacactctctacttctctggcgattccctctcccacaaccaggcgtccccctcacatcttctcaatgcttctttgccctagaacactttcccccactcctccctacccccactcccatgccagcccctgtccggagtctcctcctctttgaacacgttcctgcctaccctgggctctggagggcttccgactgtctctgttatggcgtttgtccccccgtgccaccatgtctgctgggaggtgcccgttttccgtgcctctctgcgctgggtcccccatagacgctgggctggggtctgtggagagggtggaagtccccgttctggactctaggatcgacatcctgcttgaatgtttggaagagggtcccagctgaattaaattcaaaaagaggctttcaaggaagaaggaggtgtcatctttgcaaaattaacgacccccaatccacgcaacccctacgccatcccaaggccggcgccctgcgaggtggcgggaggccagggtcccgggtttaccctcgggtgactgcccaacgcgggctgggatacaagcggaccctcggaagggttccttttgcagactggcgcagtaaggaccccatgccgggaaaggttgggaggtgggggacccaggccaaagcgccaagtatcgcgagagaccccctgcccccgcgcagtgccctaaacccccctcacaccccagcgcccctgctggctgcgcgcggggcccggccgggtggggcggacagggaagggggggcgagggtgacctcagcggttccgccgctccgggaagtcgctcggcccgccccctccggcccccgccccgagtttcgctctctctggggcggggcgagcggcgggcggcgctgggccagccaagttggagcgcgccccgcccggcgccctcgccgtccccgcgccctccccgccggggcgcgctgcccgcagctccacgcgcgccagggccgccctggggagggcgcgcgcgcgagcggcgaccggagaggagctcggggcggcggaggtgagcgctgggggtgggctcccggctctgcccgccccgcccgcccgccggccctctccccgctccccgcggccgcgctgccataaatggggccggcggcggcggcatctggtgggccgggcggcagctggaggcggcgcggaggcgtggggcgggtggcggcgcagccacccgggcgtcggggacgccgcgagcgggcggccgcccgggagtgaagttcaggagcgcccgggcggggacgcgcgcaggtttgcgcggctccggctcctgcgcctgagtcccgggacccgcccccgcggcggagctgctactgtttactttcgatcgagtttttcctgctcggggcaggtgcccgcggcggctctggacgggaggttgcgcgcgtcactcccgcgccgctctttccgcgctgcctgcagccgggaagggcgcttcgtgggcgcctccaggcgcgctgacgggcgtcccgtttgtgcccaggtgatgacggcggcggcatggagttccctgagcacggcggacggctgctgggccgcctgagacagcagcgcgagctgggcttcctatgcgactgcaccgtgctggtgggcgacgcgcgcttcccggcccaccgtgccgtgctggccgcgtgcagcgtctacttccatctcttctacagggaccggcccgcgggcagtcgcgacacggtgcggctcaacggcgacatcgtcacggcgcccgccttcggccgcctactggacttcatgtacgagggccgcctggacctgcgcagcctgcctgtggaggacgtcctggcagccgccagctacctgcacatgtatgacatcgtcaaggtctgcaagggcaggctccaggagaaggatcgaagtctggacccggggaaccctgcccctggggcagaacctgctcagccaccgtgcccctggcctgtctggaccgcggacctctgcccagctgcccgaaaggccaagctccccccgtttggggtcaaggctgccctccctcctcgagcatctgggcctcctccctgccaggtcccagaagagtcagaccaggccctggacctgtcgttgaagtctggcccaaggcaggagcgggtccacccaccgtgcgtcctccagacacccctctgcagccagaggcagccaggggcccagccactggtgaaggacgaacgggactcactgtccgaacaggaggagagcagcagctctaggagcccccacagtcccccgaagccacctcctgttcctgcagccaagggcctggtggtgggcttgcagccgctgcccctcagcggagagggcagccgggagctggagcttggtgcagggcgactggcgagtgaggacgagctggggcctggtgggcccctctgcatctgcccgttgtgcagcaagctgtttcccagctcccacgtgctgcagctgcacctcagtgcccacttccgtgagcgagacagcacccgggcccggctctcacccgacggcgtggcacccacctgcccgctctgtgggaagaccttctcgtgcacatacacactgaagaggcacgagcggacacactcgggtgagaagccctatacgtgtgtgcagtgtggcaaaagttttcagtactcccacaacctgagccggcacaccgtagtgcacactcgagagaagccgcatgcctgccggtggtgtgagcgccgtttcacgcagtccggggacctctaccgccacgtccgcaagtttcactgtggcctcgtcaagtcccttctggtgtgatgcatccctgtgggtcctgagggtggggtggaagggaagggatgggccctcccaggtgggacacagcatggggtgtgaagcctgaccaggtggaggtccctgcttgggccagatggctccaccctcctggcagagagaatgctgcctcttcctggaacttggcctcagactcggtaacttgggcagccttcctcccaccttgcctctcctttcccctcactctccaactcattccggcccccaggctgtgccctgcctaggctgtgacactatcttcctctcccgtcccctccagccaagttctgaggggtgtccaaccagcacctggctctgcccccgtttctccgtgtgagatggcacatccatctcccggcccgggactttcctgaccacctctctggcaggcttggggaggtcttcatgagcctggccccacgctaggtgaattattcacatgtcagaaaagttgttggtgtgcgtcccaatggggcgctgggagggaacaggacactcctggggagcggcagcaggaacccctgccaggaaggcctggggcacagtgagtgccagcaggggccatctgggcacagctggtgtctcggggtgggggggggggtgcagccccagcagggatcctaaggcagcaggagtagagccagctagaagctgagtggctgtggcatcattgtcactcgggtgggacgtgggtccatgagagcgtgcaattatgaccacactgtaactttgagcagagaaagtgggaatttggaactggattctctttagagccaggaagagcctcctgaggcggccagatgtctgctggtggccgcccagccacatgcttgtctgcctgagtgcaggtctaggaagcctctgggcatcccccagggtggggtctgggccgctgagctgtgtgctgctgctgggccaccgtgggccttaccttgacggtcactctgcctgctagggggtttccctggagctgtgggcatttccgtgcactgactgagcagaggcaagggctgccctgtccgccaggggcagggtttgcgggccttcctttccccacggcgaggcatgggtgaaagtggccatggcggcagggttaggggcaggtgaggagtgggagtcgcagcaccctaggggcctccatccgcagccttgggagactgacgctcctcgaacatgaatagaatgtggagaccacaacccccacacatgtcgttggttcaggtcgccctgctttgcctgcctaatggagcacatcttgctgccagaacctcactggcctctgggggtcggcaggtgcagagccacctggacgcctggagaccacctgggatgtttcctctgtgactgggaatggccttgacaacagagtccagccaagtctacgttattttctcatctcctgacaacactggatgtcatatttattagtcagcctggtctggagtgaaagaccgtccctagcgcatctcccacgcgccctgggctcctggtgtgctgggtgccagcctgggagcccagcgcttctgggtgatgccccagggctcagaggccctggatggctttggtctcgagacagctgggggaggggccctgcttctgattgtcctgggccccagcccccacctctgcaagggatcggtgtgatgtgctccataatcgggtggggggtgtgtgtgtgtgtgtgtgtgtgtgtatgtatgcatgcgtctggcacatggcaaggcccaagccaacccggcaccccgtagatgggcagctacactgccacccaagcacggagatgtggccgcggcactgggtcccccagtgggtcccatgggggaagaacttccctttgctggggtgggcagcctgccctgagctatcaacactggatttgttgtcttctgcacagctactgtgaagataacgtaaggagaagtggtcagttttcattttataactgacacagttgggacaaaatatatacgtgtacatatatttaagacactaattgtgtgggagagtttagtagaggcctgtgcagacacaaggcaaacagcgtcagcagcgtgggggtctcctgggccagctcggcacctgtgggtgctctgaccctgggggtggggacagctccgtgctaaccccagcagacagttgttggtgcacagtgtctaggaggcgtgggaatgggtgctgtcttcctcttttcacatcatggcgacagtaataaagcccacctccagtggaaacggcagtgactattcctgaggacgggtgggaacaggtgtcccagatgccaccacgtgctcatgctggtggatgggggaggctgggacagggctgaggtggcaccccctctttccccaggtttgtccccaactgccagcgtttgggggaggggagtccagggaggcagatctgtcagggaggcggagcacacaggccagcttgggcagggcagtccacgggggtttcttgccctggggaaggaggctggaccctggaggaaacctgtgaacctggggatgccatggccctccccactaccctacgcccttggcctcttgttggtgggagaaggcacagaaatttctagagccctgtgcaggctgggctgggctctgggttgatgaggctggggtgggcaattccacgcctcctcctctgccctgctccctccagaggccttgcagggggtcattagccctgagccctccctggcgggagcacggccttcctttccagaccaaatggggcagggcctctacatgtgctgtaagcgtcaacacagtgccctcttgacttgcgaagagccagggtaagccccaggcccaggacagggtggggatggtgctggccagacagtcctcaaagtcaggctgagctggtgtgcaagggcctgcccctcttgggtcagctcctgccgccttcccagtcctgaccccaaatgcaggtccttccttctgggaggtggtgctggctcctcccctaccccctcccacacccaccgtgcctcctgctgagtttggaccagtgccctgtcctgcagggaggccctctcatgttcccagttgggcccatgactcagcccaggccttctcaacccagaggaggaggctgttgctatgctaaccatgcaggaaaggaggatggtctgctgtcccctagggcgcatggggcttcctggggcccctccagcctgcccagctctgccacactgtgctcacactcagctgactgctagagctgtcgtggaagctttcagtcccactcctggccagggtgggcctcctggcaccctccttggaggccatccagccggcttccttggctggatggtaaactgaggcacatggaagggaccagtacttgtccatggtcccagagccagttggtggcaaatccaggacttccttccacaaactccaggaaacctcaagctgtttacccacagtgctgggcacagggcaccaatgctgtcagaggcacggtggcaggttggggcagcaaggacgaggccagagggaaggagagggtcagactctgcggaggaggtatccctggaggctccccaggaagggtgacctctcaggagcctgcgagtggacaacacagacacaggcaccaggcaggggctggccccccacagaggcccgatcatgtcagcccaggtgcgtggacgccaccctggggaggctgccttgcaagtgggaagcaggtgagtcggcagccttggcccttcccttctgccacctccccagctcctgcccactcccacacacacctggtcttacctttcccagtgttcctgaatggtgctgagtccttcccggtgtgggaggctccactccacagacacccctggagagccggtaacaaacaaacccggtgcagacatggctccaatcctggctgtcccagctctcaggggtgaactccaagcccacagaggctctgccctggttttctatgacttctttcatccccacctcagtcccatcttcaatgaacacatcccacgctgtcatcatggtcatcatcaccatcaccgccccctccatggaaccacaactgtcacctccaccattacctttacctccgccatcagtatcatctccaccaccatcacctccactatcacatcacctccaccaccatcacctccacccccaccatcacctccacctctaccaccatcacctccaccatcatctccacctccaccatcatcacctccacctccagcaccattgcttccacttccatcaccattacctccaccatcatcaccttcatctctacctccatcttcaccatcaccatcacctccaccttcaccaccaccaccacctttatggaagatccctaaagaaactgagccaactctaggtcggcttccaggctgaggaagtagggcttgattatgttcaagctgagaagtggttggagaaaggggtaatatctgccctcctcactcagtggagcttcagtatctgcacttcccttttctgtagccttcaagttccaggatttttatttttattttttgagacatggtcttgtgtcgcccaggctggtcttgaactcctggactcaagtgaccctccccactcagcctcctgagtagctaggattctaggcatgagccatggaacctgctagttccagggtattttctgtttccctgcacctcctccctctcgccactacccttccatatacagaagaagaaaagtctgcatctctgtgaaagtaggtctgtacctctctgcacgcacacccactggcacctctgaacacacagcacagaaggaaggccgcccctgcaagtcccaggaattcggaattccatggcacacagggccaccggtgcctgtcccgtcagccacctgtcctgtgctcataaccatgtcactccctttcttcagcctcagcattctcgcctgtgaaatgggaatggcagacaaccgttgatgggtgaatagggtaacatccacactaagtgttggcagtgttgctgctgacaaatgtaacacctgcctgcctccctctggggccattgccaggtcagaagggaaccaagggtgaggagcctttgacaacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacacagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacacagcacccccagactccccaggataacaaggccgtacacagcacccccagactccccaggataacaaggccgtacagagcacccccagcctccctggggcgccaggtgtgcttgggcattgctggtctgtggacctttgcaatccggccctggcctggctctgttcccctgctctgggcagcctcttgctcccctccccctcccactttccctcaacaccccttcacctccagctgttgtggaggatggtggggtacaccacagcagtgaggagtccagggacagcagcctggagggctaggccactcccaacacgggctggcagcagcagaagatgctgcctctggagcctgtgccagagcctgtggctgaggcggagagggtggccgttcagaaaggtcccaggccacggaggactgtcccctgccaggcaggaatgattgagcaccaaggctgctgctggcccagctatagccctggtatcggaggtggcagtggatctgggggagagccagggactcacctccctctgtggaaccctcctggttttgttttcactaattttagcagaagtctgagtctgaagtcaagacatccctttctttctttctttttttttttttttttttttgagacggagtctcattctgttacccaggctggagtgcagtggcgccatctcggctcactgcaagctccacctcccaggttcacgccattctcctgcctcagcctcccgagtagctgggactacaggtgcctgccaccacagctggctaattttctgtatttttagtagggatggagtttcactgtgttaaccaggatggtctcaatctcctgacctcgtgatctgccctcctcggcctcccaaagtgctgggattacaggcgtgagccaccgcgcccagcccaagacatccctttctttgctttctgaagcagacgctggggtatgttttttgtttctttattggctgtagtagttggctctggctgtcataataaggtaccacagacagagacagggtggcttgaacaacagacacttattgtctcacaggtttcaaggtatctgcagcgttgcttcttcctgagtcctatctcctcagcttgtaaagggcggtcttctctctgcagcctcacgtggtcttccctgtgtgtgtgtcctaatctcctcttcttcttcttttttttttttttttttgagacggagtttcgctcttgttgtccaggctggagtgcaatggtgcgatcttggctcatcgcaacctccatctcccaggttcgagcgattctcctgcctcagcctcccaagtagctgagattacggcacccactaccatgcccagctaattttgtattttcagtagagacggggtttcaccatgttggtcaggctggtctcgaacttccggcctcaggtgatccacccgcctcggcctcccagagtgttgggatgacaggcgtgagccacggtgcctggccctaatctcctcttcttataaggacacaagtcctatgggattaaggcctaccctaatgacctcattttaccttcatcacctctttaaaggctctatctccaaatacaggcacattctgagggactggtagttaggacctcaatgtacgaatttggctggggacaaaattcagtccagaaccctgaatgtttcagaagaacatggaggcccaaggacgctgggctggagccagaggcccagatcccatcctggctctgccagttctgggcaagccactgcagttttctcatcagtaaaatttgttgatgtttccatttttgtcccacaatattccaggtacacccacggacacttgggtacagtcagggggtacagcctcacccacaaagaaaacccaggtaactccattgcctaggccctcccagtagcgcccttccctggctgtcaccccacccctgcatccccagagcagaccggggtgtgggacagtccaggtcccctttgtgcttgttctcctggacactcagctgcccccgctgctgtcccatgcactgctcccctgcagaagtccgcctgcaccaccaacaggtcgggaaggaaggtgggggcatccctgaccccttcccgcttacccaggcccagctctccagaggctcacaccctcctcctctctgcggggctctcgacccacccctgtctcccccatattttctcaaggctgcagctttgggcaccccatctccttcatctcccatcccacgcgagccccccactcctgggtctgtggcctttcccaggtcatctccagaggccgcggctcccctggaatgtgagcttcaggcatcctcactcatgacacaagctgctattttcctgtttacctaatcaagcaggtaatttctctatacagtaattccttcatttcgtggttttccaattcttgaccttgccaccttcacgagtctgtctcctgccctctcctgcctgcctctcgactcagtgccttggccgtcgttagattgaccccaagcccctgcctcgagccctcccctccttttctatcaaactacttcccaagacccaacctggatgaacccacacattcccttcactgcacaggtcacagaaaaggaagggcaagcatctccacaccatctataataaatataatttaaacaagtaaactcgccccacagggagcaatggtggagcagcctgggtggactgatcccccatggataacaaagatagattctgaacaaaaatagacatgttaaaaaaactcctggaaggcactggagagcgggtggagacaggcggaagctggagaggaggcttcccttgaaaacaaactgcggcgggtgaggtctctgtttgtggcagcagatctgatagactttgcacaaaggaagttacacaaatggctaataaacacctgaaaaagtgctcaacatcatcagtcacagggaaatgcgactcaaaacccaccgaggggctgggcgtggtggctcacacctgtaatcccgcacttcaggaggccgaggtggacagaccacctgtgatcaggagtttgagaccagcccgaccaacaccgtctctactaaaaatacaaaaattagtcgggcgtggtggcgtgcacctgtaatcccagctactcgggaggctgaggcagaagaatcgcttgaacctgggaggtggaggttgcagtgagctgggatcatgccacagcactccagcctgaatgacagagcgagacagtgtcttgaaaacaacaaaaacacaaaacaaaacacaccaaggccaatcatggtggctcatgcctataatcccaacactttgggaggcccaggtgggaggactgcttgagcccaggagttcaagaccagcctggccaacatagtgagaccctgtctccacaaaaagtaaaaaattagctgggtgtggtggtgcataccgatggtcccagctactcgggaggctgaagtgggaagactgcttgagcctgggggatcaaggatacagcgagccatgattgtgccactgcactccagcctgggtaacagagagagaccttgtcacaaaacaaaagacaaacaaaaaagtcccacaacaagataccactacacgccagctctgaagactgacaacaccaagcactgttaacgtgttaacacgcacctgccacttgacctgaagattctacccccaggtgtcatccagaaaagaagtgaaaggtgtaaccacaaaggatgtgtcctctgatgctcataggagctttctccaacccctgtgcccacccacaggagaacagatagaccaactgcagaatattcgcacaacaggatcttatgcgtggatgaaagagaggagctggcggtgcacccgatgttgatgaagctccctgagctgatggagagaagcctgctgcaagattgcccactggtgagtcctcgcagaggcagaactcatccacggcagaaaaagaggggaccagcagctgcctcagggcaagatcatgagcagggactgggagggagggacacaaaggaacttctagggtgatggatacgcttagatttttattgggggggggggtgcggctacacaggtgcagccattttcagaatttacagttaagattcatgcattttggccaggcgtggccatgcctgtaatcccagcactttgggaggccgaggtgagcagatcacctgaggtcaggggtttgagatcaggctggccaaaatggcgaaaccccgcctctactgaaaatacaaaaattagctgggcatgtgcctataatcccacctactcgggaggttgaggcaggagaatcgcctgaacctgggaggtggaggttgcagtgagccgagatcgtgccgctgcactccagcctgggtgacacagtgacgctccatctcaaaaaaaaagaaaaaagaggccgggcacagtggctcacacctgtaactccagcactttgagaggccgaggcgggaggatcacgaggtcaggagtacaagaccagcctgaccaagaaggtgaaactccatctctactaaaaatacaaaaattagtaggctggacgcggtggttcatgcctgtaatccccgcactttgagaggctgaagtgggcgcatcacgaggtcaggagatcgagaccatcctggttaacatggtgaaaccccgtctctactaaaaatacaaaaaaattagccaggcgtggtggtgggcgcctgtagtcccagctacttaggaggctgaggcaggagaatggcgtgaacccgggaggtggagcttgcagtgagctgagatcgcgccactgcactccagcctgggcgacagagcgagactccgtctcaaaaaaaaaaaaaaaaaaaaaaaaaaaacaaacaacaaaaaactttccttaataaaatgttcataagaaaaaatatagataccattcggtatcagactggcaaagataaacactttgtgtcttagttcatggtgctgttacaaaataccagactgggtggcttaaacaacagaaatgtgtctcccagttcggaaggatggcatgtccaagataggggtgccagcagctttggtgtctggtggggacagccctcttgttgtgccctcacattgcaaagagagcaagctccagtctcctccttttcccgtaagaacatcagtgcctccaccctcatgacctcacctgaacccaacgacctcccaaaggtcccgtctccaaatatcatcgcattggatagtaagatttcctgtgaattttggggggacgtgaacatgcagtccataactttgaaacatacattactgggggagctatgggacaacagcaccctctactacattactggtaaggtataaatgggcacacacctaattcagatggcaatttgatcactgctgtccacattataattacataagtgttttgacccagcagttctggaaattctatcccataaacttgcacataagcaatacgatctcggtataagggtatttgttggagtattgttcagtacagcaaagcactggaaaaggctcaatgtccatgggcagggggccagctaataaatcatggtccatccattgagcagaatactatagtcacaaaaacgaaggcactcttttgcagcctttgggaggtcattaggtttagacggggtcctgagtataaaagagtgtgaagaatagggagtaggattgtaccctgtcctcccgtggtgtaaagagaagggaaactggatgcacatgagcacagtatgcgttttcacatgtacgaaatacttctggacagatcaaaagaggtttggttgcctgtggggagggaactcggtggctggaaaacgagagagggtaacttttaaacttttgaaccatgttaccaatcactaattatcaattcaatggattagcttaaaataaaattcaaaattgcttccttgatcccttacctccttccacttttctgccctttccggtcagcgttctcacatgactggccacttcagtgtactttctctttccttttttcctaagtattgttttaatctttatcctttgtcattaaaaaaatagacattgagactccctgtggcctgtgttccctgcctaccctgtacctccatccccactccatttccctgccttcaaggaaccactattagtttcttgtgtattctccagtgtttcttttcgcaactataagcaaatattttcccccattaccacccaaaaagcagcataccatgtatgttgttctgcaccttgcttttttcacttaaaaatagattgtaggccaggtgcgatggctcacacctgtaatcccagcactttgggaggccaaggcaggcagatcacctgaggtcaggagttcgagaccagactggccaacatggcaaaatcccgtctctactaaaaaatagaaaaattagccgggcatggtggcagcgcctgtagtcccagctactcgggaggcggaggcaggataatcgcttgcagctgggaggtggaggttgcagtgagccgagatcacgccgttggactccagcctgggcaacagagtgagactccgtcaaaaaaaaaaaaaaaaaaaggagattgtagacatctttccatatcatataggaacttttttttttttttcttgaggtggagtcactctgtcgcccaggctggagtgcagtggcaccgtatcggctcactgcaacctcgtttcatgggttcaggcaattctcttgcctcagcctcctgagtagctgggattacaggcgcccaacaccacaccggctaatttttatatttttagtagagacggggtttcaccatgttggccaggctggtctcgaactcctgacctcaggtgatccacccgcctcggcctcccaaagtgctggaattacaggcgtgagccaccgcgccctgccaagcaacgtcacttattacccctgctgacttgggagcaaatgtcacatataaattcccccacgtgcggaggtgtttccctttccttgctgtgtctgcattcgacagcagccacgctaagcggctggaccaaatggagcatcataacgtgttattttattttatgattttattttatgttttttgagacagagtctcgctcctcccgtccacctgccggcgctcctggggcttcgggccacggctgtctcctccgggagcggcggcgctgtaggaagcctggtcctctccctcagcggtcacagccatcgctcgcgtacgcccccggactgacgcctcccgccgggagccctcttcgaatcccgcctgcgcaactcccacgccacagccctgggccatccctgctcccgcgcagccccggccgcctgcctcctacctcgcctccccaaggccccagcgcgccggggcttccctgtcccgggcgcctgctcgtggcggcgggcgggctccttgtccggctcttaagggccggcgccggctcctgggcctcccctccttcccatcgcggcctgctcctcccacccgccttctccgagctgatgccaaggccggacggacgcgacaaaggcctgctgccgaacgtgacctgtccgcagagtagacagacgggccccctgaccgccagactgaggagacccggcgggcgggagcggatgggcgcgcctgcgcaccccctcccggcgctcgccagtcacgtggggccgcgagtggcgccgctgccggaagcgccccccaaggaaacgcaagcagtggcggagcggggttccgcctgggccgggctctagcgccggcgctgcgcgggagtcatcgcgtgccgacttccgtgttgtcgctctcccctcccaaaagcgcggccgcgaggacgggcgctgccagcgatttcctcgcctttgtgtcgcggggctgtccgctgcgcgttacttggtgcgatacgcgcattcggcggtgatcccgagccccacgcgaacctccctgtgtccttgctagtgcctggcgccgtcactgacgctgaggcgtgaacacggagtcggcccagaggggctgttctcccggacgccgaggccaccccacgcggccgcagggccgggcagaggggaactgcagggaggcgcgggccgcatccctcccggaggtctgcgagcttcttgaggcctcacgcccccttttgagccccgctgctgccctgtggcgctgcttctccatccctgcgggtgaccatcgacgcgttccccttgctcgcttcttggttacgggccaggggatactcctgcccgaccctcggcattgcccaagggagtttgcacttcccactgtgctctgccaagcctctgtggagaggagccctccacctgcctgaccgggcccagctttggggaagaccttcttggttttgtctgctggctggactgaccctggccctcagcccaggtgaggcgaccagcggcatgatgcccgggtggaacacggatttctctccagggtggccgaagaatggtttagaagcagcagtgggatgagggagaatcccgaccccgtctcaaaaggtgaagatacgtcaggtctgggggaaaaatatccctactctagagggctaagagagcttggtttggtgcaaatctgagaatccctcaacactttaatttctttaatcctgctaacagttaacaacttcctacaggctgacacctcaggaataagctccttcacctgcgttccctctgtttcctctattctttcctccaatccttaatttttttttttttagatggagtctcactcttgcccaggctggagtgcagtggcatgatcccggctcactgcaacctccacctctcgggttcaagcaattctgcatcagcctctcgagtagctgggattacaggcgcctgccaccacacccggctaatttttgtaattttagtagagacagggtttcaccatgttggccaggctggtcttgaactactaacctcaagtgattcacccacctcagcctcccaaagtgctgggatcagaggctttttttttccttttgagatggagtttcactctgttgcccaggctggagtgcagtggcgtgatctcggctcactgcaatctccgcctcctgggttccagtgattctcatgtctcagcttcccaagtacaagtagtacttcccaagtaactacaagtgccacttgtatttttagtagagatggaattctgccatgttggtcaaactggtctggaactcctggcctcaagtgatccgcccaccctggcctcccaaaggggattacaggcatgagctaccacaccagcctcctccaatcctttctaaaaagcaagtttaaccatgtcactcatttgcttaaaatctaggccaggtgtggtggctcacatgtataatcccagcactttgggaggctgaggcaggaggattgcttgagctcaggagttggagaccagccagggtgggcaacattgtgagcccccatctctaaaaaataaataaataaaaactttgttaactataggatggatggatacgtagatggataatgtatcagaagcacttttggcttcacagcagaaactccaagtgtggtgatttgaaccaatagggatttatttttctcccataacaggaatcctggaggtagatgtgactggcattacttcagcagcccagtgctgtaagggccagcaattgcagggacaggctttgcaattctgtgactttccctcatggtcacaaaaggattgccacagctccagacatcacaccatgttctggctgtaagaatggggaaatgatagttacagagatgtttatctctttattatgaaagcaaaattctcagaggctccccagtaggcttctatgtacatcgtacatggctgagcagtgccatgatctgtcagtctgtcgcctgcatgctggagaaggaagacagccatggtgtcattagtctgagtccaaggcccgagggcaggagaagatggccatcccagctcaaacagaagcaaattcttcttccacctttttgtccttttcaggccctcagattggacagtgctcacccacactggtgtgggtgggtcttctgtacgcagtttactatactaattcaagtgccaacttcttccagaaacgccctcacagacacacccagaaatcacatttaccagctatctgggcacccccttgcccagtcaagttgacataaaattaaccatccaccatgtgacaactgaggcagagctcgaagtgctgcagcttcaagctgaggaaagcaggactgtgaccccacaccagatgctgctaggagagcagcgagggaggggcctcctctcagccttcagaggaagcgcagccctgtggcaccttgccatccggcctccagagctgtgtgaatgcatttctgccatttgtagcatgcaatttgtggtcctttgttacggcagtggaaccccagcgcagcccccgaccacagtgtctgggcaagtgggagggagggggtagacaagcaaccagatcccacagttgggttttgcttagtgattccaaagagagacccaaccaagggcccaggcttctacccctgggctttcaaggaagtgacagaagctacacagcttggccaggcgcggtggctcacgcctataatcccagcactttgggaggccaaggcagatgtttgagaccagcctggccaacgtggtgaaaccccatctcagccaaacatgcaaaaatcagccgggtgtggtggcacatgcctgtgatcccagctactcaggaggctgaggcaggagaatcacttgaaccagaggcagaggttacagtgagccaagattgcacccctgtattccagcccaggtgactgagcgagagtcctataagctacacagctctggcagcctcatgtcataccctctcctgtcctacctacaagaggggagggaattcagagcacatatcctgataggcaaaatgcagtgattcccacccctgtcacccctgaagcagcgagggtgtgcatttgaaatgcttgcaggtgaggactctggcatctcaccccccagctgggagccagccaagctacattccctgcagacagtcctgctgtctccctgggagcagagcgatccttggggctgggcttattgtccccgaaggtgggctgtccagatgaacgtggagacgatgcccaccaccttgggtatttccgaatgtgggagcccatgagagcagcaggcaccaaactagtaaggaggcaggcagggtggcaggcctggggcgagaacgccctgggtggggcctgcagaaactggagctctctccttcgaactcatttagaggtgcaggcaggggtcagggagtagaccaggggccgaggtgcccggaggccagccatgtagggccgtgaggctggtgaggtttgagagtcagggaccctgaccttcacgccctttctcagggccctgggagggaccccagaaatgtacttgcagagtcatgtgacataatttacataccttaaataaatacacatatctctacatttctctccataccatctgtccatctatctacagtctgccagggctgccaaaacaaaatactacagcctgggcagcttaaacaatggatttttttctttttttgaggcaaggtcttactctgttgcccaggctggaatgcaggggtgcgatctcggctcactgcaacctctgtctcctgggttcaagtgattctcccacctcaccctccccagtagctgggactacaggtgcccaccaccatgctcggctagtttttgtatttttggtagagacccaaaatacaaaaatacaaatttttttcactatgttggccaggctggtcttgaactcctgacctcaagtgatccacctgcctcggcctcccaaagtgctgggattacaggcgtgagccaccatggccggccgacaatggaactttatttctcacagttctggcggccggaagtctgaaaaggggtgtcagcaggcttgggttctccagaggccccctccttggcttgtagacgctgccttctccctgtgtcttcacgttgtcttccctgtgtgtgtcctgatctcttatgagggtatccgtcagatgggattagggacctcacactctagtgaccttatttaaagactccatctcgaaatacagtcacattttgagggataggggttaggacttcaacatatgagttggtgggggcagggacacaatttagccaaaagtaaacaaagaaaacatatttctatattaaaatatacattgtgtgtgtgtgtgtgtgtgtgtgtgtgtgtgtgtatccttgtaccttaaagaggagcttaaagaatgtgcctgttgggccctgcaaaccttcatgtgcctctgcctggatcccagcagagcgagcaccccgtgggcgctgcggggcacgtttggctgcagaggcagcgcctgagcagggaggggtggcgagcaaggccctagccgcctcctgcctttcagtctcctgccagcagctcccactggcggcttcctgcaggaactggcgggaagggggtgatgtcccaggcagagcacagcactgggcggccgatggaggttcatggcacagcccacgtttgcactctgcgtcctgtcctcggtgactgtccttccctaagagaaagaatttctaaccccaaacggaagaaaccacagcggcacttcccacagaaatcggagctgtgttgtgagccactagtaatccctccttagaggtggcagggaagaggatcaaaggaaatggtaaattaacctgcaatacgctgcgtccgggaatagaagctcctgctgcggctggcccactcctcatccctgcaccatggaggctctcccagaggcatgtcaaaaccccagcctgacgaccaagctctgtccactgcccaccaccaacagccaccacttgagcctagatgtgtgcacgcagcggcggcgtccacccaggaggcagaccccaggaagaggcctgccgtctgggaagcaggctcaggcctgtgtgggcagcaacctagacggaaggggctaggtgctgaggggccatgtcccttgagctggaggagggcacagcaaggaactctgcagcatggacctcaggacagagctcctgggtcggggcattgccggcctgcaacgcaggagcgggtcgggggcccgcactggtgagtacagctccagcgttggtgtgctagggccactgtaaggaggtgcctccaacggggcgtgaacagcagcagcgtgtggtcccagttctggaggctccagctgtccacagggctggttgggtctgaggcagttgtggggaacctggcctctcctccactctcgtggggtttgcaggccatctttgctgttccttggctggtggaggcagcgcctcaatctctgcccgaatcttcacatggtattctccctgcgagctgtgtccaaatttcccgtctttataaggacacagtcacacaggatcaggggcccacactcccgggatgactcaccctaacttgatggatcacatctgcaaagaccctatttccaaacaaggtcacattctgaggccctgggggttaggccttcaacatatgaattcgaggggacacaattcgacccgtaacagcttctgtctccccacacatccgatgtgcttctccctctgccacgcttaggctggggtctctaccaggcacctcgacccgagtcctcactcaggccggctctgagcctcacagctctgtctgtgggagctgccctagttttccacggacctttattaggtgacatgggaatatcgagcagtgccccagaatccctgggttttgacacagtgcttcctcctcacctgaggcagcattcccaccctcctgcagggatctctccgaagagattcctctgcagagatctctggcccgcggagctcccttctccagcggtcagctcggcagtgagcggccccacatggccagagggcatctctgctcctgtgtttgggaagcagacccacgttccccagaggaccgggagccaggactgccactcctgcgaccccaccttaccagagtgggaaagaaaaatccctccatagccgattagctgtcacggccactctgtgtaaggactgcagaggcgtggcaaggccgtgactggcgtccgtccacagaagccctctcacaggcatggccacctccagttcggcattctggcggtggggaaacggcctcctaggtcggtcccaggttagaagcctgttctgccccccacaggcctgcatctcagtgttaaggggtgcagtctccccgctgcaaccattccaccagtctgttaggcctcctgcttctaggtgaagggcgtggagtgagaccagtggaactgatggacacaagcttatcgccacactggttttcctctgaaacaaggccctggattacaagtgtcatttgtggaatcccaaggcagcgaaggaggccaaggatggcatgctggcgggagaagcctgcgaggacccgtccctttgaggatccatccctgcaaggactggctctcgacaaaaggcacgccgtgtgctctgcctgcttcctggaggctggctgccctccccacagggggtggtgccacatcagggctcagacaccatcctcgctgttggaaagatgggcgcccagctgtccatgctgctggaagggtctggtgggggtgaataggctacggagcctgtgtggccaccatgcctgtggcctcagccactttgtgcaaaggactgcagaggcgtggcaaggccatgatgtgtccgtccaccgaaggcctccctggttttgagcccctcctctgcagggaatgcttccagcattttcatggattacaaatgtcttagcccctgccctttcaagcagttccttagctcccctccccagtccacagagccatctcctgcctgtgagttaggcctaatcaacgtaaatctgtcctccaggccctcccttccctccagatgaggtgcgcaaccagtggtgctgctggacgtttgaaaatacaaaaggccgggcgtggtggctcatgcctgtaatcccagaattttgtgaggccgaggcgggtggatcccaaggtcaggagttcaagaccagcctggccaagatggtaaaaccctgtgtctactaaaaatacaaaaatcagccaggcgtggtgacgggcacctgtaatcccatctactcaggaggctgaggcaggagaatcgcttgaacctgggaggtggaagtttcagtgagccgaggtggtgccagtgcactccagcctgggtgacagagcgagactcctgtctcaaaaaaaaaaaaaaaaagaaaaagaagaagaagaatacaaaaattagctgggcatgggggcacgtgcctatagtcccaactattcactgggaggttgtattagtccattttcatgctgctgataaagacgtatttgagactgggcaatttacaaaagaaagaggtttattggatttgcagttccatgtggctggggaggcctcacaatcatggcagaaggggaatggcacatctcacatggtgacagacaagagagagaaggaacttatgcagggaaattcctccttataaaaccatcagatctcatgagacttattcagaatcacgagaacagcatgggaaagacctgtccccatgattcaattacccactgggtccctcccacaacacatgggaattcaagatgagatttgggtggcgacacagccaaaccataccagaggctgaggtgggaggattgcttgaacccaggaggcaaggttgcagtgagccaagatcatgccactgcactccagcctgagtgacagagcgagacccctatctcaaacccccccccaaaaaacagatacaggtggatgattggatgggtcagggatggatgaatggttggatgggtggaaggatggatacagggtgggtggattgttggatagatggtgggataaatattcgggtggtgtatggttggatggatggtaggatggtggatggtggataattggctggatggatagtaggatggatggatgttggatggatggatgaacagtggggtggtagatgggtagataaatggttggatggacagtaggatggtgggtggttggatggatggattgatggatggatggatggatggagggttagatgaatgcatattggctggatgatagaatggtggatggatagatgggtggtaggatggtagatgtttaggtaaatggttagatgggtagtagaatggtgaatggttggatggatagattaatggatggatggtaagatggtggatggttggatgaatgtttggatggatcgtaggctggtggatggttgcatggttgggtgggtggatgtatggttggatggtgaatggttggatgaattgatggatggatggtaggataggtgaatggttggatggatagggatgattggatggatggattgatggtggactgatggatggatagatggttggtagatgataggttggatggacagttgaatggttggatggattgatggatggttggttgggtggatggatggatggttggacagatggttgaatagatggtatgatggggttaaggacagatgcataggtggtggaaagatggatgtttaaagatggttggctaggaagataattggatggatggaggatcccccagggttgctacctgagcaaactctgggaggtttggaaatcttgatcacaggggtctgtgggcctgtcctgtggatgagaagtcaagactggagaggctttgacctgggctggttttagggataggggccactgtgaggacagagatgcagaggcacagacaaggaactgggtggaggtgcactctgcaggatttctggtgtctgatggagatggttatttgtggactccagatgattctagaagtccccaagactcttctgggtgggattcatgaaggcaggtggcaggttccccagcttaaaagccaatagaaaagtaaagaatcgggccgggcacggtggctcacgcctgtaatcccagcactttgggaggccaaggcgggcagattacgaggtcaggagatagagaccgtcctggctatcacggtgaaaccccatctctactaaaaatacaaaaaaattagccaggcgtggtggtgggtgcttgtagtcccagctactcaggaggctgaggcaggagaatggcgggacccgggaggcggagcttgcagtgagccgagatggtgccactgcactccagcctgggcgacagagtcagactccgtctcttaaggaaagaaaagaatcggaatgacagataccggcagtctgaggattggcggagatggcctcgctgactgggaatatttgagcagaggcaggaaatggctggggcggagggactggcaggagcagaagcctgatgtggggcttggggcgtgctggggcgtagcgaagtggcaggagatcccggagcaccggcagggaggggagccagagggagaggaaggtgtggaggccttatggagctctcctggggtcttggatgttcactccgagtgcgatgggagctgcaggaaggtttgatccccggagagaccagatcgggcttgagctctgaccgcaacccctggcgctggttggagggcacacgggcaaggcggtggtgggagcgctgcggcagtgcaagaccacagagcagggggatatgcggggggtgggctgggagggctaggtggggcgtctgacgaggctggggaactcctgttcttaagctcaggccggggtgagcactgtccctaggagggtgtggccaatcctcgccctcaaggcactgcggcatgaatgaagcgctttaaagggagttcccaaaatgaaatccctaagcgaaaggtctggtccttctgggaagcggagcagactgcgacagctggcgttggagcggggggcggtcccaagtcatcctcaggccacccgtggccagccccaagctctctgcggcgaggagcgctagccccagagcctggcgtcctgctggggaggcgcctttcccgcggcgctgggcgccctgggcatccgggaggagcacccgtcccgccctctccccgcgcccggctccgcactccccgccagccctgcgccccgctccccgcgcgccccctggcggcaaacttcgcaatggctcccgccgcgctctgcttttcggggttgccggaggggcggggctgccggaggggcggggctgccggagggggcggggctgccggagggggcggggctgccggaggggcggggctcgagtgggaatgcaacccttggacacggtggatcctgggaatctaaccttccgtcccggggctgatgagctccagccctgccccaggaactgtgctgggggcccctggggatggggacgcaagctcagagggcggagacctcgggcgccccggcttcgtccgcaaggcgagacgggccgcaggggactgctagggtctgcaggggggtctgcgggggtgagggggcgggtgggctcggaggatggccccgggctcccagggaagctggaagggcgtcgggggaggtgacggcgcggagacctcggactctcagtcctgcaggggccgcggacacaggtggggaggagtgggggagtttttccctgggagaaatgggaagcgtcgaaggattttaaggagtgcggctggtcgggtttgcattcggggaggtcgctttgtctcttgagtggagaatgaggaggtggcaacagcaggggagtcaccgggaggctgctcgggtccagctcaaaaacgccaggcccgcccccgccccgcaggtccgcgggaaggaaggaaaaggcgttggggatgcgtaggaggcagaggccttggtggtcgatccggtgtggagtggggcaggggctgcgaggagggcgcccaggactggtatcagtgaacagtgacggtggggcagggcggtgaccttagcaccagcgcttcggtgggggggaggaagcacctgagccgcggagaaaggcctgcgtgaggtgggcacaggctggcgttgaagccctggggtggactcacgtccaggggagggcggtgcttcacacgtcccaggcactgtcttgtgtggccccaagtgctgtctgaatctctcctgcgtcttgggccccagcaccaacagccgtcgccctggagccaggcagcagccttaagcttccctgggaggctgactggctgggagcagggaggtcccatcggggaagtaggggcgtgcagggggcttggcgcctgcagtcctggaggggcagggcagatgataaggctaagtacctcctgtcctttgctcagccagccactaggaggaggccgcagagaagaagccgccaggggctgggggaggccagggacggggcagggaggaggggctgggctgaatgcaggtgccccaggagctgcgggctctccttccacaggttcgtgtctggtacacggctggagaaggcagggagggtgggaggagcctggcttggagagaaagggctggccggagacaccagagtgctcagggcaggggcgggagaggtggtccctcaggcctcagtggcagaggcatggggatccagggctgagagtgagtctgtggttcatggggttaccagaaaggggtcctgatccagatcccaagagagggttcttagatctcacgcaagaaagaattcagggcgagtccacaaagtaaagcgaaagcaaatttattaagaaattagaggaataaaagaatggccactccatagagcgggccagagggctgctgggtgaccatttttatggttttatttttattatatgataaacaaagggtgtattattcatgactctcctttttagaccataaggggtaacttcctgatgttgccatggcatttgtaaactctcatggtgctggtgggagtgtagcagtgaggacgaccagtggtcactctttttttttttttttttgagacagagtctcgctgtgtcgcccaggctggagtgcagtgacacgatcttggctcactgcaggctccgtctcccgggttcacacctttctcctgcctcagcctcacgcctgtaatcccagcactttgggaggccaaggcaggcggatcacgaggtcaggagattgtgaccatcctggctaacacgtgaaaccccgtctctactaaaaattcaaaaaattagccaggcgtggtagcgggtgcctgtggtcccagctactcgggaggctgaggcaggagaatggcatgaccctgggaggcagagcttgcagtgagctgagatcgcgccactgcactccagcctgggcgacagagggagactccatctcaaaaaaaaaaaaaaaattttaaaagaccaggtgcagtggctcacgcctgtagtcccagcactttgggaggccatggtgagtggattgcttgagcccaggaggcagaggttgcagtgagctgagatggggccactgcactccagcctgggtgacaaaacaagaccctgtctcaaaaaataaaatatttaagcttattttgtgtgtgctatggtttgaatgtttgtgtccatccaaaattcatatattggaacttaagttgcaaagtgatggtattaagaggtagggcctttgggaggtgaccagggcagggcggacgggattagtgctcttacacaagggcttgaggcagcgggttcttttctttaggccttttggccccttcctctatgtgagggcacagcaagagggtgtaatccctcccagacaccacatctgctggccttgacctaggacttccccgcccctaaaactgtgaggaatacatttttagtatttataaattactcagtctgtggtattttatttatttatttgagatggagaccagcctgggcaacatagtgacacctcatttctttaaaaacaacaacaaaaaaattaagggaaaatcagccaggcatggtggcatgggcctgtagtcccagccactggggaggctacagtgggaggatcccttgggttgggcctgggagtccgggccatgatgatatcactgcactctagcctgggtgacacagcaagaccttgtctcaattaaaaaaaaagaaaagaaaagaaaagaaaggcatagatctttactgcaagacgcccacagaatgctgtctacatgccatgcctctaattcctcttctttcattctctttttaaaaacttttaagattgagatataattcacataccataaaattcatctttttttttttttgagtcttgctctgtcgcccaggctggagtgcagtggcgcagtctcagttcaccgcaacctctgccttccaggttcaagcaattctcctgcctcagcctcctgagtagctaggattacaggcgtgcgccaccacacccagctaatttttgtatttttagtagagatggggtttcaccatattggccaggctggtctcagtctcatgaccttgtgtctgcctgcctcatcctcccaaagtgctgggattacaggtgtgagcaaccgcacccagccttttaatttctttaaatgacgtttaatagtgttcagtgttggctgggcacagtggctcacgcctgtaatcccagcactttgggaggccgagatgggcagatcacgaggtcaggagatagagaccatcctggctgctacggtgaaaccccgtctctacttaaaaaaaaagaaaaaaaaattagccaggtgtggtggggtggcgggcgcctgtagtccctgctactcgggaggctgaggcaggagaattgcttgaacctgggaggcagagcttgcagtgagccaagatcgcgccgctgcactccagcctgggtgagagagccagactccgtcgcaaaaaaaaaaaaaaaaaaaaaaaaaaaaaatatatatatatatttggtagaattcaccagtggagccaaaagggctaaggttttctttatagagaggttatttttttgtttttgttttgttttgtttgtcactaatttaatcttcttactttaattttctccagagaatactttttcttttttctttttttttgagacagagtctcaccctgtcgcccaggctggaggacaatggcgttatcttggctctctccaacctcccaggttcaaacaattctcctgcctcagcctcctgagtagctgggattacaggcacctgccaccatgcccagctaatttttgtatttttagtagagatgaggtttccccatgttggccaggctggtttcaaactcctgatctcgtgatccgcctgccttggcctcccaaagtgctgggattacaattgtgagccaccgaacccggccgagaatagtttttcttaagtccttaaggactcagctccttacatgagctttgatggtggttgtggggcagcacagacaggtctaaatccaggtagggttgtttggtccttgcaggctgcacgacatggattcctgactgccttgctgtgaatcgcacaactcacacagcagtgtagcgtcacgtgcagcttgggaagcacgtaggctttgaagatgcttgtttcagaaacgttactgactgctgtggcctctactgcttcaaatgatgaatttgttaacagccttgtctttggacacagtttgtgcagcaaataggctgcacatggccatggccctttttggcacaaccagtgttccttcttttctttgtcatcttgaaggcacagacccaagagagttatctttttacttcttaaagtcctattcagctttttaaaatttcttcttggattagtttcattagtttgtgacttttcggaaatgtgtcagtttcatatagactatctcatttattggcctccagttattccgagcatatcatcccttctatttcctgaaggtcagtcctactgtacctactttcattcctgattttattaatctaaggcttttctattttttttttttgtaggtcagtacaacttaaggtttgtcaatcttattgattttatcaaagaattcacttttggtttcactgatttttctctattttttattctccatttttatttatttatttatttatttttgagatggagtcttgctctgtcacccaggctggagtgcagtggcacgatctcagctcactgcaacctccacctcccgggttcaagtgattctcctgcctcagcctcccgagtagctgggattacaggcgcctgccaccacgcccggctaatttttgtatttttagtagagacgggggtttcaccatcttggccaggctggtctcgaactcctgacctcgtgatccgctcgccttggcctcccaaagtgctgggattgtaggcatgagccaccatgcctggcttgttctccattttatttatttccactgtcacctttgttatttcctttcttctttctgctttgggtttagtttgctttttctctagtttcttttcttttttttttttttttttgagacagagtctcgctctgtcgcccaggctaaagtgcagtggcacaatcttggctcactgcaagctccgcctcccgggttcacgccattctcctgcctcagcctcccaagtagctgggactacaggtgcacgccgccacgcccagctaattttttatatttttggtagaggtggggtttcaccatgttagccaggatgatctcgatttcctgacctcgtgatccacccgcctcggcctcccaaagtgcgggatacaggcctaagccaccacgcctggtctaaatttccctatttagccactttagctacatccataagttttggtatgttatgcccccactcgctttcatatcaaagtactttaaattttttcttgacattttttatttgactcattggttatttagaattgtgttgtttaatcgtcacctatttgtgaatttctcaaatttccttctgttattgattcctaattttattacattatgattggagaacacactttgcatgacttcagtccttttaggtttattgaggtgttttttttggcctaacatatagtctatccttgagaaccttccatatgctcttgagaagaatatggattctgatattgttgtgtggaccattttttcaagatctgttaggtttagtttagttgatttatagtgttgttgaagttgtctacttcctcgttatcttctgttagttgttctatccattattgaaagtgaggtattgaaatctccaactaggcctgcgtgtggcagctcacgcctataatcccagcactttgggaggccaaggtgggcggatcacctgatgtcaggagtttgagaccagcccagccaacatcgtgaaaccccatctctactaaaatacaaaaattagcccggtgtggtggcaggcatctgtaatcccagctacctgagaggttaaggcaggagaacggcttgagcctgggaggcagaggttgcagtgagccaagatggcaccactgcactccagcctgggagatttagcaagactctgtctcaaaaaaaaaaaaaaaaaaaggaaggaagaaatctccaattaatttgaattatctatttctcccttcaattttgtcagttttttttttttgtttttttttttttttagacagagtctcgctctgtcgcccaggctggagtgtagtggcaccaccttggctcacttcaacctctgcctcccgggttcaagtgattctcctgcctcagcctcctgagtagctgggataacagacaggtgccaccaagcctggctaattttttatatttttagtagagaccgggtttcactgtgttagccaggagggtctcgatctcctgacctcgtgatctgcccgcctcagcctcccaaagtgctgagattacaggcatgagccaccgtgcccagccagtgcatatgtgtttctagttattatatcttccttatggatcaccctcttatcattataacacatccttctttgtctctaacaataatttttgtcttaatatctatattttctaatattagtagaggaactccacctctctttgagttgctgtttgaatgttatatcttttcctgtcattttactttgttttttggacggagtctcgctctgtcgcccgggctggagtgcagtggtgcaatcttggctccctgcaagctctgcctcccaggttcacgccattctcctgcctcagcctcccgagtagctgggactacaggtgcccgccaccacgcccagctaatttttgtatttttagtagagacggggtttcaccgtgttagccaggatagtctcgatctcctgacctcatgatccgcccgcctcggcctcccaaattgctggtattacaggcatgagccaccgcgcccggcctcctgtcattttacttttaagatattgtgtctgaatctaaactgtgtctctagtagccatcatgttttatacctagcagatatagttggattatgttttttaaatctattctgccaatctttttcttttaattagtgtttaatatattaatatttactataattaccagtggtgggattgaggtctgccattgtgctatttgttttctctctgtcttgcctgttttgttcctcctctattcctccatattgcttcttttgtgttaaatatatattctctaatgtgccatttaattctttttttttttttttttttgagacagagtctcgctctgttgcccaggctggagtgcagtgacacaatcttggctcactgcaagctccacctcccaggttcatgcaattcttctgcttcagcctcccgagtagctgggactacaggtgggtgccaccacccctggctaatttttttttgtatttttagtagagacgggttttctccatattggttaggctggtctcgaactcctgacctcgtgatccacctgccttggcctcccaaagtgctgggattacaggcgtgagccaccacggccagcctccatttaattcttttgtcatttcttttgctatatatattttcaaatttatgttttattgaggtaaaatttacataacataaattttgcccaggcgtggtgggtcacgcctgtaatcccagcactttgggaggccaaggtgggctgatcacctgaggtcaggagttcaagaccagcctggccaacatggtgaaaccccgtccctcctaaaaaatacaaaaaaaattagccaggcgtggtggcgagcgcctgtaaccccagctacttgggagattgaggcagggggaattgcttaaacccaggaggtggaggctgtagtgagctgagattgtgccactgcaccgtggcctgggcgacagagcgagactccatctcaaaaccaaacaaacaaacaaaaatttaccactataaccgttttaagtgtacaatttagtggcattaagtacatccacaatgttatgtaatcatcaccactatttccagaacttttttgtcatcccaaattctgtgcccattaagcaataagtccctctccctcccttccctctaggcctggtaacctctattctagtttctgtctctataaacttgcctattccagatgtgtcatataagtggaatcatataatattggaactttaatgtctggcttatttcacttagtagaatgttttcaaattctcccatattgtagcatgcctcagaacttcattccttcttatggctgaagcatattccatttatgtgtttagaccacattttgtttattcttttatctgttgatggatacttggcttgtttccacatttggctattgtaaataatgcgttatgaacatcggtgagcaagtatctgtgtgattcctccttttcagttctttttttgtttctttgttttttgagacggagtcttgctctgtagcccaggctggagtgcagtggccccatctcggctcactgcaagctccgcctcccaggttcacgccattctcctgcctcagcctcccatgtagctgggactacaggtgcccgccaccacgtccggctaattttttgtattttttagtagagacggggtttcacgtgttagccaggatggtctcgatctcctgacctcgtgatccgctcgcctcgcaaagtgctgggattacaggcatgagccactgtgcccggccaagggttttaatttcttactacccttaccagcatttgttattttgcttcttttgaaaaaattatagccatcccaatgggtgtgacatggtatttcattgtggttttattttgcatctccctagtgactgatgatgttgaacattttttgtgtgtgcttgttgaccatttatctgtcttctttggggaaaggtccattcaagtactttgtttatttgtaaattaggttgtttagggagtttttgtttcggagttacagcaattctaatatgctgcatattaatatcctatcagatataggatttgcaaatatctcattttgtgagttgccattctactctttttttttttttcaggcttaattcactttacttctcttgtataaaaaccctatgttgtagccacagcaggagcctgggtccactgcacggagactctggtgtgggtcttgacgaggtggtcagtgaattcctgatagggagacttggtgaatacagtctccttccagaggttgggggtcaggtagctgtaggtcttagagatggcatcaaaggtggccttggcgaagttgcccagggtggcagtgcagccccgggctgaggtgtagcagtcatcgataccagccatcatgagcagcttcttgggcacaggtgcggagacgatgccagtgcccccgtgtgcagggatgaggcgcgccggcacagagccgcagcggcctgtcaccttgcaagggacggtgtggggcttgccgatcttgttcccccagtagcctctgtgcacagggacaatggagagcttggccaggatgatggccccacggatggcggtggccacctccttggagcacttaacacccagaccgacgtggccattgtagtctccgatagcaaagaacgccttgaacctggtgcgctggccggcacgggtctgcttctgcaccagcataatcttcaaaacctcatccttgagagaggcccccaggaaaacgtcaatgatctcagattccttaatgggcagggaaaagagatagatctcctccagggacttgatcttcatctccttgaccaagcggcccagcttggtgacaggcatccactccttatcctcagccttgcctccgcgagctccgcagccttggccctggccccgtccacggccgcgaccccggccccggatgccactgccgaaacctccgcggaaggcaccacggttccccatcccagggccaccagggcctccggcaccccccccccccccccctgcaccggcgtcatccgccatttggtgttttctcagacaagaagcgccattctactctttttaaaaattctttttattgttttttaaatttttttattatactttaagttccagggtacatgtgcacaacgtgcaggtttgatacataggtatacatgtgccatgttggtgtgctgcacccatcaactcgtcatttacattaggtatttctcctaatgctatctatccccctccagccccccaacccccaacaggccccagtgtgtgatgttcctcgccttgtgttcaagtgatctcattgttcaattcccacctatgagtgagaacatgtggtgtttggttttctgtccttgtgatagtttgctgagaatgatggtttccagcttcattcatgtccctgtaaaggaaatgaactcatcctcttttatggctgcatagtattccatggtgtatatgtgccacattttcttaatccagtctatcattgatggatatttgggttggttccaagtctttgctattgtgaatagtaccacaataaacatacgtgtgcatgtgtctttatagtaacatgatttataatcctttgggtatatacccagtaatgggatcactgggtcaaatggtatttctagttctagatccttgaggaatcaccacactgtcttccacaatggttgaactagtttacactcccaccaacagtgtaaaagtgtttctatttctccacatcctctccagcacctgttgtgtcctgactttttaatgatcaccattctaactggtgtgagatggtatctcattgtggttttgatttgcatttctctgatggccagtgatggtgagcattttttcatgtgtctgttggctgcataaatgtcttcttttgagaagtgtctgttgatatcctttgcccactttttaatggggttatttgtttttttcttgtaaatttgtttgagttctttgtagattctggatattagccctttgtcatatgggtagattgcaaaaattttctcccattctgtaggttgcctgttcacactgatggtagtttcttttgccatgcagaagctctttagtttaattagatcccatctgtctagtttggcttttgttgccattgcttttggtgttttagtcatgaagtccttgcccatgcctatgtcctgaatggtactgcctaggtgttcttctagggtttttatggttttaggtctaacatttaagtctttaatccatcttgaattaatttttgtgtaaggtgtaaggaacggatccagtttcagctttctacatatggctagccagttttcccagcaccatttattaaatagggaatcctttccccaatgcttgtttttctcaggtttgtcaaagatcagatagttgtagatatgcggcgttatttctgagggctctgttctgttccattggtctatatatctgttttggtaccagtaccatgctgttttggttactgtagccttgtagtatagtttgaagtcaggtagcgtgatgcctccagctttgttctttttaattaggattgtcttggcaatgcaggctcttttctggttccatatgaactttaaagtagttttttccaattctgtaaagaaagtcattggtagcttgatggggatggcattgaatctataaattactttgggcaatatggccattttcatgatattgattcttcctatccatgagcatggaatattcttccatttgtttgtgtcctcttttatttcgttgagcagtggtttgtagttctccttgaagaggtccttcacatcccttgtaagttggattcctaggtattttattctctttgtagcagttgtgaatgggagttcacttatgatttgactctctgtttgtctgttaatgatgtataggaatgcttgtgatttttgcacatcgatttggtatccagagactttgctgaagttgcttatcagcttaaggagattttgggctgagatgatggggttttctaaatatacaatcatgtcatctgcaaacagggacaatttgacttcctcatttcctaattgaataccctttatttctttctcttgcctgattgccctggccagaacttccaacactatgttgaataggagtggtaagacagggcatccttgtcttgtgccggttttcaaagggaatgcttccagtttttgcccattcagtatgatattggttgtgggtttgtcataaatagctgttactattttgagatacattccatcaatacctagtttattgagagtttttagcatgaagggctgttgaattttgttgaaggtcttttctgcatctattgagttaatcatgtggtttttgtcattggttctatttatctgatggattacgtttattgatttgcgtatgttgaaccagccttgcatcccagggatgaagctatcctgattgtggtggataagctttttgatgtgctgctggattcgggtattttattgacgattttcgcatcgatgttcatcagggatattggtctaaaattctatttttttgttgttgtgtctctgccaggctttggtatcaggatgatgttggcctcataaaatgagttagggaggattccctctttttctattgattggaatagtttcagaaagaatggtaccagctcctctttgtacctctggtagaattcggctgtgaatctgtctggtcctggacttttttcggttaatagactattaattattgcctcaatttcagagcctgttattggtctattcagagattcaacttcttcctggtttagtcttgggagggtttatgtgtccagacggagtctcccttgttgcccaggctggagtgtagtggcatgatctcggctcactgcaacctctgcctcccgggttcaagcaattctcctgcctcagcttcccgtgtagctgggattacaaggcatgtgccaccacacccagctaatttttgtatttttagtagagacagggtttcaccatgttggtcaggctggtctcaaactcctgacctcgtgatccacccgcctcggcctcccaaagtgctaggattacaggcgtgagccactgcaccaggccttattctactctttaaaaaaaaatctttttagagacagggtctcattctgttgcccagggtggagtgcagtggtgcaatcttggctcactgcaacctctgcctcccagtttcaagccaattctcctgcctcagcctcctgagtagctggaattacaggcgcgttgccaccacacctggctaatttttgtatttttggtagagacagggtttcaccatgttggccaggctggtctcggactcctgacctcaggcgatccacccacctcagcctcccaaagtgctgggattacaggcgtgagccactgtgcctggccaagtttcgtagttttagctcttacgtttaggttttttgatccatttttgagtacatttttgtatatagcataaggttaggatccaacatcattcttttgtgtatggatatccagttttcctagcaccatttgttgaacagactgtcctaccccccattaaatggtcttggcaactttgccaaaaatcatttaaccaaatatgcgagggcttatttctagattctctagtctactccattggtctatatgtcactccttatgccaataccacattgttttaattactgtagctttgtagtaagttttgaagtgaagacatgtgagtcctgcaactttatctttcttttttacaaacgattttgactatttgtggtctcttgcaattccatatgagtttgaggatcagcttttctatttctgaaaaagtaaaaatggctgttggaattattttttatttttttggagatggagttttgctcttgtcccccaggctggagtgcagtggcgcgatctcagctcactgtaacctctgcctcctgggttcaagcaattctcccgcctcagcctcctgagtagctggaattacaggtgcctgccaccatgcccagctaatttttgtatttttagtagagatggggttgcgccatgttggccaggctggtctccaactcctgacctcaggtgatctgcctgcctcggcctcctaaagtactaggatcacaggcatgagccaccacatccggcccaggctattggaatttttacagagactgaggtgaatctgtagatcattttgggtagtagtgacatcttaacaatgtttcgtcccccatccatgaatatgaagtatctttccatttatttctctctttaattgttttccgcaatgctttgtagttttcagcatctaagtctttcacctccttggttagatttattcctaagtacttaattatcttagatgctatcgcatgcagatggagttgttttcttaattttcttttctttcctggattattttttatcttagtacctgccactacctaacattttaaatatatttatttgtctctttctgtctcatttactgaataaatcttccataaggtctaaagatttttatttgcttattgccttagtctaggatctgaaaacagtgtcaggcacatggtctagtatgtatttgttgagtgcactaatgatgaaggaacaatttactaatttagcattctctttatttatgatttttttcttttgccattataaaaaaatgcgtcagggattgctgggtcaatgtccatttgccttcttaattgtgtttgcagttgagaggctgcttcccaaggtgattgttgtaatgattttcatttccgccatcagcaaatgagggtccctggggccctcacacctctgggagcactaggtgctaggttgtcttctgtgtctgacacctgggggtagatccctgtgtgagcagtgctttagctgacacttccctgatggctagtgaattagaacttcttcaaatgtttgttaaccatttcatattgctcttctatgaattgcttatttataacctttgctcatttttctatttcattcccttctttccttccttccttcctttcttccttccttcctccttcccttcctccctccctccttcctccccttcctccctccctccctccttccctccttcctccccttcctccctccctcccttactcccttctttccttccttccttctcctctctttctttctttttgacagggtcttgttctgtcacccaggctggagtgcagtggcacgatcatggctcactgcacctcaaccacccaggctctagcaatcctcccatctcagacccccaaatagctggggactaagggtatgtgccatcgcgcctggctaatttttgtattttttgtagagacagagtttcgccatgttgtctaggctagaactagtctcaaactcctggactcaagcgatctgcccacctcagccttccagagtgctaggattacaggcgtgagccattgcgcctggccacacttttcttttttgttcttttcttggctgttcttcagcatttattcttccatatacactttaagatagttttagtcattgaaaagatctggggttctacctggtattgctttcttttgtccagatattgctccatatcattccatgttttcttcctataggttctgtgccttccttagtgattttcttaagctttttatatttctttgtcgctcttctggatgggatagatttcccattgcctttgccagaagctcattattggaatggaaagaaagattgatcattgagcatacttcttctcttctcaatttaccagattattttattaaggccagcagtttttacttgagtctcttagatcgttcaggtgttcaagcatatcatcatcaagaagaagagcttggccaggtgccgtggctcacacatataatcccagcagtttgggcagcggatacaggaggatcacttgagcctaggagtttgagaccaatctgggcaacatagtaagaccctcatctctataaaaaaatgtaaaaataaaaaaagaaggggaagctctgtaatccttttttaccaatgtttacgccaattatttcacttttattatgtgcacaagtgggtggctaccttctcctctgtaccatctgttattgggggctgggggctcccgcctttccctgtgctgtggaataagtgcattgggtcagacctgtctgttctctgcaggtaagcagagccctgctctcctcctcctccccactgcctttgctcatggcctcggccgggccctgctggaaacaccaggtgctcgctcccagcagaggtttgaacctctgtccctgcaagcttgggggttggggtcctggcagatgaggtaccaggaggccctttgggggaggcccaggctctttgactgatggtctgcgggtgtgagcccccaagttctaggcctgggggccgaaaggaagaagcttcgaggaagagtcaagcaggccaccttgggcatacgtgctgtcaccccgggatgcccgcccagcgcgccaagccccccacgctcacctgtaagtgcaggtggtgctggaggccaggccggggccctgcaggggcaggcacacagtggggctccgtcgccgcagcgccccggcggcctcctcctggccgctggccctcccctaaggcttcctcatcctaaacagcaagtgaagccaaacgaaaaccctgtctctcccgccgttccctccctcctggcctccgtcccccgggctcgcctgccccgccgcccggcggaccggtcccttcctgctttccctggcgggtgctttccgctgctctgttacccggagccaggacgcgcatatattcccagaatccgcgctcagtgcgttcggtcccccgggacacctgttctctgcacaggcgcgtctgggcgcagcgggggcagacacgcgttcccgggcagcgactccggaaggcccgagggagtaaatctggccctcccggttcagcacaaagctcccctggccgcctttcaaaaccgaccgcctcccaactctccgcggacacgagtggcggctgcctcccctcccctcccctagggccgcgcacgcctcccgcagggtctcagtgcctcctgggcgggggataattcctgtccccaccggtgtcctgtactcgcggggtcccgggtgtaagttctgggtcccgggctggctccctggtgagcaaagccgcatcgctcgaattccagaaacccttctcgccgagcgcctgcctggctgctgaaagcctggagactgcgctctcggaggtggatttcggaactcaggagagaagaatgagacgctccctagtacccctagtcccccaggggtgggaggggactgtatctcaaaataagattctgcaactcgacttttataggggaaaccaggcacgcatttcaaaatcttctcatccgtccccacctccttgcgccgcttttccgcgcctcctgtgccacggaagctgccctctgctcctgctgtttccagcccggcagcccccagacaggatctagcttggcccagccgggccctgcttcctctgcctggggtcctcaggccatgcaagtgaggaaacccaggctcagaggggccacgtaactcttcccaaatcaccagcaagcctggtgcagccacggtggcgcgcattcgcccactcggagaccgagaggcaggttttctgcctgcacagcctcccgcccaaggccagacctgctggaggcccaggccctggagatggctgtcttcagggagactctttatgtcacgctcattcactccctagcgcctctttctggcaacggatgtgtccagcgttcaggtctcttaacttacggtctccgtttttccaagtttggaaatcagctcagagcagagcgggcaaagaggggctttcactggtgctcagagctcacctgcgaaggagggaccacagcctccgggatgcagcgccctggctgcctactgctggctggctggcccctcccctgcagattcctcctcacccagccccgcacaggctgagggcttcactaaccagaaccatagtgtgacaaatgcacactggggggttacggaggaagagcagagttggggtcagaaggcatttaccctgagaaaaaagggcacatggcacacaacccatgaagggaagggagaggaacagcatgtgcaaaagctcagagttcagagtggtggcctggagcttagctggagtcaaaggtgatggtgggaggtgagggtctggtgcaggtggttctcccaagctgggctgagctgtatgacttgaccctgaggggcatgcgggccaggctgtgttttgtggggaggcaggagccaggacacagattgggggaaaggggtaaaggagcctggtccctgcggccgcctgcttacctaggacctcaggacttggggaataagtggccatcctttggaatgctctcaagggatctcagataaggggaggcagaagagtgttctggagaaagcagggcccatccttctccaccccaccaccctctccccatgtccctggagctggctcctctcccacaagccaggcctggccagcccctggtatctcaccctgccaaagagctatgtagtggcagttccacaccctgtgcccctcccccaccccacccacagtgaggaccccctggtgttggggacactccgggtctgtgggatttctccagaagcagactcagacagggattggcacccacactgaaaagttaacatagtctaaatatgtgtgtccctcccaagttcacatgtgatggtggtattagggggtagggcctttgggaggtgattaggtcatgagagcacagcccttaggaatggcaatagtacctttataaaaatggcccaagagagatccctcatccctcccaccatgtgaggacacagtgagaagccccatctatggaccaggaagcagccctccccagacactgctggggccttgatcttggactccacagcctccagaacaatgagaataaatttctgttgtttgtaagttgtgcagtctgtggtttttgtcatagcaatgccagaaggtggtggatgagtaagatggggatggagaggtagctatggtaggcaactggagtataacctccaggggaattttgggaaaaatgtaaaacatgcagagctaggaggaagagagctggggtatttatacaccaactccttccagcctgtggttgagaactctccgaggtgtcaaatccccacctccagtcctgagcagaaccagagggaccttcccttcccaggatttagcctctaggtgatgagatgtcgctgctggtgggtgacaggcaggacagctgagggaagggccccaggaatctggccaccagccaagtctgctgtagtgcatttgtgctctgaagcccaatgcagtcaatagatgactaataacagccaaatgagagatttgccctttttggcccaaaaatgtgattgagctctttatttttcagcgttttccagaaagacagaaccagcaggatataagaaagggggtttattaggggagctggctcacaggctcacagaggtgaggtcctctgacaggtggtctgcaagctggagaccagagcatggctcagtccaacttccagagcctcagaactagggaagccagccaggttcagggaagccagctcaggcccaagagttcccaaaaggccgctagtgcgagtcccagagttcaaaagcagaagagccaatgtacaaaagcaggaggagaaaaagcactcctctccaaaaggtagagaggaacagcagagagagagtgaatcccccttcttctgcccatttgttccagctgggcccccagccgatgggatggtgttctgcccacactaaggaccggtcttcctctctcaggccactgactcacaagtcctcccagacacaccgagatacaatgcttcaccagccatctaggcatccctcaatccagctcagttgacccctaaaattaaccatcataagctccctagagggacaggttgggggaggaggacacttcaaggtctaggtctatgcagaagtttcccagaccatttgagaacacaacagttgaaaaccaaacacgaaaatcagggctctactccagcctgagaaacagagcgaggctctgtctcttaaaaaaaaaaaaagaaagaaagaaagaaagagagagagagagagaaaaagaaaaaccagggccagaagcgggggctcacacctgtaatcttagcattttgggaggatcacttgaggtcaggagttcaagaccagcctggccaacatggcaaaaccccatctctaataaaaatacaaaaattagccaggtgtggtggtgggtgcctgtaattacagctactcaggaggctgaggcacgagaatctcttgaactcaggagatggaggttgcagtgagctgagatctcaccccactgcactccagcctgggtgacagaacgagactctgtttcaaaaaaaaagagggccaggcgcggtggctcacgcctgtaatcccagccctttgggaggccgaggtgggcagatcacgagatcaggagatcgagaccatcctggctaatgcggtgaaaccccgtctctactaaaaatacaaaaaattacctggacatggtggcgggcgcctgtagtcccagctactggggaggctgaggtaggagaatggcgtgaacccgggaggcggagcttgcagggagccgagatggtgccactgcactccagcctgggtgacagagcaagactccggctcaaaaacaacaacaacaacaacaacaacttgtggtttaaatatattgtatctctaccggtattttgtccatttagtctatcagttaccgagagagatgttttaaaatttcccacagtagttgtggatttgctgctacttttttagttctatcagattttgttttctatgtttcagcgctgtgttattaggtgtctacagatttatgattgttagatcttcctattcaattgacccttttataattgtgaaatggttttatcgtcactgcaacctccgcctcccgggttcaagtgattctcctgcctcagccgcccgagtagctgggactacaggtgcccgccaccacacccagctaatgttttgtatttttagtagagacggggtttcaacacgttggccaggatggtctcaatctcttgacctcatgatctgcctgccacggcctcccaaagtgttgggattagaggcacaagccaccacgcccggccaatattactaaatatcaagtcaatgttcacttttccaattgttttgtaaacgtttgtttgaattggaacccagttttgccactttgtgactggttgataagtcaggtcttcttaatccacacttttcttattcgtcctttcttcccctctagcaaaggaaaccaggctgttcccctgtagctcaccagcctggattttgccagctgtgccccctgctactgtttaacatgcatctgtgcctctgcattccctgtaagctggtagtttgtattgaggagttggactccatttcttaacttctggctactgacagcttcctttttttttttttttttttttgagacggagtctcgctctgtctgtcgcccaggctggagtgcagtggctccatctcggctcactgcaagctccgcctcccgggttcacgccattcttctgcctcagcctcctgagtagctgggactacaagcacccaccaccacgcctggctaatttttttgtatttttagtagagatggggtttcaccgtgttagccaagatggtcttgatctcctcaccttgtgatccgcccgcctcggcctcccaaagtgctgggattacaggtgtgagccaccacacccggcctaaaaatccaagttttaggcaccagctactagtgcagtagccacgtgtggttagagcctccagttctttacagtctcattgtgtggcccaggctggagtgcagtggcacagtcatacatagttcactgcagccttgaactgcctggctcaagggatcccccgactcagcctccagagtagctgggactacagctgcacaccaccacatcccactaattttattattttctgtagagatgaggtctcacagccaggtatggtggctcatgcctgtaatcctagcactttgggaggccaaggcagttggatcatttgaggtcaggagttgattgtgccactgcactccagcctgggtgacagagtgagatcctgtctcaaaaaaaaaaaaaagaaaaaaaaaagattaaaaatgagatgaggtctcggggtctcactatgtctcccaggcttgtctcaagctcctagactcaagcgatcctcccacctcggcctccctaagtactgagattacaggcatgagccactgtgcctggcccgtgtgtgagaaattgagtaggggtgggaaggtttatttggtttctagcttgctggagtgtcacattccaaggaccttacctgaaaggctgagtgtttttacagggtcccttctccttgatgcctggactccaattcctttctccataacaccatcagacagctaaagctttaatttcatgggctttcagctgccattttctgcttgactttgtaacctcctacccaaaacagcttagagattggcaaatatcttaatgggaaaagaggcacagaagattgaatggtagcttccaatgccaatatttgcctccccaggcctgtgagaatcccagaagctctgagctgccactttctgcttggtctctaagtacctgccaggctcatctcaatgtgattcccttttctcaggttctcagtccctcaagtcctggctgccttggttgctctccaatgccttcaaacagctgttatgttgttgctgttgttttgagacagagtcttgctctgtcgcccaggctggaatgcaatggctcgatctcggctcaatgcaagctccacctcctgggttcacaccgttttcccgcctcagcctcccaagtacctgggagtacaggcacctgccaccacgcctggctaattttttgtatttttagtagagacggggttccaccatgttggtcatgctggtcttgaactcctgacctcgtgatccacccgcctcagcctcccaaagtgctgggattacaggcgtgagccaccgtgcccggcctgttgttgtttttaaactagtttttagagttgcttttggtgtctgatacttgttatttaccacagccacaagtaggtgtttttgctttgtgggaagctttatttttgagagcatagaggttcctgattactataaagaattaaatggggccgggcgcggtggctcacgcctgtgctccgagcactttgggaggccgaggcaggcagatcacctgaggtcaggagttcgagaccagcctgaccaacacggagaaaccccgtctctactaaaaatacaaaattagccaggtgttgtggtgcatgcccgtaatcccagctacttgggaagctgaggcaggagaatcgcttggacctgggaggtggaggttacagtgagccaagatcacgccattgtactccagcctaggcaacaagaaagaaactccgtttcaaaaaaaaaaaaaaaagaattaaatggcctaataaatgataatgagtacttatagatttgcctggtagacaggaagaatgatctactggatgatttgattgatataagaaattattaaaattagggccaggcatggtggctcacacctgtaatttcagcactttgtgggctaaggcaggaggatctattgaggtcaggagttcaagaccagcctgggtaacatagcaagacctcatctctacaaaaaaactttaaaattagccaggcacaggccaggtgtggtggctcacacctgtaatcccagcactttgggaggcagaggcaggtggatcacctgaggtcaggagttggagaccagcctggccaacttgaaaaccccatctctactaaatatacaaaattagccgggcgtggtggtgcacgcctgtaatctcagctactcgggaggctgaggcaggagaatcacttgaacctgggaggcggaagttgcagtgaaccaagatcatgccattgcactcctgcctggacaacaagaatgaaactccatctcaaaaaaaaaaaaaaaaaagtacaaagactgcatgtgcatgagtgaaaaaacacaaggggaaatgtagtgatatgaaaggaatataaaatctgacacatgaaacaaatagttctatctgtgttgttttggataaaatgaaaaggcatttcgcttactaaaaaggtgatatttcaatattctaagaagactttgattaggaatatagcagaagacttttctgcaactatccatcaaaagatcagattctggccaggcgcggtggctggcacctgtaatcctagcactttgggaggctgaggcgggtggattgcctgagctcaggagtttgagaccagtctgggcaacacagtgaaaccttgtttctactaaagatgcaaaaaattagccaggcgtggtggtgggcacctgtagtcccaggtactcaggaggctgaggcaggagaatcgcttgaacctgggaggcgaaggttgcagtgagccaagatcacgccactgcactccagcctgggtgacagagcaagactctgtctcaaaaaaaaaaaaaaaaaaaaaaagatcagatttcatctccctgaatatagaagggatgttatcttaccagccctggcaggccactacgcatatgtgcatacgttaccatgtctgtgaggcattgcaaggaatacatttttttagccactcaacacctgtagatgtcaccgtctcggcagccaacaggaagaccccatctccagccgctgttttccactatgaccctcagcgagtgttttccacatttaaccacgtgggacccacggctctggggatggctttgtgccatcttgtgtttcttcagaccctgcctgagtttcaggagaatttgcgtgaccatgggaaaggctactgggctgtccaaatgctaccgtctctcaggcacctgacctcgggcatctgctcccttctgccgcttcctgagggaactctcggaaaccccgcagcaggcctcactcaggagaggctgagggaagagatgggcagtgccaccagaggcccctctgagaggcgtttcaacagcttcacctgtgctgacaaagcagccgtggtcagcaccgccgttaaggcggccatcagtggcggctggcatgcagcgtgtacacgaattaacacatcaaacagaaaaactgccaaaagcagtaaagcgaataaggatggctgggtgctcctcactcctccaatgccagtgccccatcccctctcagtgccttcgttcacctctgactcctgtgtccacagtgacgttccaaagaagagccccacagagtggacacacagaaagtcctactcacgtcgaatgtgtcatcctctgcccttccttcctaggctcaccctggccatgagatgtgcatggctgctggaatgggcattgcacaacgattctcgagagctcagggccgccgtgagtgttctctgggtttctggcacatggtggaggaggtttaaaggagccttctctaacttcaccatccttagagaaaagacacctcattgggtggctcctggctccatggtcagtggctttgactgcaggggtggaggtgtggggggggtggaccaacacatttttatttaaaaaaaaatatatgtatatctcacaaaatagacttttttccatagaaaaaaaaattttttttttgagatggagtttcactcttgttgtccaggctggagtgcagtggtgcgatctcagctcaccgcaacctctgcctcccgggttcaagcaattctcctgcctcagcctcccgagtagctgggactacaggcatgcgccaccacgcgcagctaattttgtatctttagtagagatggggtttatccatgttggtcaggctggtcttgcactcctgaccttagatgatccgcccgcctcagcctcccaaaatgctgggattacaggagtgagccaccgtgcccagctcatagaaatatttattaccagtattccaaagaacagtacttggagaaagcatatctaagcacgtgtgcagggcgaggtacagtggttcacacctgtaatcccagcactttgggagactgaagcaggaggatcgtttgaggccgggaattcaataacagcctgggcaacatactgaggccccatatttacaaaaatttaaaaaattagctggcgtggcagagtgcacctgtagtcccaggtacttgggagggtgaggtgggaggatcacttgcagccaggattttgaggctgcagtgagctatgattgcacctgcacttcagccggggtgacagagcaacagcttgtctctaaaataaataaaaacatcctctgctacatgggtgattcagctgtaactaacagaacatccaacccaaagtagcttaaacaacatcgtttaagtttgttagcttgatccacttcgtaagattaagaagtctatggctctgggtccagttcagctgtggcagggatcttggtcagcttgtctgctctgctcctggtcttctcttagtctcaagatggctctgcagtcccaagaatcatgtcctcacccagcagaggcggtgagtagagacagagaatgtcttacctcacatcaactctttaacaggaggacggcattcctagaagcgcccttccccacacactgtcccctgcaacagcacacttcccctcatatctccttggccccaaattagttatgtgcccttgctcagtcctggacctggccccttccccgagatcaagagatcaccacagatggctgaaagcccctggttctgttggaaagaacaaggaggaaaggctttgaggcaggtggtccgcagggcccgtcatgctggagagctgatctgtaggtgagcaaaaaaaattccattttccctgatgaaccgcagagaaaggattcccgctgaagtagaaaggagatgaccacctcagtcctcttcctcatcttgttcaccatgggtcctgcagagcttagggggtgtgtgggtgctgggtggtaaagatccaggacctgggcagagatgggatccgccctcagcgcagggttatgacagtactctccgaaactccactcgattgctcttctgcctcctcatcattgtcctactctgcaccatgggacacagagcactgccccagagccggcagtcaggagcagtggagggaggaatggagggggcagtggagggatgaatggagtgagggagtggagggatgaatggaggggataggggagggatgaatgtagggggcagtggagggatgaacggagggggcagtggagggatgaacggagggggcagtggagggaggaatggagggggcagtggagggaggaatggagggggcagtggagggataaatggagggggcagtggagggatgaatggagggagtggagggatgaatggaggggataggggagggatgaacggagggggcagtggagggatgaacggagggggcagtggagggaggaatggagggggcagtggagggatggagggggcagtggagggatgaatggagggggccatggaaggatgaatggagtgagggagtggagggatgaatggaggggataggggagggatgaatgtagggggcagtggagggatgaacggagggggcagtggagggaggaatggagggggcagtggaggaatggagggggcagtggaggaatgaatggagggggaagtggaggtatgaatggagtgagggagtggaaggatgaatgtaaggagtaggggagggatgaatgtaggggcgagtggagggatgaatgtaggggggagtggagggatgaatggaggggggaatggagggatggagtggggagtggaggggtgaatggggggagtggagaggtgaatggagaggggactggaggttgaagggaggggggagtggagggtgaatggaggggggagtggaggggtgaatggaggggggagtggaggggtgaatggaggggggagtggaggggtgaatggaggtgggagtggaggggtgaatggaggggggagtggaggggtgaatgtaggggggagtggaggggtgaatggaggggggagtggagggatgaatggaggggggtttggaggggtgaatggagggagagtggaggtgaatggagcggggagtggagggatgaacgcagggttctgtggaaggatgaatttagggggtagtggaaggatgaatggaggggggagtggaagggtgaatgggggggagtggaggggtgaaaggagcagggagtggagggtgaagggaggggagagtggaggggtgaatggaggggggtttggaggggtgaatggagggagagtggaggtgaatggagcggggagtggagggatgaacgcagggttctgtggaaggatgaatttagggggtagtggaaggatgaatggaggggggagtggaagggtgaatggaggggggagtggaggggtgaatggagcagggagtggagggatgaatggagcggggagtggagggatgaacgcagagttccactgaaagatgaatttagggggtagaggagggatgaatgcggcgggacagtggtggcttaaatgcagtgggtgggggtgctggtgtgtgtctgggaagggtactgtgctctctgctctttgtagccacgtgtcagggtgctttctaagaagggtgcaggcagacactgttttcttcaggagagaagctccgaatgggacgtagggaacacagccccggagccaggaagcactgagctgctcccagccaggccctggagggttggcatcattcgagagctgaggagtgtcccccacccctcagctgcacttgggtctcagctgggatgaactggatgtggacacagtgctgggcaggcgattatcttcatgggcctgggcgctcctgctgttgtggataattatcttggcagtaaggctgggtccagtagtcggggtctcagaagggaaagcagggaagcctgggagagcagccagggagaggggaggcctgaggggagggcctgcctgggccactttccctctttgagtcctgtttcagccccaggtgcacaggctgagaaagaccagtcccaccagggcctctcgctgggggccacaggggcccaggctacagatgacttctgtcctctcctgggctggacaggcccgcacagacctgggccgccacacagaggacacttgtagaacgggggagccgctctgctccagcacctgctcctggaggaagcagagcttgtcctcacctccaggaaggccctgttcctggccgcaggtgatctcagctaacccgtggctcccgctcacttgcccagctgtgcaagcctaggcagaagaaggcaggaagagtgggtgtcagggcctgactgtggggacctgcatgtcttttgtggtctgtcatggtgggtcgccagtgggaagcctccttttcccactagagccaatgccccagttccagggctctgcgggtggcttgaagctttcactgcctgagactagcagctaagtacagaagcgcaaatgcaaaggggcatcagggttcccacggtctttgctcgctgtggaaagcggggacgggcgctgacgcaggccaactcctacatcttcaccagagccctggaccaaatcctgcagaacgtaggttcagcagacagcagacctgaacccgtgtccctgagggtggtcacaatctcagccccaggtggaggctgctgaatgccgtggctgcaaagcagggcgctggggctggggggtcagctgttggggggagggagccctctgacccgccctgcacccctttttccctccctcctctcacccccttgttcccagaagggggcacctacaccttctacctctagctccaggcacccactccggcctgccaggccccaaaaccttggcatccttgtccttaagcccaagggacccgctaggcattcccttggcgccaccacattgcgtagggggccccatgccctcccccccgaccctctctcccctacacagtactgcgaattttgtaattgttagtacagctagtgtcctcatttaaaaccttctagcagtaccaggctatagtggaaacaaaatcccctcccccgacaccccaaattcacactcctgctgggagttgtgggaagtgcctgtctccccgctcctcccatcccagtctctcatgaaaacgtctgacaggtgaaaataccatcttccggtagggccaatttgctcatccctgattacggcggaggttcagcatcttgcagtcagcagccattggggcttcctttgtgcagcgtgtccggcggcctggccctttcctcgttgactgatagtagccctttgttgggagaatcggccctttgttaaccactgagttatcatgggttctccccagtttgttgcacatcctttgattttaaatatgtggtctaggcaaaatgttgccatttgtaatttaattaaatttttcaacaatgttccctgtggcttctgcttttttgttgtgctcagaaaagccttccggatcctgagatcattaaatagtctcctgtgttttttccaaattatgtttgtggttttgggtttttgcatttctatttccgctccataaggaatttatttccgtgtgaagagtgggatcaggatccaacgtcatgtttttccagacaccaaggccgcccagttgctccaccaccctttattattattttattattatttttattttttttgagatggagtttcgctcgttgcccagactgaagtacaatggcgtaatctaggctcactgcaatctctgcctcccaggttcaagcgattctcctgcctcagcctcccaagtagctgggattacaggcatgcgccaccacatccagctaattttgtcctttttttttagtagagacagagtttcaccatgctggccaggccagtctcaaactcctgacctcaggtgatccacctgcctcggcctccaaagtgctggttataggcatgagccaccgtgcctggccacacccttttttaaatgacatcctttccctcatggatttatttatttattaattaatttattttttgagacagagtctcgctttgttgctcaggctggagagaagtggcacgatcttggctcactgcaacctccgcttccaggttcaagtgattctcccacctcagccacctcagtagctgggattacagccacccaccaccatgcccagctattttttgtatttttagtagagacagggtttccccatgttagttaggctggtctcgaactgctgacctcaggtgatccacccgcctcggcctcccaaagtgctgggattacgggcgtgagccactgcgcccggcccctcgtggattttaaatgccccattaatcatatgctaaatgatcacacagacctgctctgatgtgtgtgtccagtcaactgcccatagcaagatgttctatgatggattctactctctggcagggctaaagcccccttttttatttttcagaattttataggcttttcattctttttttattgtagtaaaatatatgtaacataaaaactactatgtttgccatttttaagtgaacagttgagtgacatcaagtgcattcacattgttgtacaaccatcaccatcctccatttccaccgtccatctctactgtccattaccaccatttatccccaccctccatcaccacccaccatctccaccctccatctccaccgtctatcaccaccctccatcaccaccttccatctccacccttcgtccaccctccatctccatctccaccatccatcaccactctccatcaccaccctccatcaccaccctccatctccaccctccatcaccacccaccatttccacgctccatctccaccatccatcaccaccgtccatcaccaccctccatttccactgtccattaccaccatttatctccaccctgtatcaccactcaccatctccaccctccatccaccctccatctccatcttccatttccaccgtccatcgccaccattcatctccaccttctatcaccactcaccatctccaccctccatcacccaccatttccaccctccatctccaccatccatcacaaccattcatctctgctgtccatcaccaccctccatttccaccctgcatctccaccctccatttccaccctgcatctccaccctccatcaccaccctccatctccaccctccatcaccaccctccatcgccaccctccatcaccaacctccatcgccaccctccatcaccaccctgcatctccaccctccatcaccaccctccatctccaccctccatcaccaccttccatctccacccttcgtccaccctccatctccaccgtccatcaccaccattcatctccacccttcatccaccctccatctccatcctccatcaccacccaccatttccaccctccatctccaccatccatcacaaccattcatctctgctatccatcaccaccctccatttccaccctgcatctccaccctccatcaccaccttccatctccatcctccatctccaccgtccatcgccaccattcatctccaccatccatcaccaccctccatcaccaccttccatctccacccttcatccaccctccatctccatcctccatctccaccatccatcaccaccattcatctccaccctccatcaccaccctccatctccaccctccatctccatcctccatcaccacccaccatttccacgctccatctccaccatccatcaccaccattcatctccgctgtccatctccaccatccatcactaccatccatcaccactctccatttcgactgtccatctccactgtccattaccaccatttatctccaccctccatcaccactcaccatctccaccctccatccaccctccatctccatcctccatcaccaccatccatcaccaccctccatcactatcttccatctccacccttcatccaccctccatctccatcctccatctccatcgtccatcaccaccattcatctccaccatccatcaccactctccatcaccaccctccatctccatcctccatcaccacccaccatttccatgctccatctccaccatccatcactaccattcatctccgctgtccatcaccaccctccatttccaccctgcatctccaccctccatttccgctgtccatctccactgtccattaccaccatttatctccaccctctatcaccactcaccatctccaccctccatccaccctccatctccatcctccatcaccacccaccatttccaccctccatctccaccatccatcacaaccattcatctctactgtccatcaccaccctccatttccaccctgcatctccaccctccatctccacccttcatcaccaccatttatctccaccatccatcaccaccctccatcatcacccaccatctccaccctccatcaccaccctctatcaccaccatctatctccaccctccatccaccctccatctccatcctccatcaccaccaactatttttaccctccatctccaccatccatcaccaccctccatctccaccccccatcaccaccctccatcaccaacctccttcaccacccaccatctccaccctccatctccactgtccatcactaccctccaccctccatcaccaccctccatctccaccctccatcaccgccatccatcaccaccctccatctccacccttcaactccactatccatgtccaccatccatcaccaccctctatctccactgtccatgtccaccatccatcaccaccctctatctccactgtccatcaccaccctctatctccagcgtccatgtccactgtccatcaccaccttctatctccactgtccatcaccaccttctatctccactgtccatcaccactctctatctccactgtccatgtccactgtacatcactaccctccatctccactgtccacgtccaccgtccatcactaccctccacctccactgcccatgtccaccatccatcactaccctctgtctccactgtccatgtccaccgtccgtcactaccctctgtctccactgtccatgtccaccatccatcactaccctccgtctccactgtccatgtccaccgtccatcactaccctctatctccaccgtccatcaccaccctctgtctccactgtccatgtccaccatccatcaccaccctctatctccactgtccatgtccaccgtccatcaccaccctctatctccactgtccatgtccaccgtccatcaccaccctctatctccactatccatgtccaccgtctatcactaccctctatctccactgtccatgtccactgtccatcaccaccctctatctccactgtccatgtccaccgcccatcaccaccctctatctccactgtccatcaccaccctctatctccagggtccatcaccaccctctgtctccactgtccatgtccactgttcatcacccccggtctccactgtccatgtccaccgtccatcaccaccctgtatctccactgtccatgtccattgtccatcaccccctctgtctccactgtccatgtccactgtccatcaccaccctctatctccaccgtccatcaccaccctctatctccactgaccatcaccaccctctatctccactgtccatcaccaccctctatctccactgtccgtgtccaccgtccatcaccaccctctatctccaccgtctgtgtccaccgtccatcaccaccctctgtccccaccgtccatgtccactgtccatgtccaccgtctatcaccaccctctatctccactgtccatgtccaccatccatcaccaccctctatctccactgtccatgtccactgtccatcactaccctctatctccactgttcatcaccaccctctatctccactgtccatcaccaccctctatctccactgtccatcaccaccctctatctccactgtccatcaccaccctttatctccactgtccatgtccactgtccatcaccaccctctatctccactgtccatcactaccctctgtctccactatccatgtccactgtccatcaccaccctctatctccactgtccatcaccaccctctatctccactgtccatgtccactgtccatcaccaccctctatctccactgtccatcaccaccctctatctccactgtccatcaccgccctctatctccaccatccatcactactctctatcttcactgtccatgtccaccagccatcaccaccctctatctccactgtccacgtccgctgtccacatccaatatccatttataccatccatcaccaccatccatgtccattgcccatctccaatgtccatcatcaccacccatcaccaccatccatctccagaacttttacctcttcccaaatttcaagtctgtattcattaaacagtcactccccatgctcctcctgtcagctactatctctatgaaagtgactactctagggacctcacataagtgggattgtatggtacgtgttcttctgtgactggcttatttaactcagcataggatcctcagggtccatccaagttgcagccagtactggaatttctttcctttttaagactgaatactattccattttgtgtgtgtgtatctcagtgcagcagggctctgatacccccgctcctcaccaagactggtttgccaggactgcatctgcccagtcccagcgggtgggaggtgggatctcactgtggttttgctttgcatttcctggaggatgctggacatttcccatgtacttgttgaccagtgtgtgtcttctatggagacgtgtctattcattctcctggcacctttagtttcctaagggctttggaatcatcatggagctacttttactggggatcattcaatatatggatcaatttgggggcattggggactcactccttcttggttttcctttcctggtctcctctgtgggttcctggcttggtttgagttgtcctctctacccctccaattccctacccccactctgtggctccaagcattgcccacacttgccccccggctcggtcctgggctcccaaatgccacgggacgactggcccaagtgtgctcaggtctctccacctctcaactgccgacctccacagctgcagctgctctcctggcctagcttcccagccaagtgacagccacgcgcactgaccagtgcaggcagagcactgggcaccaggcttgcctccccctccctgtcgagaaagtcaagcgtcctggcaaaagaaagaaaagcacaaatagagaaaatgacttttgtgaagggtcatttaccaaggtgtgaacaaggagcaggccaagccaagaaggtagagaagccctgggtagggcaggaaaggatgggcagggctggggcctctgagggacacgtctggctccagctgggaggaagcctgggaaattcctaagctcacctggaagcaggtgtggtggggccggaggggcagacccagaacaaccagtccctccctgccacctacccacccacacaattgggcagccagttcgtgcccactcttcctcccaaatttccttctctctccttcctctgcttccacccccccccccccccgccctccagcccagggcctgtggttggatgcctggttgctccctccaggcatgttttgccatccactgactttgacacccggagctctctctttcaaaccctcatcggagcagatctcagccagcatcaactcacattatccttgggaagaaatacaggcacccggatcacctggctgcaggtccctcccctggcctccctcctccccaaccttgcaatccaagctcctgccggagggtctttcctgggagccagcccggagtgctcactgccctgctctctccctaggcaagtgagttcccaccaggtgcttggggtggggctcccgccatactcaagggcgcctcttgactccctctgaactcgcaatcccgccccagggtccggcacaagggctctgctggggctgagatccgtgaaggcagatgcggagaggcgccgctggattgcgagcaggcccaggtgcggggccaggtgggcgttgtcgcagccgggaacgcccagccgctccagctgcccacaggacaaagcccagggttccccggccgggcgcacgccttccacattctccctcacctccacgccttcgctcactgcgttccccaacacctggaatgcagcaatgcccttcgggcacgctgccccgcccccacgttgatcccgtcccctagcttggctccagggacaccggatacgcctattgtagcacccggcaaggagcgagcagtccgcgggaacttacccaggaaccccgagcgcctccgtagttcccaaccccacccccacccctcggccaggtcaggtccactgtgggcgtccaggtaagacggcgtcgatgcccaccaccatcgcccccagctcagcccagagcgcccggggtcagaggtggagatgtcggacatacgcccagtctggccaggctcgggagggaaaatctgggagcggcctctggaactcaccctgactccttcaccgtccgctcctctttttggcttccggggccaaaggttggggactcgaggcgcggctggagcctacagctcctggagcgtagttaagcgttaacccgctggccctgggccagggcgcggggctgctgtgcgcacccggttccgcccgtcgagctggggccggaccgggaggcgaagcggggggcgctgccgagacgggagggcatggggtctgcgccgggtgcgagatgagccggggaggccagcggggcctgggcggtgggggaaggtgggcctggggcaggggcgggatggcggctcgccaagcctctgccgaccggaccacgcgcggggctaccggggcgggctcacctggcggccgcggacccgccctaacctggtttccggcggggcggcgcggggtgcggcgcggccgggcgggggcggggcgggcgggggcgtgcccggggcggggcgttccgggggcggggctgagcctcccgcagacgtcagggacccgcgcgcgaggccgccggcggccgctctgccgtgggctcggcccgggctgccacgagcgtgcgggcctcgccgggcatgtcctaggcggcggccccgcccagcgctcggccgggcgggcgggcgggcgcgagggcagggaccgagccgggccgagctggggaacaagccggggaccaagccggggaccaagccggggactaaggcgagccggagaccgagcccgaacagcaggtaggacgcgccggcccagcgctggccgcggcccgggcctcccatcgcccgcacctgcacggctgtggggtctcacggggcgcggggtcccggccgaggccggacaaaggcgcgggggttgggggccgcccggcgcacctggtcaggcgggtccccgccgccgcggaggcggccctggtctgcgccaggccgggaggagccgccccgtttctacgcggcctgcggagggggcggcaagcctgggcacccgggtccccgccccggcaccggctcggccatggccgcccccggagagcgctgattcagaaggcgccgctccctcccccgccgggcccggccgcctccctcctggcctggtctctcctcccgcggtccctccctccgtcttcctcctcctcccctctctcctcatttcccttcgccgccgtctccccgctgtccctgcctctcccggcctgtgcgctccttccaccgccggcctgccccgcccggctcgctgcccttccctgccctgggcctagccacctttccccgcctcacctctgactgtggcccttccggccggggcggctgaggggacaagtttggggcgtttattattcttcctcctagcaacgatggccagcccagccccgaggcagccgaaggccgttttggagcgtcgcgggctcccaggccttttcagggtgggcggccggggcagtgggtggcctggctctggcacagcggcaccaccaggctctggggctcggcttcatttcgccttaaacagggaccgtggactcctcagggcgggccgcggcaggtgatggcagagggtgaggcctaggagggctggctgggggccggaggtgcaatggtggggtaggccctgcccgatagagcaccctgtggtctcccccagcagccctagggagggtggggctgtagaggcctcctggaggctttgctgtctggggctgcagggtcatcgaagtgccagccccttggcctccagtgcctgcctgtctggctggagctgggtgcgtggcttaggaagggcagggcccccagagtgagagggtcctggctgcctggagctgccttctcctggtgaggatttttctacatcttcccacctccctgcccaaggtgagggtttaccatggggcacgtggtcacttgggcattcatgctagctggagctgggtgttggttttccctgctgctcaccgaagggagctgagatctggtgaagagcctcaaagctgaagaccttgggcgtgggcactgggcaaagtagggacaaggagccactcactcctctgcctggcaccctcatgtggtgtggccctgccctcaggatgcactcagcccggcagcctccccttctcctctgctccactgggcctcagctgctgtcatccctgtcctgggttattgtcctcacttcttgactggcctcctgagtcacagccccatgtccactcaggagctctggggccggcctcacaggtatgtgacttggagacccccacagagcccttgcttggaccccgcatgtggcatcttgctcagctctccttctcagtttttgaataagggtaccgcgttttctttttgtgctgggccctgcagtgatggagccagtgctgggccctttagggacttcatccccttccaggactagccacaggactcccaggggtatgtgaggccctccatccctctgccctgtccctctgccctggtggcaccagctgttccctctgcctggaatgcagtcccacaagcgttcatgggctcacttccacccctgtcctgctgagcctggaggctgcctcccagtgagcccccatccccgccctgcctctgtgttccctgtatccctctttgcaccttctcataagccgtttctgttctctgtgcctgccccctgctgaagggagccccaggattctgagactctgtgtcttggtcacagctggcttagcccaggccgcctagcccatagcagcactcaggatgtgctgggcagtggggtggagtgcccaggacatgtgtgctggcatgctccgggcttgcagggtgcatgctggctgggtatagggctgcccagggttgggtcttggggtgacatcagccctggccattactcaggctgtccccgttacctcccaggctgccacggggctccctgcctgtctacaccagcccctcagaccaccccctctttgttgatgtcactgggactatgggcaccaaagcctcacttccctcttgggcactgaaggggctgcctgatgctgtccttgcaccatgcccaccaaaggacatttggcctcctctcggtggtggacatattgctgactcagggcccctgtctccagctctgtccctgctgcccctcaccccaggccctgcctggggctcagtctcagagtgtcctgctggggggagtgggtcctcttgttcagtgtatgtcttggggtgggtctggtgctgtggacctggcatcatggggaccctgatgggctatgctgggtcctacccatgagctgctcctgatgggtcacgtggatgtggggtcacttacaggcagtgcagccagtgtccccatgaacttcaacccctgacacctggaagatagaggagatgaggtgtgctggggcctggaggataagggagaaccaggcagcctttgccagggatggacgtgatgggaaaggccggtcacgagggcaaaggcctggcagtgggactcgggaccatacccagggagggcgggtggcctgatgaggctggagcccagcttctccggaagctgccagcttcccttagagggtcaggatctgggctgggccttggatgtgtccagggggctaagaaccaggccagggagccccactctaacaatcccctcttccccagggccagacgggcccagccagcaccaagatgagtgccacgtcctggttcctggtgagcagcagcggcgcccgccaccggctccctcgggagctcatcttcgtggggcgtgaggagtgtgagctcatgctacaggtttgcagggagcgcttggggccaggagggtagggggtagacagtctgtccctgtggaggccaggaaggtgcccaccccacttgctgcaggccaccctggcgaggaggccgccatgcagcccaggctgggcctcttaacttgggtcccggatgcaccgagggctctggggctcccgtgggtgcgtgcaggggtgtgtgtgtgctcacaggctcgggtccctgccccgtacgtatccctgtctctgacaggagggggcttaggcttttgtcaggttctcaaagttgttggggtccctagaagcgtgagttggcgtccttttgcagagagggagctgaggctgggctttggaaggtcctggaaagccggtctgtccatattcttgttgtctgggggccccgtctatgctgtgagtgctgcctgagcgggggtcccagtatcttggtcccagctgcaccctggtgaaggctagtgccttttggcggcctccaggcatgaggggttcttctcagggcatgagagcctgccgagcaccggcactgacaatcggaagtttctctggccctggtttgaggtctgagtttggctttgtggggcttgcgatctggctgtttgagaacaaagagcaggggtggtgagctaaccccataggcccatcctggcctgatgtccttcctctaccccgtgtgcctgtgaacgagttgggctccctgtcctggctcatcccccagcgtggcacgtgggcccctgacccaggtggatggcactgtccagtctagccgaggggcctgcaggtgcagggagctgccctgcccactcagacgttgcctcctggatgcaacgtgctactgccgcacatgcccgggccatgccaggctctgacgaggtgggcaggcctcaggctgtggtgaggggtcctggccatgtgcacattccctggggcagacagtgtttgtctgcctctacccagggcagccccacccgatattgctgcatgtgtcctgctgtggcgggaaggtttgtgtcccctgcaattcggaggttgaagcttcatttccagcgtggtagcttcaagagatggggcctttgggaggtgagcagggcgtgaggctttgcccttgggaatgggatcagggaccttaaaaagaggccagaggaagctggctcaccccttctgcccagtggggacgcagcattcaagataccatccttgaagcagagacagggccctctccagacaccaaattggccggcgcctagatctcgggcttccagcctccagaaccgtgagcaatacatttgtgccatttccacattactcaggaattttgttacagcagctgggatggactaagtccagacatcccagcttctccccaggcgtcctctgatcctcttgagtctggacccagcaggtctctcaccttgtggttggttgttccggctctgaagttctttaatctggaacattctctcccttttttctcttttctttatgcctttggtagcgggagagagtcggtggctgggggcaggagtcggcaaatgttttctacaagggcctggtaaagattttaggttttatggaccacaaagtatccactgcagcccaggcctgtggccgtggtgaggggcagccagggagcgagcgtgggcgaccgaggtgggcgcggcagcacctgcacttcatttatggatgttgaagtatcaatttcccataattttcatgtgtcatgaaatagccttttgatgattttcaatcatttaaaagtgtaaagatcattcttagttctcaagccatctaaagacaggcggcaggccataggccacgccccacataccccactgcctcatggggccgcagctgtatttggcgggttgctcccatggtctgcgtacaggggtggcatcagtgatggccgcgctgctctacctagggtggctaggagggcttcttggaggcggcggcactttggagcctctggaagaagccagagtcagcctgcaggcaggggactggtgtgggtgctcttcctgccccacccctgcaccaggcctgctctgcctgcttctccctggggtaggggaaaagtgctgggggcagggtgctcagggtgagtttggggtccgattccgagtttctgcacctgtcagtggagccctgagcaggtcgggagtgttgggggcttcccagctctcctcagtggccgcccctggcctgggtgggcctgcatttctacccctcgctgttgtgggtggtgtcaccattgtaagatgtatctccatggggaaactgaggctcagggaggccttgcaggtgtggcgagtgtgggaaggctgtctgcctcccggtgcccctgcagcggcctcctacctgcccaccgctgccccctgccggcctctgtcacccctcactccctgtgcacctgccctagaggcttctcacccccaccctacagccccatgtccagccccttggcccctctgttgcccccacctgaggatgtttgcacctgccgcccctccctgcagcaacttccttggcacctgcgccaggacccccgccctctcagctcatgctcaggggcctcagtggccctttccgaacgctgctgcttccccgaggccctatccacctctgctcagatgatccacatgctgcctggagcctgctctgtcctcggcttccagcctcctactggatatggctgctgcactggggcctctcagaggcatcccaagctcggtggctgaaccaaacctgtcaccctccgtcccttccacccggggtccccgccagggtccccttccctctgctcagtgccacccccacccccaccccacgcacagacaggaatgcaggcctccactggacccagcctctccccacacctgccctggctctccggacccggctcacaccgaccttcctgccctggaacctccacaccctgtcccagcgccccctccacagtccttgctttcggcgccacatctttccactgggcagggtgtcaagcagagaccctgccctcccttggcatccactgcagagaggggccagcaaggtgtccagggtccagtcctgtgtaaagaaggtggtactggggactgggcggtcagcagacacctgcctatgttgtgctgaggcccaaggagccgcagcagcaggagttggggccggtgaggagggggaggctgtgggaggacagagctgagctggggctacggggatgggacatggaggggagacaagcagagtgggcggcccgaggcctgggctttcactaggcaagaggggcggtagcttggaccacagcaggtagacgggtaggggagttgtgttccaggcagagctgccacccacgtgctgtcccacggaccacgctgtccagggccctgcctctgctccccacagtgtccttgtgcccagtgcaagcctggcacagagctggtgcccagcgaacaggcgttaaatgacgcaggaacgtggacccaggcaggacttcctgctgtggctgtcactcctgtggtggcccaggctgtggtccagggtgtgcgtgtgtgcgtcgtgtgtgtgcgtgtgtgtgccgtgtgtgtgcgtgtgtgccgcgtgtgtgtgcgtgtgtgtgctgtgtgtgtgccgtgggtgtgcgtgtgtgtaccatgggtgtgccgtgcgtgtgtgcgtgtgtgtgccatgtgtgtgcgtgtgggtgtgccgtgtgtgtgccgcgtgtgtgtgccatgggtgtgcgtgtgtgccgtgggtgtgcgtgggtgtgcgtgtgtgtgcgtgtgtgtgccgcgtgtgtgtgccatgggtgtgcatgtgtgccgtgggtgtgcgtgggtgtgccgtgggtgtgccgtgcgtgtgtgcgtgtgtgtgccatgtgtgtgcgtgtgggtgtgccgtgtgtgtgcgtgtgtgccgtgtgtgtgtgcgtgtgtaagtgtgcatgtgcatacatgtgcatgtctgtaggtgcacacatctgtgtgtgttgtgtgcatgtgtgtgctgcatgtctgtggggaggtgtcctccgtgagagcgtgtgacagctgggatttgcactcttgcgtgctgccccagagaccacagcctgggcaggccctgaccttctgtgccccgtgcatcgagccggtctgctgcgggtgcctgtggccgccaatggggaactcgggtgagctggcaggagggtgtgcccagagccctggctgctgctactgccactcagcacagctgggccaggctgttgccccagagggcgtcagacgtgaactttgggaacatctttattctgttttaaagtgagcacaaattattagacactttccccaaaatccatgtgtttggggcgtcttccggccatgccacacatctgtgtttgcctggctgtttctgcaccgagttccgtccacagcccgggtttctgttgttttaagtcttgagccctgggccgggggccacttctcattggtggctggaggctcggccaagtgaggggctgcttctggttggagaggggagtttctggaagggggttccccatgtgtctccagcgcttcctgcagtctggggaggggcttggcaggagcaggtctggtgagaaagccctggccgggggtggaggctcagtcctgggagtgggcggggcagctgggctcggggtgttaacagggtcctgcggggggactctgtgctgagtcaaaggagccggaagctggtgtgggccgggtggggtggggaaggtgggtgcaggcaggggagggggcttggactgaaggtgagacccaggcctgggcaaggatgcggtgtgcccagagctggcagagtcatctgcctgaagcctgactgtggcctgggtggggtaaggaaggtttggagaggctttggggcctgcgggaaagggggctgtggagagagaggctgaccgagggctgccgagaggaagaccagtgttgctggagcctgtggtggagaggggcttggtgggtgaaccctccagggaaggcctggggcagggctcagaggacctggaaggtgtgcagagttgtgtccagcaggagctctcgaggcccagcgggtctgaggctaggggagcagcagggaggcgtccaggctggaaacccctccagggtttccactcctcagcagagatgacatccaagtcacccgccctcagccacctcagccctttccagaggggacaggggcagtagctccttccttcatgcccctgctggaccccatcccctggggaggtctcatgctggcagggagggcccgagcccggccccaggcctcagtgcttcctttctctgagacagcagcaggtccccctggccccgtggagcccatgtgtcgggcgggctgaggtggggatgctgccctgtgcacaggacagggtgcgggagtaggtgagccccaaccccctgagggagatccaggcctcccagcttccaggctgcactctcaggcagggatcctggggcctggccctcagggctgcccacggggcagttagtggcctgaggtgtctccagcagccatcctagagttggggagggggtctcaggacgggcttcttggaggaggtgagtgctgggggtcgcctgtgtctggaggccttcagggacaggtaggaagtccaatggaggaggtgatgtctggcatcacccaccctggccaggatcctcccccaacccctccggcagagactgccactggggtggccaggagccacgtagctgtgggtgccagcttcggagaaggaatttgaacagggtggacctggaggtgggtggtggctatcaaggtcagacccactctcagagacctgtggctttggctggcaggggagctggcaccaggagccccaccaggatccgccttcccagggagggcatgtggggcaggaggagccgctcacctggtttctgggaaaccacgggctgtgtctgggcaggcagctcagggatggctgcacccaggaccctactctcccctttaaacctccctggcacccctgcccacttcctggggggacccagggtcctgacaggaggggtgggctcctcgccaccctccactgtagtccctgcccccggtcctccactgcagtcctcccctcagtcctccactgcagtcctccccctggtcctccactgcagtaccccccaacccccacccccggtcctcctctgcagcgcaaccaccgtggcttgagccaggcacccagggcttctgagtgcccactgctgggtggcagtggcactagcgtgaggctggctctcaggcctgctggccaccacgagccccacccagctgcagcttccctgccctggcacctctgcagaggcctcagtcaagctgggccatcagagcccttgcccccaactagcccctgctgtgtgatctcctctctgagttaggaaggaggccctgccctgagggtttctagcccttgcccaggggtgctggggaaggccccacactggtgtttcatgacggtgccctgtggtggggcagtgatggccagctgccagggtggcctgcacgtggcaggctaagagtgaccagcctgaggggcccaggctctcacctgggagactgagaagccgtgctggcactcaggagggacttccagctcctagtcgtgtgggttgcaggccgtcctgtcccagggctgggggacttccttcaggcccattgctgcctgtggaagctggcctggtgtcttgtgggtgtgctgcctggatggtccctaggtggtggcgagggtcacacgctgtctgggccaggactcggtgacttccctgggtcggctggttctgctggcctttcctggggctggatccccaggcctgtggctcctgaggtttgggggcaggagggatggagccaccacccagagccccaggcagcacagggtgctgtgtggagtggaggccgggtgggcagcagccgtgcttgcagcgctgtgtggagttgggggccgggtgggcagcagctgtgctcgcagtgctgtgtggagtggaggccgagtgggcagcagccgtgctcgcagcgcttaagcaagtagaaagtgactcgcctctgcctccgtctccccatgccccagtggggcagtgatgggggcttggctgtggccttatgattggacgaccgggcttgaccttgtgagggcactagggcacctgtcctccgggggggtggtcctgggtgggctagtggcccagaaagggtcggcagcacttggagtgggagcaccaaaggtgtggacactggctgagagttgtgtgtgttcctgtggggctgggccaggagtgggggagggctccctgagacaagccccctcaccgccagcctggctgccgccacctgaccttgggagggagcagcgtgtgccagatgaccagagggctcccagcactcccacggcccagcggggagcatctctggggagggcggtcatgaggggaggcctggggcagcagcagagggtgggggacgtggccctggcatcttggcgaatcctgctctggagacagggtgggcacagctctgtggtcagaggcctgggggccactgctggtgttgtgctggggcaggggatggagcaggggtgcctctgcctcttgggtgtcacctcctcccctggagcacctgagggctggctgtgtgtctctccagtcccgcagcgtggacaagcagcatgccgtcatcaactacgaccaggacagggacgagcactgggtgaaggacctgggcagcctcaatggggtaagtgtgagaggccctggcctggccttttaacagctcgacccttcagccctggcccctccctctcagttctggctcctcccccagtcatagcccctccctctcagccctggcccctccctctcagttctgcctcctcccccagccatagcccctccttctcagccctggcccctccttctcagctctggctcctcccccagccctggcccctccctctcagccctggcccctcccccagccctggctcctctccaaaatctggcccctctcccagatcgggccccatccccaactacagaggcccccaggcctccccagaaggctccccctggcagggtctcaggccgccaaggatcaggctgctctcagggagagtggaccctgcagatgggaagggaagcactaggctggggaatggggcccctgaaatggaaggagctatgcttgggtacccagtctgggtatgggtggagccatgtgatcctttcttctgtaagttgggggtggcaggggcaggaaggtaacccggagggaacccctggctgcaagagcagggttggggggtcaggtgaaaggaatggggtatggggtggaagcaggcaggaaggctggaggcccctctctgggggcgtgtgtctgtccctgaggtccctgtctggatgtctctgtctgttgctgcgcttggcggactccagcttgtcctgggacactctatctttactgcactctgcagtcctgagctggggggccctagcagcccctcagcagcccctcaaggagctccggccagggggtctcaggctgctggggtctgtcctgagctccctcctcccgcagcatgcctgtctgatgaagcggctgtccctgaatggctgcacagcaagtggccgctcctctgcctgtgtggactgcgtcacccacatgggctttgagagggtccccggggttgttggcctgggttgcatggcaccgtcccagtccgtgctcctgggccctgcatggttggctacttctgaggcctgtgatgcccacagacctgcctcccacctgcctgtgggactggtgcatcaacactcctgccagtaggcagcctggaggggggtatcagaccctctgaggcctgacccttggccaagggccaccacagggcaggcctgcctcgactgttcccaagggctcatggggccaaggtgggggctggggccagcacgaggctgtatgggtgagaggaagcatctcttggagtccacttcacaaagatgctcaaagagttctgttctggagggttccatcatggtccctgcagtgctgggtgggccccagtgtctgggtgcccctgccatggctgtggaacttggggctggtgcctgggacagtgctgcacaggccatcactcgccgtgggttccagagagttggtgcccccgcggccctgcccactgccacccacctgctcagccccaccaccctgcggccctgcccacagccacccacccgcgcagctccccccccccccccgccacctgttttcctgcagacgtttgtgaatgacatgcgcatcccggaccagaagtacgtcacgctgaagctcaacgatgtcatccgcttcggctacgatatcctgcccctgagcgtccctcctcctgggcttcttctcagtccccaggaccacagtcaccctgttactccagaagcagggctgtcactgctggggttgctgggtaacagagcaccaaggatgaccctagggctgggctccacctgctgatggagcaccccaaggaatgccagtccctgcagcccggccccccgtggacaccctggccacgggtacctgctgcttgcccacccacccagcctgaggtcacatggggcctggggaactggtgaccactccctaggaccccgagtcctggcccgaccttgggactgtctgagcacatgggtgggcatggctgtgcctccccgggaagaaagaggcccctcctctgcctgcctcgatgggcccttgagctggcacacctgttgctgggcgtggacttcagcgctgggctcctggctcttctgctctgtgttcgccttaacacgtgtccacattccaacatgtatgtgctggagcgtgtgcagcaccgagtcccggaggaggcactcaaggttagtgctggccaagcccgggtggctcagccacgagggctcagccccccatcctccccaccatgctcccgctgccatctccccagcaaacactcaccaggcctctggggcgccctgttcaggctgcgggtgccatgagtcaggccagcctgtcctgccctgccagatggcccagtccggcaggtgggaaggtagtcattacccccagcctgctgcagtgacaggtggcgggggcaccgggacgcgggtgccactgttgtggatgcagcagcatccgggctctgggaggggcctgggaggagccgggctgcatggtcagcctgctggagctcctgggctttcggagctgcatcgctgggcactggcggatttagctgtggctcacagaacaaatggctcattgggtgagctgggtggccagagcccaggaagctgctggggtcaccctgcaggagagtgcagcggggctgaggcgggggccagcagcctccctgggagcagagggccccgttcagagggccaggagggtatagagcccctgagccccccagcatctttttgggagtgtctctcaggttaagtagctttggggtctcataaggggctttagattctctgacattacagttatttggagtcttcgaagctgaagggattaagagtctctagacagagtgtttagggtctctgaggctggggaatttggtctctctgtgagtgagatatttagggttccttaggctcgggggatttgaggatctacgtgttagaggatttggcgttcctctgggtgaagggatttgaggtctctgaagctgaggtgctttggggtctcatgcccaggggattaagttcgctccaggttaacggatttgagtccttcaaggtggcaggatttggggtcacttcaggctgagaggatttgttgcttcttagggtgaggggatctgaggtctcctgggctgaaatctgaaggtcttaggctgagggtttataagggttttacgctgcacgaccaaggccccccgagttcctgtcagtctctccgatctcctcccgcactgcccgccctggccgggtgccctctcggagcccctcaggaggtaacagctgcccccagcacattgatgaggccgccagcagggggtggccagaggcaggaaggaagggtgctggaggccgacggtggcagccttcaggggtgggcatccttgcgtgccctttccccggtgtgctggcgacacgcacagccggggcccctgtggggggcgtgagggtcctaggtgggaacggcatctcctcgccctcacttgttcatgtgggagttgtggagcacagattcagggccctgttcagagctccccgggagccctttggggccagggcgcttagcccgttcctcggatgatctccgagcagcctggggtcccccagcctgcaaggggcagggcctaagggagtcaggttctgtctgatggcacaagcggccctgctgcccatcccagggcccccactctgatgatcgcagcctgctctgtcctgccccacccaagcaggcccctgctttccctggaagctgcccctccccaggcttgagctggaccccgagccgtgttacctgggcaggctgaggctctgtctgctcttttggggagcattagggagagcttgtgacatgcaaagtcatagctgggccctctggatggagaggagaggctgggcccaccctggtgggttcctcctgaggctgggcccagtacctcaccccgcctggcctgcccacagcatgaaaagtacaccagccagctgcaggtgagcgtgaagggtttggcgcccaagaggagcgaggcactgccggaacacacaccatactgcgaggcctcgaaccccaggccggagaagggggaccggagaccaggaacaggtaggcccaggcagtgcggatggggtgagcacacagggccactgccaggccctctgccccgcacctgcctctctgcaccccttaaccctctgcatgcatataccatgtacacccatacccctcaccctttgcacacacctacccttgcacatgcacacccctcacccattgtgcacacctacccttgcacacccacattcctcacccattgcacacacctacccgtgcatgcctgcacccctcacttctgtacacacctacccatgcatgcctgcatcttcgttatacacaccctactcatgcacacccacaccactcacccctgtgcacacctacccatacatgcccatagctctcactgctgtgcacagacctatcatgcacacccatactgctcacccctgtgcactcacacccccacccctgtacacacatctacctgtgcacacccacatccctcacctcttaccccacacacacagctacccatgcacacccacactgctcacccctgtgcacacctacctgtgcacgcctgcaccccttgagcccacagttcttgtggggttggtgggccaccagctgggcaccctctgtccccagtggtgagaggcaggtgatgggggggtgaggctatgctccctagtatcaggcatttggactggattctgcagaccgagccagcagggctcaggggttggtggtttctgatgaaacctgatttgcgcctttggcagtcagtgcagcgggtaggcagaagtctgggaggaggacagctgcacgagggtccgcgtgggtccggtgggcacaaagggaagggaaggagcgagagtgagaaagtgcctggtggggtgtggaggggtcggggtggggtatccaagcctgaggccccagacttgagttctggttagacaggggtgtatccggggatcaggctctcggctcccacctcggtccaggaggggtcaccctgccacccccagctttggccccatgtctgctgtgttctgctgtcagcccacacatctgtgttgtacagccgcagctgccggtgtctggttgggatgcaggtccgcccagaatggaagaccgctggggactgggaagctttccagaaagccatctgagctccccagagcacctgtcagtgtccagactgtgaaacacatgcagctggtgacagccagtgtggggctgtcccggaggtcatgacaggtgcagccagctgggcagcctggctccttggctccgttagagcgagggcagcacattgtggggaccaaggaggagttcagggccggcagcagatggggactgcctggtagcagatgcccctgcctcagcagcccctgggtgtgtccctgggtcaagagggagtccccagggaggggtaaggcgtgtgtgacacatctcaggggccctgcatccccagcgcagtgtgcacatggttccctatgggtaactggccccagcgcagtgtgcacatggttcctgacgggtgactggccccagaccctctggccccccagcagtgtaagcagctgggggccatgacgcagaggccccctgggcttccgcaaggatggaaagagcttgggtggagggcccaggaaggagactgtgggcatgagggccagcgccctgacctgagggcactggacactgcttctgttcactgctgccatcaggaagggctgggctgccggcttctcagagggagtcaggagtgagattctatctgaaatatacaatttccctcctggtcattaaggcaaacaaactaaaatgccgcagggaccatgtagattgcagtggctgcccacccccagggccacccatttgtggcctgaaccatttaccagccttggaggtggctggacccaggtgtgggctccccctggcctcctgccctctgttggatgcgctctggggtcgggaaggccggggcagggttgcaggacggaggtggggggcccccaccatgccccaggggatgagcctctgagtacatcagaggggagagaggaggggccaggcagggaggaggggccaggcaggcagggagcctctaagcacttgtgggaggaggtggggccaggcagggaggggccagtgagccacctcggaactcaaggtagtcaacattccccacagaggcggggccctgggctgccacagggccaagctgggaggtgatgccagggcctgccccagagtccagcctctcctgggctgccagttctctgcttttcacactgggggccccagcaacacagggtctgacctctcgctccctccacagaggcagcctcttaccgcacacccctgtatgggcagccctcctggtggggtgaggacgatggtagcacgctgcctgacgcccagcgccagggagagccctacccaggttggtcttggggccaggctggtgagaccctgagggctcccagagggtggtgtgtgaaggggatggcctgggcttgaggagcccactccgggggacatggggcctgtctccccctcttgggtggagtggatggtcctggctgaggagggtggtggcaggtggttaccctgaggcccggtctgaagacatcttcccacaccagagcgccccaagggaccagtgcagcaggacggggagctccacggcttccgcgcccctgctgagcctcagggctgctcgttccggcgggagcccagctacttcgagatccccacgaaggagaccccgcagccgtcgcagccccccgaggtgccggcacacgagatgcccacgaaggatgcagaggcaggtgggggcggagcggcccctgtggtgcagagccacgcctccttcaccatcgagtttgatgactgcagccctggcaagatgaagatcaaggaccatatcaccaagttttccctgcgccagcggcggcccccgggcaaggaggccacacctggcgagatggtgtcggctgagaccaaggtggccgactggctggtgcagaatgacccgagcctgctgcaccgggttggccctggggatgaccgccacagcaccaagagcgacctgcctgtccacacccgcaccctgaagggtgagtgcccagctggcggccgtgccagtcccgggacaggcaggggaccggactttggctgggtctgcactgttgccatgcagaggggcccattcagctgggttgacttcccatttttcagttaattgcctaagagccacctgcctggtcaggagtccggtcctgcgtcttcccgttgcacttctttgccctgtgtgggggggccctgagggctggggtgctttgtcaactcagctaaggcatggggtgatgaggctgcctgagatcgacagctgtttcctttctctcggcctgacaaggtggggtcccctgtctcccccaggccacaagcacgaggacggcacgcagagtgactcagaggaccccctggccaaggcggcctcggccgctggggtgcccttggaggccagcggggagcaggtgcggctgcagaggcagatcaagcgggacccccaggagctactacataaccagcaggcctttgtcatcgagttcttcgacgaggacacaccccgaaagaagcgctcccagtccttcacgcacagcccgtccggggaccccaaggccgacaagcgccgtggcccaacgccggccgatagggaccgccccagtgtcccagccccagtccaggcagggggccgcagctcggggccacagagggccggctcgctcaagcgggagaagacagaggaacggctgggcagcccctcgcccgcctcccgaacccctgcccgccccttcggaagcgtggggcgccgctcccgcctggcccaggacttcatggcccagtgtctgcgggagagctccccggccgcccggcccagccccgagaaggttcctccggtgctgcccgctcccctgacaccccatgggaccagccccgtgggccccccgaccccaccgcccgcccccacggacccccagctgaccaaggcacggaaacaggaggaggacgacagcctcagtgacgcagggacatacaccatcgagaccgaggcgcaggacacggaggtggaggaggcccggaagatgatcgaccaggtgcagcccagcggcgagtgagagccctcgtggggaacgggggggtggaggcgatgccgggggtggcgagtgagagccctcgtggggaacggggggtggaggcgatgccgggggtggcgagtgagagccctcgtggggaacggggggtggaggtgatgccgggggtggcgagtgagagccctcgtggggaaccgggggtggaggtgatgccgggggtggcgagtgagagccctcgtggggaacgggggggtggaggtgatgccgggggtggcgagtgagagccctcgtggggaacgggggggtggaggtgatgccgggggtggcgagtgagagccctcgtggggaacggggggtggaggtgatgccgggggtggcgagtgagagcactcgtggggaacggggggtggaggcgatgccgggggtggcgagtgagagccctcgtggggaatcgggggtggaggcgatgccgggggtggcgagtgagagtactcgtggggaacggggggtggaggcgatgccgggggtggaggtgggcggacgttgtcctgctccggcccagccctggctcctgcctctggcccagctgggcaggagggagcctggtatgctgcccacagccccgcccctccccttcccagggctgggtccgtatcccatccgcatgtcctgctgacagccaggctgcatgtcccggccaccagccactctggccaaccaggtccctgctctccctgtggcctgggggtggccagtgtcagtggagggttgggaggtgggcttctctgaccctcggtgcctgggaccatttcctcttggcaggtctttggggtgttggagtcccctgaactctccagggcatcttcggccacctttcgcccagtcatcagaggggacagagatgagtctgatgacgggggcgtggcccagcggatggcgctactgcaggagtttgcctcccggccactgggtgcggccccccaggcggagcaccaggtacaggcacagacggccaccccaaggaggggctgggcaggaagagggcagcatccaagccggacctggggtcagcgggccccccatggggcgagactggactttcctctgagggacacgctcagaggagggtgggctggggcttccatgaggagggatcggggccaggtgtcaggcccactgttgatttgaggtcctgggcaaaacgggctctgaggtcaggacagggccacggctgctctgccaacctggaactgagttctgtgaggctgcctgggctgggcaggcagggggtcgcgttggagcaagtccaggcgaggcaactgggatccctggctgcctttgcaggggcacgcttgctcatgcggcaggccctgggtggcgcgcatgcgtggggctggtgttggctgctctggacgcccctcctgttccctggcaccccctgcttctcgccgttgggcttgcgtgtggaaacactcccaccctcctctccacagggcctcccggtgccgggctcccctgggggtcagaagtgggtgtcccgctgggccagcctggctgacagctactcagacccgggcctcacaggtaagtggctccagtgctgcgggggagtcgggccaggccggggcgggcctcaggccactgaccacggacacaggctgcctcttcctgagcgtggagggcctgcagaccagcggccctctaaccggctgcctttgtgctccacagaggatggcctgggacgtagaggcggggagccggaggggtccctgcctgtgcgcatgcggcgacggctccctcagctgcccagtgagagggctgacagccctgcgggcccagagagcagcaggaggagtgggcctgggccaccggagctggacagtgagcagcccagccgcctcttcggccaggaggagttggatcctgacagcctcagcgatgccagtgggtcggacgggggccgaggccccgagccaggggtggagccacaggacagcagacgcaggagcccccaggaggggcccacgtggagcaggggtcggcgctcaccaagggcccccggggagccaactcccgcctctttcttcattggggaccagaatggggacgctgtgttatctaggaaaccgcttgcggctccaggggatggggagggcctagggcagacagcccagcccagccccccagcacgggatggcgtctatgtcagtgccaatgggagaatggtcatccagctacggcctggacggtccccagaacccgacggccctgccccagcctttctccggcaagagagcttcactaaggagccagccagtggtcccccagcgcccggcaagcccccccacatctccagccacccgcttctacaggacctggccgctacccgggccgcacgcatggacttccactcccaggacacccacctgatcttgaaggagacggagacggccctggcggccctggaggcccgactcctctctaattctgtggatgccgagtgtgaggggggcagcaccccgaggccgccggaggacgccctgtctggggactcggacgtggacacagccagcaccgtcagcctgcgtagtggcaagagcgggcccagccccacaaccccccagcctctgcgggcacagaaggagatgtcgccatccccgccagctgcacaggacccgggaggcaccgccctggtcagtgcccgtgagcagtcctcagagaggcagcatcacccacttggcccgacggacatgggccgtggagagccggtacggcgctcagccataaggcgtggccacaggccccgagggtccctggattggcccagtgaggagcgtggccctgtcctcgcccacctacccagctcagatgtgatggcctccaaccacgaaacccctgaggccaccggggcaggacggctaggttctcgccggaaaccagcggccccaccgccatccccagctgcccgggaggagcagagccgtagctcagccagctcccagaaggggccgcaggccttgacccgctccaacagcctgtccacccctcgccccacacgggcctcccggctgaggcgggcccggctgggggacgcttcagacactgaggctgcggatggtgagcgggggtccctgggcaaccctgagcccgtgggccggccagctgctgagcaggccaagaagctgtcacgcctggacatcctggccatgccccggaagcgggccggctccttcacagggactagtgaccccgaggcagcccctgcccgcaccagcttctctggccgcagtgtggagttgtgctgtgccagccgcaagcccaccatggccgaagcacgggctgtctccaggaaggctgccaacacagccaccaccacgggtccccgccagcccttcagcagggcccgctcaggcagtgcccgatacacctccagtgagtgccagggcgggtgggaggccagggccaagacagggctgccagtgggtctgcagcatcttggatgccagctgagtgctggccgtgggcccctggtcctggcacgagaggagcctctgttcccaaagctggggtagatgtgttgctggactcacgtgcacacacacacgtgcatgggccgagggcagggcccgcagtcccctggtgtgggtagaacaccctgaccatctctggcgtggagagggccttccatcccccagggtgtgcctcagggccccgaagcccaggctggccctccccactcttcctgtactcctggctcaggcccctggtgcctttgggtccccacgccatctgcccatgggcctgaggccctaggcctggggagggctgtcccatggatctctgccgcagtactgtggctcagtgaagggtgccaagtacacctgtgccctccgctggtagctgctctaacacccttctgagcccgcaggccccatgaccagggagggagggagggctgtgagcagagtcctgccctgccccccagatgtccatgggcacagcaagcggggatggtcctctgtggccaccagagctggcctcctacctggggtggccggacatccgcgtctgcagagcggggcccaccccgcccgccgaggcagctgagctgtcctgcgagtggattggtttgaggtcaaggtgctgctgctactgccttctgccctgtgcacccacctacccacccacgatcccagtggagcctctttcctgactcccagcatcctcccacagccccaccccaactgctggctgcactgggcaggccttgcgtatggctggaggctgaggcagggttcgctggaggaaggggtggggcggggccgagggtcacccctgcttggtggagcctgctgtccctacccgacgtggtgcactggtggtgtttgacccaagcatgcggctcgccatcatgccccgctacagtgcaggagcgcagctgctgccaggcttagagcaggggctggtgaggaggccaggactctgcccaggagggcggaacctgaagctttgggtctgacaaactcaagcaggcagcagggagggactgcagtggccttgcttgcgctctgactggtccttgcctgtctgtgtggtccagcctgggccgcagcaggtcctggtggggaggtttactctgttttggggtctgtcaggcactgctttcccaccacctgtaagggggtttcccacctaatcagctgcagactgctcccgggttgcagccactggcctgggagcaccaggccgccttccccgcatgtgccctgggctggtgggggccttgtggtccctggagctcagcagctgttgatgtttcaatgaagggctactgggtgggggcaccagcctcgacgctgcccagccctgcagcactgagccctctcccagagggaccctgggactgccacagggtgctgagtgctgctttgttctgttcttgcttctaaaaccaattcactcaccaagacacgaggcgccggcagcagggctcggattacacgtccacctctgaggaggagtacggctcccgccacggctcccccaaacacacacgctcccacacctcaacagccactcagaccccgagggctggcagctccagccgggctcgttcccgggcccccggcccccgggacacggacgacgatgaggaggagcctgacccttatggtttcatcgtgcagacggcagagattgcggagattgccaggtgagtagcccattcagagtaaatccactgggtgccagtgcgttttcttgagtgagagcaccctgagggcagggaccaggctgggagctcccttcttgagtggatagatggtacggcagatggctggctggctggatggatggacaaatggatggatggatggatggatggatggatggatggatggatggatgaatggatggatggataggagggtgggtgggtggatggatggataggagggtgggtgggtgggtggatggatggatggatgggcaggtgggcaggtagatggataggttgctgggtgggtggatgggtggatggctgggtgggtaggtgggtgggtgggtggatggatggatggatgggagggtgggtgggtggatggatggatggatgcatggatggatggatggatggatggatgggtgggtaggtgggtgggtgggtggatggatggatggatggatgaataggagggtgggtgggtggatggatggatggatggatgaatggatgagtgagtgggtggatggatggatgggtgagtgggtgggtgggtggatggatggatggatgagtgtgtggatggatggatggatgagtgggtgggtggatggatggatgagtggatggatggatggatggatggatggatgaatggatgagtgagtgggtggatgggtgagtgggtgggtggatggatggatggatggatgaatgagtgggttggtggatggatggatgagtgggtgggtagatggatggatgaatggatggatgggtgagtaggtgggtgggtgggtggatggatggatggatggatgggtgagtgagtgggtggatggatggaaggatggatgagtgggtgggtggatggatggatggatgaatggatgagtgagtgggtggatggatggatgggtgagtgggtgggtggatggatggatggatgagtggtgggtggatggatggatggatgaatggatgagtgagtgggtggatggatggatgagtgggtagatggatggatggatggatggatgagtgggtgggtggatggatggatggatggatgaatggatgaatgagtgggtgggtgggtggatggatgaatggatgagtgggtgggtggatggagggatggatggatggatggatggatgagtgggtggatggatgggtgggtgggtggatggatgggtgggtgggtgtgtggatggatgggtgggtgggtgtggatggatggatgagtgggtgggtggatggatggatggatggatggatgagtgggtgggtggatggatggatggatggatggagagtgagtgggtggatggaggggtgggtggatgcagatcttcccaggaggtgagaccgccagtacaaggagggcctcctcaaaggttttcattagaaatgaactccctcacatggtcattcagtaacagggccctctccaggccaggcgctggggaggatggggtagggagttgggtgggagtgagagtggtctttgccaagcagtggtcagtactgcaaaggcagtccctgaaaggctgtggggcaggcagggggggtcccaggaccagggtggatggcaagtgtttgttgtggaggatgctgagcttgaagcccatgagggacctggaaggaggtggccaggagcaggcggcccttagagagtggcccacactggggtggaggcgcaggcacctgaggctgtgagcagcatgaagttggtggggaggacctggggggcttggaaggatggggactggggacagggctcttgggatgcttgaggtattgggggagcatagggaagaaggctgccatcagcggaggaggctagcacagggctagggctctggacagagacactgcacctggctgagaagggggtgggtgcttccaggcctgagagcagaaggggatgtggggggcccatgtgggtttctggagttctctgccttccatggtgggtgagctggagcatgccatatgacgggggcaggaggccagggagtgctgggcgggggcctgagggccaggggcatgtgccagttggtgtcacccagaggtggagggagggcttccatgttttgtcttgatgtggaatggtggacccagctaggacccagtcctgaatggggccagggcagccagtgggatgtgcaaggccatctgggcagagggtgctgggggtgtttctctggtcgtgccagtgtctggcgagggttgtggtgccgctggaggtaggggtagggggagggccctcagggtggtctgttccttgggtgactgccagtgtgggggccgaggaggcttggggtggggcctgtccccatgaggatgggtggttggcagtgacagggagcctaggtccccacggcctgggctgaaggcctaagtggggcaggacctgctggtggcccaggtgcttaaggggccagcaggacagctgacgaggctgtgcgctccagcagagggctgggagctgctcacgggcccggcaggcccctgtcctcgctgggaagtgtctgttacctcggcagggtggaggcctgtgccccctgggcacatcctagggggactgagctggccaggcttgagcagggggctaggctgagctgccattggcctcactggcctgcaaggggtcccctccctctctggatctgcccagccccaccctctgcccagccccaccctctgcccagcccccaccctcagtgtgaggagtgccaggctgtagtttctgtggcctcagcccactcccttccttgcctcagtttctctgcctgcagagctgggcacccgtggcacccacacgttctatgactgagtcccatccatcccatttgggccccgcagctgtgatgctggccctggggggccggagagagaggaggtgtggcctgccccagagccagcaagggtttctgtgcacccttcttttcaggctccgtcccagccccccaccatccctccttgtggctgtggggagtttggcctccctttggggccgtggccagtgcctgtgtaaccagtggctaggccggtgtttggggccaggctggggagcacctcccccaggccccacctctggccagcagctgcctgggagctgggaggggctttgaggcctgtctggcccctgctgccccgacttcctctgtgcagaacctgccgtctttcctgccggctgcaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggaggtgagccccaggctttctgaggcccctgtgccagagccaccctcgaggagggtcaggccaggtccccacagccctttgcatgcctcggctgaggccctgctgcacatccccacttggcgagctggaacatgtccccctgggtcagcgccccaaacggccaccggagagctcgaggtctggggcgctcgtggcacctgagtcaagcctgactgtgccgtcatccccagcccagctgcctccatggcggggcaggggcacaggagggaccttgcacagacggaaggtgggtgtgctctgtccacctgccgggccggagcagggaggtgcagccacagcctggcaggagcctctgcctggggcccacggtgccggccctccctcttgcagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggcacggtgcccactaccgccacggagctgggtgtggggggagcaggggcggggctcctcgagggcggggccatgctgaggccgggctcttgcaggtgatcttcgataacctgatgctgaacccggtgtcccagctgtcgcaggccatccgtgagaacacagagcaccttgccgagaagatgaagtgagtcggcttcctggctgaggtggacgcccagacaccagcacagctgcatgagctgagactcagcctggctgaatccctcaagggcagcggtttcatgggtactcgtgtgcacctgtggagcagccctcccgtgtgcacgtgtatgtggctcccagcaggcagaccctgaactcagaggagccagcgcctccagggcggcccttcctccccttctcccctagccctcatcccgggcccagccctccccaccgccgagtgtcaggcacagatgggactttggtgcccttcatgcatcaggcctcagtttcccccttaggcccaggtgggctgggatgaacttcaccatggcagaggaggtctgggagaattgtgcctcagctctgtcatctctgtccttgtccccccatttctgcctccccctacctcggacaggatcctctttcagaacacagggagagcttgggaggacctggaagccaggatcaacgccgagaacgaggtgcccatcctgaagacatctaacaaggtgagcgctggggccccgtgccccttggcctgcccccagccagcctgcctttgcctggctggccccaaaccttgtcccagctcctgcacacagagccccggggcagggctgcagcccgtcagaagttgactccacctcccttcctgccacgtttccaggaaatcagctccatcctgaaggaactgaggcgggtgcagaaacagctggaaggtgagtgtggcccaagcctggggcagcaagggaggctggcagggccttgtggggaaccctgactcacagggtgggagcaggtgaactggatccgcagcctgaccctccctccccacctccagttatcaatgccatcgtggaccccagtgggagcctggacctgctcacaggaaacaggagcttggccagctctgcacagccggggctggggaagggccgcgtggctgcccagagcccaccctcacccgcctcagccgaggccctgctgccagccctgcccctgaggaatttcccacagcgggccagctgtgggcctcccagcctcccggaccccaccttcctccctgatgccgagaggttcctgatctaggccccagacctggccaggccagcctccctgtgcgtgtgcgtctctgccttccgtccgccgcacacccgcctgcctggccgcaggtggttctccctgaagacccccacatgtgccatatccctgtgggcgggtgcctcccacgcccttgccccctcgtcagctcccagccagcaccctactcaccctgtccagccccatggccacccccacccctgcctcgccccctacaggcctctgggcccagctcctggccaggctgctgccaaggtcaagccctcaagggcattaccccgcctcctcttcatcactgttatttttgtctttagctttaaaggaaagagttgttggtgccattgcaggtgccccctccaggcctgactggctccgccaggcactaacctgccataaccctttgtgctggcctgcggccaggcagaggaagagaggtcgactgtggggtcatttggtgccaaacatggaggtgggcaggctcacctgttcctgggactgtctgagatggcagggcacttgccctggtggctcccacctgaccccaggccttttataggcaggagccccactgcttccagcctctggtgccaacacagttgccaaacccattgagcttggggctgccctgtggaggcctcctgggtatggaccaggggcttgttgagagctgagccatgcacacaggtgcagacaccccccaactcccatgcacacggctagtccaggcgcctccacgctgcaccgtgaggactgcagggcatgtccccgtgaggggctatgggcctctgtaggtgggcttccaaggtcctgggtgcagccgggtgcatggcagcccttctggcgggggtgagcgcacgaccaaagtcactggaagccgggtttccggaagctcgcagcttggcctgcaccacacgccctccccttttggcttcacgccatcaggcctcaagtgggcatgggggcagggacgggcccaggaactgttgttttctcaggattctttcagctgggaacatggcaggtgagcagagcttggtgcctctgccgtggcccctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagggccagctgctgggggagcggcactggggactggaggctggaagcgggtggtgtgtgtcccctgtttacttttagctgagctggggttgggtgtacgggttctgttcctctgagcctgcggcccacctgatgtttacgtgtgtgtgtgagggggggcgggggtggcaggtgtccccccctggtccccgccccaagagcctgctgtctgtatggaggaggtgctagcccggtccaccgggctgctgcccacccctgcatgccccagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatcacatggcagcacgctggagcctgtcaccttggccttgtttctctatccttggtgtttggggtgggtggggccctgcacataggacagaccaggggtggctgcaattcagagatgctgccaccaggaggcggcctgggctagaaagcagcatttccagatgtttactcctaaaaaacagaagagttaatttatgaaaactgttcagtgagacagcatccgagagcgctgtttttgtttgtttgtttgtttttgagacggagtctcactctgtcgcccaggctggagtgcagtggcgcgatctcggctcactgcaagctctgcctcctgggttcacgccattctcctgcctcagcctcccgagtagctgggactacagtcgcccgccaccacgcccggctaattttttgtatttttagtagagacggggtttcactgtgttagccaagatggtctcgatctcctgacctcatgatccgcccatctcggcctcccaaagtgctgggattacaggcgggagccaccgcgcctggccgagagcactgtttaaaaccccgctcatcctgcataaaaataggcagtaagcaggcacacagtccccgtgtggtgagcaccacctcccgccccagttccttctccctgctagggcttcggaggacacccactgcccgttgttacatcacgtcactggcacccatcacacccgggttgttggaggtgtcagaggtcactgtccacttccggccacagggcgggccccacggtactgatgtgttgtccggctgccaggctaccaggcagtggttcaggtcctcagcaaggctgaccttgagaccctggcgggagtagcagggcgggcttcttacctccgcagcccagccgtctggctgctccgagccccttgtccttccactccctgcggtggccgtggagaggacatcgccagatgttcctgggtggactgcctttatgatgccaccctcccctgcccttggggatgcatttgagtttgcaagggggtggttgagccgagcggcccgccgagaacttgaggacagggctccacaggcctcatgcagccactcggggcctccacgccttgtcttgcatctgaaccatctgaacgccactcccggggccacactggaggtggtcaccgctggcccggcccccttaacgggaggccacagggaggactgtgggtaaggccaggtagtgagaccttagtctgggcagcagactcctgagggccttctgagtggggccccttaacgggccttcccagagacccaggacctgctggaaagtcagcctcaacagacgtcccagggcccacggctgtggaaggtgccgggggtgcgccagccctagggtagggctgggcctggcgggccagtgggcggtgatctggtttggtgggctcaacattccaggacctccctaaggagtgcgagcttttcttgttccttgtctagtcagagtgaggagggctttgactgggagtgagggcacaggggctgcgggaggaggcggtggagggcagatgggccgtgtggagaggccggaggctgaaggggctgggtccccggcggaggggcagagagggccaaggacatgcccagctcctggcccaagtggcccagatgtggggacagtgggtgagatgctcaggtgacagttggggatgcagtcagggagctggagctgaggagagagaaccctgcgggacagaggggagctcagtggctcagggcctgctttgggtcttgggtcatttgcaggagtgagtgaagcacacatgtggtttgtgtccaattaatcttgctagtgacaaatataagaaaccattagacagaatgaagcccgcaccttttccatgcaaaaattaatggctttttcagagaaaattttcagaaaaattcaaagaaatgatggccaaacattcaaattatgacaaaaaagacagtaaactgtttttactctcaaatacaataaaattttactgagaaggctgtcatgatttagcttgaagaagaacttaaaatcatgccacaggccatttctccttttggccgtgagtaatggggtacaggatggatttgccttctcaccttgaacagtgagaaaatgacaaaatatgtgaaacggcagttttcagacactggacagcaggcagcacaggaccgtgatgtcaagaaaggaaagaaatgaggtgagcccgaccgcccgccttgctcacagcatagcttgcaggccaaagggcggagcggctcccacggggtttggtgatgttgccgagttgaggcccagatcagagtttggggaggccaaagcaactggaatttgcagagtgaagcagcggtgaggagagcaccacacacacagccccagcgccggcagaggaccccctgcacacacgcgaggaagccaggggaggcaggaaaaccacccgcagaacgctggagccgagcatgcctcggatgtgatacaggcctggaaatgcttgcacccccactggctgagggagaaaggctcgtggtgcacaggacactggatggtcctcagaagggaactgccgatgagtagggcaccatcagcccacagccctgcctcccctcccgctgcaaagcttgggtctggttttctcactgtccgaggtgagaaggcaaaccatcctgtactcctatcgctcacggccagaagcagcctgtggcataattttaagttcttccttaagctatcaattataaggcaatttctttctttctttttttttttttttttttggagatggagtctcgctgagtgcagtggtgtgatcttggctcactgcaaccttctcccgggttcaagcaattctcctgcctcagcctcctgagtagctgggattacaggcatgtgccaccacacctggctaatttttgtatttttagtagagacgggggttttgccatgttggccaggctggtctcgaactcttgacctcaggcaatccgcctgcctcagcctcccaaagtgctgggattacaggtgtgagccaccgtgcctggctgggaatttcttagtaaattaggctacctgaaaactaggaacctctattcatccaaagacaccttgaagagagtgaaaaggacaaataatttggactcaaaatgtatagtaactattataagtcagagaaaaaagatgggcaacccaataaagagcagggaaagtgaacaggtgcgttgcaggagggtgtccaagtgaccaaacacctttatgaaaacatgcccaatatcatttgtcaaaaaaagagaagtgcaaattaaaaccataatgagatacaaccatacccaccaaggtagctaaaactagaatccttggcttggcaggtgagagtatagtggttcaactattttggaaaaagtggcagaatttaccaacgctatacatatgcctacctcggacccagcaattctactcccagctttatacccaagagaaacaagtgcattcagcccttcaaaggcatgtccaagactgctcatagcagctgtatgggtaaaatctccacatggaaagcaacctcatggccctcgacaacagaatgggtgaataacacctggtatgttcgagccctgggctaggacatggcaagggaaaaataaatgactacacttcataaaacatggatgattctccagacgtcgcaatgagcaaaagtagccagacaccaaagtctacatgccgtaggatttcaaaagcaggaaaaagcgatccatgacagcagaaatcacaacactggttacctcttggggggaaggtattaactaagatgttcaaggaaatgtcttccacctgtctccaaaaaaaaaaaaaaaaaaaggccaggcatggtggctcacacctgtggtcccaggcttccaggtaatagatggattcagggattttctggttgccagttgattgaaagagttatctgaagacctggaatcaggctgggagcagtggctcacgtctgtaatcccagcactttgggaggccgagacggctgggatcacctgaggtcaggagttggagaccagcctgaactggtgaaaccccatctctactaaaaatacaaaaaaatagccaggcacggtggtgtgcacctgtagtcccagctactctgagggaggaggcacaagaattgcttgaacctgggaggcagaggttgcagtgagctgagatcgcaccgctgcactccagcctgagagagagagcaagactctgtctcctaaaataaaataaataaatttggtcactctacatatgtatgttatactgcatacaaatttgaaaaaaataaggatagaaaatatctaatagcatcaaattgttcctaatatcctcttgtctttctcgcctctgtaggagccgctgacgctctcattttcactcctgatgttggtgatttgtgccttttctcgctcttgtttcattcttgctgtggtttgccagtttcaatactcttctcataaaaccaactttttggttttacatattttctgttgcctgtttattgttttctctttcattgatttctgctgttagttttaattttctttttgtttgttagcttttttcttttcttccctatctggggtttctttcctactcctttctttccttcgtgacatggacagtcactgatttttctgcgaatcttcttttctaatacacagatttaaagctatacatttccttctaaacataattttagctgataccataaggtttgatatattttcatcactatttaggtaaaacaatttctagcgttttgtgatttctttcttggcctgtcagttatttagatgtgtgttgttaaattaccaaacatttgagaattttctggttagtcttttgttattgatttgtagcctcttttcactatggtcagaatatatgcttaaaattatttcagtcacttgaaatgtatagagaatgacttacggcccagtatatggacacttttgataattattacatgtgcccttgaagagaatatgtaaacttccaattttttttggagaggtgttattttttgtcaatttgaccagcttcataatttatgttcaaataatctatatccatatgaattttcttccatctgcttattctactagttactgaaaggactgtgttgaagtcgccgccgtgatagcagatctctctatttctcttttcagttctgtaagtttttattttgttttattttattttattttttgagacggagccgcactctgtagcccaggctggagtgcagtgatgtgatcttggctcactgcaacctccacctcctgggttcaagccattctcctgccttagcctcccgagtagctgggattacagactcccaccaccacacctggctaattaaaaaccccatctttttaaatagagatggggtttcaccatgttggtcaagctggtctcgaactcctgaccgcaagtgatctcctgccttggcctcccaaagtgctgggattacaggtgtgagccactgtgccaggcctataagtttttctttatgtattttgaagctatgctattaggtgcatacaatttagaattattaacttcccggtcgatgagccctcttatcattatgaagtctccgttatctctagttgtttttttatctgaagtccagtttgtctcgcattattatagttctgccagctttttttctagttaatgttatcatgatttattttttccatccttttatttatttatttaaaccaactcacttcaaagaatttctgtccttttaacgacatttttgtggggcttgttttaaaacattcagtctgacaatatttcttgtaattggagtatttttagtatacatctattatatttatcaatgtacttaggtttaaatctgctatattacatctgctatttgttcttttttctcccttttttttttccttttttaggattaattaaaatattttattttacatcctccgatttgcttgttagtcatacttttactgtactagtagcaattacccaaacaattataaaattaatccttcactaattatggtctaaggcaaattgttctttttactactttctggcaattatacaattataattataaaatcatttacaattataaaatgtaattataaaattcatccttcacttaccagggcctaatgtaaatgtgtacttttatcacttcctggacaatgtaaagaccttctaacgctttatttatttatttattttttgagacagagtctcgctctgtcgcccaggctggagtgcagtggtgtgaactcggctcactgcaacctctgcctcctgggttcaagcgattctcctgcctcagcctccggaggagctggggctacaggcatgtgtcaccatgcccagctatttttttttttttttttttttagtagagacgggatctcaccatgttggtcaggctagtcttgaactcctgacctcaaaggatccacccgccttggcctcccaaagtgctgggattacaagtgtgagccaccacgctctgcccttctaacgctttaaatccatcggcctctcccccactttttgtgctgtcattctcaggtatttcagttctgcacaatgttaaaccacacaataaatcatcttatcattttctacagccggcgtgcatggaaacgcactggcgtgtttcttctctgctgctcttttattctttccctcctgcatttccatgtttccatccaggaccattttccaaaggcctccattgtgatttgtcttgtttattagtgcatgtttgctgtaaggaattctctcaattcactggggagggtgtctgaaaatgtttttgttttgcctttccctttcacttgaaatagcatcccaagttggcagttattttctcttggtacttagagaatgttgttccattgtcttctggctttcagtgcttacgtggagaagtcaagagcctcattattgcttctttgaaggtggcatcttgttttttcctggctgttatttgtttaatttatttttatttttgtagagacaggatcctcctgtctcggcctcccaaagtgttgggattacaggcgtgagccactgtgccccacctcctgttactgcttttctcctagttagtgggttttcagtggttttactacaatgtgcttaggagtatctttgtatttctctatcttgaaatgtgtagcacttcttgcatacgcaattggtatgtctttcattggttttggaaaagttgcactcattttctcttcagatattgttctgccccatttgcaatctcccttcttggatttgagtgacagatgtggtaggcctgttgacggcaccctgtgtgtctctgatgctatgttccgtgcagttttctctgcgtgcttcagtcttctgtcggctgctgacctcaatcggtgcttgttaatcctctcttgagttctgtccactaacagtctgttaacccatctgtcacagtctttaccttggttattgtattcttagttctagagtttctatttgattttttcaagatttcatttctctagtgaaaatttccatctcgccgcttatttctcagagcagtcatcagagtcacttcaaagctccaacagtttcatcccctgcttttacacttgggtctatatattttttaatgtgtctggtgactcttggtttaaaacgacagacactgtggaaaaaaagtacaatctctggatgatattgtggccatcagagaggacccgccctgtcctctgccacaaagcagggacagatcaccagtcaagtcatgactgagctgtctaggacaggctgtagacatggtaagtctggttccacctcttgtttgccctctgatttacctctttgtcgtgcttctagggcacacccctctggggtctcaactgcaagccaggagagtttagcagtacctccctcctccctcctcctttgaaggaagtcctgggctcaattttgcttcccccgagccataatagagtgaagtttcactgaactcttcaaccactcaatgctcagcctcttagctgaggtgaacgtgactctcatgtcgggtgagaattagccactgcctcaagaggaaaaccagcacaggaagtccggctctcttctcagatcctctattctctgaataatttccaccccaatcctggtggtcctggcagggttgagagccaacgtctatctcctgagacttgtgagtttgccagaatctattacgcatgtcttttctgcctcttagcaaccatcctctgcccaacttctcagcccctcaccctcactgcttaatctctaccccttgaaacagctagaattgtcagctaaaagtaaaatcaaaattagacatcattataggcaagaaagggaaatccccatatgccagaaatggagtgggaaccgcgagccaggacgcgcagggagctgacgctgcaggtgggaaccgagagccaggacgcgcagggagctgacgctgcaggtgggaaccgagagccaggacgcgcagggagctgtcgctgcaggtgggaaccgcgagccaggacgggcagggagctgacgctgcaggtgggaaccgcgagccaggacgggcagggagctgtcgctgcaggtgggaaccgcgagccaggacgggcagggagctgtcgctgcaggtgggaaccatcagccaggacgcgcagggagctgtcgctgcaggtgggaaccatcagccaggacgcacagggagctgtcgctgcaggtgggaaccatcagccaggacgggcagggagctgacgctgcaggtgggaaccgagagccaggacgcgcagggagctgacgctgcaggtgggaaccgagagccaggacgcgcagggagctgtcgctgcaggtgggaaccgcgagccaggacgggcagggagctgacgctgcaggtgggaaccgagagccaggacgggcagggagctgtcgctgcaggtgggaaccgtcagccaggacgggcagggagctgtcgctgcaggtgggaaccatcagccaggatgcgcagggagctgtcgctgcaggtgggaaccgcgagccaggacgggcagggagctgtcgctgcaggtgggaaccgtcagccaggacgggcagggagctgacgctgcaggtgggaaccgagagccaggacgcgcagggagctgtcgctgcaggtgggaaccatcagccaggacgggcagggagctgacgctgcaggtgggaaccgcgagccaggacgggcagggagctgacgctgcaagtgggaaccgagagccaggacgcgcagggagctgtcgctgcaggtgggaaccatcagccaggacgggcagggagctgacgctgcaggtgggaaccgcgagccaggacgcgcagggagctgacgctgcaggtgggaaccgagagccaggacgcgcagggagctgtcgctgcaggtgggaaccatcagccaggacgggcagggagctgacgctgcaggtgggaaccgcgagccaggacgggcagggagctgacgctgcaagtgggaactgagagccaggacgcgcagggagctgtcgctgcaggtgggaaccatcagccaggacgggcagggagctgtcgctgcaggtgggaaccgcgagccaggacgggcagggagctgacgctgcaggtgggaaccgagagccaggacgcgcagggagctgtcgctgcaggtgggaaccgagagccaggaagcccagggagctgtcgctgcaggtgggaaccgcgagccgggacgggcagggcagggagctgaccctgcaggtgggaaccgagagccaggacgcgcagggagctgtcgctgcaggtgggaaccatgagccaggacgggcagggagctgtcgctgcaggtgggaaccgcgagccaggacgggcagggagctgacgctgcaggtgggaaccgagagccaggatggtcagggagctgacactgcaggtgggaaccgagagccaggaagcccagggagctgtcgctgcaggtgggaaccgcgagccgggacgggcagggcagggagctgaccctgcaggtgggaaccgagagccaggacgcgcagggagctgtcgctgcaggtgggaaccatgagccaggacgggcagggagctgtcgctgcaggtgggaaccgcgagccaggacgggcagggagctgacgctgcaggtgggaaccgagagccaggacgcgcagggagctgtcgctgcaggtgggaaccatgagccaggatggtcagggagctgacactgcagtatctctgggacgtttatgggcccagaaatagccctactggctaagcacccgagatgttccagccacccggtcaggggatgaggccttatgctaggagaggggagagatgacattgagaatcctgctccgagatgtgtgttcaaagggcagggaaaggggccagataaacttgacttgtggctccagtgaacaggcaaggaaacttgtctatcccctgactgtgggtgagaaggaaaattccacagtgagaaattgaaacctcagggaaagttgaccaactaattaacagagctgaagaaacaacttgcaaatgggaaggttgatcatcagaaattaggcagatgcaggaatgggatgaagacatgtaaaatgtcaaaggagattatgaggcatggaagatagaatgaaaatctatttaatgagttttacaggatgaggataaagaaataagaggagtcgatattcaaagagataatggctgagatccttacagaaataaccaaaagcataaatccttaagtttaagctgcacgagtcccaaggagaatgcataagaataaatctaacctgaacacagcatgttgaaactgcagaactccaaagacaaagagaaaaccttaaaagcaaacagagataagagaaactgttttcaaaggaacaacaattagcttggtgcatatttctccacagccacattatgtttcagaagtcagtatcttcaaattgtaagaatataacaaccaatacccaacttaagtattattcaagagtgaaggagggagcagggcacagtgacacatgcctataatcccagcactttgggaggccaagatgggaggatcacttgagcccaggagttccaaaccagcctgggcaacgtagtgagaccttgtctctacaaagaataaaaaaattagctggacattgtggtgtgtgtctgtagtcccagccactcaggaggctgaggtggaaggatggcttgagcctggaggtcaaggctgtgctgagccgggatcacaccactgtactacagcttgggcaacagagtaagaccttgtttcctaaaaaaagaaaaaagtgaaggaggaatagctattttcagacaataaaacctggcaatttaccactgttagagccatgatgaaagaatcacttaaggataataaactttaggaagaaaaaaccctttaattcagaattcagaaggaagttggggcatgcaagaagaaatagtgagtaaagaaactggtaaatatgtggtaaatctaaataatcattgaatgttaaaaagttataatggctatgaaagtttataccaaaaggtaaaactaaaatactaaggaataaaagccagcatccctcaggaagcagttggagcaaaacattctgagccctttttgctgttcaaaagggtggagagatgaagtctagacttctgaaagtcaagtatcatgttacaaatataaacgtagccactaacagcacagaaagataatgggttcttttctgtcagctgtattgtaggttcccaggaaccagcaagtatgataaaacctttaagctttcctgttctgtctcctcatctgcagctggtcctaccattcctcccctaaggtaacatgattaaagcagggagaaggaccacagccctgaaaagttctgcactctcaaagggaaagggagaagtgaacgtgtgggagaccctggaacagcaggtgctgcctggccatgcagtggcctcattatcaaggggagcttctggatctcaggacttaatatcaacttgttctcttattagcctcatttggaactgttgaaccagcgtcttaccaagctacaggcagagatgaaagtgagacctcagcccacctgggtgtatctctcttcagtctccccttgtttcacgtggtctcagggttgacatttatgttacagctgaccattaaagaatctaagtaggccaggtgcagtggctcacacctgtcatcccagcactttgggaggctgaagcaggcagattgcttgagcccaggagtttgagaccagcctgggtgacatgacgaaaccctgcctctaccaaaaaatataaaaattacctggctgtggtggcacacacctgtggccccagtgacacaggaggctgagacaggaggatcatttgagcctgggaggttgaggctgcagtgagccgtgatcataccattgcactccagtctgggtgacagagtgagaccctgtctcaaaaaaaaaaaaattagaatctgtaagtaaagaattagagaaattcattcaaagttttgtgggttgatggtgacccctgcagaagcagaaaggcaagcatctccaatccagggccctcaatgctcccatgcagcaaagcctggcaaatatgagctcacatcaaaagttgttttttttttgtttgtttgtgtttttttttttttttgagacagagtatcactgtgtcatgcaggccggaatgcagtggtgtgatcttggctcactgcaagctctgcctcccaggttcacgccattctcctgcctcagcctcccgagtagctgggactacaggcacctgccaccacgcccggctaattttttgtatttttagtagagacagggtttcaccgtgttagccaggatggtcttgatctcctgacctcatgatccgcctgccttggcctcctaaagtgctgggattacaggcgtgagccactgtccccggcccaaaagttatcaagcagcaacaccagcaaaaaatgacagatggacacagtactggaagatgcaaaaggaacaaaagagcatgggatacagccagagtcagaaaaacatcacatggaaaactataatgactgaaaataaagatctttcaaaacctcaatgaaagagttaaacagcagattagacacagttaaaacaagaattagtcaactgtaagaaagatgagaagaaattacccaaaatgcaatacacaggaacatggtgggaatagaaaatgtgaaagacatgttaataggcatagaagactgcgtgacaacatataacatacatctatctggagtttctgaatgagggagtcgaaaggatgagacacaggaaatattcaaagagatcaggccagaattttccagaactgggaaagacacataccatggatgaaattgtctctcaaaagatgttaaagtcctgatgcccagtgcctgtgaatgtggccttatttggaaatagagcctttacagatgatcaaggtaagatgaagtaattgggggagatccggtaaaccaaaaataaaaacctaagctcccgactgactgatggatccccccctcagcaaagggcattccaaagttaacctaaaagactagctcaggccatgatgcgaattaggggtcagatgcttcattataccctcttccctttggaattctggcacagctgaccagcattaacatttcaacagaaagattaaaattaggactgatagaacagactattgaagtctgataagaaacatctgcaatccattctctctgaagtctgctacctggaaggcttcatctgcatagtaagaaccctggtctctacaaccgttatcttaacctagacacccccttctattgattccaggtctttagataactcttttttttctttttttttttttgagatgaagtcttgctctgttgcccagcctggagtgcagtggtgtgatctcggcccactgcaacctccacctcccaggttccagcgattctcccacctcagcctctggtgtagctgggattacaggcatgtgccaccatgcctggcgaatttttgtatttttagtagaaatggggtttcatcatgttggccaggctggtcttgaactcctaacctcaggtgatcctccaaacttggcctccaaaagtgctgggattacgggtgcgagccaccatgcctggcctatattaactctttcaaccaactggcaaccagaaaatccttgaatccatctctgacctcgaagcccccacttcaagttgtcccacctttccagaccaaaccgatgtacatcttacatgtattgattgatgtcttatgcctccctaaaatgtataaaaccaagctgtagcccgaccaccttggaaacatgtctcaggatctgctggggctgtgtcacaggccattaggcactcatatttggctcagaataaatctcttcaaatagtttacagaatttgactctttttattgacaaccctaatcccatgtgactgatgccttatggtaggggaaatttgagacagacatgtacagagggaaggcatgaagacacagggagaatttcatctataagctaaagaacacctggggctaccagaaattatgagagagccacaggatcctccctcacagcctcagaaggaattaaccttgccgacaccttgagtttggacttccagcctctggaactgtgagacaatacatttctgttgcataaactactcagtttgtgaacttcactacagcaaccctagaaatgaatacaacatatatccacagaagatacaaaaacataagggaagccaaacagaataaatgaaagtaaaactacacagttacatcacagtaacattgaggaatactgtagataataaaatttgtttaaaacagccacaatagtaaagaaggattctctacaaaagaatggtggtggccaggcatggtggctcacacctgtaatcccagccagcactttgggaggcagcggtgggtggatcacctgaggtcaggagtttgagaccagcctggccaatatggcaaaaccccgtctctagtaaaaatacaaaaattagctgggtgtggtagtgtgcacctgtaaacccagctatttggaaggctgaggtggaagaatcacttgaacctgggaggtggaggttgcaatgagccaagatcatgccatttgcactccagcctgggcgacagagtgagactttgtctccaaaatgaaaatgaatggtggtggatttcttaacaatgggaccctaaagacctcaaagtttccagagaaaataattgtcaatctgtaattctatacccagaaaaatgatctttcaatactaaaggaaaattagaaatatttttatgttacataacaactaagagtttaccaacacatcttgactcaaggaaaacaattgacaacccaaaattttatacccagctaaactaatattcaagtagactttaaaggatatatttcaggaagaaggacaatgatcacagagggagaggctgaagtcaaagaaggaatagtgaataaagaaattgctaaaagtggctgggcactgtggctcacacctgtaatgccagcactttcggaggccaagatgggtggatcgcctcagctcaggaattcgagaccaccctgggcaacatggtgaagccccacccctactaaaatacaaaaaaattagctaggcatggtggcgtgcacctggagtcccagctactcaggaggctgaggcatgagaattgcttgagcccaggaggcagagattacaatgagctgagttatgccactgcactccagcttgggctacagagtgagactctgtctcaaaaaataaataaataaataaaagtatttttaaaaggaaatcattaaaagtggataattctaaacacactctcactagataaataatatctagttagacaaatatataattatagtagttaaatatatcatccttataaacatttaatttatggagtttaaaataataatattacaagtgctatggtcaggcaagtattaataaaaagaaagctgatgtggctaaactaatattctcttttttttttttgagacagagttttgttcttgttgcccaggctggagtgcaacggtgcaatctcggctcaccgcaacctccgtctcctgggttcaagtgattctcctgcctcagcctcccgagtagctaggattacaggtgtgcggcaccacgctgtgctaattttgtatttttagtagagacgggggtttctccatgttggtcaggctagcctcgaactcccaacctcaggtgatccacctgccttggcctgccaaagtgctgggattacaggtgtgagccaccatgcccagcactaaattgattttcaaaaaaatatattttaagacaaaaaccataattagggaaaagaaggccggtatataataatgaatagtattgttcagaggatgtaaagattcaaaacatgtatgtacctgaaaacagccataagtatggggaaaaaatgaagaagactgcaagtagaaattgataattctatcataaaagaagatttcaacacaactctctcagtgactgccaggtcaagcggataaaacattaataaaaggtgaataagattccaatagcacatttcgcgagctggatttaaagccatatctagacgtgaccgttagagaggacacattatgctctggtacgtgtggagcacttacaacaatcagcacacgcttagacataaggcagggcttaacacacttcaaaacccacttatgacaatgagcacatgcttagacataaggcagggcttaacacacttcaaaacccacttaggacaatgagcacacgcttagacataaggcagggcttaacacacttcaaaacccagtgtcatatgacttcactctctcagccaaatgtaattcaactctcaatcactcactgaggaagagtgttaaaatacatctggaaaccttataacagatttctaaatcattcatgaatgaaagaaaacgtaaaatatttagaactaaataataatgtatccctgacacacttacattagtaaagaagagcagctgaaaattaaaaagttaagcatccggccgggcacggtggctcatgcctgtaatcccagcactttgggaggccaaggtgggcggatcatgaggtcaggagtttgacaccagcctggccaacacggtgaaatcctgtctctactaaaacacaacaattagccgggcatggtggcgcagggctgtaatcccaactactcaggaggctgaggcaggagaattgcttgaacccaggaggcaaaggttgcaatgagccaagatcgtgccacttcactccagcctgggccacacagcgagactcttgtctcaaaaagaaacaaacaaacaaaaatgttaagcatccaactgaaggaagtctaaaaatgacaataggaatatactaagaaagtagaaggatgaagataaaggtgaaacataaataaatgaaaaacaaaacaaaactagaactaaaaatatctaaaactaaattagaactaaaagcagaactaacatatataaatttgatttcttgaaaaaattaatgaaatggccacaagatctctgaagggaaagaccggcaagaggcacaaaaccctactgagaaatgagaggagggctgctctacaatgcagcagagggcaacatgagtgatctcacagcaaggcaacttggaaaattacacaaaatggaccatttctagaaaaacattatttgccaagtttgattcatagagaaacagaaagcccaaagagtcctataatcctagaagaaattaagaagttaaaatcttcccacaaagatgtcaaaaatctaagacaattttacatgttctgccaaaattaaaaagaatattttatcccattttacaaacttcaaaatgtaggcaaaagtgggcacatgacctagttcactgtaggactctatcataatctcaatacaaagacaggacaagtgtgtaccacaaaagaaaaagcacactcttgggcacggatgaaaaatcctatataattattgccctatccaatctcaaaaatgtataaaaagtaccgttaaccactgcacccccaacacacagtcaaaaatctacgtataacttttgactccccccaagttgatgactagtagcctactgttgaccagaagccttacagatcacacaaacagttgattaacacatatcttatgttgtctttattatatgctatattcttacaatcaagtaagctagaagaaagaacataatattattaagaaaatcataagaaagagaaaatatatttgcacttcattaagtggaagtggatcatcctaaaggtctccattctcgtcgtgttcacaatgagtaggctgaggaggaggaggaagaggagggcttggtcttgctgtgttaggaatggcagaggcagaagaaagtttgcgtgtaaggggacccatgcaagtcaaacctgtgttgtccaagtttcaaactgtgtatgatattttggttcagttgggattattccaggaatccaaggttaatttaattttagaaaatgtctaagtcattccattcacatattaaaggagaaaaaccatattgtcatctcaatggttgccccaaaagcacatggtgcttctaaagaagggagagacttgctcatcagaccgcgcacctcagaacaaagctgtgataatgaatatagaacaacacagcacggagagaaacggatcaacggaatgggaaagagaaccgggacaaagacccgcacatgtggcgacttgagttcgtcagagctggccagacatatctgttggaggaagacggaatagtcttaaatacccacgaggaaaagaagtgaaatggaactctgcctccagccttccaaagcaatcagttccaggtgtagacaacacctcaatgtgaaaaaacaggggggcctttagagcagagtatttggctttacacacttagataacagcaaaagaaaaaaaaacttgcaaagaaatcttaaatttctcttactagtattactggctgtagagatattggaattgttattttgaaaacatgttaaatatagggtaagctaaagctagtaattacattaaagttgttaggagccaaaattttccatataagagaaatgacatacaagtacaaaaccaaagaaattaagaaaaactcttttttttttttttttttttttgagacatggtctctgctctgtcaccaaggctggagtgcagtggtgccatctcgactcactgcagcctagacctcatgggctcaagcaatcctcctacctcaaactcccacataggtgggactacaggtgtgcaccaccacacccaactaattttttgtattttttgtagaaatgaggttttgctatgtttcccaggctgctctcaaactcttgagctcaagcgatctacccaccttggcctcccaaagtgctgggattacaggcgtaagccattgttcccagcctaaggaaaatttttaatgttaaatttgaattggaactatcaataggaactcatgatttaacctgggtttctaaatgccatttccccactttaaagacccatggactcctcagtaagtagctgagtccaggtctggtgcaggaaatgtgtaataagataaggctggaagatcttgttgtggcagaaagcagctgaattaagatgcatagattattggaaatatgaaaaaagaatatagtggccagaatgatggattttgttagtggggtaatgaagctgtgattatgcaggaagctttccttctttattcagaaatgcatactcaagtatttagaggtaaaatatcatttatctctgcccattacttttaaattttccagcaaaaatgatgaaagagctcccactgaccaaagaatgatgactgaactggatcaaaacacattaaatatataataatccgtgagtccataatgatacatcaaaaagtcaaagaaagaaaactaaagcaaaaagcaaacaaaaactcatctgccaccatcagagacagcccattgcacaaaccccttaccctgaaaattggtaattagagagaaagattcaagcttttctcctgcctcgccagcaagaactacacatatgttgcaagtattgccgactcaattccaggccgctgcaatgtcacataaatgtttcagctttccagtgcatacaaaagttatctttatactttacgtagtctagtaagtgtacaataccattaagttgaaaaaaaactgtacgtaccttaattttaaaatatcttattgctaaaaaatgctaataatcatctgagccttgggggagttgtaatctttttgccggtgagggtctcgcctcagtgttgatggctgctgactgatagggtggtacttgctgaaggctggagtggctgtggcagtttcttaaataagacaacaatgaagtttgccgcatcagtggacgcttcctttcatgaaagcggcactccccacgattcaagtacagatggtcccatcttaggacaattcgagttaatgatctttcaactttatcgtggtgcaaaagtgacacaccttcagtagaaaccatgctttgagcacccacacaaccattctgtttttcactttcagtgtagtattcaataagttacacaaggtattgacactttattataaagtgggctttgtgttaggtgattttgcccaactctagggtgaaatcatatgcctgttagccatgtttttttggtttttgtgttttttttgagacagagtctcactctgttgcccaggctggagtgcagtggtgccatctcagctcactgcaacctccgcctcccgggttcaagagattctcctgcctcagcctcctgagtagctgggactagaagcacctgccaccatgcccggctaatttttgtatttttagtagagacaggggtacaccatattggtcaggctggtctcaaactcctgacctcaggtgatccatccgccttggcctcccaaagtgctgggattacaggcgtgagctaccaagcccggcctttgtatatcttcttctcagaaatatctgtaagttggccaggtgccgtggctcactcctgtaatcccagcactttgggaggccaaggagggcagatcacaatgtcaggagttcaagaccagcctgacaaacgtggtgaaaccccatgtctactaaaaatacaaaacttagccaggcatggtggcgcttgcctgtggtcccagctactccgtaggctgaggcatgataatcccttgaatctgggaggcagaggttgcagtgagccaagattgcatcaccaaactccaccctgggcaacagaacaagactccatctcaacaacaacaacaacaaaaagaaatgtctgcaagtgttctgatcacgtttaaggtcaggctatgctatgatgttcagtaagttaggggtattaaatgcataatgcattttcttttgagacagagtcttgttctattgcccaggctggagttcagtgatgcaatcttggctcactgcaacctctgcctcccggattcaagggattctcgtgcctcagtctacggagtagctgagaccacaggcacacgccaacatgcccagctaagttttgtattttttgtagacacagggttttgccatattgcccaggctggtcttgaactcctgggctccagtgatctgcccacctcagcctcccaaactgttgggattacaggcgtgagccacctcacccagcctgcatttttgacatgatatattcttaattgatacataatttttgtacatattcacggggtgcatgtaagcttttattacatgcatagcatgcgtcatgattaactcagtatttagggtgtccatcacttcaagtctttgtcatttttatgtgttgggaatattccaagtcctctcttccagctcttttgaaataaacaatacattgttgtcaactatagctaccctactctgctatcaaacattagacatattccttccatcgcaccataatgagtgcatttgtgctcattaagcatcctctttttgtcctccccctccactggaaggaaataatgtatacagtggtccattttcaagacaaagtgccttaaatcggcttaggtcagcaaactacagaagaagcaggatatactaggccctgggttggatagccaatgcctgcttgtcacccaccctcccgccacctacttaagttgccctcacccaaaccaaagaagtttggtctaagataaaagtttgctagcctgtaaaatagcttgccttgtctgttcgtatcagcctgcccagctacttaggtcataagtcaaatacttgaagagcccctgagctaactaggattgcaatgcattgtgggctgcaacaaaatgcagcaagacaactctaaagaaaacacctaaagcccctgcccaacaaccaataggtgacgtccaggaaggttgtgaccccatagtactcagcctatgaggaaccgggggagggacctgcacacgaggggataaattgcttgttgaaactgtgctgggtgtgcctgcccaccagacacccgatcttgcaagactgtcattaaaagtttcactttggcttttctccgggtctctaagtccattctttgggtttggatgggtgagtttgtttctcacatacccacgcacccttcctagactctgggatctatcgttctcttctctgcctcagaggtcaacttttttcactcccatgtgtgagtgagaacatgtgatgtttgtctttctgtgactggcctatttctcttaacataatgacctccagttccattcacgttgctgcaaatgacaagatttcattctttttatgaccaaacagtattccattgtgtgtgtgtgtatatatatatcacattttctttatccattcatccattgatagacagttaggttgattccatatcttggctaccgtgagtagtgccgcagtaagcatgggagtacaagaatccctttcatatactgatttcctttcctttggataaatactcagtagtgggattgctggatcgtatggtagttctgtttttagttttttgagaaacttccatacagttctccacaatggcttcactaatttacattcccaccaacagagcataagtgttcccttttcttggcatccttgtcagcatttattttttgtcttcttgataacaccaattctaactggggtgagatgatatctcattgtggttttgatctgcatttccctgatgactagtgatactgagatttttctcgtatgcctgttggccatttgtatgtctcttgagaaatgtctattcagatcttttgcctgatttgttttttcaagactgagtttcgctcttgttgccaagctggagtgcaatggcacaatctcgactcactgcaacctcagcctcccgggttcaagcgattctcctgcctcagcctcccgagtagctgggattacaggcgcctgccaccacgcccacctaattttttgtatttttagtagagacagggttttgccatgttggccaggctgttctcaaactcctgacctcaagagatccgcccactttggcctcccaaagtgctgggattacaggcgtgagccaccgtgcccggcctatttattttttaaacagtgtcttgctctgtcacccagactggagtgcagtggcatcatattggctcactgcaacctctgcctcctgggttcaagtgattcttctgcatcagtctcccaagtagctgggactacaggcatgcgccaccatgcctggctaattttgtatttttagtagagacagggtttcatcaagttggccaggctagtctcaaactcctagactcaagtgatctgcccacctcggccttccaaaatgctgggattatgagctactgcacctggtcacattaaaaaaaatttttttagcaacagggtctcactgtattgtgcaggctggtctcaaactcctggtctggagtgattctctcaccttggcctcccaaaactctgggattgcaggcgtgagtcaccttgcccagcctgctgggagtttttatcatgaagaagggatgtcgaattttatcacatgctttctctgtatctattgagatgaccatacggtttttgtcctttaatctgtgatttgacgtattgcatgtattgatttgcgtatgttgaaccatccttgcatccccaggataaatcccacttagtcataatgtattatctttcaatgtgctattagattcaatttgctagtatgttgttgaggatttttgtgtatctattcatcaggaatattgacctgtagttttcttttttgttgttgtgtccctgcctggtttgagtatcaggataatgctggcctcatagaatgggtcagagagaattccctcctcttcagttttttggaacagtttaaggagaaatggtattagttcttttttgtaagtttggtagaatttagtagtaaagccatctggtctataggccttttgcgttgttgttgggagatttttattactgttccaatctcatcactccttattgatctgttcgggtttttttgtttcttcctgattcaatctcggcagctacgcgtgtccagggatgtctccatttcctccaggtttccagtttctgagtgtataatttctcatgtagtctctggtgatcttttgtatttctgtgatatcagttgtaatgtctcttttttgtttctggttttggttatttgggttgtctctctttttttcttcattatcaacttagaatattttcagcttccatttatgatgggcttatcaggacatagctccaccatgaggtgaggtgtgtctgatgtgcttacggtggggtttaagtgctcccacaagcctgctctgacagtctgtacttatttggggtaaaaaacaaaaaaaaacaaaaaaaaaaaaaacaaaaaacttagctctgctgacaaataatgagtcatattttcccacaaagttaatttttgaaataacaaaggaaattaaagaaaaaatgttcaggctgggcacggtggctcacacctgtaatcccagcactttgggaggccgaggcaggcagatcacgaggtcaggagattgagaccatcctggctaacacggtgaaaccccgtctctactaaaaatacaaaaaattagctgggcgtggtggcgggcacctgtagtcccagctactcgggaggctgaggcaggagaatggcgtgaacctgggaggcagagcttgcagtgagccaagatcacaccactgcactccagcctgggcgacagagcgagactccgtccaaaaaaaaaaaaagtaaaatgacaggaaaagatataacattcaaacagcaactcaaagagaggtggagttcctatactaatatcagaaaatatagatattaagacaaaaattattgttagagacaaagaaggatgtgttataatgataagagggtgatccataaggaagatataataactagaaacacatatgcactagctgggcacggtggctcatgcctgtaatctcagcactttgggagcctgaggcgggtggatcacgaggtcaggagattgagaccatcctggctaacacggtgaaaccccgtctctactaaaaatacaaaaaattagctgggcatggtggcgggcgcctgtagtcccagctactctggaggctgaggcaggagaatggcctgaacctgggaggcggagcttgcagtgagccgagatggcgccactacactccagcctgggcgacagagcaagactccatctcaaaaaaaaaaaaagttttgcttcatgggaaatccccaaagtccctccccacaccccatgggaccaaagggccctagacctcagggtggggcctgcagcgcagggagcagagccggcaaggagctgccctcaggtcgttcctggccacacagccagcctcggagccactgagaggcctgccctgggtcccgaatctagacgccccttccagcctcaatctttcttccagggtaagcagcctgagaggccaagaggacagtccaccgaaccctgagcccaaggcccaggattccttgcttaaacatccccaagcctggatccatcctcccgaggtagagctgcctgagctgtacccagtcctgctggcctgaggggcagccaggggaggtgacgtggtgcttttctggggctgcaatgagctcagacccacgggctgggtgtagcatgtgggctcattgaggcccctcacaatgtggggaaatcggagaggggactggctggggctggccctcctgcaaggacttctgagagtgctccaaggagccctggggtcctccacttgcccctggccttccaggccctcacacaccattgttgtccagacagaagagactgggcgctgtggttcacgcctgtaatcccagcactttgggaggccgaggcgggtggatcatctgagttcaggagttcgagaccagcctggccaacatggtgaaaccccgtctctaataaaaaatacaaaaattagccgggcgtggtggcacgtgccttaatcccagctacttgggagacagaggcaggagaatcgtatgaactcgggaggcagaagttgcagtgagccgagataaagccgttgcactcaaacctggggtacaagagcgagacttctctcaaaggaaaaagaaaaaaaaaaagacagaagagaacctgttctgtctaactgccttttgcttgagtgcagggaaggcagcctcccttcatactcatgccccagccctgcaaatgtcacagcaggacccacctggctgcccctccccatacccagagtaaccctcacccagagtccctggaggacccaaccctcgggggcatgcctggggcccagctgcattcaggcatccagcaacccagccagagggctggggctccccaaccatggccgggaggtaagggctgaacccaaggccaaatcagagcatcaggaaggtgaagagagatctgggaggggctagggagaggatggatctcttccccattcacttcctggcccacccagactggccccaggggtgcagctgacaggccccacccttgggaactgcaccctcctgactggtgtcctgcaggcaccctgaggccatcaccctggacccctgccctacataggccttacaaggaggagccagggtggacacccagacctcattgaaagtaggagtgttctcaaggtcccagaccttactcagggaccccagtcggggggtggggcagtgggaggcagagccccttgctaggagcttctagccaggcccaccttttcagatatgccagtgagcagccccagcttcgttctccaagataaagaccctagttacctccattgctcagcctcccttgcagctaagtgtagccatgtgactaagttctagatcaagttccagatcacagataagtggaagtgccctgtgggacttccaggaagtctcctctgggatgtcccttattctctgctaagaacacagaggcaatggctgagttccagcagccactgtgaggccatgaaggcagggatcctagggactgggatctgagagcctggctcccaatggcagtggagcaatgccatcatctctagcaaggccgtctctagcctgccagcccctggacctgcttagtgttcgagagtaatgaacaaccttgctgaagccactgttccttaggtgtctgtggcctgcagctgaacttgactccgattcgtaggcccgcaactggagggcctctacctcgagggagtggggtgtagatttttcctggaggtgaaggttctcagccctaccctctagcccgcccacccagctccagccgtctgtttctgtctcagatgagagggggcctctcaggacaaagaggaagtagctggaaggggaaggagccagctgcagagaggaggaggtgagctgcagagaagaggaggttggtgtggagcacaggcagcaccgagcctgccccgtgagctgagggcctgcagtctgcggctggaatcaggatagacaccaaggcaggacccccagaggtatgtgccaatgaggccagggcagctgagaaaagccaggcatggggaaagggctgctgtctgcctccctatggcctcagcctcccagcaaccccaggtccagagagtcacacagcctccagctagtcctgtagatgactcgctccgtccccagtccgtgcagctgggataagctgggccctggctctccagccaggtgacagctgggccctctacctcagcctgggactggcagccatgcctaatgccctgcagggcaggaaatctggcaccttcagccatgacctctgatgtctgcagggtcttacgctatctaccatgggaccagggggctacagccctactctgcaggggtctctcagcttgagccaacctggctggcggtcctcccaggttccattgcaggaggaggtggtgaggcgctctggggtctgtagtcctgggaggggacttggacaggctccaagtctgagatggggcctgcaagaggcagcgcctctgtgctctgagctgcccgtctgcctggagcatttaagggagcaaaggtcctctctggtgagggcagggagtgtggggagcagctgtccaagaacagccctggcacctcgttgcccagccacagcccaggattccatgtttcctctcattgaccagccacagcccaggattccatgtttcctcttctgagagttagtgggggagagcaaaggcccgatgctgggccctgaatccctggggacagtggggacacggtgggcaccctgaggtctcctctgtggggtggggggagcatcccccagagttcagctctggggtgggggcggcacccacccacctctgcaggaccccccagcgtggggggagttgggccgcagtgacttggcctgagtcccctgtccccacacttggtttatgctcctacccccaatcccccataacgcttggtctccagggcagactcagtccaggcccgactcctgtggtgttcctggcatttccgccccatgctgaggcaggccaggttctcaaagccctcagccctgacccgtgggaggacagcccagacgaaccccagaggcctggaggctgagctggctgctcctgggtggacagccgacccaccgagccctgggtcccagcgcccagcctggctgcagacactggcactcagcactgcccaggcccaggccccaaacctcggagacatccccatcccagccaggggccagccagctcctgccctggtggatgtctcagtcagaggctggccagccaggtgaccatgctgggcacagacccctccctgcacccggggagggcgcctctgtacttgtgaggcacccttcccccatggtggcacctggggcagcctgactgcttgctttgggggtaggagtggggatgggagcccacatcccacagggcccagatggcctggctcccagctccttgtggggtgaccactctgaggagataaggcgagtccctgcagcagaggacaaccccctctgccagcagtaggggtcccactctgccgccatctctgccctctccacgcctagcctctccagcaagggtactgctcagctgccccctctgacctgtggctctctggaggggctgccgtggggccaagacaggagcccagcccaggagggaagcagttatttataggccagcaataagaggaccaagcgacaaaagcagaaacagccctttcagacgcagtttcagttgtggttgaaacagggaactgagatgcaaatacctagatactcactgagtgggagaccctgaaaggggagacacagaaagccggggcatgtggctaggcacagacgcccgcccgcccctcgtgcttggcccaggctcagccctggggaccgccttaacagcagtccttccggcttggccagggggacaggacaggtgacatgtggccggctgcgggctccaacacccacacggcttgtcctcgtggaaagcacacccccaacatccagggcgtgacctcgggcatgagtggggggcttttgggggcttatgtgggtgtctgtgcaggggtgtccccagtgcccagctgcccaggcactgaggggcagttctgggcagagctggagctgctggtgatgccaggctgccctgtgcagatgctgaagcctctttggaaagcagcagtggcccccacatggccatgctccatgccgccccgccgcccgtgggacagagaggctggcacggtaggactggggggccccaggggggaggtggctgggatcaatggcctttcaagagctccgagccagagtggagaggtcacaagcagccttgagggggcctccaagcagaggtgccctgactggtgggcaagggaagcctccctgggctgctccagaccttccctttatgcccctgctggaggtgctggggacagccagttaccacgagccacagcattgcagagtgggctgcaggccccctgacccctgccaccaccctgggctgggggccttctctgtatcaccctcccctctcccttgtccaccctagtcccaccccagtggcagcccaggtccgggaagtcaagacggtctctgtctcagcactggaggggccatcgtggcccagccagaagtcaagccccgccctgtctggtgaccctgcgggtgctgccccatccagttgcaggtcctgggagcgctggctgtgctgtggctgggctccgtggctcttatctgcctcctgtggcaagtgccccgtcctcccacctggggccaggtgcagcccaaggacgtgcccaggtcctgggagcatggctccagcccagcttgggagcccctggaagcagaggccaggcagcagagggactcctgccagtaagtgagcccatggaggcctgcgggggcaggtctcagtttggggctgctgcctgtgtttctgcccttggatctgcccgtgagataaggggggccctctaccagctcctccaggaaggtgcaggtcaccagggagggccacgaccatatgagctggagtgggggctggggacggggcaggcgtgtggtgctttttgcagcaaacagaggctgccacctgggggctctgacaggctggagaacactgcctgtgctgaggctcaccccctcagtccttccacccctgggggtaatgtcactgtcccctgccgcccctcatccttccctcccacccttctttccctgcggttggggtcctggaatcccaggactgccccggaggaacctgttgggccatcctgcacacatcccctggaaacgggagcttacctgcccctggcccaacctttcccttccaggccagctctggccaccaccaagggcttccacaccacgaggccaccccagaccccagactccacagctctgctctactctgcccggcttcaggagcagctgctccctgtgggcagtgcctcagggctgagtggggccaggaccccccagtctagcctgctctggaccaggcagcccctctcaggctccttcccaaattgctcctgggtgtcaccaccccagcagcatgctgggctcaggcccaccctgcccagtctgttttgttgcctataccttaaacccttaccctgcacacttggcctgggctcatcccgggggccacctgagcaacggttgctctggcttggcagtgggatggggcaggtgatgtgaggtgggctgggggctcccgcacccatactgagcccagtgtggctctccccacaggcttgtccttgtggaaagcatcccccaggacctgccatctgcagccggcagcccctctgcccagcctctgggccaggcctggctgcagctgctggacactgcccaggagagcgtccacgtggcttcatactactggtccctcacagggcctgacatcggggtcaacgactcgtcttcccagctggtgcgccccgccctggccccaccgcatcctggtgctggaaacacagcaagtcaggctgcctatctatgcaggcgtctcgggcaccaggcccgggggctcagcttggtggtagggtctagcatggaacagggattaggccgctcctttgggggctctaacagcagaggtgtcaaggagctgggcctctgggtgactaaacactcagactgtgcctggtgcagtttggctctcaccaagggtcatccagatacttgacctgaccttgagctgtgggcagtcataggtgggcctcctgaggaggacatgggtcctagtggggatgcggaggagagggcagcctgaggtcagctctcatggctggcctggccttgcagggagaggctcttctgcagaagctgcagcagctgctgggcaggaacatttccctggctgtggccaccagcagcccgacactggccaggacatccaccgacctgcaggttctggctgcccgaggtgggtacctgcaccatgctgggcaccactgccctagcgtcgggcatgggctgtctggctggcaccacaggacaaggaaaagaagtgagggtgggaaaggtgccctggacttccctaggacaccccaggagggcaggacccagggctctgaggtcctttgagtcagcttcacctgggcacagggctggttccacggatccaaaagtgccattttccacagggcagagcacaggtggcctcggagccctgctgagcccagcagctgacctgtgggtggaggctcaggctgggacctctggctgggcagtgagaggccatgggcagtcaccacaaaggcaggctctggagctgagctgcccagagggatcctgggccagtctatccctctgtgtcctcacctataaaatggggatgaggatagcagcagcttagtaggactgttgtgaggacatctgagtcaaccccactgtcaagagcttggggtcaggctcaccatgaagctagcacttagcaagacctagttcatcccattgcctgaactctccaccaggtgcccatgtacgacaggtgcccatggggcggctcaccaggggtgttttgcactccaaattctgggttgtggatggacggcacatatacatgggcagtgccaacatggactggcggtctctgacgcaggtgagtgccagggccctaacacaggaggcctgcctgaagcgtttccccgcctgcactcctggggacttggcctgacatctcagtgcatctggagaaagtcgtgtagtcctgtttacaattcactatggtagaaacaaccggagactggtctaataaatgatagaattctacacagccactgaattcatgctgtggaatcacattcaatgacatggaaagatgttcaagtcacattacccagggaagcatggagattacaaaatacaagcctttttaggaaaagcaatgcatgaaaaacgtgtcagaatggtcatggcaaaggcaaccatggttatcacttgacagtgggattaagaatgatcccattcttaatggcttgatgcattttctattgtttttgtaataaacgtgtattgctttgatcattggaatacaatgttcaaaaacacaggcacccgctgggcactcctcccaccagcacactctattacagattcctacaggcaatgcttcccgcaagtggggaccagtcgggcagggactgcacctgccccaacatccctggcctgggtggagtggggtggaggccccacagaggggtttttctcccacagcgcctgactttggtccctgcaggtgaaggagcttggcgctgtcatctataactgcagccacctggcccaagacctggagaagaccttccagacctactgggtactgggggtgcccaaggctgtcctccccaaaacctggcctcagaacttctcatctcacttcaaccgtttccagcccttccacggcctctttgatggggtgcccaccactgcctacttctcagtaagacgggttgagaaggagcccatcagaggcccctgttctcccctggctggccagacccacagggagccctctgggctggccctgcagacaccagcagcatcagctgggtcctcaggcagccagcaccatgggtggggctgtggccctggggtgagcagcaagcaggctggcatcagtaggctctgggctgtgcctggaggcaggcttagctccaggaggacagctggtcagcaccatccctgggaaacaggccgcctgggaggtggtgggaggacctggggccctgggagtctccagactgctgggcgaggccaaggggcttagctgggcactggagagggaggggaaccccacttgctctgcggggaaggaagggaagagtgaggggtgggcagatcctcctttatcagcccacgggggtgggggtggacagccctccagccagccgagggactggtctgtagtagaggctgtatcagaacaagggaagcctccctagatgggggtgggggtggcaccctgaagggagtggataaacttccctgtggccaggaactgtttctgggacgtcaatccagcctggagcccagggcagtccagctgcttccccactctctccgccaggcctcagagccagtccccaggacccctgttgagccgaccccttctttcctcatatttccaggcacctgggccccctccctccacaccacatggggcctcttaggtggtgcatggtggggtcacaagttcagaatgggctgggctggcagagccttcagggatttctctcccgtcacaggcgtcgccaccagcactctgtccccagggccgcacccgggacctggaggcgctgctggcggtgatggggagcgcccaggagttcatctatgcctccgtgatggagtatttccccaccacgcgcttcagccaccccccgaggtaggtctgagtgggaggtgggcggcctgctctgctgacgggcagctcctgggcacgtcccctcctgctgggacccctatcgggcccggcttgtaagcagagccccgtccctccccaccccaaggtactggccggtgctggacaacgcgctgcgggcggcagccttcggcaagggcgtgcgcgtgcgcctgctggtcggctgcggactcaacacggaccccaccatgttcccctacctgcggtccctgcaggcgctcagcaaccccgcggccaacgtctctgtggacgtggtgagggcgtgctcccggccgggcgtgggaaaggcggccctcctgccgcccttcctgacgcgctgcctctgctcccctaagaaagtcttcatcgtgccggtggggaaccattccaacatcccattcagcagggtgaaccacagcaagttcatggtcacggagaaggcagcctacataggtgagcgcgatcagatcacggcgggcgggccccagggtggccaggcacgggcgagggaggcactggctttgtgaccggcgtggacacctcaggagggaggggctgctgctgaagggggacggggtctccatggagttccggggaccaggccacccgcctgtcacctggccccacagggccccagaacactgagtcaggacgcctgtccccaagtgatgaaggtggagttctaccgcgaccagctgtccctcccgcacctaagcgaggggcttccccggctggagtctgatgacagtggaggggccagctgccaaccgtccccaaacccgtagccgggcctggcgctgagcgggctgcagaggggcctgtgggagccggcgccccagtgtctcctccatcctccccgcaggcacctccaactggtcggaggattacttcagcagcacggcgggggtgggcttggtggtcacccagagccctggcgcgcagcccgcgggggccacggtgcaggagcagctgcggcagctctttgagcgggactggagttcgcgctacgccgtcggcctggacggacaggctccgggccaggactgcgtttggcagggctgaggggggcctctttttctctcggcgaccccgccccgcacgcgccctcccctctgaccccggcctgggcttcagccgcttcctcccgcaagcagcccgggtccgcactgcgccaggagccgcctgcgaccgcccgggcgtcgcaaaccgcccgcctgctctctgatttccgagtccagccccccctgagccccacctcctccagggagccctccaggaagccccttccctgactcctggcccacaggccaggcctaaaaaaaactcgtggcttcccggtgcctctgtgtgagtcccgcgcgggcggcccttcatcctcttgccaagggcccgcctctatgcgcccgcccctgcgaaactgcgccgcgcgaccgccgtggcagcgcctcagctagccccgggtccgcgagaacctggggcggggcggggcggggaccagacgggcctcccaggcggagcgaaccctccacctcccaccccgcgccgggctgccgcgctccggaacccaaattcccgccccgaggctgccgggggaagcgagaggcgcggagcccacgcccgggactccagcggaggaaacgcagaccaaggcgcagcgccgcgcacccaccgccagggggcagctcctacggcgccggacaggggcggcgcgggaggggagcggggctgaggggaccgggagggcgggaggggacctgcgactgaggggacagggagggcgggaggcgacccgcggctgagtgagggaagggcgggaggggacccgcggctgaggggaccgggagggcgggaggcgacccgcggctgagtgaggggagggtgggaggggacccgcggctgaggggacagggagggcgggaggggacccgcggctgaggggaccgggagggcgggaggcgacccggggctgagtgaggggagggcgggaggggagcggggctgaggggaccgggagggcgggaggggacctgcgactgaggggacggggaggatgtgaggcgatccggggctgagtgaggggagggtgggaggggacccgcggctgaggggacggggagggcgggaggggacccgcggctgaggggacggggagggcgggaggcgacccggggctgaggggacggggagggcgggaggggacccgcggctgaggggacaggtcctgcgtgcgggctggggagacaggcgggcgagggtaggggtgcacaaggctgtgtggtttgtgggctgttgtgcagggtgggtccaagcatgtgggggcaggcttgtcctggggatgcagtgcccagggttggtggatggggctgagaggaccagcatttgagctggagggcaggaaggtgactccagtctgagaccaggacttggatgcagctccactggaactcaccctatcctgggagccacctgggcacctgtcctgcagatgcaggatttgaacccaggtttggcaactcagttcccactcttctgctatgaatgctgggtcagaaggattctcaaaacaccctggcttatctcacctgatggttcctgaccaagaccacagggtaccctcccctggtggaggtccatggggccatgctaggctggagttcagggatggctcagcggtatgaaggagcactggatgctgaatggaccccagggtgccccgaatgctctcccggtcttgaggcaccactttcctacccttctctacttctctccttttcctacccttctctacttttttctttcctacatttgtgtccctgccacactgtgaactcagccatatcttcctcttccctctttgctttggggaaagctagcaaagttcatctcaggtacagtacaagttacttttctgttcgattagtgacctcatacttcccccatctaaaggacaccttagacttcagcattctgtctgtgcagaaatctcctacacccatcctgcctccctgcccaagcttgtgaaaagcttgctgcagatgctgcagggggatagggatccacatagccctgcaaggccttcaggagcttctgggggctgctttgtgtgtgagctgcacttggccaagccaagctctggcagttgcagtggctgctccctgtggcttcctatccctcattcatgctccatatctcctcagtaaccatctggcaaaaagcttcgtggcaacacctggctcagaagccgatatcatcccagactaagctctgccctccagggttgcacgtgtgggtttgctccctggttcttggccttatacctgaatgtgtctcagagcacttggcctgctctcttggcctgccaactatgttctaggagggctctgtgctccaggctgtgatttggacaactggctggtggccctcagccagtgaaaggcctctttccacacacctggggactggcagtcacacctcagtggcactgacagaggcctgcttcaaggcagatgcctattccaaaggaaatccagcttgacaaggcttgggagaccccaggagggtgccacaatgtggccccttctgggctatagcagacagactctagaatggctcccttgacccccacctgctggtatgcatgcccttgtgtgatctcaccttgagtgtgtgcaggacctgtgccttgttgtaaccaatagaatacagaggtaaggggatgtcactcctgtgacaccttgtgatcatgtgacataagattataacattatcaaggaatagcagtctatcccttgctagctttaaaaagtgagctgctaggctatgagctgtcctatgaagaggcccatgtagcagggtactggggttgcctccagcccccaactagcaagaaactggggccctcaatcatcccatccacaaggagttgagtgtggctagcaacaacgtgagcttcagaagtggctgctttcctggtcatacctgaaggggagaccacagccccagctgacatcttgattgtagcctaatgggaccttgagcagagaacccaacaaagccacacttgggctcctgatccacagaaactgggagatcataaatgtgtgttgttttaagttgctaatttgtagtgatgttcttatgcagcatagataactcatacacagagaaccaaggccacgcgagaaccctgtgggggcccctgctgctcagccactcctcacatgctgggacagctgtctctctggcctctagcaccaaggtccccactatcccaggccttgactcttggatcagagagggacaaaagccccatggagccaagcagactcctccccctgggctgcactcacctagcttgtctggcacacacaagttggagtagagaaggcaggaagccctgggaagggagagggtgatggccttgcttaactgggatgagtgtccaccaaatttcccttcccacttcccctgctcatgagcccccaggggacctgtgtcagttcactttctagaggcttctatgtgccctaacttggatgacacccacgggcctccccaactcagcacagggaacatatgcccatggtggcatggggaaagaacccagcctctcccctgcccaggctcctgcaccccatagctgtcacccctctggaacctctcagggcagcacgagtggtagcctcggagtggccttcaccctccaggcactgcggtcctccagattggctcacagcccagctcttgctcccatatccacagccatgagagcagccacctccccagggggccataagcgcttctcaccaggagcccacctaggccaggagggagctgggggcaagttccaactgcccccttgaacactgcatacccatgaatctggcaggggcatctgggaagagatttgaccactgaaagactgtagggaaacccttgaacctcaatccgctacgccacgtggatttgcttcctgtgggctgcccaagagcgcctctgtggtgaaggaagcttctgaggatgggccactaaagatggccaaggtcacctttctgtgctgtccccactctgcactccatctcccatcccacactgcctccagctggagggagggagggagggttgtacgtctgtgtccctgccacactgtgaactcagccctatcttccttgtcttcctcacagcctctggctcagaggaggacctggacaaatggatgataggtaggcaaccacccaaatgttcctcattgactgttctctagagctgcttagtagagaccaggagtgtgtgggaggaaagccctggtaaacttcgaccctgagacagaagacctcagcagccttcagcatgggatgcagcactttctttattgcccatccagggaacagccaagccagctccatctgcattctggctgcagcgtgtacattaggggactcaggggccacagtgtgggaccgtgcacactggcaaggcactggcggatgctggcaggccagtggacatggatagatgagaatgacaactcacagatgtcctagcttctgctggcccagctgccagccactggccatcacccttttgcccagcatgtgtgcattgtcacccaaaacatcttgaaacttgccattagtgaggcattcaacaaagaagtaagctaagtgagtaggaaacagtgtttcctggaatataccgcactctgcctgaaataggaaaactatgtttgccgggaagcagcagcagcaggaaagaagttataccaaaaacgacttgtacaccacagacattataaccctttcctcaaagaaacagtcatgttctgttgggtattatggacaggtctctggaaatttatctaataaagaccaacaaacttccccagcagtgcctctgagtaccgtgtgaattctggtgtcttgtggaagtcagggtgccttctttgcatccaaagctttgagggagctgggaagctttggttccattttaggagggctgtgtgatggtgacaaaggtgttctggtcatttctgctctgttctccgttctgtgaagtgaggtggatgtaatgtgctgtgggatggggtgctccatatgtgtgtgtagcctttactttccaacttagttttttgcatctctcttgtactgatgagccatacctctcagccttcatttggtcccaggcctgaccctttgctttcatcgtcagcttttctgtcctgctcgggcaggattaactctgttcttgccgcggatgtcaccatcactctggagtccagcccagtgcccacaggcccgatcagttcaccctcttccttctcttcaggggagaaactttctcgggcatcaaaaaacgtgattgtttcttcttgaagtttttgttcttccagctctgccccatcttcggtgcttttgcttttcttggtaggagatgaggagaaccctaatttgggaaatcggaaccagcctgccttctcctgttttttaggcagttctgcctctggtcgtgcctcaggctgtgtttgaatgggagcagatctctggacgtcatttttggaatcaacacctgtctcatcaacagaagaggaaaacccaatgtttggaagccaaaaccagagcagaccagattttttactttctggtttgtcttttggagccctgccttcatctgccagtggtgtggttgcctcttggctatcatcagggggaaactcaagaatttctgctggctcctcatctgaacagctgtctgcaagctggtggccagaaggaacttcaaatgtgagtgtttgctgtcccagtacattgacgctggaagagatcatctcaaatggttctccagtgtcaggctggagatctccagaaatggagtctactcctggggtggcttgtatgggagcctcttctgtgccctcctgagtcctagagtgttgagtcattgttgtgtacactctagcctgcgtgtggggctctgggattttcacttttaataaggaaaatccgtacgaaggtgtttgaatctctgacgtggggatctctgattcccgcacaatctgagtggaaaaagtcctgggtactgagagatctacaaactctggtgtcactatgctgtgtatagtgacctcttgactttcaacctgagcaccctgaatatgcactctgacctttgaaattgggggagcttccaaaggcaggttaaggtccacaggctgctccccagggaccccagcacctgccttcaggatgctggctccccagagccccggactttccttacaaagggctgtatcaatattggcctctggacactgcacttccctcacagtggggatgaacacatcatcctctgagctgggggcagggaaggagaaccttggtaccattaatttggggaatttgacagttaggacagaatcttcccacagttgatccacattaaccacagaaatctgggatggcatatcagtacttgaagctttcaatttaagtggaccttcaggctgggaagaccatttctctgttttatcctccatgctggcaaggtcatgtcctggcttggaaagaggagtctcatctatttctcctggaagaacctgggtttctggaagcctcatgccaggcatctgaaaagggagaggtcctttggatggatggatcctgacctcagaagtggaaagctcatccccagtcatcccagcagtggagaggtgcagcttcaagcctgtgctgtcaagatcacaccttagaatatctgtggatgatttgctctcagaagctgtcacttctgcatctgcctctgggagctgtagggacatagctgcctccacgtttgacccagaaacaaggaactctttgactttagctgctgcttcaccccctgttgctgccggtgcctgtgtctgagccacttccagctttccagccccgcctctgtccctgaaagagcgcctaaggctgggcatgcggaacttgggcattttaaaccagctttcctgcgagtacttggtcatggcttcctcctctgggctttccactgtgaggacttcagcatctggttttctacaggatggctggaggggatcttcaggtgtgggggctatcccctccccacaaggctggctcactgggacatccccgagcccacatcctctgctgtcaccttcggtagacagatcatgtttgggaagaggcaggtcagcttcaggctggctcacctccaccttggccttggaggatctgagatcaggtttggcaaagcccaaactgggaatgtggacctgtggccggtggaggttcacaccctcacttcctgtggcacttgctgttgcaccaagtcctcccctaccaccgtcactgctggccttttctgtgtcttgaaagctaccccctgctgtggcactagaaagggaaggatccacgtctctctgtggcaggctgaccccactcttagaagccttcattttgggaagtgcaagttttggcatggcaaagccaggctttgtgctcctccccttctctccatccctctcaggaggcagatccatgtggatggcagactgcggggccacttcatccttgtctaaaaccaggctgagttttgagtcctccacgctgcattctgggtccacctttggccctgtttccttcttcggggaccacctaaatgatggaagcttaatcttaggcattttcaagggactccctttcccttcgtggtcagcatcttcagaaggggcttctccaggggccactactgatgtctgcaaggaggccacaagctcttctgggccctgagacacacaggtgcctggggatggcagctgggtgcttggcaaggggcactgcactctttctccagggctaagaggagacatgactggggcacccactgctgcatgtaggtctccctcaggaactgccatttgggggactgaaaacacaaactttggtttatagaatttaggaaaagatacctgaccaagagaaacaggaatcatggaattcagtgggccagagtgactctcagcttgagatgttggaactccctctggaggctgcaggtcagtggagcactctgtcttgggaagaggaatatcagcctgagacccagaaggaatttccagagcaagctcaggggccaaggcagctctgggaacagtcacctggtattttgtaagtgtaacatcctcacagggagagagaatagaagattcaaagtgaggaccagtgagatcaagccgggatgatggaaacccagcaaaacccaccttaggcatctgcatggatggctctgaacaagccgaaacctgttgtaattcaaaacttgagcattctgaagatgataaaggaatcgtggaaagacctatgctagactttgcacctgggactaaactatctttaggagttttggtagaagaaaatgaaactttgggcactttaaaatgcagtttcttaaacttcgaatccattccaacttctccaacagcaagccccaagttaccatcgcgagatggatcatgaagatcaccttcatgaacaacagattccacaatgggaaatgtggaagtcttctcatggaatgtaacatttccttcgatttcagaggaagacatggaaactttctttgacgaccattcaaaaccagacgtgctcagttttggtccttgaaacttactgtctttcccagctacatcctcgtgggccagggacaggtccccctcaagccgcgcaccatccagcatggatcctggggcctggacatccgtctccacgctgggcagagacacctccacatcgggggccatcacctctgcctttgggcctttcaggtccagcttggggcccttgacgtccacctgggggcccttgaggtccactttgggcatcttgaaactgggcatctccaccttgggcaggtgccctttgaggccggctacctcgggcatgtggccttctggaagtttcaagtccacctggccagcctggacctccaggtcggcggaaggggcctgaatgcggaggtcagtggtcttgaggtccccctgcatggagggaatgctcatgtcggcctccatctttggcgcagacacatccaccgagacctcgatggacttgcctggggacaacatcccaaaggatggcatcttgaacttgggcattttgaacttgctgtctttggcagtcacgtccttgtcagccagggacaggtccccctccagccgcgtactgtccagcttggctcctggggcttggatgtccacctccatgctgggcagagacacgtccaggttgggggacgtcacctccaccttggggcctttcaggtccagcttggggacattaacgtctatctggggacccttgaggtccactttgggtaccttgaaactgggcatctgcagcttcggcaggtgccctttgaggccggctccctcatgcacagggccctctgggagtttcacatcctcttggccagcctggacctccagatcagcggaagggggctgaatgctgaggtgagtggtcttcaggtccccctgcatggaggggaggctcacgtcagcctccaccttcagcgcagacacatccaacgaggcctcgatggacttgcctggggcagacaccccgaacgacggcatcttgaacttgggcattttgaacttgctgtctttggcagtcatgtccttgtcggctagggacaggtcaccctccagccgcacactgtccagcttggctcccggggcctcgacgtccacctccatgctgggcagagacacctccacgacgggggtcatcacatccgccttggggcctttcaggtccagcttggggcccttgacatccacctgggggcccttgagggccactttgggcatcttcaaacagggcatctgcaccttggggaggtgccctttgaggccggctcccttgggcagggggccctccgggagtttcacgtccacttggccagcctggacctccaggtcggcggaaggggactgaatgctgaggtcagtggtcttgaggtccccctgcatggaggggaggctcacgtcggctttcgccttcagctcagacacatccacggacgcctccatggacttgcctggggccgacaccccgaatgatggcatcttgaacttgggcattttgaacttgctgtctttggcagtcacatccttgtcggccagggacaggtccccctccagctgcacaccatccagctttgctctcggggcctggacgtccacctccatgctggacagagacatcttcacatcaggggctgtcacttccgccttggggcctttcaggtccagcttggggcccttaacatctatctgggggcccttgaggtccactttgggcatcttgaaactgggcatctgcaccttgggcaggtgccctttgaggctggctccctcgggcacggggccctctgggagtttcacgtccacttggccagcctggacctccaggtcagcggaagggggctgaacgctgaggtcagtggccttgaggtccccctgcatggaagggaggctcacgtcggcctccacctttggcgcggtcacatccactgatgcctccatggacttgcctggggcagacaccccgaacgacggcatcttgaacttgggcattttgaacttgctgtctttggccgtcatgtccttgtcggccagggacaggtccccctccagccgcgcaccatccagcttggctcctggggcctcgacgtccacctccacgctgggcagagaaacctccacatcaggggctgtcacttccaccttggggtcttttaggtccagcttggggcccttgatgtctatttcagggcccttgaggtcgactttgggcatcttgaaactgggcatctgcaccttgggcaggtgtcctttgaggccggcttcctcgggcacgtggccctccaggagtttcatgtccacctggcgagcttggaccgtcaggtcggcagaatggggctgaatgctgaggtcagtggtcttgaggtccccctgcatggaggggagactcacatcggcctccaccttgggtgcagacacgtgcaccgaggcctcaatggacttgcctggggcagacaccccaaatgacggcatcttgaacttgggcattttgaatttgctgtctttggcagtcacatccttgtcggccagggacaggtccccctccagctgtgcactatccagtttggctcttggggcctggacgtccacctccacgctgggcagagacacctccacatcaggggctgtgacttccgccttggagacttttaggtccagcttggggcccttgatgtccacctgggggcccttgaggtccactttgggcatcttcaaactgggcatctccaccttgggcaggtgctctttgaggccggctccctcgggcacctggccctccgggagcttcacatccatctggccagcctggaccttcaggtcggcagaagggggctgaatgctgaggtcagtggtcttcaggtccccctgcatggaggggagactcacatcggcttccaccttgggtgcagacacatccaccgaggcctccatggacttccctggggccgataccctgaatgacggcatcttgaatttgggcattttgaacttgctgtctttggcagtcacgtccttgtcagccagggacaggtctccctccagccgcccagcatccagcttggccttcggggcctggacatccacctccacgctgggcagagacacctcgacatcggggactctcacttctgccttggggcctttcaggtccagcttggggcccttaacatctatctgggggcccttgaggtccactttgggcgtctttaaactgggcatctccactttgggcaggtgccctttgaggccggctccctcgggcacggggccctccaggagttccacatccacttggacagcctggacctccaggtcagcggaagggggctgaatgctgaggtcagtggccttgaggtccccctgcatggaggagaggctcacgtcggcctccaccttcggcgcagacacatccagcgaggcctcgatggacctgcctggggccgacaccccgaaggagggcatcttgaacttgggcattttgaacttgctgtctttggcagtcacatccttttcagccagggacaggtccccctccagccgcgcaccatccagcttggctctcggggcctggacgtccacctccacgctgggcagagacacctccacatcagggactgtcacttccgccttggggacttttaggtccagcttggggcccttgatgtccacctgggggctcttgaggtccactttgggcatcttgaaactgggcatctccaccttgggcaggtgccctttgaggccagctccctcgggcacgtggccctccgggagcttcacgtccacctggccagcctggacctccaggtccacagaagggagctgaatgctgaggtcagtggtcttgaggtccccctgcatggaggggaggctcacgtcggcctccgccttcggcgcagacacatccaccgaggcctggatggacttgcctggggcagacgccctgtacgacggcatcttgaatttgggcattttgaacttgctgtctttggcagtcacatccttgtcggccagggacaggtccccctccagccgtgcaccatccaacttggctcctggggcctcgacgtccacctccatgctgggctgagacacctccacgtcgggggccgtcacatccatcttcgggcctttcaggtccagcttggggcccttgatgtctatctgggggcccttgcgatctactttgggcatcttgaaactgggcatctgcaacttgggcaggtgccctttgaggccagctccctcgagaacgtggccctctgggagcttcacgtccacctggccagcctggacctccagttgggcagaggggggctcaatgctgatgtcagtgttcttcaggtccccctgcatggaggggaggctcaggtcggcctccacctttggcgcagacacatccaccaagacctcaatggacttgcctggggcagacaccccgaacgacggcatcttgaacttgggcattttgaacttgctgtctttggcagtcacatccttgtcggccagggacaggtccccctccagccgtgcaccatccaacttggctcctggggcctcgacatccacctccatgccgggctgagacacctccacgtcgggggccgtcacgtccgtcttcgggcctttcaggtccagcttggggcccttgacatctatctggggtcccttgcgatctactttgggcatcttgaaactgggcatctgcaacttgggcaggtgccctttgaggccagctccctcgggaacgtggccctctgggagcttcaggtccacctggccagcctggacctccagttgggcagaggggggctcaatgctgatgtcagtggtcttcaggtccccctgcatggaggggaggctcacttcggcctccaccttcggcgcagacacatccaccgagacctcaatggacttgcctggggcagacaccccgaacgacggcatcttgaacttgggcattttgaacttgctgtctttggcagtcacatccttgtcggccagggacaggtcaccctccagccgtgcaccatccagctttgctctcggggcctcgacgtccacctccacgctgggcagagacacctccacgtcgggggccgtcacctccgccttggggcctttcaggtccagcttggggcccttgacgtctatctgggggcccttgagatccactttgggcatcttgaaactgggcatctgcaccttgggcaggtgccctttgaggccggctccctcgggaacgtggccctctgggagtttcacgtccacctggccagcctggacctccagttgggcggaggggggctgaatgcggatgtcagtggtcttaagatccccttgcatggaggggaagctcccgtcagcttccaccttcagctcagacacatccaccgaggcctcgatggacttgcctggggccgacaccccgaatgacggcatcttgaacttgggcattttgaacttgctgtctttggctgtcatgcccttgtcggccagggacaggtccccctccagccgcgcaccatccagctttgctctcggggcctggacgtccacctccatgctggacagagacatcttcacatcgggggctgtcacttccgccttggggcctttcaggtccacgttggggcccttaacatctatctgggggcccttgaggtccacttcaggcatcttgaaactgggcatctgcagcttgggcaggtgccctttgaggccggctccctcgggaacgtggccctctgggagtttcacatccacctggccagcctggacctccagttgggcagaggggggctgaatgctgatgtcagtggtcttaaggtccccttgcatggaggggaggctcatgtcggcttccaccttcagctcagacacatccaccaacgcctcgatggactcgcctggggccgacaccctgaatgatggcatcttgaacttgggcattttgaacttgctatctttggctgtcacacccttgtcggccagggacaggtccccctccagccgcgcaccatccagctttgctctcggggcctggacgtccacctccatgctggacagagacatctccacatcgggggctgtcacttccgccttggggcctttcaggtccagcttggggcccttgacatctagctgggggcccttgaggtccatttcaggcatcttgaaactgggcatctgcaccttgggcaggtgccctttgaggccggctccctccggcacagggccctctgggagtttcacgtccacttggccagcctggacctccaggtcagcggaagggggctgaatgctgaggtcagtggccttgaggtccccctgcatggaggagaggctcccgtcggcctccaccttcggcgcagacacatccaccgaggcctcgatggacttgcctggggcagacaccccgaatgacggcatcttgaacttgggaattttgaacctgctgtctttggtagtcacatccttgtccgccacagacaggtccccctccagccacgcaccatccagcttggctcccggggcctcgacatccacctccacgctgggctgagacacctccacgtcgggggccatcacgtccgtcttggggcctttcaggtccagcttggggcccttgacatctatctgggggcccttgagatctactttgggcatcttgaaactgggcatctgcagcttgggcaggtgccctttgaggccggctccctccggcacggggccctctgggagtttcacatccacttggccagcctggacctccaggtcagcggaagggggctgaacgctgaggtcagtggtcttgaggtccccctgcatggaggggaggctcacgtcggcctccaccttcaacgcagacacatccgctgaggcctcgatggacttgccaagggcagacaccccaaacgacagcatcttgaacttgggcattttgaacttgctgtctttggcagtcacgtccttgtcggccagggacatgtccccctccagccgcgcaccatccagcttggctcctggggccttgacgtccacctccacgctgggcagagacacctccacatcaggggctgtcacttccaccttggggtcttttaggtccagcttggggcccttgatgtctatttcggggcccttgaggtccactttgggcaccttgaaactgggcatctgcagcttgggcaggtgccctttgaggccgacttcctcgggcacagggccctccaggagtttcacgtccacctggccagcctggaccttcacgtcggcggaaaggggctgaatgctgaggtcagtggtcttgaggtccccctgcatggaggggagactcatgtcggcctccaccttgggtggagacacatccaccgaggcctcgatggacttgcctggggcagacaccccaaacgacggcatcttgaacttgggcattttgaacttgctgtctttggtagtcaggtccttgttggccagggtcaggtccccctgcagatgcgcactatccagcttggctcttggggcctggacgtccacctccatgctgggcagagacacctcgacatcggggactctcatttccaccttggggtcttttaggtccagtttggggcccttgatgtccacctgggggcccttgaggtccactttgggcatcttcaaactgggcatctccaccttgggcaggtgccctttgaggccagctccctcgggcacgtggccctccgggagcttcacatccacctggccagtctggaccttcaggtcggcagaagggggctgaatgctgaggtcagtggtcttcaggtccccctgcatggaggggagactcacgtcggcctccaccttgggtgcaggcacatccaccgaggcctcgatggacctccctggggccgataccccgaacgacggcatcttgaatttgggcattttgaacttgctgtctttggcagtcatgtccttgtcggccagggacaggtctccctccagccgcgcaccatccagcttagccttctgggcctggacatccacctccatgctgggcagagacacctcgacatcgggggctgtcacttccgccttggggcctttcaggtccagcttggcgcccttaacatctgtctgggggcccttgaggtccactttgggcatcttgaaactgggcatatccaccttgggcaagtgccctttgaggccggctccctcgggcacctggccctccgggagcttcatgtccacttggccagcctggaccaccaggtctgcagaagggagcggaatgcagaggtccgtggtcttgaggtccccctgcatggaggggaggctcacttcggcctccaccttcggcgcagacacatccaccgaggcctcgatggacttgcctggggcagacaccccgaacgacggcatcttgaacttgggcattttgaacttgctgtctttggcagtcacatccttgtcggccagggacaggtcaccctccagccgcacactgtccagcttggctcctggagcctcgacgtccacctccacgctgggcagagacacctccacgtcgggggccatcacctccgccttggggcctttcaggtccagcttggggcccttgacgtccatctgggggcccttgagggccactttgggcatcttcaaactgggcatctgcaccttggggaggtgccctttgaagccggctccctcgggaagggggccctccgggagtttcacgttcacttggccagcctggacctccaggtcggcggaaggggactgaatgctgaggtcagtggtcttcaggtccccctgcatggaggggaggctcacatcagcttccaccttcggctcagacacatccaccgaggcctcgatggacttgcctggggccgacaccccaaatgatggcatcttgaacttgggcattttgaacttgctgtctttggcagtcaccgccttgtcggccagggacaggtccccctccagctgcgcaccatccagctttgctctcggggcctggacgtccacctccatgctggacagagacatcttcacatcgggggctgtcacttccaccttggggcctttcaggtccagcttggggcccttaacatctatctggggccccttgaggtccactttgggcatcttgaaactgggcatctgcactttgggcaggtgccctttgaggccggctccctcggacacagggccctctgggagtttcacgtccacttggccagcctggacctccaggtcagcagaagggggctgtatgctcaggtcagtggccttgaggtccccctgcatggaggggaggctcacgtcggcctccaccttcggcgcagacacatccactgaggcctcgatggacttgcctggggcagacaccccgaacgacggcatcttgaacttgggcattttgaacttgctgtctttggtagtcaagtccttgtcggccagggacatgtcctcctccagccgtccaccatccagcttggctcctggggcctcgacatccacctccacgctgggcagagaaacctccacatcaggggctgtcacttccaccttggggtcttttaggtccagcttggggcccttgatgtctatttcagggcccttgaggtccactttgggcaccttgaaactgggcatctgcagcttgggcaggtgccctttgaggccggctccctcgggcacggggccctctgggagtttcacgtccaattggccagcctggagctccaggtcagtggaagggggctgaatgctgaggtcagtggtcttgaggtccccctgcatggaggggaggctcatgtcggcctccaccttgggtgcagacaggtccacggaggcctcaatggacttgcctggggcagacaccccgaacgacggcatcttgaacttgggcattttgaacttgctgtctttggcagtcacgtccttgtcagccagggacaggtccccgtccagctgtgcgccatccaacttggctcccggggcctgcatgtccacctccacactgggcagagacacagccacttcgtgggccgtcacctctgccttatgacctttcaggtccagcttggggcccctgacttccacctgggggcccttgaggtccactttgggcatcttcaaactaggcatctgcaccttgggcaggtgccctttgaagccggctccctcaggcacgtggccctccaggagcttcacgtccacctggccagcgtggacctccaggtcagcggaagggggctgaatgctgaggtcagtggtcttgaggtccccctgcatggaggggagactcacgtcggcctccactttgggtgcagacacatccaccgaggcctcgatggacttgcctggggctgacgccccgaacgatggcatcttgaacttgggcattttgaacctgctgtctttggcagtcacatccttgtcggccagggacagttccccctccagccgcgcactgtccagcttggctcccggggcctcgacgtccacctccacgctgggcagagacacctccacatcaggggctgtgacttccgccttggggcttttcaggtccagcttggggcccttgacgtccacctgggggcccttgagggccactttgggcatcttgaaactgggcatctccaccttgggcaagtgccctttaaggccagctccctcgggcaggtggccctccgggagcttcacatccacctggtcagcctggaccttcaggtcagtagaagcaggctgaatgctgaggtcagtggtcttcaggtccccctgcatggaggggagactcaggtcggcctccaccttgggtgcagacacatccaccaaggccttgatggacttccctggggccgataccccgaacgacggcatcttgaacttgggcattttgaacttgctgtctttggcagtcacgtccttgtcggccagggacaggtccccctccagccacgcaccatccagcttggccttctgggcctggacatccacctccatgctgggcagagacacctcgccatcgggggctgtcacttccgccttggggcctttcaggtccagcttggggcccttaacatctatctgggggcccttgaggtccactttgggcatcttgaaactgggcatctccactttgggcaggtgcactttggggccggctccctcgggcacagggccctccggaagtttcacatccacttggccagcctggacctccaggtcagcggaagggggctgaatgctgaggtcagtggccttgaggtccccctgcatggaggagaggctcacgtcggcctccaccttcggcgcagacacatccaccgagtcctccatggacttgcctggggccgacaccccgaatgatggcatcttgaacttgggcattttgaacttgctgtctttggcagtcacctccttgtcggccagggacaggtccccctccagccgcgcaccatccagctttgctctcggggcctggacgtccacctccatgctggacagagacatcttcacatcgggggctgtcacttccgccttggggcctttcaggtccagcttggggcccttgaggtccactttgggcatcttcaaactgggcctctgcaccttgggcaggtgccctttgaggctggctccctcgggcagggggccctccggaagtttcacatccacttggccatcctggacctccaggtcagcggaaggggtctggacgctgaggtcagtggtcttgaggtccccctgcatggagaggaggctcacgtcggcctccaccttcggcgcagacacatccaccgaggcctccatggacttgcctggggctgacgccccgaacaatggcatcttgaacttgggcattttgaacttgctgtctttggtggccacttccttttctgtcagaatttgttccttttttaagcgtttttcatcgtgtattagttgtatttttgttgtgtttgtcattgagtcactgtcttctttgtcttttaatccttcctctgtgcgtctctgttctcttctatcagctgttgctgtggcctctccttcccttccctgctctgtgtcttctgtggctttttctctgcctgtctttgtgtgcttgcttggcgaccatcctaaggagggtatcttgaacttgggcattcttatctgtccttctgtgtcttccctgcccttgtcctgttcctcagtgatccttgtcctctgtagtccttcctctccatctccttcatccccctgtgcttctgcatgtgtggttggttccctgcccggcatccacccggctccttccacctcctcacccttcaggccagtacccgcttttgaggacgcatcctgtctcttccctcgctgtggggtactaaggcgcctttctctttctggctctttttctgtggaaaatgcaaattttggtgtctttaaatcgtgtactcgcaccctaatttctggtgggccaatctgtgtgcctccttcggttgtgtctctcaaggacagtctggcgatcccgatttccaggctctgcagtccctcgccttcaccctcccggctcattccaggagttggctgggccctgggcttcctctgggccactgctgtctcctgtgcctgcccctccagggtctttccatggagcctggctgccctgagtcccccttcctgaggggttccctcgcaaagtctagggtcaccgagctctgtgggcaatggcatgctctgagcaggcatcacttctcgatcctgttctgccctctcctctctcctgctgcctgtggcagccccagtctcctcgaggctatcaccccagggccccaactcttccaggaccccagcacggcccaccccactctggaaccccctgcctggctgtcctgtcgatgaagggccctgtcccgagcctgtcctgaatctgaggttgaggaacttccgcctcctctggctgcccggccctgccttctgctcttggcgctccaccgtgagctgggcctctgtgtctgtgcttgtaggggacacgtcatgtgcgtccctaggttcgtaggcctctgacgagctgtgtgacctctggggtcccggcccccgcttgctctttatggattgaaattttggccaagagagcctctccctctggctctgcctgcctctccccacccttggtttggagatgagtctctcttggtccccatctccttccagagttttcgtgggggtctctctgcacccatcagcaacatccgtgtcctgaaacatagggagagggaatctgttggtgccagtccaagaagcctggggccctggcccagggacagatggagtgggagtgctatcccctcccaggctcagccagcagggtagtgaagccagctggggccctgccccccgggcatagtggtctcacctccttctccttgccctgtgggccgtgctgggcatcgctggaagcccactcttcatcctgtggggcagggagctgccgtctgattttgaactgaaccttgtacggctctgaatattgaaggattttgagagcatcttcatattttatgttttcaaagaacacggttgtactgagcagctgatcccctagaccaagaaagagcagccccagggccgggtgtgtgaatgagacggggtctgctgtcttgccttggctggcgaggagggtcccggggacatgaatagggggaatcccactgagtctgccccaccagtcccccactgagtgcctcaggcacaggcaaggtggatggggtcccccattttactagatgcagtgggtgatcccagcctcaagctgttgagcagaggcgtgaggaggtcatcctaagctccaggtgtggttcttacccctcaatacccccctccaggtccctcccatcctggtggggagaatggtgaccccagggatggaactgccatggcaccttctctcaagttaaaaagcttggcggctgaggagtccttcagcacttgcttgacgaagatcccctggtccccaccacctgtgacactgtagccactggctcctgcctccacctctgtcttcagcgtcacctctgttgcctcctggacagcctggagcagaagcacatcagggccatggtgagcatgtgccagtcccaccataagcatccctgctggggcctgtgtctccagaggatgggcaccccaccatcctttccatcagcccagacaacacagagcagagtagggtacccaccaggtgggctcaggtagctgtctctgagctctggaggaagccagctggaacctgccagaactcttgtccccaccccaacctgccaggacttaggcacagcctgtccatgccaccaggcccagcagggcaccaggagcagcgcagaacggattctgctttccctgtggccagtttctctttttcagctccttcatgcattcttcacaaacgcgtgaagcaccagttgtgtgcaaggcacctgatgctcaagacaaggaagcacagcaatgccaaggaaaatacgggacattgggtgcagcctgcgagacctgggacaggatggggcctgtgtcctgcagagctcttggactgctggggcctccaaggaaaaaaactagttgcttaagaggcagagtgccctcatcattgggtgctagcagagtctagcaccttccatagttccatggcctgggtgctgactggccttttcagccccacagcttgaatatgcaacagacaccagcactgccccattgcacggaggagaaaatcgaggtctgtacagccaggtctacctggccaggagcttggctatgcatcagactccaccccagggaggggtggagagggccaggaccagatgtagccttctggagcccctgcccttccccaggcctgacaagggggacaagaacacccctcctccccagggcacggggcacactgccagcctctttgctcctcccctgcctgctctgacctcggactctctggctggatcccttgaggaccgacacacctctgtgaccctcagctcctgctgtacccacctctggacgactcatcctgaaaaatgtccgtgagtcccctgaatctcgcttccaccaggatctccgtctcccagcagaaccttgcctgccgggggcgtcttcctgcagccacaagtgttgggagttaggcacctgccccagctcagggacagggaggggcacaggtaggctggtgccagaccaggagccctcccttcagaggggcccagaacttccaacacacagctgtgtgcagaggcagccgagttcctccaggcacatccacagagaaaaggcaactctcggccttcctgcttcccgacagggcccagcctacagcccacagcacccaccctacagcccacagcgcccatagggaagccccacagcaactggagttttgtatggagggagataagaaattcaaattgtacaaaaatgaatcctttcatagacatgcctcctctgatcccttccccgagtccttgtctccagaggtagccatggggccctgtccccaaagacagcatgagtgtgttacacaggtgcagggatgcacacaccctgtgcccctgaaacacaaacacagtaacatgaggcctgtccccatcagcccatacgcatgctcacaagagctgcagggcacctccatcccactgtgccctggccggccacagggagggacccaagggcacagaggagtctgagaggacatctgagtgggcactgcccagtgggcagcggggcagggcagcaaggttgaacagacatgcgtgagttgcccacacagggcgatgcaggaggagacctgggtgcctgtggggctctgcccagcaggctcacctggagtccaaagtcggcagcctcagtcgtgtattcgtagacaggtgaagacccctgcggccgtggtcgaatgccctcatccgcaggcccttcagtcacctgacgggagagaatccagttatttttgccactcggttctcccagggcccagggagaatgggggcagggtatgaggaggacacacttcctcctgctctcacttacagagtggtcatcttccgtttctgcacctggctccccgggctgcagctgacggccggacactgcagagagagtggctgtcagtggagacaagcaggctgggggagcagatcggggcccgggggagggagccaggactgtatgtacactgtggaggtgtcatagtcctttcctggacactggatcggagagcaaactcaggggctgggggaagatctatagccaatgggctggagaggctgaggcatcacgtcaggtagcagtgaattgagactggacttattccaagttggaacagatttagtccaagaaagtgactaaacaaacacaaggcgtttgttattgtataaccacaccctgggaggatcagaatccagagctgccagaatatattatctaaaatgtccagcagccaccaaaaaattacaagttacgcgaagaaacaagaatgtatggtccatactgagaaacaaagcagtgaatggaaagtgtctctaaatgtctactaatgctgggtttaatacagacttcaaagaaactattaaaagtttgttcaggccgggcacggtggctcatgcctgtaatcccaggactttgggaggctgaggcgggtggatcacctgaggttgggagttcgagaccagcctcaccaacatggagaaaccccatctctactaaaaatacaaaattagccaggcatggtggcacatgcctgtaatcccagctactcaggaggctgaggtaggagaatcacttgaacctgggaggcggaggttgtggtgagccgagattgtgccattgtactccagcctgggcaacaagagtgaaactccgtctcaaaaagaaaaaaaaaagtttgttcaaaacacaaaaacaaatcatgtttaaaaaattaatggaaaatatgttaacaatggctcaatgaagagagaatctcataaagaaataaaacttattttttaaaagcaagcaaaaattctggagttgaaaatttactactggggttcaccaacagatttgagataccagaagaattatcaacttgtagattaatataaattaaccaatttgaagaacggggtcagggggaagattgtttgaagaaaaacagagtctcagagcattaaccataagataaagaggcagaagagagagttgaagaagtgatagctgaaaacaatctgcagaatccaagaagcgcgaccagacctaagcaggagaaacacagagatccacacctagaaacgtcacagtcaaaatgcttaagagaaagggccccatcacataataagggcacaaaaatacaactaacacctgaatcacatcaaaaccatagaagctacgagaaagtggaacaatatattcaaagggctgaaagaaactgttgtcaacgaagaatttgatatcaagcaacctatccttccaaaaataaaggcaaaatagtctgggcatgctggcttatgcctgtaatcccagcactttgggaggctgaagtgcgaggattgcttgagcccagaaactcaaggccagcctgagcaatatagtaagatctcatctctacaaaaaaaaattttttttttgagacggagtctcactctgtcacccaggatgaagtgcagtggcacgatcttggttcactgcaacctccgcctcccaggttcaagtgattcttctgcctcagcctcccgagtagctgggactacagacacgcgctaccatgcccagctaattttcgtacgtttaggagagacgggtttcaccatgtcggccaggctggtcttgaactcttgacctcgtgatccgcctgcctcagcctcccaaagtgctgggattacaggcatgagctgccgtgtccggcccaaaaatttttttaaaaattagcggggcatggtggtgcatgcctatagtcccagctgctcaggaggctgaggcgggaggatagcttaagcctgagaggttgaggctgcagtgagctgtgattgcaccacttcactctagtcaggcagagcaagactctgtctcaaaaaaataaaaatttaaattttaaaaaaaggaaaaataaaggcattcccaaatgaacaaagacttggaaatgtcattgctagcaaatctgccttacaagatatactaaagaagtccttcggactgaaaggaactaataccagacactaagtcaaatgcacaggaagaaatggagaatgcagaaaatggtaactatgcaggcaaatataaaagactctatgaatatatattgtcctcattttatttcttaacttctttcaaaaacagaggattgtataaagcaaggattgacaaacttttcttgaaaaaggcaatatagtggatattttaagcttaccaggccacatgatctctgttgcaactctgcagccatagtacaaaagcagctatagattatagataatatgtaaataaatgagcaaaactgtttcaacaaaactttacttgtaaaacaaaaaggaggctggatttagaagacagacaatcatctgtgaaccacttatataaggcaacaattctaacaccatattgttaggattataacatatatagatacagtatatacgtgacaataatagcaaaaaggagtaggaggagagggtatacagtcagcctctcatatcagtggtttctgtatcctgagttcaatgaaacttgggtcaaaaatgttctcccaaaaattgcacctgtactgaacacgtgtagactttttttcttgtcattattccctaaacaatatagtataccagctatttacatagcatttacattgcattaggtattataagtaatctagagatgatttaaagtataggggagggaagatgtatgtaggttatttgcaaatactacattgctttatagaagggacttgagcatccatgaattttggtatctgagggaggtcctagaagcaatccctcatggatgctgaggcacaagtgtaccctggaccaaagtttctataatttaccagaattaagctggcattgcctggggctgggagtgggaagggagattgattgtaaatggggttgagaaaatttggaaggtgatggaggtcttccagaactggattgtggtaatgtttgcacaactctataaggttagtaaaatgattgaattgtacatttacaatgggtgagttctatggtttataaactgtacctcaatgaaactgtaaaagaaaaaggtaattaactgtataaaacaaaaataagtcagcacggtggctcacacctgtaatcccagcactttgggaggccaaggagggcagatcacttgaggccaggagtttgagaccagcctggccaacatggtgaaacccctctctactaaaaatacaaacattagctgggcagggtggtgcacgtctgtaatcccagctactcaagaagcagaggcaggagaatcacttgaacccaggaggtggaggttgcagtgagctgagattgttccactgcactccagccttggtaacagaccaagactctgtctccaaaaaaaaaaacaaataaaataaaatgtatcttagaattttacaaatatagaagtaaagcatatgacaggatggggatggagtgcaaaagttgctgttgtgggccgggcacggtggctcacgcctgtaatcccagcactttgggaggccgaggcgggcggatcacgaggtcaggagatcaaaaccatcctggctaacacagtgaaaccccgtctctactaaaaatacaaaaaaatagccgggcgaggtggcgggcgcctgtagtcccagctactcgggaggctgaggcaggagaatggcgtgaaccccggggggcggagcctgcagtgagccgagatcgcgtcactgcactccagcctgggtgacagcgagaccccatcttaaaaaaaaaaaaaaagttgctgttgtgaagatcttacattatacttaaagtaggacaatcttacttgaaattatactgtaataagttaaatattcagggtataaagcataatgcaaccattaaaaaaataaaaagatgtataggtaataagccaatagtggaaccaaaatggaatgctaggctgggcacagtggcttgtgccgtaatcccagcactttaggagaccgaggcaggaggaacacttgaggccaggagtttgagactagcctgggcaacacagtgagacctcatctttagaaaatatttaaaaattagccatgcatggtggcgcacatctgtattcccagctactcgggaggctgaggtgggaggatcacttgagcccaggaggttaaagctgcagtgagccaagctcatgccactgcactccagccggggcagcaaagcaagaccctgtctcaaaaaacaaacaaaccaaaaaacacctagatctcctttttgaaacactgcagtaaaaactggcaaaactgaaaggagaaataaatccacaattattatacaataggagattctaacactcttaggaaatgataaccttacaaagtagaataggggaagatacaaaacacttgaagtacccatcaaccaacgagaccaaactggcactgggagaacactcctgacagcagccggtgcatgctgctctcaggtgcacaggggacagtcactgagacaggccccatgctggctcagaaacctgtcttgacgaatttaaaataacttcagtcatccgagttctcttctctgacccccagtggaatcaagacagtgcggcagaaacacaaatcagtgaacagaaaacaaagtccagaacagccccacacttacatggccaattcattcttgtttgttggttggttggttttgttttgagacagggtctcactctgtcgctcaggctggaatgcagtggcacaatctcagctcacagcaacttctgcctcctgggttcaagcgtttctggtgcctcatcctcccaagtagctgggattacaggcatgcgccatcatgcctcactaattttttttttttttggtacttttagtagagatggggtttcaccatgttgcccaggctggtcttgaactcctggcctcaagtgatccacctgccttggcctcccaaagtacaggcgtgagccaccatgcccggccaaattcttgtcaaagcagcccagttattccaacagaaagcaaagtcttttcaccgaatggtcctggaacagctgggtatttactgggaaaccaataaacctggacccttccatcccatcactcatgaaaatgaatttgaaatgaatcatagaggggaatgtaaaaccaaaaactataaaacttctagaagaaaatataggagaacttctttaacacctcgagggcagcaaagttttcttaggatacagaaggtaaggatcatagaacgaaaactgataaatttaagttctcataatttaaaacactggccttaagagctttcattttcctcagaaaacgaaaaggcagtgaatgtatctggcaaaggacttgcatggagcctgtgtacaactcaacggaagagaaaaagctcagctaaaaataggcagcagatttgaacagacatttcacaaaagaagatgtacgagtgttcaataagtacaaggaaagatgctcaacattttcagtcatcaggaaaatgcaaatcaagaccaatggaacagaacagagatcccagaaacagacacacgtacacaaagctgtgatgatctgttcaacacatggcctgggatccatgggatatccatatggaaaaacattaatcttcgccccacctcagccagagaaaattaatttcatgtggattacagatccaaaattaaaggcttaacaataaaatttctagaaaataaatagaaattacttttggagtaggggaaaaattcttaaacagaacacacaaaaaatgacagatattggtctatattaaaattaagagcttctggccaggcgcggtggctcacgcctgtaatcccaacactttgggaggccgaggcgggcggatcacgaggtcaggagatcgagaccatcctggctaacacggtgaaaccctgtctcttctaaaaatacaaaaaattagccgggtgtggtggcgggtgcctgtagtcccagctactcgggaggctgaggcaggagaatggcgtgaacccgggaggcggagcttgcagtgagctgagattgcgccactgcactccagcctgggccacacagcgagactccgtctaaaaaaaaaaaagaaaaaaaaaagagagagagagaaaagaattaagagcttctgttcatcaaaaaacaccactaagggcatgaaatgtaaattagtatagccatgatagaaaacactatggatggttcctcaaaaaattaaaaatagaactaccatttgatccagcagtcccactactgggtatatatccaaaggaaatgaaatcgataaattgcagctatctttgcccaaaacacagattgggcaaagatacctgcaatacatttaccaagcaaaggcctccaacccagaatgcacaaagaattcttgcaaaccaaaagacaaacaacccgatagaaatatgggcaagaaaacactggaaaggtagctcatagaagaggatattcaaccagccgattagtatatggaaagatggccagcatttctagtcatctgggcaatgctaacaaaaccacgaggtgccatatgctcccaggagaatggctgaaatggaaaagtcgaggcagaccacctggagacaaggcctagggcagctggaactccatcctggtgtgggttgggggtcagctggcgcaaccacttggaaacagcctggtagagccttaccctgtggcccagcaactcatagccaggggcagagccaagaaatatgcgcacatatgtccctcaaaagatggatgcaggaacatccatctcagtataatctgcagcacccagaaaccagagattcaaatgtccatcaacagtagaataaaaaaaaatgcgaggtatttgtccaatggaacagtatatggtataaactatgcctatgtgcaacgtggatgaagttcacaaacacaaggttgagacacagaagctagatataaaaagcgctcgtaccgggggagcccgtcacatccagctcacagtcaggctcaggccacctagggctgaagtcaccagggggagcaggcagacagggtctcctggagaggactaattacttgggtgtgccatggtttgtaccctttctccataaaaaattttagaattctatataaaatcaaacacaattataaactttacactaataaatctgaaaatttcgattgattggatatattcctagaaaacccacaagaagaaccaaacttgtccaacccacggcccacaggccgcatgtggcccagaacagctttgaatacggcttaacacaaattcataaacttcctaaaactttattacactcttttgcaattgtttcttttagctcatcagctatcattagtgtagtttatgtgtgacccaagacaattcttcttcttccaatgtagcccagggaagccaaaagataggacggacgccccgatggataatccaagtatttttgtaacgatttaaaaatcaacatggtgaaaccccatctctactaaaaatacaaaaattagctgggcatggtggcaggcgcctgtaatcccagctactaggaagactgaggcaggagaatcacttgaacccagaaggcagaggttgcagtgagccaagatcatgccattgcactccagcctcagcaacaaaagcaaaactctgtctcaaaaaaaaaaaaaaaaaaaagaaaagaaaagaaaagaaaaaatcaaatcccttatttaaaaccgtcccacaaaaaggactccagtctcaaccccactctgaattatactctaaatattccaagaagaaacagtaccaatcttacgccaactctggcgccctggcctgggctccagggcctccctcctgcagtgacaaggagggtctcagaactaaggcccccatccctgccccagacccagttgctggtaggacactgattgggaaggagcatgtccctatcctttggggtggtgtgctggcctcggggaccagctgctccctgtcccctgcggtaggtgtcctggccttggggactgtcccacgaagacagatggggaggcccagtcccggcagtggtctaggtctggctgctcctctggccagtgtgctgtgtggccctgagcaagctcatcccctctctgagctttcattccctcatggatatgtggaccaccctgcctgccctgactgtgggttgctgggctacagacactgctcccgcagaggcacccccagggccatgcctgctcatcccaagagcacctctgcctgcgcgggcccctgccactccctcaccgcttcacgggcctttccttgcccttctgcaagatggctcacagcccaggtcccctctggctctgctctcaggcctggcagggctggaggatggtgtctcctggaggaggttctctcaagcgaaggaagagaagggcaggaggtgagggcaggcagggctgggtcagtgccaggaggcatcaacactcacccccacgtcatcccggccccgccaccttcctactgctccgggggccaggcccagacccctggcctccataaccccccagcagagccacaacctccgtttcccccacctgccaaaccagccttgcccacggtgtcagcccaagaattgtacccctggcaaccccacaacacgatctcctccacaggccccttctccctaaccaggcagtgaaggggcaagaccctgtctcccttctgcacagctctgtcctggccacctgggcccatctcactcacctttgcattcagacactgccccaccacctgacagggcccctgctgctcccacctggacgcacccccaacctgcacagacagaacttggccagccccaccgctctgcctcccagatggctgccaaaccctccactccttgcccacctgccccctcccactccctccacgtggccctgccagggctccccagtgcaccccacaaccctgagggaccaccagctggggccaccccagcccctctggagctgcctggagctccagccacaccagacccacaacaaattcgtgggacggggtggtgccaaggaaagggacaggaatctggccagagcctgcccaccgctaagccaagggcaatggcaggtaagccactctctggcctcagtttcccttcctgctctgcccagaccctgccgctcaatccccaaggtgggtaacatatgtgaaaactgaggctgggggaggggagccacttacccaaggggacccagccagtaggtgtggagctggggcaactacctagcagggctgggggcagaggagggtccctgggtcacttggcccacagctgctcccctggcagcaggtgcagctggggtcatgagtggggaggggctccactgcctcggagaccgggtgtcccaggccctgcctagcactcagggtggggcaggtgttctgaggctgcccagaaacccagccgcctccccgtccctccgcagcctccccagccaaaaagccccacccagctggcaggagcctggatgggttgggggtggggggcagctgctgtgaggcccaagaaagggtcaggagggcaactcctcggagaagggactcgccaggcagggaaacacaggtctgctgggctgggggtgggcaccacggtcaagggcccctgagctgggcacagccggctgcactcccaaatctctccagggtagtcttgtgggtgttggggccggtgagggagggtgtcgacagcaagccctgggcacaccctgtgctgggaacctgcatgggggaaggaggaggagacgtgaccagccctgctcctgctggccctcgtgcctggtcctgccactggcccacgcgggacagtccccagccccaccctcagccaccgcactgggagcggctgttcctacactgcctgtagtggggatggagtgcagaggctcagcgagcggcagacctgcctctggccacagagctgcgcagtggggacccctccagtcactgggctggcaggagcctggcccaggaacacaaacaggaagggggaaatcctgcccgcctcgggataaggctgcgcagccaggctaccggcctcggacccgcgccagtcgggagagagaggaaggcccccagtatcccagtcccccgccaagagcaccgcctcccaggcccgagctcctgaggaagccccgcctcggccgcagagcgcaggggaggccgcctttgcccgcccggcctccggttctcccagacaggctctgcaagtggccccatcacctgaatcatgacactgtttgttgacggtcaccaaagccccacttcacagaggagaatgtggaggtgactcgcctgagccaggcccagctggtcaggccgttggcacctggttccttccccaatgcccttcccccactccccgggccccccagcgccctggcctcaacactaccattaacattcctgcgggtgaaaacttgaaccttgtggagggaccccgggacccaggtcagtcccttgcatgccagggcaggtgggggtggtaccacagtgaaagccgcagaggacacccaccctggcccagaaaagctgcctccccgagaactggactatcctggcgcagggcctgagcaggcggggcctcaggcagtgtgtctgggggacgagcagatcctggccgggaggcggggaggggccgagcgggaggggagaaggaacacaggcggggagtgtggcagaggctcaccaacacccctgctccacagctgggtccagattgaggactcccaccagccaccagctaaatgagagttcttggagggtccagaacaggtccgtggggggaggaggtggattttgcttaaacaaaatccaagtttgcctctaaactggcagccccagggccccatctctggcctccaggtgggagggcatggttgggtgcatttgcaagtccccagggccctgggggctggcagggaggagactggctctccagtggccggaaaagtccatcctgggtgggaggaacgaatggcccactccaggtttgcaggtgtgtgtgcacacgtgtgtgctcacaggatgtacgtgctcaggtgctagggcgtgtgtgcacttgtgtgtctggcctgggctcctccctctgaacacccatggacagcccagagtgaggccatggaggcgggagccctgtgggagtcactgccctcgggctggaaacctggtgcccacccagacacaggcacacacagccggccgcacttgggcctcacccagtcgtggaacttcatgaagaaggtgccaagcgggctgactgtcatgagaccttcagacttccctgagcaacatcccccgcccctccccgatgcttcttgagataactctctcgggatgagctcaggctcttgctcctgcctctgtgtctgcctccaaggctgcaggagggctggggaagccagactcagtcccctagacctgggagctgggctccttgcccatccagcagccattccccactgcagcccagctgcacccgtgaggctattcacatcaccctctcccgaaacaacctttcgtagctccctggtgccatccatcggtcagactggcctggcagcctctccgtgcctgctctagccctagccgacatccccagcctctccagccctcactgtgcctgcctgggccacaggcgctctctctctgggctttcccaggctgtcttctctgctgggcaaattcacagactgagcttggccaccctgccatggcttctggacactgccggctccctggtccccagaacactttgctcaccaagcactcagagcctggcacacagtaggtgcataataaatgctagtgcaggcagtgcatgggaaaaaggaaggagcttgtcagatctcctggaaaagcctggtaagcctgagggtgggagccagttgatggggatgggagggcagcaggtgggcccagttcatctccttctgctcctggagaaactgaggcacagggtagcacatgtgccacctctccaagggatttggcagccaaaaggaacagccccatgctcccatccatcccaggcgggctagcctgagccagtttccctgggctgaaaggccggccccacagacgtccagggcagtgtgaccctgtgatggagctacccatcgccccaggcccccacagcccacctcgggcacccccaggagagtaaacctggcctttggaagcaaccaccctccacagccacccagggcccctgtgcaccaagcaagcacacggtcatctgaggacccttctccaggccccacgcccaccttggggacttgcagacctgcggctgccctgaatgtgggtgctcttggcattcacctccccccacacccaggctccttggaaacaagagccactgtcccctacctgcccagggcccacagcttggtgtcctgccacacaccttgtatggcctgggctccgccggcaccccagggaccaggacccaggagaaggggctccggggctttctccctgacatccctgcccagcccgctggccctggctggagccacggtgaactaacacccctgcccgtctgtcagctgcaggtcgggggatgcctagcccagctctgttcctccagccccccttgctggtggcctgctggcccccacagacccgcggaagagtgaggcaagcaggtgtccggacatggacacaggagccacttaccaaggaagctacagacgctctcccaactggcccagaagcgaagatcccaactggccacctccccctgccacgcccggttcttccctccacagctcctccccccattgtcccgcctctgcctgctcctagggctggctctggaccctgccaggacccccacatcccaccagagggagtgggcgggtcccctgatgggccaggagcctggccagcccccaacactcactcagcttcttggagctggggaccccaccctgagtgcccacccccagcctgagcagctgactgcagaggaacagaccgctctgagtcacacagccagcccagtctggtgagtgccttagtgtgcgccaggtcctgctgtgtggacagacacaggcctgaggcaggtccctcctaggcaggctctgcacaaaccctgtgtctcagtttccctatgggggccaggacagaggctggcccagaagggaggagaggcatagcctaagggcctgcccccatggtcactgggccagtgaccttggggcctggtcatctgccacctgcctgagcccccagggcagccgaccctggcctcccttcagcccgctcagcccaaactcacagcggccaccacacctcgaagcaccagggtatctggtaagcagggtgcggtggggctcaggaagcagcattttttgaaacagggtctctctctcacccaggttggagtgcagtggtgcgatcatggctcactgcagcctcaaactcctggactcaaaccatcctcccgtgtcagcctctcaagtggctggggctccaggtgacgccaccacacctggctaattttaaaaattttttgtagagataggatcctaccatattgtccaggctgatctcatacgcatgggctcaggtgatcctcccgccttggcctcccaagtggctggggctgcaggcacacaccagcacgcctggctaatttttaaattttttgtagagacaaggtctccctgtgttgccctggctagtctcaaactcctaggctcaagtgatccttctgcctcagcctcccaaactgctgggattacaggtgtgagcctccgcactggcctagcttttttttttaacaagcctcccatccttccccgtcatttcaatacaagtggtggctgagaaacacctgagtcccatgaccccaagtcccccactatccagagctccagctgcctggcccacctcctggtcacctcaccctgctgcaccctgggcccttagcccccactcctctttgctctgggcagccaggaggctccagcaggactcaaccagctgtgctacgtgtagcccccctgggatcccagtgtgccagccctgtgcccatagcctgggtgtggacgtgcctccaacaggcagtctggagcaggcccacacagccgaggcccagcccaggccttaggggcagcgaggggtcagacccagcctgggaggtcagcgatggaacggcttgcacctgcaccaggccccaacggcatgggaagaggtgggaaggtgcagctgagagggctgcccccgccacgggatgccagggtggcctgaggtgggcacacagagaaggggtcctcaagtaggccagaggacttcaagggcagggaaggctctgtcccagccccagggcaggggcacttgccggcaaatggggtgggagaggcctcaggggctcctcaggcctgaaaggtggggacctgattccaggccccttctgggcctccccccattgcaataccctaaaaaggctgacacaaaaacctaacggtcacaaagatagaaaacgactctatttacacggaggcaggaaagctggccacgtctgctccagggacactcccagacagctctcacctgggaacgctgtttactgtttaccacctgacacccacactcagccaggcagggcagggctggctgagtcagcgccgtacccagaggcccagcctgctggagtgggacaggaaggagacgctggcacagagcggggccgtcatgccagacacagcactgacccccgcaagagcctttgctggggcccccaccccagctacgcccacctcacagcagccagagggaggtgccctgcacagctggccacagcgctggccacgcaagcccttcccagaccctcgctgcagtgcggccagtgtggtccgccaagccctggaacacatgacggagatctcctcctggtgcaccctccccaacgcggacagccatgggaacgcaccacaccctgccccaggccctctccagactctaagcacgtgccactggctctgcctggggcaccctcccagctcagatcctggacttgctcccccgccaggcactcagaaccgagccctcggctccagagcccctggcggtgggtgcccacagcacggtgcagacacacagcaagggatggggtcaggctggaggccctgggctctggctcagggggccacttactgggaagggtaagagctggagagccatgcttcacacctgcccctgttgctacccagtcccaagagaggcacacttgaccaccagcaggcgggtgctgggcagggccttgctcacctgcctcagttcccgggggccccacctaccggacccctggcaccacgtggtgggactcagtggtcaggcaggtgtctgatcagctggagggacggcaagcaggggctctgctaagccaccacatcacagaccctgagacctaggccatccggcatgtcccgtgatgcgcactgaacagctagtcctggctcagagctgctaggacccaggaccagctaggagtcgccatgggaactcggctgctggcgggggccagggagggctgagggcagcggatggtgaatcagccgggaggaggccaaggcgtgaagctcggcattctcagggcgtgtgtcaccaaggagcccgcggtgctggctcacccaggagccaggcctgccaagcagcaggagcagggcgaggaccgaaggctgtggccctaaacaaaggggccttaattccacctggtgggggtgagtcatggggcctcctgcccacccaggcgccatcacctgacagcccctccagccggcagggctcacacggacatagcccagtaagggtcccccaagtgtcctgcccctgccacatcccgggtacccccagctgcccctgcttggctataccctcagcagcgtccaggcaggggtgtggcttgagatccctttccggactcctgcctggaacagcctgggcaattgcctagcctcccaccaccgccacccctgcaggaaggagtccctcccaagagctctgcagagaggaggccccgatgccactcccaccctcacaagcacacattgggtcagcaggtccgagtgcgcagcagagctggcagggcagggacccgcagccggaggggaggggagggcggtggctgcaaaaacctctgcctggcctctgtggggtgcggggatgggggagtaccgcctcccgccccagcccctccccatcccctgcctcctgggctcagctccatgtttccattttagaaagtgcttctgactattaaatatttatccgagcaaggaaggccttgactcccggccagccgatgacttccaaaaaaagaaaaataaagggaaatctggaggcccaggctgagtgcaggtggggcctggtggagacaccctcaagctcgcagcgtggctggggatcccgtcacccttagagcgggtggaggggagcagaggagcatgccccgtcctccttgtgtgtccagttaagcctccgctaagctcccttagctaacctggcctccacatcccccacggagcagcttccttcccaccaaaactgccctaagacctatggggctccccggtgccctcaggacaaagccctccctccagcagctgacgctgccacctctccatcctcaccccaccccgtcccagatgcactgggttgaacaacttgcaggtccctgacttcgccctcagcctctgcaggctcctgctgctttgcctccgcttctttttcatgaccagtcccggtctccattgggccagttgtcctccagggagccctctctggcccttctgtgccccctaaggctgcactggccacaaaaatgggattcacatttgttgactgaacaatgggtggatccttcctctgctgagctatgacctcccaggtcccagggttcccggggtggctttgagacccagaaggatgggtgaacaggccgccagacagacggggaagcacccccacaactcacaccatccctgagcgcagggtccgtctctgccagccggaagaccaagctgggagagtgtggcattttactcctgaagtgggtggcagggacccccagatggccagtgccccccacttgctggggcttgggggcctttcctccccagcacctatacttctccacacctggccaagccagcccctagctgagcctgaaacacagaggccttccgcataggtgtcacaagaggaaggacacagagcgggccagagtctaagggagagctgggagtgggcccagcaacccaggggacttcccagaagaggcagctcctagcccagcccaggacagaagagcttggccaaatggagagaaggcaatgagggcattcctgttgtaggcccagccacgacgagcccggatgggagtgggcactcagcttcctgggcatggagaaggccgggagggagcgggctcctggggcattggaactggaggctctgcgggcttgaccctcctgtccacttctgagcctcacccccttccctgagctgcaccaggtgggcactgcctgaggcttggggcaggagccagaggccagcaggcagcccagcctccctccctggtggtccagcttctgtttccccaccagggaaagagctggggttgttaggaacacacttacagcatcactgtcggtggcttctgagaggccacctcactggagggcactccaggatgccctctgctgcctcctcctcaaggcccattcctgccactagcggctacagaggggctcctttgcctgcggtcaccctgcctggtggggcagggcagagccagcacctgtcagaacagcatgtcaccgaccaaagcgtgcgacattctgctctggcccctaagagcccagggagtcactgcgtcactgtccccagcctcagtgtccttgtctgcagaatgggaatacagccctcccccagtgtagatgacccagtcagggagacaccagggtggtgacagacccgcccgcgctgtcactcggcatccctggctgcgtggagctagcagcacaggcagctgcaatcactcctgaccccgaatgtgaggtcctgacccacatttgcagcctgaggccctgaagagggcaccagcgaggcacagaacagcgagaccacctccacagctgccttgctttgcacccttcttgggaaagggcccagccatctcatgacccccaccgcagagaagagaccacccacacatcttcgcatggtatcaccacctggggccttcccaacacggtggtgctttcttggggggtcgtgggaggtgctcaggccacaccggggcagcaggtgcagggtgggggccggggccggggaggggttccctgtctccccagttatcaggggcccagctctgcccctgggaaagaggcaacctgcccctggagtaggcaagagtgtgacacccagagcccactgggagtgaactggctggtgttacagtcggcagcgctgcgtggggtggtcccagcatggccaccagggggcagcctcggcacaaaagccgcccaggagatggctccctgctgggctggtgcctggtgtgtcgggcagagggcaggtttggactggacaggaagacgagagcaggggagagtccgcccatctccagcctgctgagaggaaactgcaggtggaaaaggcctggaccaaatccaggctgggaaaggcagtagttggcagggtgcttgtcaggaatgcacgttcctgggccgcagggttggggagggtctgggaaccggtgtgctggacagaactcccaaggtctctgatcttgcaagtctcctaccaaagctccagcgagagccactgaccttattccctaagagcggatggttccgtaggctggacacagggagggactgccccagacgggctgggaaccatgaagccagcacaagcctctgtggaggcagggggtggatgagatggtcctggaccctgcagcttgggagtctctgggtgcccgtgagtgaggaggaagcagagcagaaaggctgtgcagggaagctgggggcagggtagtggtcccatgcctgggggccctgcccttctccctctgaggaggtcgacctgcagccatgtgggcagggccagtcatagtgaaagaggagggggccaggggcctccagcccaccggagccatcatcctcccgctgctgtgcccaaacaccttgggctcccatctgcgacaccgtgaagcaggtgctgtaggggcctccctgctctggagccccccagacaagcctcccaccctaagtgcgcaccagacagacaggccacaggaggggccttggtagtgcctgctgcagctggggggcatgcccaggccaggggcacccctctcacctgcagcattgtcggcaccattagcattgacctgttttccccaaggagtggggtccagcctgcaccagtgccggccagcccaaccccctggccagtggctgccaatgccctgggtgtggtcagctgcagcagcatagacccagcgcccaagggactgccctgcccccctcagccctgccctccaagatgctgagacacccaggccccggaaccaggcccagtgcagggacagacacacaaagagcagcaggtacacatgccgtagcctgcggctcagagggaggctactgaccatccctgggggcatgccagtaggtagcacccactttcccttgcccagcactgcgggaccctgtggcctgactttgaccccattcaggcccctcaccaggccccagacctcaggcctagccctgccacagcctccacctagccagcgaccccaccacacagccacacagtagacgcagcccagccctgcctggaagccccggaccaaagtggagagcccagactcctggaccagcctggctgctctcccgcaaagcaggtgagagggcaagcctggtgcaggtgccccgggtcccggcggccccggctttcacgccccttgcagacaccagccctgctccagagtgcggtagcacctcccaggaggccgcctctcgaccagacagcgtcccaggagcggggcaggagcgagaaggagagacagacagggaccgcgagtgacagagggagtgagcgacagagacgagtcagccaccgagaaacaaagtgagcgacagagacagtctcagaggccgggagaggagcaggaacctacagccacggacaggtagaacgcgaggcatgggagaagagactccagcggccgggaaggcccagaaccacgcgcgagtcccgcaggcgtctccgagtcccccgcccccaaggcccgcactgcgcgcccctggacacgccccggcgcgcgccctcgcgcgtagcccacccgccccaggggagcgggctgcaggcggggaggggcgcaccgctgccgggggttccgggccaggtgggcagcaccatgtggaagcagtcgcacatcgcggcggccaggcggtgcgggcctggcggcccgtcgcgtccagtcgctggtcccggctccggcgcacggggcgggcgggcgggagccgcgctctgccccgctgccctgcgctgccgcgggcggccgacctcggactgcggacaccgcgcgccaggctacccagccgctcagctaggaccccgcccggctccgcccagccctgccgggccactgcggagcgcgctcgcgggcggtgccgtcggcctcattcagcccattggctgccgtcgccgcggccccgcccctcccagccaggccccgccccaccccgcgcccccggcccgcctgtcgcgtccgcagaattaactttggactcccgccagggagcgacctctggatccccgcaccgaggctcctggacttgccgctgtcttcacctcccattccgggggagacagacactttagtcagaagctggggtggggggcagcctgcggggacaacaggggtcgcgggcaccgcaggaggtgatctggcagcataaggacaagatagaattctgcaggggctggtgggtggcagatacgaggacgcggctgagagcgtgcagcgggaacagggcgccccgggcagggctgcggggtgggcgccgcgtgcgggagcgcccagcgctgggggcagtcctggagccagaaccccgcccagagtcatcctttctgctgattcttgtcaagagcctagggcctaggacacagcggcaaccagcaccccactggccctgccccaggggctccaggtctggcgtagacacaagcaagcctgtaaggatgaggcgttctgcagggcggcactgccctgggggcgggggaacggaggtcctggagggctcctggcagtgtaagctgggaccttaggggtgagacatgtgccaggcagtgtaggaagcgttctggagagaggggacagagtagcgtgtgtgcagagaatgggggcaaaagggctggggttgaaagtcaggcccagtgggcgggggcagggcagcaaggaggctgagggggctcctgtcggtaggaggtgccacttaaggctccaagcagggtctctgagcgtggtgagagctgaggaaagactgcgcaggtggctaggggtgttggcatggggcacagctggaaacaggagcagtggaaccacggccatggtatgggagggagtgaaaggatatgcaggcagaggggacttggtgaggatcagagtgcagagggtgggagcctccctgggatctagcttgggcaccacacagaggcagcacacctgggggtgtggacagggagggcaggggcccaagggagttctaagagtttggtgacgcctggcctggtgtagacccaaaccgggcataccccagaaggagtggagttctgcagggattgtcggggaaggcagggctggaagagacccaggagaggaccgccacctccatgaggagctgcctggcaatgtccaggggtgtgggtcagatgcagggacacacacacacacggacacacatacggatacacacacacatacatacatacagagataaagacacagagacacacagacacacacggacagagacacagacacacagatacacaggtacacatacagacacacacacagaggcacacacagacacacacagagacacacagacacacatggacagagacacagacacagagatacacaggtacacatagaggcacactcacacacacacagacacacacacagagacacacagacacatacacatagagacacaaacacacatgctctgtcatacacacacacacacacacacacacacggacaccttttcctggggtgggaagaggccaggctgtaccggaagggccaggcagacacacacactcatagataagatcacaaactcaccaagacacagacacaggccacctgagatatttgatacactcaggcctgcatgcatgaacacccacaccaggatacagacccatgcacgtgtatacatacacacaggggcacacgcattcctgggctcatttggagaccacgcacagctagcgggcccaggtgagccacccgggcacgatgactcaccctagacagttcccgttagccgcgctgcagccaccgggcagccatccagcagcaggtcagatggacgccagagccactgctgggaagaggccctggcagcctcctgccagtgagcccaggcatgatgggcacaaccttctccctcgtgtggggacctggcgcaggtcttaccccaccccctcgcagtgtccttttttcggggctgagcagtgttgcctggggtccagaggccctgcacttacctccctccccaggagcccaccctgctctggtcacctggagtcagtcactccctggacacagggagagagccactagggtgcctgggtgcatacacctctgtgtgtgtccctggatgtgtctatgcctctgcctggtctgctggggtttcgcccgctagtcctctgtgtctgagtctggctgcagggcctgggaacgaggggccgctcagggcactcacccacctttgtgtcctcagcccctttaggtgtgtgcccttgacaaagtcatgtggcctcctgggtccccatccaaatgaagtggcccctctcctgattgtctggcgtgatctgcgcagggctacggggactccccttggctttgcgggatgggtgaggatggagccctgggtggggaagccgaggttgcccccgacatgtccctgtccctgggctactacctgctgcccctgcctctgttttccttcagcaagatgagagaaccctccaggccatcttggtgggggccgagtgagagcgcaagttcagcgtggcgtcacgggagtgtggggaccccacacttgggaggactttgccctggtcctgcccctcagcctggggtggctgagatcttcccctagctgtgtccactgggcctgtcctcccctggctaagaaatggtcccagaaccaaccacagctgcccaggtccaggaactttgcctctgccctgcacggggctgcccacttccaaggtgggcacagacacacacacgcagctgcgccatgctcccctgtggccccagaattcaggatggggtctgggcagggcctgctccacccggaggccgtccctcccttctcctgcccactctgagacagagggctggtgtctctctgcagtggcctctggctctgcgctgccctgagtgctggggccacagtctggttgtgactgtcggggagctggggactgcccctcccaccctccttctgggggtcttctcctagcttgagggttaagctgacagtgtcatgagtaagacaccttggggtgtctgtccagagagcttccccacctcaaggaacctggggtcctgagagctctatctcactccagatgcctctgggagggcctgcaacttgggcagtgtacccccacaaacaggcaggctgcggctatgtgcagttgaggactggctccccaggggccagccagaatccctcctcccgcccaccagggcctcagcagctgaaacaggggtccagggtcacagctgtgggagcaggggagaagatgagaggggctgccagcccccatcccgggccctgcccgccagctgaagcctgcgctcctgtcgtcacgcccagctccagtttcctccccatgtgcccctctgaggacagatgcccagctagggaggaccacagaagcatgcctgggctcaggaattcatgcccccacccacagcatcgctggacacaagcccaactcacagccgcccctggcacatacaaggccccacacctgctgtaggtgtcaccccagggagagggcatcgcatgctctctcctgtgcacacagcctccacctcttccctggaccactgagatggggacactggcccagcccactggttgcccacagccttcctgaggctgggtgccggggcctgggtgaggagccgaggctccccaggccctgatcatcagcagagccgctgccctgcccccatggcctgactggcgctgcttgcctccaccctctgcaggcagggatgcccacagcatcaatgattgattcttgctgcggcagctgcagcaacataagcaaaaatagctctgctgtggtccctgccccgccccagccacagccttgcatccagcccagcctcgtgcccagatggaggggtgtgaggtgaggtgggagcatctaggactgtctcagccactgcctgcccctcctcagtcttttatacggagatgatgggggaggaccccctgaccaggtgggggacacttgtccacccagcctcccactcttgcctgaccacactgactcctgacctctaaccgcctcactctcccccaaagctgggtgcccgtttcaggcctgggtattgtccccaggtccacttcctctgcacccacacagctgggatcaggaaatgtggcagtggtggggcatgtcagggtgctgccatcgttccactcggatgggtttcttcaacccatgtcttcatcgggctctctggctcagcagtccgtgtgggctagcctgggatccgagcagcagcaggttcccatgctgccgcctgcaagccctggcactcctgctgccagaggtgaggacaggcacacgccccaacttgccctagggacttggggctgaggatcccagaggaccaggatgcctgggtgcttctggggacccctccccagccagtccttgctcatcaggtgatgctgggagatcccaagatgactgtggggctctgtgcataggtggcacttgccccagaacccaggctggccccttcctcctgagactagggtagggaagcttggctcctctgcagaagggaaggtgctccccacacagccattgagcagggctggggctcagggtggaccgaggtggctggagaggtcctgggagggccacatgggctcctcgtcccgaccacactccacctgccccctccatgcccctcgggagtcatggctaatgtcccccacacccaggctttaatgggaacccaccctctccggcccagtctcccctagcagctgggccagttcaatttgagcagtgcctgctccaatcgccaacctggaagccttatcctcagctcgtgcctttcaggctgtgccatgaagcaggatggtctgcccagaagctggcccaagaagccagcagcggcctagcagccacctgggctgcccccacctcctcctgcaaccagggttgggcacctgatgtcaaggttgccgctgccatttcctctgcaccttggcttccccgacgcagcacttctcagtgggtcacaaggggtcactcaggcatattagttccctgctgctgccataacaaaatacccccgacacagtggttgaaaacagcatgtgcgcatttatcaactccagttctaggtgtgggcaggatggtgtgccttctggaggcttcaggggagatctgttttctggtcccttcagcctccagaggcatctgcagtctcgtatcactccggctctgcttccatctttgcgtctcctctctgactctgaccttcctgcttccttctcaggacctttgtgattacatgcctcatccaggctccactcctcctctcaagagccttaatttaagcccatctataaagtgtctttgaccctgtaaggtcacatagccacaggttccaggggttaggatgtggacatctctgtggggctgttcaactgccacaccagctcttcaacccatatgggtcatttctatcctccaaccaccctgggagtactgtgctccccacgctcttcacgtggaagctgaggcccagacgggggtggggaattgcagagaacgaggagagcagctcctgtcccagctctgcttctcacgcaggcctttggggtggggcctcagtttccccacctgtacacaaggacaacactcctcctgcccccctcccagctccctgggcctcaaggacggcaaggacgtgcagtggatgaggggcagcagtgggaacggacactgcccttaagctggcaagacaggcccaggcctggtctacaaacccagccagctcctgatcaccatccttagggtcactgcggtgctggggtggccaagccaagatccagtcctgggcagtctgaccgaagagcttccatactgcatggcccggctgctctgcccctcaggaaggagcggggacaggaggctgggtctaaggtgcagagaatgatctcatcttgtcatttgtaaaattaaattgttctgtagcttggctgagaaggaccagggagggaaggggtgattcaagcaaggacagagtccaggcagggccccaggccccagggtgggagaaatgcgagcctgaggtagatagggggtggacagtaggtggcatggttcagggcttcaccagggccaggccctccccttacccagaggaggcagtgatgggggccagtctgggaaggccagggaggagatggagtcaaggttgactccttgagtctgggggtgagggcagatggcagaaggcctggaagcccggaggggagctgccagaggccagcctagctccttggtcgtccagtggctggagaggggctgtccgtcagccctgctctgcccgggtctggctggtgacaaaggaggggagcactccatgcggcctgcgagggaggggtggagcctccccgcagctccttcccccaggaatggggacgagttaggggcgggcgaggttttgggattcaggagtcagcaagacggacttggctctcgccagggacaggtggggtcctgaggggccgtcgctcagctgcacccacagaggggtcggcggcgcggcaagttaggctgcggggcgccgggagaaggggctgcgggtgacgggtgcgctgggacggacctggggagctcgtcgtgaggaagaaagaaccactctagggccaggcccagtggctcaagcctgtaatcccagcactttgggaggccgaggcgggcggatcacgaggtcaggaaatcgagaccatcctggctaacacggtgaaacccagtctctattaaaatacaaaaaaatcagccgggcgtggtggcgggcgcctgtagtcccagctactcgggaggctgaggcaggagaatggcgtgaacccgggaggcggagcttgcagtgagtcgagatcgcgccactgctctccagcctgggcgacagagcgagactccgtctcaaaaaaaaaagaaaaaaaaaaaaaagaaagaaccactcgggcggcgaactgagcacggacagaaagctcgagcggcccggcgcccagggctcggccagtgtggaagcccgatcccacccgcagcggaggcggcccggggcagggagggcgggtccggggcgggtcctgaacggcgggggccggcgctggcctcgccccggatgcgtgctgacgccacggcgacggacgccggaagcggagctggcgcacgccgttgccaggcaacggggcggcgcaggcaggagggaacggctggttgcaggtttctctcgccctggtcccgcgcggccccgccgaggcggcgaccaaggtgggtgcggggactctcgggagccgtgggccaggcgcttagccggccacctcgggccctgtccaggcccaggcgttccagggctgctctgcgggccgcgtgcgagagggactctcgggaggccccggggcgccgcacccactccttcccacttgggactcccgcgggcgcccggctctcgctcctctggccagcgtgggcctcccaggccccctcgcggctctctccagagcaggagccccaccttgggccgcccctctcacacctgccgtgggtctggtacgcgcctctgtgtcggactccgcgcccgcctgcgtgggaggaagccaggactcccgggcgaccgggccattcctgtggtttgtgtcagttccacagcagcacgtgggcactttccaccgtcagccactgggcagcccggggcactcctgcagcgtcccctggccctctccagggcaggggaaggttgggcagtcctgggcggccagcaccccggcgtgcatgtctcctgagcagctgcccatcgggcctctgctggcctgggggctccaagatgcaaggccggcgggagctggggggagagcctttgagtgacctccaggaggaagcagccagcgcttccctccgagtggcacctgagaggctgagtgatgacagtttggaatggagacggacctgccccgaccttctcctgtccgatgggaaagccagcatctccatgccccgtgagggcggttccacctgcactgcccgatgtcctgaccctggggaacacagcagcacttggggggagtttgaaggctttcgggaatcttcagccaagtctggacaattctcacagtcccttgaactcctcgagggacccacagaaccccagccaccgagaaccacttctgccccaaaagagtgcagttctcaccaaccatgccagggtggaccttgggtgacaggaacttctgccgtcccaccttctgaggtatttctgctgtgctgtggtcaccatgttgagtgggacgtgtacacaccaagaggcctacagccctcgaatgctgtggcgtgctggccagggagggggctgacagccccagagcgtctgcttctctcctggccttcgtccctggccatgtggttggcagtcccatcctgaggccagggaagcaatgagttggcagaggaggctgcagaaatgggtcacacgaaggccaggtgggggccacctgagctgggtcgctctttctgaccattcctcccccagcctgtccattccccattggtgggggctgcactggccccagctcagggcatttgaggaggagctttttgtctgaattctgaatctgctgagttcaaaagtctcagagattctaaaatcacatgatcacatttcaacttgcttgtaatgaattgggtgacgcgggatccaacctgtccgggagcttgtaatgaattgggtgatgcccattccgacctgtccgggagccagggtcccagccttcaggcccctgccccctgctctctttcagagcagactgtgggtgtttaccgtttggtgacacttccgctccttctcttttcctgtcttcttccttccattgttcctctttctctgccacttcttcccaaatggttcatcccaagcaccatcatgagagatcagaaataaaaccagtgaggaaggaaataaagatattgtagttctcagggctggcctgttttctcttccttttctttttttttttttttttttttttttttttttgagacagcctcactctgtcgctgaggctggagtgcagtggcactgtgtcggctcactgcaacctctgtctcctgggttcaagcagttctcctgccttagcctcctgagtagctgggattacaggcatccaccaccacgcccggctaactttttatatatatatatatatatgtatgtttagtagagactgggttttaccatgtttgccaggctggtcttgaactcctgacctcaggtgatccgcccgcctcggcctctcaaagtgctgggattacaggcgtgagccaccatgcccggccggactgttttctgaagcagtttccctggaatcctgatgagatccactcttaatagagtaaggtctgctgtaatgcttgttttgaatacaggatttgttttccagcgtgattgatgtattagggaacaattagagcatagttgaaatttcacaagaaagagtagataaatgcagaaaactgcccccagctgagctggggcccgttggaatacatgagactcgcacacgtacaccctcacacagcgcttagtgccccaatgtagcacacctgtcaacacctggtgttaggacttcacccggttcagaccaccctcctcctaccccttcacactaactcagcctgcgagcctttgtcttttccaaggtaaagtgctgtgcttactgtagtatgtataatttctttttttttttttttgagacggagtctctctctgtcacccaggctggagtgcagtggcacaatctcggctcactgcaacttctgccccccacccgccggattcaagcgattctcctgcctcagcctcctaagtagctgggattataggcgtgtaccaccacacccagctaatttttgtatttttagtagagatgggggtttcaccatgttggccaggctggtctcgaactcctgacctcgtgatctgcccacctggggctcccaaagtgctgggattacaggcgtgagccaccgcgcccggccgcatgtataatttcttaaccaaactggaaaacagcactgacattattgggtggtcatcttttttcatgtgtcactgatgaagtttgaatgttttgccctaaccccacctttcccatgagtcctctggttttgtgtgattttgctaacttggtgatttttaggaatgaatatgtcaagtgatagtaacactaatggtatgatcaattacaaatttcatttctatcacaattatttctttggaataaggtaacgttatgtatgtctttctcctaactttggtatgcttttcttcttttcttttcagcccattctcagctatgagaacattttaaagtgtgcttttcaagaaataacagtccagcaggcagctgaagacgtttccaccatagaccatttcctagaaataagcagtgaagaaaaacctggcgttgaacgtgtacataaattgtggtaatgaactgaagaaatatttcttacagcaactgcttttgtacttttgtttgataaaagtaggtgtgtgaggctttgtttttgcctttatggagagtagcatctctcctgaggtccctgccatctgtgggtcataggggtcctatgagaaggggcagcacgattggcgctccagctgtggccttccactctgagccctattcatcctcctccccagccagctcacctggagcagctggacccaagcccagctccccttgggtctcagtgccagtgctggtggagtgggtgggggcctcgcattcagtgcgagtggctggtgggcctgggcagtgggcacaggggccttctgggggacttggctgagtgggcaccggctgcctcatggttctcagccacagagttctagaaaacgttccacactctggagccccattgtcagccccaggcccagccccaggggtgctcccggtgctgcctgcagggccacaggctcctaggggaaagtgcacccgcagtcactcgcagatggccattttccagggacacactttcaactgagcattgaaagacagacagcgctcgagtggattaggccgcagtggttgagaagctcgaggtaagttggcccaaggccccagagggaggagggaagtgaaggttggggtgagctagcttccctgtccctcggtgtggtctgcggagtgggtctcccagcagccaggggagagccaggtcagcctgctgatttttgtgtctctgagcaggcctggactttcagagagctctgcagacaggccattctgggctccagccctggcccaccgtgtcctctgctggggtccaaccagcacctgccccagggtaccctctacaggggcttgaggacagaggcctggagcccagaaggccgcaaccagcattgcccagatggcccgtgtgccctctgtgtgtggtgcttctgcaaagcatgatccctggggaaaaactgtggagaatgtggtcccagcaagctgacggtgggggtgggctctgtgctggcagcattgacatctctgtccccagcagcacaactcgcggacccagaggcatggggagtcctgggtgtcaggacttggcggggctggacactcgtgggacagaaggctggatggtactttgggggtggagtagagcatggtttgtgtgttctgaaacactggggtatttttggaaatggtttggtgtttagcacatttgctcttcttctgtactcatctggagtgcagtggcaccatctcagctcactacagcctccgtctcctaggcttaagcgatcttcctgcctcagcctcctgagtactgggactacaggcacccgccactacacccagctaatttttgtattttttgtagagacagggttttgctatgttgctcaggctggtctcaaactcctgagctcaagtgatttgccctcctcagtctcccaaagtgctgggtttacaggtgtgagctgccgcacctgcccttgcactcattttcccttccatactagaacgtgaacttcctgcaggcagaccttctcagtccctcacagtgcgtagcagtgacgtgtggcacatagtagacattcaccgttggtttgctcatttgttctcctgagcatgcactggtactcgtagtttgggagcatctgttttgtactcagcacagttctaggcacttgagtgaacaaaaccagcaaaatatctggtctcacggagcttccactccttggaggagacagtaacggcagtaagtcagctactccagggcaggtgctgtgaggcatagagggggcacgggaggtgggttggggtgttgaaggatggcacgtgttgtttgaataaaagtataaatgaacaaataaatgagacagcccagtgctcctgcagggaatgctgtttttatttgtttttttgtttgtttgtttgagacagagtctcactctgtcccccaggctggagtgcagtggcgcgatctccgctccctgcaacctccgcctcccgggttcaagcgattctcctgcctcagcctccccagtagctgggatgacaggcgcccatcaccacgcccggctatttttttgtatttttagtagagacggggtttcactatgttggccaggcagatcttgaactcctgacctcctgatctgtcagcctcagcctcccaaagtgctgggattacaggcgtgagccactgtgcccagcccgggaacactgtttttagagttcttaacagccatacgcctcttggcttgtgcgcgtctcggcttgcgggtaaaggccaggcgccccgctgcgtgcctcgggccgtgcctcatgatctcctcagaaggctctcaaggtcaccttttaacaagtgcatctgttttccagtaacgaatccagaaaactctggagagcccttcagagcatacacaccacgtctacttctcagcgcctctggagcgagtcccgttgccaggagaacttctttcttgttctcggaatagatgctgcgcagaaggtaggcggtttgggttgacacagggctcctgggagtgtggttgaacttcactgtcaccagtggcccttggccgcgcccaaggggtgggtgcaggcagaggtgtgggttcaggtgggttaaagccactaggtggccccataaacgtgtcagggccactggatgactcccgaatgcttgaggcaggagccagcaaagcctagagcaggaggtggggaaaggctctggaaggaacgggcctgagcctgcagcagacaacgcattcagagatgtgcaacagtgtgtgtgcactcatgccactgccgccgccacgcacatgccaccacgcacacgccgccacgcacacgccgccacacacacgcctcacacgccgccatgcacacacctcacgccaccacatgccgccatgcacacgccgccacgcacacgccaccacgcacacgccgccacgcacaccccgccacgcacatgcctcacacaccaccacatgccgccatgcacacgccaccacgcacacgccgccatgcacacgcctcacacaccaccacatgccaccatgcacacactgccacggccaccactcacacgccaccactcacatgccgccacgcacacgccaccaagcacacacaccacacacgccaccacatgcgccactgccacgcacagactgccgtgcacgtgctcaagctcctgggctgtcgcagaaaacgccagtcatagggagggccgccttttcagagatctagatttcaatgatctttcctcattcttaaatattatggaaattttcaaacatggaaaactcaaaaagggccagccaggcaggcagattggccctggtgaagacaggggcatgaaaatggttgccctgttggcccatgggccacattgggctggccaggaaggaagtgaagggcagaaaggaacagagaggctcccagtgagattcgccctgactgtgtcattgtgtgaggaaaacagagaaccaggaggctaggaaatgggggaggcctgaatagaagcctcaggtgcgggccagctccgagtggcggcagcctgaagggtgtgtctgaaagtggccgtgaagacattattcccattgagcagttgaggggcgctgaggtcctgaaggggagcgaggcctgtgagccgggcatgaggcagcgagtggcagggcgacacaggggaaactggtgcgctgaccttgagaggggcctgagagaactttgcagttttagcatgaaattagtagaggggctcaggggaaaaggaaacaggagacaaaatgatgactgtaccggctgtctgatggggtctgtctccttagaacctttctggaggccagggccacatcatggaagattgtgacctcaaagagcctgaaggactcctcactgtcagcagcttctgtctccagcattgcaaagccctgatccagaccaaggtgagtggtcaccaaggagaggcctcagggaaccgcgctggcggtgtccacacatgtggagccctccgctttctctgatgtgagtcagttgcttgttttcttcctttaagtcttgtggacttccagaaaacaaacatttgtgctatttagggcagacaggcaaattgtgaacaccactgcagggtgccaaggaatataaataccatccggaaagactctcaggccagaggacccaggatatgggtgggtcacgcaggagaagccagggagagaagagagctgcagggaagctgagacgccaggtgtggatgacgaggctggaaggatgaggcaggaccaggctgtgactgttgggccaggggatgttgactccgcctgggcagctgtcgtgaacggatctgactggcggcttcagtcacgggccgcttaccctacacagggtctgcccacagcttttctctcatgagccgcggttcttgccacagagtcacttcatcacatcatcacagccgggctcaaggcagaagaggagatgggcagagaaggggacttcttcttgcagctctctcttttatcagggggaagaaaagcttttctgggctggagtctggagcccaccctcagaccaagtattgcaggaggggtgagatggccaggcctagctcacctggtttcctgctcaccctggagacccaggaccttggaacagtcggggctcattgtgtacacccaggagatggtgggaggggcgcatgggcggctgtgagcatgaagagtgacatgcagggaggcgcaggggtaaagtactgccctgtggcctggtaggaggtaacaaggacctgagactgagctgggacagcaggaaggttgcatagcacaggaggcagccagggtcagcttctgggcaagaattaggcatgaatgtggcactgcccccagctgacatggggtgggttccctggatgatcagcacacaggtgacaggcgacaggtgccatggggcaacaggagagggccctgatcggccgtcttcacaggctgtccatctttttgaaaagcaccatagcacaggagggttatcctagagcagcagctgtaaagaaatgttcgtggctgtgttgttcacagcagccggtgggggagacgtccagccgcagctgtttgggggaagtctgtggtgtagtccaagagtggctactggagggctgtgagtgtgcagggtagtggcagcctccaccagggagtgccagacacgtagcacaagggccagagaccccgcctaagatgtgggcccactgctgtcttcggggctggctgcaggccagagccacagactgcaccatgaggaagccccagcatgttttccctgggcgcctctctggtgacatcccatgatgagaaggtttctaagaggagaaccaaggagagaacactagggggccgagaggcagggggcggccaggggcaaacgcccaagctagcgcttctcattgcccggggtgcgcgcgcctgactgctgtcctctcatctcagctctcggggccgcctggcagcaaacaggggaggctgatgacatgcagccgcttcctgaagaccccctcatgcggaggtggccagcacatcactattccaaggaaaaggatgttcactccacgcaagctcaaactgacactctttaatagcgacgtttgctaaaatcaggaggactttgtacctttatgaggaatttttcattttcttcctggctgggttgatgtggaaaccagagctgtctgtggagctgttttccagaccccaggcccattcctgggatctctccaacaggacctgtcctgtgttctgggcttgtctcgggtctgaccaggagatggaggatgtgtccttggcagagccaaggggagacagaggtttctggatgccatgacaggctgtcggggtccaggtggcactcatgggccccctgccccatgtgaatgctgctggcacctggtggggggttgcccagggatggaccctgggcatggcttctgggctgcttagtccagggggagcaacttgtggccaaatccatgagttcagaggaaaaggggaaggcactgaaacgtcaccagagagacagctgttgagaccgctcagaaaccctctgtctgtcacactctgccctggctgctgtgtggtcagggcaccatgagggtgtacagatgtgctgtgtcctcagagcctcgcaggtgccctcacttactgcctgggcccctgcccagcagcctcaaggacaggcctttgtccctcacggttgtggacaggaggtcgcaccactggcctgcgagagcctctggtgggcccgtggcttcccccagttatctgctaaggaaaactgtgctcttcgaagggcagagccaagaagtcagccctgacttttgtaaaattttactaaataaaaccacctggataagcctgttgtcactggttcatcagctggggggactgatacctgaaatcctgtccccaggggaggcctgaagtcttaagcaagcagccaccctggctgtctcttttcctgccaaggccacacaggggaccatagcctccatgtcactgtggtatcagtgcgatgtgcacagtgatgggcaggagtttccatcatgagggaggaggaagcagatgtccctgcacaaaccctggcctcggccacccagctgcatagccagcaccatgttgcacgtggctctaggtctgtgatgaggagaattcctttttgtttgtttgtttctgggtaccacatggtttggaaagctgcctttatttttcattttcagccaggggaaagtgggaatttagagactgtttttctaacacacagcttccttcaaaggcactgtcttttgggccctgccagcagagcccctccaggagatgccctggtttcctaacctttaaaagttagactttaacaagccaaaatactccatcctgctcctcccactccaagattcgggttcagactgtgccatggcatcatggtgtcacccatggtggcccttgctcctcacctggctggatgttggtgacccacagacctcagaaggccaagcctttcttctgacttccctgtggcctcacaggaacctcagaagcaacaggttccaaacctgacttctgtggcacccactagagaagagaggccctgctgctctcgtccccagaggggagtgagaggaagaggcccctcagagtcaggtaaggagggaccaggcgacgtacatgcaaaccacttgtccactagtgcggctgccaagcccccagggtctggaggaccctgcaacaggcaagtccaaagctccctggcctccctcaggtccacactgagtgctcaggaagaaagtgccaaaagctgggagtgggggcagggagctgacggacactccctcgagaacgcccctctcacagatatgctgggatttttgttcccaaagtctggaggcccagcaggggagctgggacagtgggcgggaggcaagcccccaaaggctgaggaagaggctgcaagacaccccgggcgcaaggcgaggggctggaatggagagcaaaggaagcctccagtggccaaaaaggacggcagtccggctgaagaacggagaaatcatgcagcccccaaagccagtggcttggctgcgacacacaggctgatgtccagaatcactgtgctcaaagctcagaccccaccgaagccatgccctgatgccaccctcagggcgtctgaaggcctaactacagctgcagagaagtccagagctagctcaactaccgggaaggacaactctgttcccactctggcaacctcacagtggaaggcacgtgcccctctgtggaactaaacgttgtttgcttcagcctcgattgttcttttatatgaactgtctagcctgcagtaagacattacaagacacatgaaaaggcaagaaaacgtgagccacagtgagcagtagaagcagagtcagccccagtggtaaaactgaagtcaagggctttgaaggaactctggggaggtggggagggcctgtggaaatggcgggtgacattcaccaagagatagggatgttcagcagaaacagggacacttcagtaaaagacagaatgaagatgctgcaaatgaaaaatacagtatataaatgatctttagatgggtttaacagcagactggacatcacagaggaatggatcagttaacttgaagattggtcactaaagaagatccaaacacagagaggggagggaagacgacagagggtccaagatctgtgggccaaagtcagatggcctaactgggtgtaactggagtcccagagcaggaacaggagagaataaagaagaaatattccaagaccgaatcactaagaactttctgaaattcatgaaagaaaataatccacaaatccaagaatctctgtaactgcaaggaggtgacgtggagaaaaccgtacctgaacacatcctacaggccttaaaggcagctaggatggaaacaggagattcatatagagaagcaacgataggaacaatggctcacttcccaccagaaggccacgcacgcacccacatctgcggtgctgaagggaaaaggaaggtcaacttagaagttcacatacattgaaatattctttaggctggtcacaggggctcacacctgtaatcccagcactttgggaggctgatgcaggtggatcacctgagatcaggagtttgagaccagcctggccaacacggagaaaccccatctctactaaaagtacaaaaattagccaggcgtggtggcgcatgcctgtaatcccagctacttgggaggctgagacaagagacttacttgaacctgggaggggaaggttgcagtgagccgagatcacgccattgcactccagtctgggcaacagagtgagactctatctcaaaaaaataaagaaagaaagaaaagaaaaaaatattctttaaaaatgaaggcattatcagccaggatacagaaaccacaccagttatctgaagaggaaaaaatgtaaagaattactaggcccggtatgtggttcatacctgtaatcccagcactttgagaggccaaggtggaaggattgcttgaggccgggagtttgagaccaggctgggcaacatagtgagacccccatctctacaaaaaagtaaaaaaaaaaaattagcctggtgtggtggcgctcacctgcagtcccagctactcaggaggctgaggtgggaggattgcttgagcccaggagttggaggctgcagtgagctgtgatcacaccactgcactccagcctgggcaacagagtaagaccctatctcttaaaaaaaaaaaaagaattaagtagtaaaagttggttaactactaaaagggtcttggtttggtttggcttgggttagagacagggtcttacgatgttgccgtgctggttttgaactcctgagctcaagcagtcttcctgccttggcctctctttttgttttttgtttttcaataaagacttacttaataggccctgaagtagcaggtgcgggaaagcagcttctctgggttggcggtgaggtacagtgaggaattaaggcctggccaaggccccctgccctcccaggctgagacgcaggcctttcacagtgagtgtggctatataggaacaggcctaggcaaaggagctgagctggagctggtctgcagggacagctggcaggacaggtgcccccaggagcaccctactggagtggctcaggagcagagccagtgcaaacacggggcatgctggggcccatcgtgccatgctgggctcctgtgccaaataacactgatggaggaccagacccaagagggaagcccctctcccagccagctactgccgcttcccagctgtctgcagtcagtgctgagtagagagtggtgcagagccagccgtttctgcccacctcggcctcagatggacactctatccagggcccatgggtgtggcaaaggcccttcctcccacagatgccaggcttgcattgaggctgacagctttcctctgcctgctcctgctttctaacccttttgtccttcataagtatttccccaaataaacttcttgaatgtgtaaatctgtcctggcctttgattcctagaggccctgaaggaacgtgaccatcacctgacctgagtgacactgcaaagccctcattctttctagtggacgtggagctctctccaagcagataactgagccgtcagccacatcagaggccagggacatggccttcagaggctttggccatcatgcaaaaaacctggccaccctgaagcctctatgctggagaaatgtctgcagtgatcccacagagatgctgacaagatgcccaaggacccagctgctggagctttccggccagcatgccagccctgggaggagggaagccttcagggtggggtgcatccagctgcagctgctgcctgacagcagtggcctgacagatcccagcaagaaccacccggctgagcccagccaagccgtggcatgagatcatggcagtaacagatggtaggtgctgcatgctgtgaagctagtgatggcagctacacagcaggaggtcatgaaaacaacacatgtccagataaccagtgggtccatagaggtcactggaaacttagtaattgaaactgaataatgaaaatggcactgatcaaaatctgagtgaatgcagtgcatagaaggaaatttatagctttaaatgtttatattagaaagtaagaaaagtacaaaaccacctaagatttcatgttaatgtgcaagaaaaagagcaaattaaaccaaaagtaagcagaaagaaggaaataaaactgagtgccaaaatcaacaaaatggaaaatggcagaacactaggaaaaagggatggtcctaagtgaagacgtaagagcatgtgatgtgcagctctcgcatgactcctgattcaaacaaaccaaatgtagagacaacttcgaataacacacagcgaggaaaagcaggcagcctctgcccaacacagccaggagacagcctcggaaatcggagaaaatatttggaaaccatatgtctgataaggggttaatatccaaaatacataaggaactcaaacaacgtaacaggaagaaaacccagataacctgattgaaaaaataggaaaaggacctgaacagacattttttctttctttctttcttttttttttttgctgtgtcgcccaggctggggtgcaatggtgcaatgttagctcactgcaaactctgcctcctgagtacaagtgattgtcctgcctcagcctcccgagtagctgggactacaggcgcccgccaccatgcccggctaatttttgtatttttagtagagacagggtttcaccatgttggccaggctggtctcgaactcctgacctcaggtgatccacctgcctcggcctcccaaagtgctgggattacaggcgtgagccaccgcgtccagccaagcagacattttccaaaaatatatatatatctatttttatatatatacacacacacaaatgaccaacagctatacaaaaccaatgctccatatcagtaatcatcagggaaatgcaaatcaagactgcaataagataccccctcacacctgttaggatggctattctaaacagatgaaatgtcggtgatggtgtagagaaatgggaatgcttgtgcactgttggtgggagtgtaaagtagtaccgccgctatggaaaacagtatggaggtgtctgaaaaagttaaaaatagaactaccatatcatctagcaatcccactactgggtatttatccaatggaaaggaaatcagtatgttgaagagatacccgcacccccatgtttattgcagcactagtcaccatagccaagctatggaaccaacctaggtgtccaacaacagatgaatggataaagaaaatgtggtacatacgcacaatgggatactattcagctgtaaaaaaaaaaaaaaaaaaaaaatgaaatcctctcatttgcaactgtctagatgaacctgaagcatttatgctaagcgaaataagctggtacagaaagacaaaccccacgtgatctcactcatacgtggaacccaaaaagtcaaactcgccaggtgtggtggctcatgcctgtaatcccagcactttgggaggccaaggcaagaggatcacgtgagtccaggagtttgaaaccagcctgggcaacagagtgatacctcatctctacacaaatataaaataaaggccggggcctgacatggtggctcacgcctgtaatctaagcattttgggaggccgaggcaggcggatcacctgaggtcaggagttcgagaccctcctggccaacatggtaaaaccccgtctctactaaaacaaaaattggctgggcatggtggtgtgtgcctgtagtcccagctactcgggaggctgaggcaggagaattgcttgaacccaggaggcataggttgcagtgagccaagatcgggccactgcagtccagcctggcaacagagcgagactctgtctctaaataaataaataaaataaaataaaggctgggcatggtggctcacggctgtgatcccaggactctgggaggccaagctgggcagatgacttgaggtcaggagtttgacaccagcctgaccaacatagtgaaaccccgtctccactaaaatacaaaaattagccgggcgtgatggtgcgtgcctgtaatcccaactactcaggaggctgaggcaggagaatcacttggacccgggaggcggaggttgcgtcgagccaagatcgtaatccctgcactccagtctgggtgacagagcgagactctgtctcaaaaaaaaaaaaagcaaaactcaacccaagagattgaggctgcagtgagccatgtttgcgccactgcactccagcgtgggtaagagcaagaccctgtctcaaaaaagaaaggggagttcacagacgcagagtagactggtggttgccgggggctgagggctggctggggagatggtggccaaaagatgcaaaatttcagttgcaaggaatgagctcggggatctcttgtacgcagggaccgtaatcagtaacaatggattacattcttgaaaaccactaggagagactggctacggtggctcacgcctgtaatcccagtactttgggaggctgaggcgggtggatcacgaggtcaggagttctcgagaccagcctggccaacatgatgaaaccccatctttactaataatacaaaaattagcccggcgtggtggcacatgcctgtagtcccagctactcaggaggccgaggcaggagaatcgcttgtacctgggaggtggaggttgcagtgagccaagattgcacgactgcactccagcctgggcggcagagcaagactccgtctcaaaaaaataataataaaaccactaagagagtagatttaagtgttctcaccccaaaaagtgacaagtatgtgtggcagtgcatattaattagctcgacttagctgtttcacagtgtacacatatttcaaaacatgttgtacatgatatacaatttttgtcaatttaaaaattaattttttttttttgagacagagtctcactctgtcacccaggctggagtgcagtggtgccatcttggctcactgcaacctccgccttccaggttcaagcgattctcctgccttagcctcccgagtagctgtgactacaggccaccatgcctggctaatttttgtatttttagtagagacggagtttctccacattggccaagctggtctcgaactcctggcctcgtgatctgcccgccttagcctcccaaagtgctgggattacaggcatgagccaccacgcccggcctaaaaattaattattattattattattattatttttttgagatggagtttcgctttgttgcccaggctggagtgcagtggcacaatctcggctcactgcagcctcctcctcccaggttcaagcaattctctgcttcagcttcccaagtagctgggattacaggcacctgccaccacgcctggctaatttttgtatttttagtagagacggggtttcaccatcttggccaggctggtcttgaactcctgacctcatgatccacccacctcagcctcccaaagtgctgggattacaggcgtgagccaccgcgccccaccaaaacagttaattttttaaaaaagaacagcaacacacacaacctgggcaaacctcacgacatgtaaaggccaggccctgcaggtgcccattcacaagcagatcaggcccacaaatcctgttggcaacggtggggacgcacctcccctaccttaacccatagcagctacagggtatcttcccgtgtaaactgttgccaagcggacactgacaattctggcatgttctggactctactatgtacctcaatttttaaaagttaaaaaggaaataaaggggccgggcgtggtggctcacgcctctaatcccaacactttgggtggccgaggtgggtggatcatgaggtgaggagatcgagaccatcctggataacacagtgaaaccccgtctctactaaaaatacaaagaattagccaggcatggtggcgggagcctgtagtcccagctagtcgggaggctgaggcaggagaatggcgagaacccagggggcggagcttgcagtgagcggagatcgcgccactgcactccagcctgggcgacagcaagactccatctcaaaaaaaaaaaaaaaaaaaaaaaggacaatttagggagaaaatcagacatttgactatgaagcaggtgttagatattaaagaattctccctaattttccagttacaatatggtgtaaaccaaaaagcatctgaggcagctctcaatcaagtcagaggtttattttgccagagcccaggaaaaagaaacacaaaaccacaggaacagtctgtgatctgtgctttttccaaagagagcaagatttggggacttcaatatatacacatattttatgagacagagtcttgccctgttgcccaggctggagtgcagtggcacgatcttggctcactgcagcctctgcctcccaggttcgtcacgcaatcgtctcgctcagcaaattgtgctttcataagctacagcagacaagcgcagctgcctgtggaggcctgtggccttctacctgcagctgtttgctcagaaacaaaaaggcggtttcttgaatgagtcagtttccagcttaatttttccctttggcctagtgaatttgggggccctgaaattgtatttttctttcacaatggtattgtggttgtgtaagaaaatgtcttttttggctgggcgcattggctcacacctgtaataccagcactttgggaggtcaaagcaagaggatcacctgaggtcaggagtttgagatcagcctagccaacatgttgaaaccccgcctctactaaaaatacaaaaaattagctgggcatggtagcgggcacctgtaatcccaggtacttgggaggctgaggcaggagaattgcttgaacccgggagacagaagttgcagtgagctgagatcgcgccactgcactccagcctgggcgacaagagcgaaactccgcctcaaaaaataaataaacaaaagtctttttaaaaaagtttaacctggccaggcatggtggctcacacctgtaatcccagcactttgggaggccgaggcgagcggatcacgaggtcaggagttcaagaccaaccagcctggccaacatggtgaaaccctgtctgtactaataatagaaaaattagctgggcatggtggcacaggcctgtagtcccagctactcaggaggcggaggcaggagaattgatcgtaccggggaggcagaggttgcagtgagtcaagatcacatgccactgcactccagcctaggtgacggagggagactcagtctcaaaaaaaaaaaaaaggaaagaagtttaacgtgtttttagggtcaaaatgtctcaacatctgggatttgttttaaaattctttcagaaactcaaaaaggccaggtgcgctggctcatgcctgtaatcccagcactttgggaggccaaggcgggcggatcacttgaggtcaggagtctgagaccagcctggccaacatggcgaaatcccgtctctactaaaaataattagccgggcgtggtggtgggcgcctgtaacccaagctactcgggaggctgaggcaagagaatcgcttgaacctaggaggtagacgttacagtgagccaagattgcgccactgcactccagcctaggcgacagagtaagagactctgtctcaaattaaaaaaaaaaaaaggatgaacagtgctaacacctggtcagcccaggcagcaggcccgggggctcagtgtcctgcttcccagctcgggctccaggtgtgtgaactgttccaggcaagcctgcctgcttcgggacagcacctctacctctggctgggagctctgcctggccctcaacttgcatccagaaggcgaagcatggggaaccatgaggccacagtcgagggccaagtgtttggggtggtggcaggggttgtggcctcctggggaccctcccagtccccagtgaccctcagcaccaggctggccaggcccacgggcgaggaggaaaatgcacggcccgtgctcctcgcagccgcacccagtgtgagcacggctgagcagctctgcgggagtggtggccccgtggtcacagggacaggatcacaaaccaggatcttccaacaggctgggatctgaccacttccccggccctcacccccagcaccccctccagctgcgcatgcacatacgtgtaggtgcacacacacgtgcacaccctcctacaccacccagccagtccccacagcaggcagccaggatggaggcagcacctttccgcctgtgtctcaccgtgggactgggcttaggctgacttggtacagccagtccccaggacgggctgggcctctggccagggtcgggaggcagaggcaccgccccaactgagctctcagagctgggtagtgccccttcttgttctcctgcccctcagtgggtggctggtcctgctgggtgcctgggtccagcacagctgtcacaggccaggccaccagccaaggtgggaagaacagggtgaagacggcagagcccctgggagagcttcctgggacccgatcttcagcttgtgggcagcacgcaccccacctggctcttgccctgcaggctgcccagctttatcactggtggggtcattggtggggcagcccctcctggggcccagcaccacagtgccctctgtccccaggcctgcccagctctttgtagggtcctggaacgccccttctctgaccccagcgggaaatgaacccacctgtaatgaaagtcctgtctgtcaaccaaatgcagcccatgggcctggctgtgctctgcatcagctccagtaagaggatcaccgggcagcctggagggcaggttcgcctggcatgccagatttctccgcagcttgcgatggaggcacttgcagggaggcacatgtgtgagtgcaggacagaggagctttcatcaggcagaggctgcgtgttcataacatcccgtccaggttgctttgttttgaatctgaggtggttttcgactccactctgggcgtccacccaagaggtgcctgtggacacccacccgctcccccaactccatgcaacttgccaaccttcaagtagatcggtgtaactaccccccagtccgatggtgtgcaggaatgtgggggcagcaaggtcacagggcctcgggccaacccagggatgggggtagtttatacatttggggctttttcacaaaaagatgagggtgctgaagggtccctgaaggccccagaggtggcagggccgggccaggccaggcagtgagcccgagcctggcgtctacaggccgacgggaaccactgcacagtggctgtggccaacaggctgctcagagcctatcatttttagggcctttcctggaccttccactccagctcgctgtaggttttccaagcctcttgttctggcattgaccaaattgtcacccaagaagcaggccctcagtgcacctccagttcatccagctggttccgacagcttcaggaacagtccatggagctgctcccagcttcctctgcaaggcccctgccgggctcctctgcgcagtgcagaggctcattcaggcccagcgtggaaggcaagggggacggatctgagaaggcggggcttatctcccaggggcacagcagagtgagggatgggccgatgaagtgtacgcctgcaaggggcagcaagcagccccaagagcttaaactgtccagctgcagcaagtctgctggagcgaccaagcaacatgtgtcacctcaactgagggctgcacttggcagtcacatcttcccagacgggcgatcgccactcctgagaatactgcaaaggctcatcactgagaaagggaggttaccctcgaaccctcaggcatccacacatcacaactcccctccctgcttggctccactacaaaccctgagcaggcactgaggacacagccacctccacacagggcatgagaaggaacagcggccttcctgtgagtaaatgcagcaacccagcacacacagcactgccacatggaaagcttggttcaggtcacagcaaaatcccagtttaaggacacggctcgctggttgcagatagaaacttctagcaacccagaaaccaactgtgagagtttatgatgagggacgtgatcccaccactctgtctttaggtagacaccaaggcaacacatcaagtgtccacacctcagacacccacccaccccagcccggccctttccggtggctccgccagcctgctcacccggctacctggactccacagggtgagcacaatgtccacacttgttccgcagtttgctgctgcgtcctccttccatcactgccgggcccacttcactaaggagtgaacctgggagaaggcgcctggcccagatgtggcccagcagggatccaggcccagatggctgggctcagccctgtggagaccaccccctcccaccccgccccgcccccgaggaaatcctgcgcaggcatctgtgggcggagcaggtagcgttctccaaggtgcgctgtcacccctgaaaggaagatcggttccctgggaggagtctgctatcttcatactggttccatgtcttcaaataaacgtgcattactttataaccctagaaaccgaacttctgaggtagaaggggctccgaagctgtgtgcaaggcatgctgcacgtgaggggtacccaccacacgtcaggaaacgcccctgggaaactgtcaactaacatgcccgctcccctcagtttggccagaagcaaaccgcagagaacagtgccaagtttagatgactggaatttgtatttctgtttctgaataaacattttgtaaacaaaattattaaacacttggaaaatttcttcccaattaaagtcaatttgtacctacagacttaaaaataccacatacatggccaggtgcggtggctcacgcctatattcccagcactttgggaggccgaggcaggtggatcacctgaggttgggagttcgagaccagtctcatcaacatggtgaaaccccatctctactaaaaatataaaaattagccgggcgtggtggcacatgcctgtaatcccagctacttgggaggctgaggcaggagaatcgcttgaacctgggaggcagaggttgcagtgagccaaggtcacgccattgcactccagcctgggcaacaaaagttaaatcctgtcaaaaaaccaagaatgccaggcgcggtggctcacgcctgtaatcctagcattttgggaggctgaggcaggtgaatcatgaggtcaggagttcgagaccatcctggcaacacggtgaaaccctgtctctactaaaaatacaccaaattagctgggcgtagtggtgggtgcctgtaatcccagctacttgggaggctgaagcaggagaatcgcttgaacctgggaggcagaggttgcggtgagccaagatcgcgccactgcactccagcctgggagacagagcgagactccatcaaaaaaaaagaaaaaaaaaaaacaaaaaaaaacaaagccacacacacggactaaacttgcagagaaatgatgcttggaaaacagctgattactcagccactgcgcaccacggtggaaacaagcaggctttggtgtacggtgtcacaggtgaacacggcgagtccagggaatgagactccggctacacttctaagtcacagcagctgttctctcctgtctgtggtccttccacagacccagtctgttttccgaccaagcacccctaaagcgctcaaaagtcacattctctgagcagtttataattttgaaggctaccaaaacaggcactacaactactactaatgctgaacaaatgatgtttctaaaagataaaaatgctatacagaaacaaaatagtgctttagatttattcctataaaacacataccctttaaactagggtccatgaggattaactttcgacatcgggggctgtcagaggtcgtggacacccccaactccagccgggcgctgaacaatgtaaaaagaatttgctctgcaaccctgtgggggggggaaataaaagtaacccagcgtccatttaatgcagccaagtgcaattcctttccccaccttagaaagcaccaccagataatacagcagaactgatcctgcagaaaggttgctggagggtcaggccgtggtcgtaactaacaccacattcccattttgtttgctggataattttttaataaagtgaggtttacatcactgatatttaagaatggctatatgcacaaaagaaaacacacctttttggttaaggggtgaggaagttagagaaagcatgagaaacagggagcatgtggggtgaggcggggcaggagtggaaggctgcaggcacccccagctcactccctgcctgcggcagcacccatgacactacagatcaaggggttatgaatgacatggattcagatttctttcattctagacttcaacctagccttaaccttttgtttcagcaccagtctaacagagcagcgcaggcgtttctcatccagcagcaatgctacttcctcacccagggcaggtgcatgggctgaccctgatgggagcctccaggaacactgccttgagaaggcaccaccgaggggctatgaggtccctgaagaccaactggtgcctgtgatctacaaacagacaaatatttgacctttgtcttcaatgacatttacatataaatagacataaataaaatcctccataatttactcttaggtctaggaagatgtggctgtgtgcggctcctgattttcacccaggtctcactgcagcgcaggacataatgaagaagtatcacacacacatttaaagtaaaacatgatacattcacactgttgactgagactgtagtgatgctcactgcaaaaaacaaaacaaaacaaaaaacccttatttaaaccttaaaaaaatgaaacacaccaactgcaattgtttaggctataaaagttctaatgtagcagcaaaggatgtttatagaaaaaatatacttttaagaaaatagctgaaaaaatctaaagagataaggtataaaaagtttaaaaaatatatcttaagacaaaatactgcccaaaacatgtaaaactgaattgtaaaaattcacctatctaaaggtaaaaggaggttgatgcagctgcggctcaccgtcctctacagtgggggacacaaagagacacgaggggcccagggctgtggggacgtcagaagacaagaagccttccagaacagcctctgcctggcgctccacaggggggaggtgagtgggacgggcctagggctgcagccccactggtaatgggctgttctgggatttctcagaatcagcagacagggcagcaaggctgggccgctggcggcaggcgcaccctccgtgggagccagtgctcacgtgtcaatgcgtcagaggcggctgtgagcactcagggctcctgctcaggtctccaccaggatctccaccacgtggtccagctcgcccaggtcggacttgcagctggagctagggcctggggtggccggagccaagccctcgagcccttcgcaggggcccggcctggcaccccccatcatgcctgtcagtactgtgtccaggtcgtagtaggggctgtccacgtctgagaacagctcttccatgcagctggggtttttagtctccagcgtttcaaatatctgatcaagtgacttgtgaaagcttcctctgttttctcgagggccatccatctcccaggcgctgctctgcaggtgccttggtgcctgtgctgaggtgactgggcaaaggtcagaaactggaccctgtgtgtggccgtcccccaagccaggagcaggatgtgccccctcttgcccccacgctgcacggcacaggatctccgtggagaccaagcggtcgagcggcgcccgctctgcagcctggggtgccactgtgcgccacgtcccatcctgcgtcatctcctcttggatctgccggaccgtgttggcaatgaggactgagcggcacaggttgggctccacaagcatgtggcaaagctgcaacttcaccagagacatgtccaggagcgactgccgctgcaggctgtatgaggacactgtcttcaagccggccagggctccctccacgtcttcctcgtggccaacacatttcctcttcagtcctcgtgcaaacattgtgtcctgcagaaaccaaggaagacaccacttagcacacggcagactctctgcggacagcgccccttggatttcgtctgactgccctcactgtacgcaaggagcagcgactccgtaactggcagggacttgacagagctgtaactccctaacagagctgagacgtggagcccagtgggagacccccacccccagatcagctgccatcctgcctaagccaggcacagtcacgttgttagaaacgacaaacctctcaactgtaccacgacagtgttttatagcaaaaaagataaatgaactaaaaataggagaaatatataagagaaatgtaagtgttcgagagcttggctgaaaatctgtttcaaaaatctaactgtggtgtgtacaaaagaagagaccctggggtaacatgagattaatgtgaaccgtgccagcctgcagagggcgcagggcgggggccggacagggccgggcacacacacgtaccattctgacttccctcaggatcctgcctcggacaaagtcacttctgcgttcagaagagttagtgccttccccctcaatgctttcactaaaagcctctatatgtcgcagacagccgggctggaaagctgtgccaccaggaacgcgcaggggaaggactgcagggctgtatgctcatcccatgcagcgagtggtctgtgtttcgtgcacaattctccaagggacacagggtctcctggccgagcctatgtggccctggacagtcccttgctcccacacccgcccatgctgcctgccttagggatcacacccattccttggctccccccacccgccccaccagttcatttctcccaaggtgcacaggctctgcctggctgctttctacttgacatctctcaggtcaatgccctccactcgagagctctgaccagcccgtacaaccatggcctcaggggccacctcccctctcatctcaactcctttctcttcaaaggaaccaaaacatggcagggtatgtgtgtgtccggggcagggggggtgggttcctcaccagtgtgttgtggcagcccagagctggccaaggcagtgtttctcggcgtatgcctcagcactggcgctgttggttgaagatgcagattcctggatcttaccccagacctgggcaactccgggatggcacctaaggctcagccttgctgggcaggttccactaagacgcacagcacagatgcactagatggacattggccatgtctactctcagaagtacaagtctgtgcaaactgtttttttttttttttaactgattctaaattgggacatctctggggcactaaaggcagagcagacaggagggtgggctctggcttttgacagatgccattctgagccagtgccgcctgcggggagctgggaggatgacagctggctcagggccatactggccggcagagtctgacaggacaagcatctcacgcatgattaagtttctctcttctcatgcttgtaatgtagtgaaatattatttcaaataattcaagttatgcataaatagggttacaatcttttgaatatgcaaactttggaacttctttttctcttagtcaatctgatggctccctgtgaccagggtatacccaggtgctcttggaaagctggcgtatgggaggcacatgctgtctctgctcggggtctggagaccaaggatgggaagttttgcagtgcgggagaactggctgccaaacataccccttcccaggagcccctctggaggctcccacctgctggtcctacccttgaattaacagaagaaagggtccccctgttctctgaatttcccttcagtgtcacagatctcatccccgtgcctttaacacatgtaaattttaaaaaactaagtgacctcttgggcatttatcccagagaaaaagccaatgttcatgcaaaaaacatgttccagaatgtgcacagcagctttatttgtagtagctccaaatctgaaacaaggaaaatgtacccttcacctgggcacggtgacacacactctgctccattcatgccaccaaatcctactctgcaatagaaagaaatgaactgttgatacacaggacggatccttccacaggggcattaggctgagggagaaaagccaacctcagaagggtgcttgctatgggatcccatttatgccacattgtcatgctgacccagagctgaggggtggcagggctagaaaggaacctgcgcagggagatcttgggggtgagggcccttctgctcctgggctgtgggggtggccctaccctgactgcacagcgccggacacgcacacatgcgcctgcggcagccgtgtcatcacacggacctggggcctggctgtgcatcctacaaggatgccggccctggggagcagaggaagggcacataggacctcctgaacactgctctgcaacctcccctggctctacaattatttcaaaattaaaattaaaggaaaacttccctaaccctagcttatttcccctacagcacccatttccccagagcagcatgccagtgtcaccacaggcacagccctcaggctgggcaccgcctctcacacctgcatacaccagcttctcaactaattctaaatgaaggacagtttaccaccaaaacacatttacacatttctattacttttggtaaatattcgagttctttgtgtcagccacaaatttaacttttcagagcttttccatcccaatccattgtttaaatcactggcttaaaattgctaagtatatcgagaattaacataaggctatgtcaaactacaaaggacaccctgcgttggggaaaagattaagtcccacgggttcctctgtgggaagtcaatataccttttaggtttttagtttctctttcaacctatctcaatcccaagcctgcatagcaatggattaatttaggacccaaaccaaatcctcttgaacagcatgcattaagcccaagtttatagacagaagaacccctggctgcctcccctgactctggaaacccagcagcacaacccccataatgtggggcctacaggaggtcagcacgactgagcagggcaatcagggcaactcacagaaggaacaagaataccaatgggacaggccaagaagacccacaaccacactgggaaccagttcaagaagctgtcccaagctcctaggaccctctgggtcccactttcctttcctctgagtccttagaaatgccaggtcctgagtccaaacccaacgacagaccctcccgcccttttctgaaagccagatatggatactagaagcctcccactggggatcttaagaggatgaattcagtgcttggcctggtgctgtcagcggtcctaagggcagcactagcaatacgtgaccgtcagaaatcaccctaataacatctgctctgagcgagggaatataccaacaaacaatggcggaaccacatacagaaacagaactctcagccattatctgccgccatcagtcggaaaccagccctttaccttcagtaacgggccaggaagccaggttgccctagtcagacctgcaggaagcctggctgctttctctaggaacaatccaggaagctaaacaatcatttccatagcaagcagcccaaaatggccaggacatgattagtaaccgacaacctctccagtttttgtccctgcttccaatttaggaccaaccagagaaagccaaacatgttctaggccatctcacaggagccccacttctttgttgttgttgttgtgtcgcccaggctggagtgcagtggcgcaatctcagctcaccgcaacctccgcctcccaggttcaagggattctcctgcctcagcctcccgagtagctgggattacaagggtgtaccaccaggcctggctaatttttatattttcagtagagacttaccatgttggtcaggctggtctcaaaactcctgacctcgggtgatccactcaccttggcctcccaaagtgctgggactacaggcgtcagccaccgtgccaggccaggagccccacttctaactggccaccccagtcccccaagtcagcagcctccatcagccatccctgagcttccctggattccactgtaaagctctcctgttccctcacctgcctatgagtttctgccaatcacgagagaggagggccgcacccttgctaggggaagctctggataaacagcctctgcctgttctcacctggttgcttatttccacagctcaccatagacaatctggaagagcatcaaaaaccataaaacgaattttctcccaggatcccatccactcagaaaaacacagtcaccacctgggttcctcctttccagtcgtttctcccagcactttcctctctgcacaagggagggaagtttcacactactgacaattttcccaatcacaaatgataccagtttctaactttaggtgttttggtatttctagcatttggcttccttagcctcggctctttacttactagggtgatgtgcaggtacatttttaagaggcttgataaacattattaaactgcatcctaagaaggtggaacgctccaccaactttctcccgcactatttctgcacacttgctggtaaagcttcctcttgttttgccaagtctctaagccccacagctaagcgttccttccctcctccactgagctccacgtctgtgttcctaccctgttccacggctgctctcctgccaggaccagacaccctggcctccctgtgtaggtccttttctggccatgccacccttcagctctgggtcagcccaacaatgtggcataaatgggatcccacagcaagcacccttctgaggttggcttttctccttcagcataattctcttgagatccttgcaaactcttgtgtgtcaacagttcccaacagagtaggatctggaggcacagacggagcagagtgtcaccacaccccagctgaagggaactttttccttgtttccagtttggagttattacacataaagctgctatggacattctagaacatgtttttgcatgaacattggtttttcatttctcttggataaatgccaaagaaataatcgttttataaaatttaggagtgttaaatgcacaggcaatgagatctatcacaccgaaaagaaattcagagaacagggggaaccttttttctgtctattcaaggacaggaccagcaggtgtgagcctccagagaggctcctggggaggtggggggcggtccttggcctagtttcatcactctcagttgtaagcattctttttttttttagatggagtctcactgtcgcccaggctggagtgcagtggtgcaatctcggctcactgcaacctccacctcctaggttcaagcgattctcctgcctcatcttccctcaacttcccgagtagctgggattataggcgtgcaccaccacgcccagctagttttttgtatttttaatagagccggggtttcgccatgttggccaggctggtctcgaactcctgacatcaagtgatttgcccacctcggcctcccaaagtgctaggattacaggagtgagccatcacacccagccacaagcattcttttaggacttaaacagcccgggcacagtggctcatgcctgtaatcccagcactttgggaggctgaggcaggcggatcaccaggtcaggagattgagaccatcctggccaacacgatgaaaccccatctctactaaaaatacaaaagattagtcaggtgtggtggcacgtgcctgtagtcccagctactcgggaggctgaggcaggagaattgcttgaacctggaaggcggaggttgcagtgagcagagattgcaccactgcactacagcctgaacaacagagcgagactccgtctcaaaaaaaaaacacacacacacaaaaaaaacacttaaaacaagttgaatgtatacgatctggtgtattctgacaaaggaatgcaactcagcaacatacctcaatgatttatgcaacacggataaatttcaaaacattatgctgaataaaagcagcaagacacacacaaaaatatgtaccgtaggattctattgatctgaaccttcaggacaggcaaagctaatctaagttgtgaaaacacagaagggtagccaccatcagggtgggaaatgctacaaggggccagaaagaatcctccaggatgatggagattctctctcgccccttgtaggacttgtgtaacccagggacctgcatagatgtgcctgggttacacaagttctacaagggacgagagataatccccatcatcctccactgcatctcatcccatgcacagatcccattctggtaccaggagaatatccctgttcagtcacttcaaatcattcctctccaatgttccaaatctccagcagctgttaattctgtgttgtacccaatattttaaaatgctgacaagtttattactattaatacaaaaaagagtaaagctcacaggtgctttttacagtcacgtgaccccaaagagctgtcacccagaacatgtgttcaggagtgaagaggataaggttgggcccggagaagctggcctgtgaggatcaccctgaattgggttatatctgtgtttgggacaaagtcagcaagagcatggtcttaaccagccccgagggatgcctgggctgggcccagctccctgagggcctcctgtgtgacttctgcctgaggctgcttaactccttctaatatggaatgagaaagggccctataccataccggtggggctgtggagcctagctccctgctcaatttttttttttttttttaagacagagtctcattctgtcccccaggctggagtgcagtgatgcaatctcagctcactgcaacctccacctcccaggttcaagcgattctcctacctcagcctcccgagtagctaggactacaggcacgcgccaccacacccggctaatttttgtattttttgtagagacggggtttcaccatgttggccaggctgatctcgaactcctgaactcaggcaatccgcccatctcggcctcccaaagtgctggattacaggcgtgagccaccatgcctggccccctgctcagttttgaagctctttctacacatctagttaaatgcctaaaatcccaccaactccacaggttgttaccgggacagccaagccctcagtcaactcccagcactgccctcaggcttctaaaccaagcaccgaccagacagagaaaaacgaagagggccagacggactgaggacatgtccgacatggcaggtggaacagccaacaggccactagggacagagcaacctaggcccaccgaggcagaggccagcagggagcagccccgcagtgctgctcaggcaagcagagtacagctcggggactggtccttcactacagcagcagtggccacaccttcgtggctgagcaataccacgaggctggctgaaaacgcagattcccagattctgatcagtagggctgggacggttggggacagactcaactctgacctaacctgtcaccttcacagctggacttgcagccacttcaaagtttcgggtttttaagcaaatcatcaacaatttccattcctcacacatcagataagctttgaaatactttatcggaaaaacagggagaagaggagcaaggtctgcagtcttgagtactgagtgggagctccaccttccactacaagtctcctggaggctgttcatgaacaattactgttatgttaatttcaggtatttggttttttttgttttttgagacggagtctcgctctgtcgcccaggctggagtgcaatggcacgatctcggctgagacctctgcctttctggttcaagcgattctcctgcctcagcctcccacatagctaggattatgattacaggcatgcgccatcacgcccagctaatttttgtatttttagtacagacggggtttcaccacgttggccagctagtctcgaactcgggacctcaggagatccacccgcctaggcctcctctcaaagtgctgggaggtgtgagctaccgcgcccagccaattgcaggtacttttgttacttggaacgaaacacactccttcttttccctgaaaacatgttccagtggcaagttgagggaaacttcctagccccttttccaagatacagcctactactcttcctagaaaaggggtgtaactcactttgtattctggatttccaccctaattataaaacacggtgacacttgaaaatagagtggttgtacgtagaaagttgataaaacgtaagttttgtgaacaggcaatgtttttctgtggctcgctttgagagaacggttatctgggtcccgccgtcccgtgcgtcccacacgaaggccacaggagaagcgaggcagcggagaccctctattccagcaagctgtcggagcctttgccacgacgatcctgtttgcggggcgagaagcgtctgaagacgcggagggaggcttgcgtctgacttctgcaagtgtctcggggactttccctagtcccacctcgcaccgccggaggagcccagggaagacggcgctggccgacccgcccggggtctgggcctcctcccacatccgcggccctctccgcggccgggctccgacagagggggctgcggcgcgcctggcgttccctccgctgcaactagagccgaggtacgggaaacgccgctgcgtaccccagccgggccctcgtgaagcggctcccgcgtggggccgcccgcaggcctcggcaaagccccagctccgcgctccgcaaggaacgcagacggcggcccgggcccctctgttccccgggccccctcagcagcggccaccccgcgggggaaccagcgcccaggagggcggcgagggcgccgcggcagccccagcggtggtcccgggcgccgcctccgccccggacccagcgccaggagccacagactccgcgcaccgcccccaggctcctccgcgccctgcagcacaaaagtgcacgccgccgtagacgccctagcggtccgccgggcccgctcacctgacccgcgaggccgcccgccgggtcctctgctcagccaccgccaccgccgctgccgccagcttcccgccgctgaggaaggagcgcccgacggcgcggggcggggcgagcgaccgccactcggcgtccacaaagggtcgacgctgcgctctccgcgcgctacgcccgctgattggccactcgcgggccgggggcggggcctcttgttcaaacccacgcgggcggggcatctgtggcgcgtcttcccgcgctgcggcgacggccgttggggctcgcgcgcgccctcggttgccccgcccccgcccctgcgcccggccccgccacgcccacgccccgccggctcccaggtctccccgcgcccagtccggccccgccccgccagctcccaggtctccgcgcgtctggccctgaactgaacgcgcctgcgcctggggcccacgtggggccctcgggcgggcgtggcggggcaaacagaggtttggactctctcgcttctgcctggctcaacttctccgccgaggcatccgtgccggggtcgggaggagccgggcacggcaattcccgggcggtctgggctccgaggtctatccaagcctctccagagaccggggttatctccaaaggcttcctaggtttacacgtaagaaatgtaacgtgaaagttcaaagcaggggacacgtgttttaaatctcttagtggaaaaggttttaaataggatgcgagaacctgcaatcattgacttaagtaataccctgagcgcctgcagcaggcccggcaggcgtggctgcagctgagagccaagtgctggaagttgggggggaatcctcagatcaatccgcaggtgcggatgcgccaaggtcggtggtaaatgctgaaatgctgtcgggaaacctgggagtgacgtgggggcgctgctcacataggtctctaggataaggagcgtcttaaagcaccaaaaggaagagtggacgagaattcaggagaggaatggctggggcaaagcccgaggcaggggcaggaggcaggagcacgtctcagtgcagtgagaaagaaccctgtgatctcgtgggaaagttttaagtgtgaggggtggagggacttttgggctattctgggagtgggatggagactactggcatggtcagcagagaaggaactggaatctgaattgtgcttgaaaagaatcactgttcttatttaaaaaaaaaaaaaagggggtctctttcgcccaggctggacaacagtggcgtgattatggctcactgtatcctcgaactcttgtgctcgagtgattctcacgcctcagcctcccaagtagctgggactacagaagtgtgccactacaccaagctaactttttttttttttttggtaattttgtagagacagggtattgtcttgttacacaggctggtctccaactcctggccttaagtgatcctcctaccttggcctcccaaagttctgggattacaggcatgaggcaccacaaccaccaagaatcactgttggtaatagatttggaggaggtggcaggaaggctggaagtagaaaatcccattaggttactgcccaggtaaaagaaaatgggacttgataaaggtgactacctgagaatttaaagtttatgcatgtcaaagtgaaaagacaaatggggaaaaaagtttttcctggctgtatcccacataaaggttaaattccttaatatacagatattctgcaaatgcaaatgaaatctagatcaccaaagaaaagtggtttggaaatagtggcacccacctgtaatcccagctactcaggaggctggggtgagagaatcccttgagcccaggagttggaggctgcagtgaactatgattgcaccactgcactccagcctgggcagcagagtgagaccccatctcttaaaaaaagaaaagaaaagtgggcgtagaatataaacacagttcagagcaaagaaaatacaaatgctcctatacaggcgaatagatgctcagccccaatcagaacaagagcagtggaaattaaagctatgctggagtgctgtttgccacgggtcaaattggcaaagatctaaaataatgtctggagtaagataatatcttccagagcatattagtctattctcatgctgctaataaagacatacccgagactgggtaatttataaagaaaaagaggtttaatggactcgcaatcatggcaggagacaaaggaaaagcgaagggacgtcttacacggcggcaggcaagagagcgtgtgcagggagctcccctttataaaaccgtcagatctcaggaaatgtattcactatccggagaacagaacaggaaagcctgccccatgattcagttacctcctgccgggtccctcccacgacatgggaattataggagctacaattcaagatgagatttggtgtgatattttgacatgtatatacaaagtataatgatccatcaaggtagttagcatatccatcacctcaaacatcatttcttttgtgttgggaacattcaaaatcctctcctctacctattagaaaatatgcagtaagttactgttaactgtagtcataaaatattaacaggcttgctaggacataggaccagaaaaaacatagaagtctatggttacaccaagattggagtcatatttttcagtaactaatgtattcaggaaaattgatgacaaggagaactagaatccgttaaaaaaaagactcaaattgaagaaagagcatcagtcttacacagagtcttccaaatgataaaggggaactcttcttaccaatttgttctacagggctaacaaatttgatactaaaactcgaaagggacatgatgggagaaaacacacatggtattctctctcatgaacattgtttaaaattccaaaccacatattagcaaatcagatccaatgataatgtaaaaaaggtaactcatcacaaccaagttgggtgtactccaggaactggagtacagttgatttcacattgcaaggtcaacatgattcatgacaatagaatgaaggagaaaaaaagtatgaaaatctcagtgtagaagcatctagtaaaattcaacaccccttcatggtataatctttagcaaactaaatatacaagtacaaagttagggacagccccaagaccaccctcaagtttgaaattcattagaaggactcagagaattccctagaagctattgtactcgtggttatggttcattaccatgaaaaggctcattaaaattaaccaagagaagaggtgcatggggcagcggccaggagaggccatgcggagactccagttgttctcttagtggagtcatagtggtattgctggtgaaaatgtgtcactgggcctgagtccagagttcatttacttcccaaatgaatatatacatttattctattgccaggcaaaatcccaggatatttttgaaacctcacaaaatgctattaaaaatctagagaaatggccgggcacagtggctcatgcctgtaatcccagcactttgggaggctgaggtgggcgggttacctgagttcaggagttcgagaccagcctggccaacatggtgaaaccccgtctctactaaaaatacaaaaattagccaggcgtggtggcatgtacccgtaatcccgctactcgggaggctgaggcaggagaattgctggaacacaggaggcggaggttgcagtgagctgagattgcaccactgcattccagcctgggcgacagagtgagactctgtctcaaaaaataaataaataaacataaaaaataaaataaaaatctagagaaatacatgtggaaggctaccctatagataaagtaagaaaaaagaaaagtattaaggaggacacccacctctatatcagttaccttttgctgtgtgacacactttcccaaacttagtagattcaaaaggcagccttttgtttgctggcatttctgcggttggcatttcggctggggtcacagcatcctgtgtctcatgaggcatcagctgagctcactcaagtgtttgggtcttggcagagatgactgactcatctctgctctgtcatcctccggaaggccagcccaggcaggcaccaatacaggggctctttttatacttccctctgctctgctcatatgtgccaatgtccaggtggccaaaccacatgtggccaagcctagggccagtgtggacacgagaagacaattccctggaggacattattattgttactattattttgagacagaatctcactctgtcgcccaggctggagtgcaatggtgtgatgctctcaactcactgcaacctctgcctcctgagttcaagcgattctcctgcctcagcctccctagtagctgggattacaggcgcccaccaccatacctggctaatttttgtatttttagtagagacaaggtttcaccatgttggcgaggctggtctcgaactcctgacgtcaagtgatctgcccgccttagcctcccaaagtgctgggattacaggcttgagccactgcacccagcctattatcgttattgttttgagacaaggtcttgctctgtggcccaggctgaagtgcagtggtgctcactgcagccttgacctcccccagctgaagtgattctctcgcctcagcctcccaagtagcttgggctactggcacacaccaccacacctaaccaaacattactgtagtctactaattcttaccacatacttgaacatactgtaagtaaacttaaatatatacttagtaatgacagatattggtgtatactgtagtaaaattaaacaaatatatacagatgcttctccacttaggatgaaattatgtctcaaaaaccctattgtaatttgaaaatatcaaaaataagttgagaatgcatttaatacatctaacctaccaaacatgccttaagcctagcccatcttacacatctcaaaacacttagcttaatctacagttgagtaaaaccatcttaactcaaagcctattttataataaaatactgactatgtcatggaatttactgaatactttcacttttttcaccatcactgaaagtgaaaaacagaatggccggctgggtacttggaagtacggttcctactgaatgcgtattgcttttgcaccactgtaaagtcaaaaaatcgttaagtcaagcaatcataagtcagagaccatctgtatctacaagaatccacaggaaatactaaaatgaatagcgaaatggtgaaaatggtaaagctttctcctattacttcctcatctcctgactcatctccgctctgactaatttctacccaacgttgtactctaggacctagctattgtaagaaggcaagaaaaagaaagaaaaggtatgaagatttgaaaatgaactaaaattatcattaatttcagaaagttggaatttgaacgtagaaaatccaaaggatgctgggcgcggtggctcacacctctgatcccagcactttgagagaccaaggcaggaggctcacttgaggccaggggtttgacaccagaccaggcaacatagtgagaccttgtctctacaaaaaaattttaaaaattagccacatgagccgggcgcagtggctcacggctgttatcccagcactttgggaggccaaggcaagcggatcatgaggtcaggaattcaagaccagcctggccaatatggtgaaaccccatatctactaaaaatacaaaaattagccgggtgtggtggcacgcaactgtagtcccagctacttgggaggctaaggcagaagaatcgcttgaaacaaggaggtggaggttgcagtgagtggagattgtgccactgcactctagcctgggtgacagagcaagactctgtctcaaaaaaagaaaaataaaataaaaataataaaattagtcaggtgtagtgatgcacacctgtagtcccagttactcaggaggctgaagcaagaagattgcttaagcctgggaagttgagactagagtgagccatgattgtaccactgtcactctgggtgacagagcaagactgtcaagaaagagtctcagaagagagaaaggaagggagggaggaaggaggaagggaggcagggagggatggaggaaggaaggagagaaggaaggaggaagaaaggaagggagggagggaatccccagataaattgttcaaattaataaaaagttaatgtgtaaacaaattgtatactaacctaagaggatggatgggtttgtaataagcagctgagtctcagccaatcatagcagctgaatgtccaccagtcagaggctgaaggctgccaaaacatgaccaaacaaggcaaacaccaaatgtaaccaatcaggttatttctgtatgtcatttcctcttctctggctataaatatagcttgcagaaattgctgggtgatgcattctaaaccattttcagtctggactgtttcccaggtacacgaatgttttctctgcttacttaaactcagttatatttaacttgtcttggatttttattttttaatatagccaatacaggaaaatcaattctatttgtatatataagaaaccattggccgggcgtggtggctcatgcctgtaatcccagcactttgcgagtctgaggcaggcggatcatgaggtcaggagttccagaccagactggccaacatggtgaaatcccgtctttactaaaaatacaaaaaatcaggtgggcatggtgttgggagcttgtaatcccagctacttgggaggctgaggcaggaaaatcgcttaaacccaggaggcagaggttgcagtgagccaagaccacgccattgcactccagcctgggcgacagtgtgagactccatcccaaaaaaaaaaaaaaagccagaaaccattataaaatacttttttaatgatgtcatttgcaaaccactgaaaacatcagcactagggataaatctaacattgaatatgtaagacctctacacagaaaactacacaacattgccaagagaaatctaaataaatggaggaataaaccaggcatatggattggaagacttactcttgtaaagatatcagagacctcgaaatttatcttcagattcaaagcaatctcagtcaaaataccaaccttttatgggaattgacaaactgattctcacatttttatggcaatacaaagtgccaaaaagagccaaaacaaccttgaagaacaagaaagtggtgagctggacaatcactttggagatgtatggcaggatctgccagacctgagcacacaccgagcctatgacttagcactgcttgtcaggatgtgtcccgtagaaaggcatgcatatgttcacaaaaagatttatacaataaaatttatagcagggttactcatagtagcctggtgaaagttgtccgattcaaaacgggatcacttgtgacaatcccctggctacatggagctggggaagggcatgaagggaagtctcccgtgtatgatgtgcgcgattataagaactatcatgagatgtttccaaaccacaggtcactacacaagtcacacaaggacagctagctgcttatacaagaacacttgcctgacacgtggcctcacaagcccaatccaaaactgcgggagcctagccaactcccagactacacgtcctacctagcaactaccaacacttgccagtcagaactcaccagctcagagccaggcacagtggctcatgccagtaatcccagcatcctgagaggctgaagtgggaggatcacttgaggccaggagttcgagaccagcctggacaacatagtgagaccctgtctctataaaaaagaatttaattttaaaactatgaaaaataaaaactcaccagctcttataagacacttccagctccaatatactttctttcaaaataacctgtgtagcctacgctttccctaataaaaccctaaccttttcccttcattctttggacataccagagaccaccatggtctgtctatatgtcccagattgcagtcctacttcttacacccaaatacaaccttttatttaaacttagagattcaactctctgttttttttttttaacttctatttttggggggacagaggctcgctatgtcgcccatggtggagtgcaatggtgcgatctcggctcattgcaacttccacctcctgggttcaagcagttcttctgcctcagcctcctgagtagctggtgttacaggcgtgcgccaccacacccagctaattttttgtatttttagtagagatggggtttcaccatgttgtccaggctggtctcgaattcctgaccttgtgatccacccacctcagcctcccaaagagtgctgggattacaggcgcgagccattccacccagtgaaagctccaacctgaaaacaacccaaatgtccccaagagaatggacactggaggtgggtatgttcaacagtggcacacttgtgagatgagacgagcaaacattgctgcacacaaacaaatggatgggtcccacaagcataacgtttcgggagagaagccaaactcaggagtaatggctgcttccacagatggaaagctcagatgaggcagagggcaccgtgccagagaatggccctcaggcagcacggcagtctcccaggacctggagaccatcactgtcttgatctgaatggtggtgttgaatctgttttgtgtgctccctttcagggcattctgtgttttgacttcaataaataagtacattaagccaggcggggtggctcacacctgtaatcccagcacttcaggaggtcgaggtttgtggatcacgaggtcaagagatcgagaccatcctggccaacatggtaaaaccctgtttgtaccaaaaatacaaaaattacccgggcatggtggcacatgtctgtaatcccagctacttgggaggctgaggcaggagaatcgcttgaacctgggaggtggaggttgcagtaagctgagatagggccagtgcaatccagcctggcgacagacagacactccatctcaaaaaaaaaaaaaaaaaaaaaaagtacattaagtactatgtatcgtacaatgtatctatggctggatccccaggggctatctctgggtggtgccctggtggctggggctcaggccaggctagaaggttccatgtccgtctttttgttcctttggaattacctcccatgcatatgtattacctagtcaaggaaaaaaggcttctgtttaattaaaaaaaaatgcattcagcttttcagcctcgcagctgagccccttcacttgggagcagcctgggtgcatttgtgcacagttcagattccaggcaggacgctgctatggccctacccaccccctcatcactcatcctgactcctggggccaaccctggggctgtgggctgttgggtctgtggtagggtggagaccttaggcccatatgtaccaggaagtccccagagagccagtgaggagatgctcaggacactcctgtcaaggcaggccctcagcctgtgactaagcctcccagccatctttttcttttcctttatgttgtttaatatttttgtcacaaagagccatggtcactggcagagctgtcactatttaaatggtagaaaatgccccttttggggctgggcatggtggctcatgcctgtaatcctgacattttgggaggccaaggtgggaggatcacttgagttcaggagtttgagaccagcctgggtaacatagcgagaccccgtctacaaaaaatcaagaaattagccgggcgtggtgtattggtttgctttcacactgctataaagtactgcccgagactgggtcatttataaaggaaagagatttaattggctcacagttcaacatggctggggaggcctcaggaaacttataatcatggaggccatcaaaggggaagcaagacaccttcataaggtggcagaaagaagtgccgagcaaagggggaagagccctttgcaaaccatcagatctcttgagaacaaatgcactacgtgagagcagcatgggggcaccgccacccccatgactcagttacctccacttggtctctcccttgacacgtggggattatggggagtacaattcaagatgagatttcgttgtggacacaaagcctaactatatcacatggtgtcgcctgcctgtggttccagctactcaagctgaagtgggaggatcgctggagcccagaaggtcgaggctgcagttaagctgagatagtgccactgcactccagtctgggtaacagagccaacagattggctgcaataacagaaactgaaaggaaaataaatctcaggaccccaaaatcactaagccaacgggaaaagtcaagctgggaactccatcagcaaacctgcctcccatcctattcctaaataaaatagctacaaacataaaaaagctatgtccttccctcaaaatttgtccacagaaaattccttgtggacaaaagacacgcagaactcaagagtcctccctctgctccggtgagacaaacgcacagctgatggcttctttgccctattgtttcactaagctggactaaggcgtaagtgactattcctataaattgtgtattcaattaaaggctaatcagaaactcaaaagaatgcaaacttttgtctcttatttacctatcacctagaagcccccttcccgatttgaattgtcccacctttccagaccattgaaacgattctcctgcctcagtcttctgagtagccgggactacaggcacccaccaccatgttcgggtaatttttgtattttcagtagaaatggggtttcaccatgttggccaggctggtctggaactcctgacctcaggtgatccacctgcctcagcctcccaaagtgttgggattacaggtatgagccatgcacccagcctcagatacgttttggtttaccaatttggtaaccaacagaaaggactctgaggccgggcgcggtgggtcacgcctgtaatcccagcactttgggaggccgagacgggcggatcacgaggtcaggggatcgagaccatcctggctaacacagtgaaatcccgtctctattaaaaatacaaaaaaataagccgggcgtggtggcgggcgcctgttgtcccagctactcgggaggctgaggcaggagaatggcgtgaacctgggaggtggcgcttgcagtgagccaagattgcgccactgcactccagcctgggcgacagagcgagactctgtctcacaaaaaaaaaaaaaaaaaaaaagactctgagtggaggtgaccctgaccttcaacaaatctatcagtgattggtaccagcttgagctttctttacggctcaaaccaataggacaatttgctgaagactgggagcttccctccctccagagaatcccagatctcccaaaatttggttgagatctacagtttatttttctgtgcaactgtcagaggcgtgtgaaccagagcaactccaccttgaataggggctgggtaaaatgaggctgaaacctactgggctgcattcccagacggttaaggcattctaagtcacagaatgagactaggaagttggcacaagatacaggtcataaagaccttgctgatttaaaaacaggttgcagtcaagaagccagctaaaacccaccaaaaccaagatgaccacaagagtgacctctggtcatcctcactgctacactcccaccagcaccatgagagtttacaaatgtcatggtaacgtcaggaagttaccctatatggtctaaaaaggggaggcatgaataatacactcttgtttagcatatcatcaaaaagtaaccataaaaacgggccatcagcagccctcaggcctgctctgtctacggagtagccatgcttttattcctttactttcctaacaacatttatttccctttatgtactcgccctgattctttcttgtgcgagatctaagaaccctctcttggggtcttgatcgggacccctttcttgtaacacaactcctttttttggagttttacttgcttccaacaaggaaggcaagttttcctgcttccatgacggtggaaggcagataactcctttccggagttcgagcctgctttcaacagggaaggcaaatttgagttttcccctgcttctagaatggaagatggcagtcttcagcctgagacccattcctaggtaagtagcttaattgggttttcgtcttggctaaagttatgattaacaaccagctggtctcagtttctctttaccattagagtgctcagtaatcatattgttgggatcttttttaaaaaaatgttttccggtctttctcccattagatttgacccactctacctgccttggtcaaatccgaatgagaattccaaattatggggaacaaggactttctgaattacctaaaattcctcacagatgcaaaagagaaaaccaaaacaaaaccatactctcggtttccgcgttcgctccccgtcgcgctctcggtttccgcgttcgctccccgtcaggctctcggtttccgcgttcgctccccgtcaggctctcggtttccgcgttcgctccccgtcaggctctcggtttccgcgttcgctcccggtcgcgctctcggtttccgcgttcgctccccgtcgcgctctcggtttccgcgttcgctcccggtcgcgctctcggtttccatgtttgcttcctgtcttacttttcttccaccctgttcctccttccccttcaccaacttcagtaccaagaaaaaaatctagaggtgtctaatgactcaaatcctgtaaagaactcagaacaatggcaccactcaccccttttggggtgttctgttttcttggtggcgtttcaagagtcatggacaggtccttctgggtctaaggctctggctcctgctacattacctgtattctttggctttgtgggggtaccagagatgaccttgcgctatgagaggatttgagcttggcgtttataatcatggtgggcgagagctacaaagttaggggtggctgaggacagtttataggaagtggtcttggctgggattttttccccctgggaagttgttgtttaggatcctaattctagttcggaggtgcattttaaagggtcttctccattgccttgtatgcacatttgcatgaggaactcaactgttgttttcataggtaaatgagagattgagtttcctcagctccaaaaagaaaggacattttgcttttcccagtggaaaggtgctcctgggtgaatgggggccaagcaggagtgtccggggggttgacccgctgcgatgtgcgacggtcctacaggaaacccccaacaaaattagtttaaaaggttgtccaggaagcgcatgtaagagtggctcactccgcactttgagcccttctggaggtacttagacgtcctgagagagaaattgagacacttagacctccggagagagaaattgagacacgtgagagggcagcaatgactcgtggtgacactgtgaagtcccacccgcaaccagcacagtttgacccatgacacttgctaggccacaggtcacttcctccttttgagaaaaaaatgtgggaaacaaatcatctaagaatgaggaaagccaaggaaagcaacgcctcttgggcccccgtttggttttatgatgcctctgtttgcaagtgtttgtataaaatggaaatatggtctttctgtgcacaattacgtcaaggaaaatgcagcgcctgagggtcggcctgcaactgtcaagttcctaagtgggttttttttgttttttcttttgttttgagacagtctcgctctgtcacccaggctgttgtgctatggcaccatctcggctcaccgcaacctccacctgttggtttcaagtgattctcctaccttagcctcctgagtagctgggattacaggcacccgccaccatgcccaggctaatttttgtattttttagtagaaacggagtttcaccatgttggcaaagctggtcttgaactcctgacttcaggtcatatgcctgccttggcctcccaaagtactgggattacaggcgtgagccgccacagccggccaaagttcctaagttctctatctctctgctgtgttttccctgctttaagtctgctgttacttttctactgagataaaatccactgtttgcatccaaccatttctttttgttattgtttccgcaaaccaatgagtttgtattaatatcgcatggctagagttctaaagtaaaagctataggatttttgagtgtgtatgtgtgtgtttatgtgtatatacctgtattttgttatgtgtttttggccacaggtaccaaattggcttaaagttatagagtactcataaataataaccgaaatgcttttcaagttcatgtgacttaagtaaaatctttaataagctagctttaaaattttggtaaggtgatattagaacagtcttatgaattgtcggcatactttttttttttttttttgagatggagttttgctcttgttgcccaggctggagtgcagtggcgcaatcttggctcacggcaacctccgcctcccgggttcacccaattctcctgcctcagcctcccaagtagctgggattacaggcatgcgccaccacacccagctaattttgtatttttagtagagacagggtttctccatgttggtcaggctggggtctcaaactcccaacctcaggtgatctgcctgccttgacctcccaaagtgctgggattacaggtgtgagtcactgtgcccagccagcatacatttctatttgcatttattgatcaagagatttcattcttatccctgccaaataataaatggtgccaacatttggcataaagctcattaaactataaacccagcccaacacagaatgatcttggcttgggtaagttttcctgcttgtgtaatttttgataaataagacgttaatactgttttaatgaaaacagttaaatattgaattatttagtaaaataaccatatatttaatcttaaggtttctactcacctaaatatctgaaattcacaggctataaaatggttgacagggaaataactttacatgatgactcacagttttcataaataatgcaggtaaactattaatataaaataattaggtgtatgtaatgggatacatacttgtagacaaatgccataatttagaacctaaagtttaatattaagttaaatagcagatatttccttaaataggtatttttcaattaaaaaaactaagaaaacattctttctaaaaaatgtgtgttcttgttaaaagatgaataatttttgtctaatttatttattgttatttttatgattatatatattttttgagactgagtctctctattgcccaggtggagtgcagtgggtggcacgatctcagctcactgcaacctccacctcccgggttcaagtgattctcctgcctttttttttttttttgagacggaatctcactgtgttgcccaggctagagtgcagtggtgtgatcttggctcactacaacctctgcctcttgggttcaagcgattctcctgcctcagcctcctgagtagctgggattacaggcacccgccatcatgcccagctaagttttgtatttttgtagagacagggtttcaccattttggccaggctggtcttgaactcctgacctcaggtgatccacccacctcagcctcccaaagtgctgggattacaggcatgagtcaccgcacccagccaatttttgtgtaatttaaagcttatttaaagattatgtataaaacaaggtaaagggaaccaggaaataaaagagatgtaaagaaagttataaaaggccatggccaggagcggtggcttatgcctgttatcccagcactttgggaggctgaagtgggcagataacctgaggtcaggagtttgagaccagcctggccaacatggtgaaaacctgtctctacaaatatacaaaaattagctaggcatgatggcgggtgcctgtaatcacagctactcgggaggctgaggcaggagaactgcttgaacccgggaggcagaggttgcagtgagctgagatcgtgccactgccctccagcagcttgggcaatagagtgagactccatctcaaaaaaaaaaaaaaaaaaaaaaggctgggcacggtggctcatacctgtaatccagcactttgagaggctgaggtgggcattatcacctgaggtcaggagtttgagaccagcctgaccaacatggtgaaactccgtttctactaaaaatacaaaattagccaggcgtggtggcacatgcctgtaatcctagctatttgggatgctgaggcaggagaattgcttgaacctgggagacaggttgcagtgagctgagatcgcaccattgcactccagcctaggcaacaaggagcaaaattacgtctcaaaaaaaaaaagaaaagaaaaaagaaagaaaaataaagaggcatttttagtattaaaaaaaaagttggctcggtgcagtggcttatgcctgtaatcctttttagcactttgggaggccgaggcaggtggatcacctgaggtcaagagttcaagaccagcctggccaacatggtgaaatgccgtctctacaaaaatataaaaattagccaggcacaatggcacatgcctgtaatcccagctactcaggaggctgaggcaggagaattgcttgaacccaggaggcagaggttgcaatgagtcgagatcatgccactgcactccagcctgtgtgacagagcaagactctgtctcaaaaaaaaaaaaatgcttagagaaaaataattttatatgagaaagaatcttgtttggtgaatttttgtcctagaataaaatgactggttgttcatgaaagagggatgttcaggacaaaccagaaagtccaaacgtcatgaatggtctgtgtaaatcataagaagaggatttatggaaaaaacttttatagttgtcataattaaagggaaattgtttataatggtctttctagagattaggttttgatatttaaaaacttcctaaaaagttggtttgaacaatgaaattttcctaaggtattgctttactcttaataaagttacacaacattattatttttgtatgcaaagttcaacttcattgcacctctctgttttccgctttctctccccttttaataggcctgaaagaataactctgtccttcaactagtgtttaactcttgtaagttttttattcttcagcttctgtttattgtgacctgatgctagaaaatgttttgttttagagttctaaaggacgcgtttccttccaacataacgttctgtgctcttgctttaaattgttctatggatccaaaaattttcgcttatgacccaggaaacactcttcctattgtggaatgagaccaccacttctcctgttgtccttcccagcttctcccccacctccccttttccctagtttataagacaagagaaaagggagaaagcaaaaagttggaaagaaacagaagtaagataaatagctagatgaccttggcgccaccacctggccctcgtggttaaaataataataataataataataataataataataataataataataatgttaacccctgaccaaaactactggtgttatctgtaaattccagacattgtatgagaaagcaatgtaaaactttttgttctgtgagctgatgtatgtagcccccagtcacgttcctcacgcttacttgatctaccatgaccttttcacgtggacctcttagagttgtaagcccttaaaagggctaggaatttctttttccgggagctcggctcttgagacgtgagtctgccgacgctcccagctgaataaaaacctcttccttctttaatccggtgtctgaggagttttgtctgcgacttgtcctgctacactatgtgtaactaattcaagtaccttgtcatcagttctgccttgccggtgatctaaatggactccccgcagggaacagcactcatactgcagaaggtcttttcttttgcctttgggtaactggctttttacactttattgaaataattcctaagttgtgatttgcttagaaaaattgagattaaaatgtttttaaattaaagttattacatctgtgtaattttctgtacgtgcttttaaaatccttatgccattaagttacagggctttgactcctgggtctaaaaaggacaccaagtcctgctaatttttttttttttttttttttttttttttttttgagacagagtctcgctctgtcacccaggctggagtgcagtggtgcgatctcagctcactgcaacctctgcctcctgggttcaagcgattctcctgcctcagcttcccaagtagctgggattacaggtttgcaccaccacgcctggctattttgtatttttagtagagacagggtttcaccatgttggccaggctggtgtggaactcttgaccccaggagttcccaacccacctcggcctcctaaggcgttggaattacaggcatgagccacccccactagccaaagtcctgctaaatcttaaacactgacagcagttaaagcctcatcctcagacccgatagaagatgccagtcaaaataaaccgcgttcctgagacacaggccagaaatcaaaccaaaaccagttaaaacagttcagttcctgaaggcccagggactatcgcggaagaggcgggtgtgtggattgtaaggggtgattttgagagataagttaaccattaatgttgaaggcacactgatgtaagcccagcatatgggcctctgtgtcggattaacaaggttttcttggagtattaacccagtccttaataaaaggttataaaaggcttatggaaattgtattttatactcaacatgattaaaattgtatagattgggctaggtgcagtggctcatgcctgtaatcccagcactttgggaggaccgaggtgggcggatcacttgaggtcaggagttcaagaccagcctggccaacatgatgaaaccccatctctactaaaaatacaaaaaaattagctgggcgtggtggcgtgcaactgtaatcccagctacttaggaggctgaggcaggagaatcgcttgagcctaggagggagaggttgcagtgagccaagatcccaccactgcactccagcctgggtgacagagcgagactccgtctcaaaaaaagaaaagaaaaattgtatagattgtcgtgcacttggtttctcaagtcgcccacctggccctcttccacgtgtgctttccttcccttcattcctgttccaaagttctttaataaacattcacccctgctctgaaacttacctcagtttctccttctgcttatgcccattggtcgaattcttctgaggaggcaagaattgaggttgccacagacctgtacggattcactgccagtaactcagatacctttcaccagtaacatgtcaatggaaagaatcaaactctgtaaaacatttgaagagatttattttgagccaaatatgagtgaccatggcctgtgacacagccgtcaggaggtcctgagaacatgtgcccaaggtggctggggtgcagcttggttttatacaatttagggagacacagacatcaatcaaacacatttaagaaatacataaggccagccgggtgcggtggctcacgcctgtaatcccagcactttgggaggccgaggtgggcagatcacaaggtcaggagatcgagaccatcctggctaacacggtgaaaccctgtctctactaaaaatacaaaaattagccgggcatggtggcgggcgcctgtaatcccagctactcgggaggctgaggtaggagaatcgcttgaaccaggaagtcggaggttgcagtgagccgagaccgtgccactgcactccagcctgggcaacagagcgagactccatctcaaaaaagaaagaaagaaagaaatacataaggccgcgcacggtggctcacgcctgtaattccagcactttgggagtccgaggtgggtggatcacctgaggtcaggagttcaaggccagcctggccaacatggtgaaaccctgtctctacaaaaatacaaaaattagctgggcatgatggcaggcgcctgtaatcccagctacttgggaggctgaggcaggagaatcgcttgaacccgggaggcagaggttgcagtgagctgagattgcaccactgcactccagcctgggcgacagagtgagactctgtctcaaaaaaaaaaaaaaaaagaaacagaaacacattggtttgttccaaaaaggtgggacaactcgaagcagggagtggggagcaccttccacgggtaacacatcacaaggaatttccttgtgggcaatttgtgtgggaggtatgtagctttttaatctttgtagctgtcttgtttacaaataggattggagggaggtctgcctgccagcagttcccagtttgacttttcactttggcttagtgattttggggtccccatattttcctttcatactagcaaataccccaaaaccttcccacacccccgtggccacagttactttgctgttcttggtctcaaactcctggggtgcactctttctccaccagtggtgtgatcatggctcactgcagcctcaatctcccgggctcaatccatcctcccacctcagcctcccgagcagctgggacaacaagcgcacaccaccatgcccagctaatttttgtatttttggtagaggcaggattttcctatgttgcccaggctagtcttgaactcctggactcaggcgatcttttcactgcagcttcccaaagtgctgggattacagtcatgagtcaccatgctggcctcctgaggcctttatgtacctatgggcttgccagccgtcctccaccctcctctcctctccaagccactgggggccttgggccaaactttgtgggccctgccctgccctgcccaacccttgcacttgctcttcccaccagcccctcctcgtgagcctctgtgcatccctcctctccgccccctcccagtgttgcagggctccggatcccagccctcacaccgcccctctgtcaccgcctactccccaggcgcctctccagtcctggattaaacgccatccaccctgcaccaaaagaaccaggaggccactgcgtgtcagccgtgcccttattttaagcaccccagtttaggccgaattctaagaacatgtgctctcccagattcccctgcgccagcccctggaactggtgcctctgcggaggtgccactcccaaggtcgggcgagtttacacggcagagtggagcttaacgctaattcccaagtgggcctgacctagtcccgggagccttgaaaagaggacagttttctgtggctggtgacaggagggggagtcagggaggtccaagcctgggaaggcttcaaggtgcggatgctggtttgaagacagggcggggggcgtgagaaggaacatgagcaccccccagaagcagggagcagccatcagtgacaccacaaggaggcagggacctcctcagtcccacacccggcttcccagcgacaggagcgagcttggaaggggaccctgagctccagaccagagcgtgaccagctgccgcctgactccagcgtaagcagagacccacagactgcaagctaagaaaggtgggctgcttgaaaccacgcaatttgtggtaacaggagaggaagaccaccagctacctgaggctcctccgaagcactgggttcctcctgcagcctctttctttcacctccacctcccatctgcccgccagcgtcctcggctccaccttcacacacatcaggatctacccacctgcaaccgcccgcgctgctgcccagttcggaggctcacctgcacccttgggccgcctccagatgcttgtagctcttcctgagtatccaggcacttccacgacagccagcgggcccttaaatgcgagttggctgcattggcctctgctcaggagtccccggcacagccgtctcaggtgctcagagggaactccattgtcgatgcctggcttcctgggctcttgctccccgtggattctcaccacttctcgagcacctgaagtgctccctgccctgggcttttgccctgcgcctgacccagaccagctgcaaggttgctccccacttccactggtctggtctcaaaagcacctgctcagagaggccatccatggccctgtctgcagcccactcagcccttcccagcatagatgaccctggcacgttgtatactggtcttgctaatcttcctaagaaagcagtgacctggatacagttattgtctccattttccagatgaggacagcgaggcacagagaggttgggtcacttgtccaaggtcccagagagtaaagggcagtgctggggtctcagctcaggccctggggtcccaatgtccacacgtgaatcctcagcgtcatgcatgtgtctccctccaggcagagggcaaatttgcttgctgtccaagataataaagatggcttctccctctgggcagaaactgggcaggtttgctagcagtcctttaaatgactggtgtttcctaacccagggttccttagctgtgtgtacagcatccaccggagccactcctcattgtccgtggggctggggggctggggggaatatgaagctcgtgctgcctgctgtgctgtgagtaacaaagtctttgtctcagacccaggtgtctcatgtcttgcccatgttcagaacactggcaggctcactgttcacttgcaaacagagggaactctcagaccattcatttcttcctttttcctacttcccctttccctcctccttgagggccagcttttaacctgccaaggagccaagaaagagacgttggagagggctggggattgcacaaataagtaaaagcatcggggatgaaggatttgaggactctcgtttcggagaagggagttgcaaattaggaaagtggtcagactggaccaacttctggctgggtggattgaaattggagatatcagtacaaatccagttccaatatggatagctggaaatacagatgtatatctatgtgtgtgtatatatctatgtgtgtgtgtataggcatatgtattttctacagatctggaaacagtgagcacccctagtgcccagatcttggattattattattattattttttgagatggagttttgctcttgtcgcccaggctggagtacaacggcgcgatctcggctcactgtaacttctgcctcctgggttcaagcgattctcctgcctcagcctcccgagtagctgggactacaagcatgtgcaaccacgcccagctaatttttgtattattagtagagacggggtttcaccatgttggccgggctggtcttgaactcccgacctcaggtgatccacccacctcagcctcccaaagtgctgggattacaggtgtgagcaactgtgccctgccttctctaccattttgtgacacagaatgaaagtcctcaccagggccatgcccttgaacttctcagcttgtagaactgtgagctaagtaaacctcttttttttctgataaattatgcagtctcaagtaatcttttatagcaagacaaaatggacggagacccgcacatacacacatgagagagaagggtaagcctgacctcatagtggaaacctcaaattctctccccagaaacggtgtaataattgcttattcattaatgaatgcaaaatgcttactaattaacttttcagtggggaatggcggcagacaccatcatacccaagcgatgagggttatcatcaccagcgatggccagattggccccgtgggcctccggtaggttgctgtaagaggaaagtctcacttctgaggggttcctcctggaaatgaagaagccacaggaaacaggcaaggctagagcgagggccatcccacaaagacccataagacccacaaagactcactgagacagcggggaaattggcaggggctctgcggagtcgatggggacattggatcagtggtggcttcctgatttttcaaggttcactgcaattacttgggagagagttcgtttatttccaaaatactctctgagctgtttaggggagcaagcctggagtctgcagcttattctcaaatgccatataagcaggagcgagagaaggaatagcggggcaatgttcacagatggcgaatctgcaggacaggaatatccgggtctctttgcacggtgtttgccaccttctgtaaattgggattttttttttttttttttttttttttgagacggagtctcactgcaacctctgacttcctggttcaagcgattctcctgcctcagcctcccgagtagctgggattacaggcacacgccaccacgcccagctaatttttttttgtatttttagtagagacggtgtttcaccatgttggccaggatggtctcgaactcctgacctcgtgatctgcccgcctcggtctcccaaagtgctgggattacaggcgtgagccactgcgcccagccccaaaattgggaattatttcaaaataaaaagctggataaatgcatacacacaaggcagtatcgcgtattttccacgagtgcctgtgcaggcaggtaaggatttaggaaaggtctggaaggatgtgcaaaatgttccgcctgcgaaggttccgcggtggcggggacactgctccggctccgctcccgcccgcccgagcgctcggatggggccgcctctgcactgcgtggccacaggcgcggcccggctgcccacgggcgccctttgcagctgctgccccctggcggccgcgggcggctactagcgggaaagcgaaacccgcccggtccattcaagccccgctgcctggcgccctctagggtcgttcttgggaacgggcggacctttcgtcaacactttgcctgcaagatcccccattgggggaaccgaggaggaagttaaaggaagatgtgtgtttttgagcgctgctttgtgccaggctcatcttaggtgtgggacgtgtactatctgaattaataccccaccaggcctgtgggacagtcactgtcaccattcgcaaattatggatgaagaaaggaggtaccaagtggtggtatcacctgtccatagtgagctgtccctcaggagggtggccgccccacgcgaccattcagtgtgctctcattcacacgttcattacccaagagcactgctagcactgggggctggctcactcctgcgatcccagcaccttgggaggccaaggcaggcagattgcttgaggccaggagttcaagaccaatctgagcaacagtgagaccctgtccctataaaaaatgtaaaaattagctgggcagctgggcatggtggcacatgcctgtgatgccagctactcaggaggctgaggtgtgaggatcgcttgaacccaggaggcagaggctgcagtgagctgagattgcaccactgcactcaactccagcctgggtgacaaagcaagaccctgtctcaaaaaaaaaaaaaaaaaaaggatggatgtggtggcctatgcctgtaatccctcccagcactctgggaggctgaggcaggcagattgcttgagtccagaagttcaagaccagcctgggcaatgtggtgaaaccctgtccctaacaaaaaaaaaaccagctgggtgtggtggtgcacgcctgtggtcccagctattcaggggaccaggaggtggaggctgccgtgagctgagatcatgccacggcacttcagcctgggtgacagagcaagactctgtctcaaaagaaaaaaaaagtcctccatatgtggtcccccctcatgctgtctcttccaggcatgtcctcccacatgccaggaggctgcagggccaccaggatgtgacctccttgggctgtgctcccctgccccaactccaggcagtaggatcccagaattcccaacaaaactctccctgcctccctggcctatgcggcctctccctgggctgtcgctgtgaggcatccacagcccctgccatgccaggcagagtggggatggtcggaggggagcgggtgtggacgggacacagggccttccggagagcctgaggtgctgcttctgaactgctccttcccctggtgtgcaggtgtcttcgtcacagtaggacctgggagaacagttccataggtccgggggcttctctccagctggcgaggaggtgtgtggtcctctctccctgtcaccgttactcaggtaacgacagggcagtgagcagagcagtgttgcccctcctggaccctgtctgaagaggcaactgtggctagaggctggagggcagggcggcagggcatggtgctggaggcaggggtggccctcggggctcccctcctcattcccgcctccctgcgtgggtcacagcggccttcactgtggcctcctcactacctggggtgccccaggagcacctcgtggagggagtgcctgagtgaggtcaagcggggcggaggaaggggtcgatggtgagagagacagtgagtgagcccagactccacacagggcggcccctagcgctggccacctcagcagctcccaccagcagcacaagctggatgacagggccagggcctgtggtcagtggtcagtggctgatgacaaagccatgctgtgaccctctctcactgccagagcagacgcggggcggtgagcagccaggcaggcccgtaacctccacctccccagctgcgcccgtcctgcagggactcaacctgctgccctccgcccacagccctcgagggtctcagcattaagggctgggctgggcctcccttctgggtgcctggtcccatttgggcctcaccctgggcaaggtccccgtagctgcccctcccatcaggtaagccccaccccccgagtttcactctgagtggtttgtctttgcatagagcttccccacctgatggtgactgccgtgggtcccacaggtccggtgtccatttttaaatttcactgcagacattgcgctcaggcgccctctgaaaccgccacagaggtgtcatccccaggtcccatcgggcctttgtctcctggcctccccgtgtgcagtggtgcagtgctagctcactgcagcctccacctcccaggctcaaatgatcctctcacctcagcctcctaagcagctgggactgcaggtgccacctcacccggctatgcctggtaactttcctgccactgtgacaccagccagttcaggcagtccctcgcctgagccaggtactctgcgtgtctcagcctagccctgctgtccctaccggtgggtgagacggcgcccggtccccaaggctgggatctgacgtgggagcgaggctcttatttgttgctgtgtggcagcaaaagatgaaaaagtggactctggcttcagagctgtgagaaaacagtggtttttttttttttgagatggagtctcgctctgtctcccaggctggagtgcagtggcgcgatctcggctcactgcaagttctgcctcctgggttcacgccattctcctgcctcagcctcccgagtagctgggactacaggcgcctgccaccacgcccggctaattttttgtatttttagtagagaaggggtttcactgtgttagccaggatggtcttgatctcctgacctcgtgatccgcccgcctcggcctcccaaagtgctgggattacaggcgtgagccaccgcgcccagcctgagtaaacagtttttggttgtgtttttttgttgttgctgttgttttgttttttgagaaggaattttgctcttgttgcccaggctggagtgcaatggcacgatcgcagctcactgcaacctctgcctcctgggttcaagcgattctcctgtctcagcctccgaagtagctgggattacaggtgtgctccaccacacccagataatttttttgtgtgtgtttttagtagagacggggtttcatcatgttggccaggctagtcttgaactcctgacctcaggtgatctgcccgccttggcctcccaaagtgctgggattataggcatgagccatggtgcccagcccggtttgttgttttaagccaccaacttgtgggaactggttatagcagccacaggaaagcccctgctggacatcgttatgatcccttttgccccagccctgaatattccagactggtccagaacctcagccccaacttttcaagtccctggtcacggctgtcctctggaagcctaggggcacactcctctcaaggcaggagaaatgttaactgtgaaggttaaattggagaaatgttaactgtgaaggttaaattggagaaatgttaactgtgaaggttaaattgcattatttcttttatttttatgatttttttaataccaaaaaaaagagacaagattttgccatgttgccgaggctggtctcaaactcctgacctcaactgatcctcccgtctcggcctcccaaagtgctgggatgacaggcgtgagcactgccctgccttgtgcttttatttctaaacacattttcctaatgtatttttctgatgactctcaaggggaggatggctgttttggctgggtgtggtggtgcacacctgtagtcccagctactcaggaggctgagcggggaggatcgcttgagcccaggagtttgaggctgcagtgagctatgatggtgccactgttctccagcccaggcaacagagcaaggccctgtctctaaaaaaataaatattaaaaacaaaaacaaaaacaaaacaaaaacaaggaagagcaactgcatagctgcctgacaaaacgagagcgtggctcagccccacggccctgcgcggcctccctggaagcccctgtgctgtgccgggcactgggctccccatgcaggtgctgcgtctgcccggctctgtgctctgagtgcatgcgatgtgcccgaggtgtcggggcagggaggaggattgatctcgatggtgacccagtgaggtaggtgtcattggccccattttacagatagggaaaccagggcatcagtgtgacctggtctaggcaaggcctttgcggcagacccagatctgactcagccccgagggtgcagggagctggctttctccgccagacaagcaggccaactgctgcactcccccctcagtaaggggctaggggtggggaccccaccctgtacggacccctcaccagcatctccccgaggatgccgctggggactcctggcaccccttgcctctgctgtggctgtgtcacacctgtcctgccaactgttgttctgggcgtggacatttggggctccccgttgaggacgcctgggctgcgctctgggagccagcagctggccaccctgccccacggttccctagaggccctccagctcagcacagacccaaccccagatgagggcgcctgcccccttggaggtggtaggctgccctatgccctcctgggcgctgccacagtgctgggtgacctccagcatggtgctcactgacattctgaggcaggagcccagagggcccacaatgcaccaccgcatccaggcaacgcttgcagaaatgctccgcaaataaagtcatcgccactgatgcgaacagggcagccaccaggtacctctgccagcaggcgtgctacctgcccacagccaagggagccagccaggcaggctgctgatgaagaggccccactgcctgccacatgctctctgggctcccggaagcctggaggtgtcgctcctccccttggcatgcagccaccttccatgtgggaaagcctggggccagtggtcacggagggagtggcttcaggaacgagaaattggtagtttgtcttccagaggggacatgggcactgtggctggtgggctcagtgcacaggaaccacattgctggccccaggacccccaacctgccatccccctgccacacagtgggctcagcaggactcctcaatcagcctctttgcagggcatggtgaccctggtgggtgcacgggcctggagaaggtgtagtggtctgcaagggccacgggcgactgcagctcctcggtgtccctgctgtgggtgagcctggtgacgtctgtcttcatggaccactctttccaccccttatggattctggacacttcttggcgggaatggtccgtggccagcacgtagataatggggtcagccacgccgttcaccgtggacaggcacagaaacaccacagaggctgtgtacagcctttcctccaagccgcacatggcgttcctgtctcctctgtagtaggaaaaggcagcggctttgacgaggagaaccaggtggtacggggcgaagcagactaggaagatgacaaccaccgcgatggccgagtgcttcaccttggccttctgggcagcgcttaagcccatgctctgcttgatgctcctgaaaatccggtggttggtgaaggcgatgatggagagagggatggcaaagccaacggtgaacctggcgtagtagtacccggcaatcctgctgtccatctgcagcatgtcaaagcaggtctccttgtcttccgtctggaacaccgggtagtgaacgatcccgacgaggatgaagatgcaggcggagatgaggatggcggtcctccggcggcggcggccccgactctccagcgcgtacaccacggccacgaagcggtcgcaggagatgcagcacaggaagaggatgctgacgtagatgttgcagaagaagatgtaggcggtcaccttgcaggccagcaggcctagggtccagcggtgctggttgcggatatagatgacccagagtggcagcgtgcctgtgtacagcagctcgcagagtgccaggcagagcaggtagacggccagcacgttgccctgcagtacctgcagcagcgccagccacgcagtcaggcagttggccggcacccccagcgtgcacaccgcgctgtacaccacgaccaggactatcctgctctcttcgaaggacacgttgttgcaggtcttggcggagaggcccagggaggcccacggggcagtggtggtcactggggtggcgtttcctgtgggacagagacaagagtgaggacgggagtccctggaaaccacctgggagagactctactgtgggaagaaaggatagaagctttgtggtagctcagactagacacacgcaggtgtttaaaacatttccaaattgattttttagagcaattattagatagtggatctccaacctagcagcgtcatggacaaagaatgcaggctgggcaatactgaatcatttttcttttttcttttttttgaaatggagttttgctcttgtggcccaggttggagtgcagtggcacaacctcggctcactgcaacctctgcctcctgggttcaggcaattctcctgcctcagcctcccaagtagccaggattacaggcacgtgccaccatgcctggctaatttttgtattttagtagagacggggtttcaccatgttggccaggctggtctcgaattcctgatctcaggtgatccgcctgcatcagcttcccaaagtgctgggattacaggcgtgagccattgtgtctgggcaatgctgagtctttgtaactcactgaggttttcaaaaatgttgcttctggcccggcatggtggctcacacctgtaatcccagcattttgggaggctgaggcaggcagatcacttgaggtcaggcgtttgagaccagcctggccaacatggagaaaccctgtctctactaaaaatttaaaacaaatagttgggcgtgctggctcgcacctgtaatcccagctactctggaggctgaggcaggagaatcacttgaacccaggaggcggaggttgcagtgagctgagatcgtgccgctgtactccagcctgggcaacaagagtgagactccttctcaaaaaaaaaaaaaaagttgcttgtgtgtttgaaaagaatgttgatcctgtaattgctgtgtgagtgcttttctaagcagtctgttaggcgctgctactatgcccttccagcgctgacccactttgcctccacttcccacctggccccatagctgggcactgcctcatcctaattcctaacctgtagtctttttttttttttttttttttttggagatggagtctctccctctgctctgttgcccaggctggagtgcagtggcacgatctcagctcactgcaacctctgcctcccggattcaagggattctcctgcctcagcctcctgagtagctggcattacaggcatgcgtcaccacacccagctaattttgtatttttagtagagatggggtttctccatgttggtcaggcttatcttgaactcccgacctcaggtgatctgccctccttggcctcccaaagtgctgggattacaggcgtgagccactgcgcccggctaatctgtagtcttaccacatatttgcctgtgtgaactatcaattactaaaaaagataattataagctcctgtgggagtggtggatttgtccacctctccttgtattctcccagtgcttgctttacgtatttgaagctactgtgaattggggcataggagtcacagatggttctgtcttcttggtgaattgatcctcttattactatgtcatgtgatacccctcctctcggtggcaggagactaatgaccccacccaaaagatgtctgaatcctaatccttgggacatgtagatatggcaggttacacgggaaaggggaactaaggttgcaagttgaatgaaggttgctaactagctgacagtaaaataaagagattattctggactatctggtgggcccaatggaatcacaaaagtccttaaatgtgggagagggcaaaagaaaaggagatcaaagtgatctcagcaacctgcctcaaacacagctctccgaggtcagaaactcatcctttccagccagggggttgctagaggtcacgcagggtgtgcagtggtgtgacttccccaagctctgccagcgccaccagctccagtgtcctggctgcccactctggctgagttcatgcttctgggccttctgtggttacagatcatggagtcccacctccaggtcagcaggaagccgcagacagacctggcctcagcacctgacggacggacagagcgttgccaaacttattgggccacagcagccccgggcggggcaaacttcagctgtgccctggcgcgaggtcaggggtccctgggcactgtccagcccgctggcctcaggaaccttccacatgcaaatgtcgtagtttccttgacctccctcctgtacttgagggcctgttgacctccagcacgatggggcaagtcaccccgaacggggtcagccctgcggccccattgtgtcgctctttttttttcttttttttttttttgagacgtagtctcaaaaaactgtgttgatgcccaggctggagtgcagtggcgtgatctctgctactgcaacctctgcctcccaagttcaagtgattctcctgcctcagcctcccgagtagctgggactacaggcactcgccaccacgcccatctaatttttgtagttttagtagagacaaggtttcaccaggttggccaggctggtcttgaactcctgaccttgggtgatctgcccaccttggcctcccaaagtgctgggattacaggtgtgagccaccatgccaggccacttgtttttgtgcatttaaaaaattcagctgggcgcagtggctcacgcctgtaatcccagcactttgggaggccagggtggggagatcactagaggtcaggcgttcgagaccagcctggctaacctggtgaaaactcgtctctactaaaaatacaaaaattagacaggcgtggtggcaggtgcctgcagtcccagctacttgggaggctgaggcaggagaatggtgtgaacccggaaggcagagattgcgccactgcactccagccagggcaacagagcaagactccatctcaaaaaaaaaaaaaaaaaaaaaattcggccccatgggccgttcattccttcaatcccaacgctttggaaggacaaggcaggtggatcacccgaggtctggagttccagaccagcctgaccaacatggtgaaatcccatctctattaaaaatacaaatattagccaggcgtggtgggcacctgtaatcccagctacttgggaggctgatgcaggagaatcccttgaacctgggaggcagaagctgcagtgagccgagattgtgccactgcactccagcctgggcgatagagtgagactcaatcgcaagaaaaaaaaattgaaaaagtggaaaattgtggcaaaatacacataacaaggaatttaccattgtaaccgtttttcagtagcattgggcacattcacattcttctgcaaccatcgccagcatccgtcggcagaaccttctcatcttcccaaacggagactctgccccaggaagcactcgctccgcatttgctcccagcccccaggcctccattccactttgtctctgtgcgctgggctcccctgtcacctccccacgtgggtgggcatctctgcgtgtcttcagcgtgtgtccttccgtgtctcacgtgctccactcaccacagtgtcctcaagctccctcctgttgcagcgtgtgccaggatttcccttcctttcaaaggcgggatggtattccattgtattcagtgtgtcctccagggtctcgccaaaaatataaatatatatatatattccactgtgcccttccatcttgagcaatcctgcacgtgtggcgtgtggcgtgtggcgtgtggcgtgttctgctcagccacgactccgctgacagacgctcggctgcctctgtgccttagctgagctgctgagaatgacggtgtcaagaacatgaggagggctgttcacgtccctgctttccgttctcctgggtcagacccacagttggcattgctggatctcacggcagttccgtctcatctcgtggggtgcctccgcgctgttctccacggtggtggcgctggcccaccttcccccggcggtgtgcagggctccggtctccccacagcctcgctgcgcttgctgggtttctccgggtgagtgtcgtgtcccttgctcaccttcctccctgggcagagggagagagtgggtgtgactgggctgcctcacactcagttgtcaccacttcgcccaagacacaggcctgtggcgggcggcggggggcagtgaaggcagttctcgggtgggaggcccaacgcctgtgtttgcactcactgttcttcacccagatggctcttttcccatcaaacgagtgccccagccccgctgtgcgagtcctgagctcagaggaagtttcgggccccctacacggccccgtctctttcatgacaatcacaggccctgggaggcagagccagaatccaaaacacaaggggagatgcaggcaagacccggggtggccagaggggtccctcccacctcagcctgcacagagccgctctggtctgttccctccccgacttcctacggctcccccaccccacacatcgtcgcccgtgcggtctcagtcagggcctcggtgcccctcagtcccgcaccccctgctccaggcctcacgcagccttgggaccttcacctctggacaccaggtccgtggtgtctgtggctctgtgcccatctggtgaggaggctgtcccccgctcccccgcctcctgccacaagtgacctcctgggaagagagccttcctggtgggtcagaagtaggggcaacggcaccaggagacgcatggatgcggggggctggtggtcagctcctcatggcccagaccgtgcagggctcccctgggacctgtgggacagccccctgactcagtactgtgtcgccctcccaggagccaccaactatgccctcattcccgttcctggcttcccagaacttcacgaaagaattatgaaatcagtccttcatttctccatgtagcacctctagatttattattgctgagctagtttttatctcgataatctatttttatgcgttaatttttgaattatgagacaacatgcttcatggaaaaattctcatgggcttcctcttacatgttcaaagtcggagaaggctctctcacctggcatattttgcgggttccaatctcagtgtggctctaagataagctttctaagtacatgtcatgcgtcttgtcggtcctatcaagacgttcactctgagagtttaaaatgacctggaaaaagagtaggttgaaattgttttagggaaatcagattgagtcacaagttaacccattgacaaacggctagtgagtatttactaatttactaagtggcccgttgattcgtaggtgttttttaaatgttgagaatctgccgttgcatcccacatgagaaacacaagcaaggctccaagccaacaggcatcaaaacgtcacattagccactgcgactacatacgattcttttttttttttttttttttttttcttgagatggagtcttgctctgtcgcccaggctggagtgcagtagcacaatctcggctcactgcaacctctgcctcccgggttcaaactattctcctgcagcagcctcttgagtagctgggagtacagtcgcctgccaccacccccagctaatttttttttttttttttttgagacagagtcgcactctgttgcccaggctggagtgcaatggcatgatctcggctcactgcaacctccgcctcctgggttcaagcgattctcctgtcttagcctcccaagtagctgggactacacacacgcgccaccatccccagctagattttgtatttttagtagagacggggtctcaccatgttgggcaggctggtctcaaactcctgacctcaaatgatccacccacctcggcctcccaaagtgctgggattacaggcgtaagccaccgcacctggcctaggtactcttcttgtttgtcaattatacctttataaagctgggagagaaaagaaagttgatgagctttcacagaaaacataaaaatagctcctaaaggccaggtgtggtaactcatggctgtaaatcccagccctttgagaagctgaggtgggaggatagctggagtccaggagttcaagaccagcctgggcaatatagtaacaccccacacctacaaaaatataaacaggcatgatggtgcacacgtgtagtcccagctacccaggaggctgagttgggaggatcgcttgagcccaggaggtaggggttgcagtgagctgtgactgagctgctgcactccggcctggctacagagagagaccccgtctcaagaaaaaagaaaagctcctaaaatctgaaaaatgttcaactccacttctaatcaaagaaatgcaaacatgaatatctgaaagacagtcttttaaaatctttttttggcctatcatgttggcaaaaataaagaccttttaaactcatagtgtttgagagtaggcaatgggtgcccgtacacgggactgacggaagtatgaattggctcgcagcaaaattttgcaatatgtttccaaaaatctcaaatgtgctctacttttgacctggctgatccccttctaggaatttttcctggctacccgaggtgtgacgtgcacatggcctggaagctgtgtcacccacagcatgaggggcccggaggagggaggcatgatgggcgggcagcagatggctcagggcatgcaggggggtggcgcaaggcgcccaggggcctgtccctctgcttccttccctaacctgaggtgcctctaaaacaggcaccaccctgaccagccaaagagggtttgcagggaggagagcgccctaaacccatcctcagatggtgtttgtgcctctcccacagccctgcaaagcctgagggtctcgctctgctgtttccgggccctgcagtgcagggatagaggctgagcctggcggctgcctcactagctccaatcctgcctccctggtgccaggcccaacccccaccccatgctgcctggtgctgccctctatcagccgagaccctcatgggaagccagcaggtgcagtcagtctcccagtgcacactcccctcccagggcagggccggcccggctgcgggcagagcccctacacagcaaggcccctttgggcccgaggcctgtatgttgagaggctggccaggggcactccctggagccacttgctcttcccgcccatcccacgtggctcttgcaggaattctctggaagctgctcaaaagtgaggcagaacccagggacacccacaccaagggctctgggccagcaggtggggctgcctgtgtgttgacatccccagctgccctttcaagtatatttctgtgaaaggaaagtatcttgggccccttcaagctgggaactgctcagcgccgatctgcctggcgttctattcagtcatccctctgctcactgagacagatgcatattctgatgcctcctttggagagacttatcagaaactgaaaacaatgcaaccatttgtctctcgcctacctgtgtaggcgagagacaaatggttgggaagccccctccctgcttcgagttgtccccacctttctggacggaaccaatgtacgtctcacatatattgattgatgtctcttgtctccctaaaatgcatgaaaccaggctgcgcccgaccaccctgggcacgtcatcaggacttcctgaggctgtgtcacagacgcgtgtcctcaactttagcaaataaacctcctaaaatgattgagacttgtctcgacgttttttaacaactggaaaaacaggaagccacaatgttctcctgagattacaggaagcttgttaacttatggagaattttaaagcaataccttgaaaacacatgaaaaagtgagacactgagtcaagaaagaaacaagaaaagccatctccaaagtgatgcccccttggcggtgggtggtgtgggccggaggggttcctgggctacccattctgccaccaccctgccactggctggagtaagtatgcactgctccctgcatctcgggccagccccctgagtggagatggtggggcagcgctgagggtcttcagactctccctcgggtgcctgtgtgctgggcgctgccctcccagctgctgctctgccaagatccgtgtggccctgtcgtctggctgctgcgcccagctccaaggcccagcaagagatgcagggctctctggccatgcccaaaacagaggggtcagtaggtgaggaagcagtgagccggaaccaggagggccaaggaaggcagacccccagccaggcagggggcccaagtgggctgggggcatgtcagagccacctgagaccagtcctgttccttctgagccccgggggtgtggggggcccgaccagcctcacactgggcctggcttccctcctcagctgccgagtccccttcagtggccctagaagcccacatactcttgctcgctggtgtctactccgattctgcagccgccccctccccacctttcaaattctgaataacacgaggcagggacctctcctgtcaaatgagcaggagtgagcacatggagccactgcctgaggcccctgggccccatcagaacgcctgagccgcccaggaaggggctcccggggagtctgcctccttcactttaactggaccaagggttctggaaaccctcccaaacctgggaggatgaactcttgctggtccagggctgtgccgcccagtcacgccaatgccagccggcaaccctgggtcagagggctgcaagcacttctgcaaaaccaaaggaagtggcagctgcagtggaaatgcacgctcccctcccgggccccagccgcaggcagaggctcacagcgaggcccctctgggatccaggcctgtatgttgagagcagagactagccaggggcagagccggagccaccttcccatccagctggtcccatgcggcccatgcagcgtgagctgctgacgtccagatcccgccacgtgcctgacctttgggcaccacagcctggcgaggatgcctggaaagagtcagtgggcccagcaggaggcccggtgggaacaacccaaggcagggcagccggagagccgggtccactgggacgtcccgactccctcgcaccgaggtccagctcctcaccacgcatggccaaccaggcttgggcgccgggggagccctgcaccagccctttgcttatcagagcacatccaggctttgtctggcattccctgccggacaggcccacagcctcaggcagcccaccggcctcttccgagggccttcctggaccagggtccggggtcccgccagcacctgctcaccatccttttgccgcacctgctactcctactgcccctgggagcctctgcctcccctcggggtgagtgagctcaggataggggctcagggccctctctccggccagcccagtggccccacccgccagctgcagtgtcgcggtctgtcctggcccggggccagggctgtttcctccacagaaaggggcgtggggtacagcaggtcacccacatttcaggccctgctcttcctcggggagggtgcagtggggcccgggccctctctcagcttcccctggggctgggtcttcaagtggaaggacaaggccaggcagaggcttcctgtgttgttccactcaggaagcaggcaccaccctcctggggggggggagtccctcctgggctgtgcatggggaccgtcccttcctctcatcgccccagctgtctggcccaccagtggggctcctctcagctgtggggtgggtgggagtgactgagccctgtgggaaaggtccccggtgcagactttcacttctgaaacagcagcaaggtgctcccagcctgccggaggcttgggtaggggatagcccaccatgctcacagcaccagcaatgccagcctggcctggtggactccaggggactctgttcttgatctgctctgagggactatgacaggcagaggccccgctatcaccatccaactccaactggattcagggcagcgtggccagacatgatggccatggtgaggtccctcggatgactccagccacaagaccacagtgtgtgtgggcccaggtcagcctgacacccccgtccacccatccctgagctccagctgcatctcctgtccctgctggccctgggcccctgcctccacctcacatcagcaaatgaccaagcccctcatcacccagcctccatgctgggcaaatgtgtccctgtccagctccatcttcaagccacaccttggcagcccactgaggccagccctccactgctccctggacttctctctcctgtgtccaacccgcctttctcccactcagcgtgtcagctccgaggctgctctgcctcacactttccgtgcttcttccatgaacccatgttttctctttctttttttcttttgccttttttgccttttctttcttttctttcttttcttttcttttcttttttttttttttttttgagatggagtcttgctctgttgcccaggctggagtaaagtggcgcgatcttggctcactgcaacctctacctcccaggttcaagcaattctcctgcctcagcctcccgagtggttgggactacaggcacaccaccacgtccagctactttttttgtatttttagtagaaacagggttttgccatgttgcctaggcaggtcttgaactcctgggctccaatgatcctcctgcctcagcctcccaaagtgctgggattacggtgtgagccactacgcccagcttttttttctttaaatactattaaaattgttctctctctctctccctaaccctctccctctctctcttgctttatttgtttgtttgtttgtttatttatttatttggagacagggtcttgctccctcatccaggctggagtacagtggcaaaatctctgctcactgaaacctccacctcccaggctcacatcatcctcccttccgagtaactgggactacaggcacctgctgccatgcccagttaatttttgtacttttattcttagagacgaggtttccctatgttacccaggctggtctcgagctcctgggctcaagaaatccgccggcctcggtctccgaaagtgctgggaatacaggcgtgagccaccatgcccggccaatgaatccattttccagattagagaagcaccacatgttcctgggatggacatttcaataacaggatctagcatgacctcacccagccactgtccctggagctctctggcctgcaagttgctgtgctcctccagtcttttaaaatctattttgtaactttttttttttttttaggctgagtttctctctcgttgcccaggctggagtgcaatagcacgatcttggctcactgcaacctctgcctcccgggttcaagtgattctcctgcctcagcctctgaagtagctgggattagcaggcgcctgccaccatgcccggctaattttttgtatttttagtagagaaggggtttcgccatattggtcaggctggtcttgaactcctgacctcaggtgatccgcccgcctcggcctcctaaagtgctgggattacaggtgtgagccaccacgcccagcctgttttgtaacttatgatggaacttttcagacagacacaaaaggacagagaaggagccctggcccctgccatgtgcagggagcagttcctcattccagcccatttgtcaaaaacagctcctcaggctgctgaggtctgtcttgtggactatctgtaatttctttctttctttttttttttgagacagagtttcgctctcgttgcccaggctggagtgcaatggcacgatctcggctcaccacaacctccacctcctgggttcaagtgagtctcctgcctcagcctcccaagtaaatgggattacaggcgtgtgccaccacgcccggctaattttgtatttttagtagagacagggtttcaccatattggttacgctggtctcgaactcctgacctcaggtgatccacctgccttggcctcccaaagtgctgggattacaggcgtaagccaccgcacctggctggattgcctgtaatttctaagctgtttcacggttgctggccattcctagccatttccgtcttttactcccacctgctttggcaccaggcaaacctatgacctcttttctgccgtcacgtttgagacaaaccctagggagggaaatgtggagtcaccagctccaacctccctgctccaccacacccatccaaagcccattgtcaactttcttatttttcccaatttgatagtgttgcccaggctagagtgcaatggcgcgatctcggctcactgcaagctccgcctctcaggttcaagcgattctcctgcctcggcctcccaagtagctgggattacagacgtgtgccaacacgcccggctaatttttgtatttttagtagagacagggtatcaccatgttggtcaggctggtctcaaactcctgacctcaagtgatccgcccacctcggcctcccaaagtgctgggattacaggcatgaaccaccgtgcccagcccctatcctcatcttcttccaggagcctctgctctcccacctcggcctggccaatctcctgaaatatcattttgtgctcagcccaactggccagtcttcagtggtcagtcccagtcccttgcagtggtacagacccacgtcatgcacttgacagaaggtattgggccccccgccccgctgtgcctggtgcgccgaacgccactccaaaggccggtgacctgcccagctccaggatcttgtcacgtgactgggccaactgccactcaccgcagcacagcccccactgccctgcttttccctctgtgtaaccccacaagcagcacaggccccacagagagaagcccagcccttcagtgccccccgaccaatcacggaagcaagtggccaaggagagattccagggacaaagtccagccccctgactcacccccatctggaccagtagccagggaagccttttccagaagaaagtctccaggaaggtggcggtgacaaagatacaatggaaactgttgtccctctcccccaaatcctccggccccatcacatctgtggtcactgggggtcctgggttctctcgggagggaccccagattaagaaccctcaacaaagcctccatctttaccaacaaatcacctttgccttcagatccccctctgcccgcctccagctcccagcccccagccccatcccagagcctggccccccaggcccactccccagcacgcagagcccagcgacttacccagggccccgcctgcgtggctagcctcgcacccctccctgcagtcctagctgaggtttcaggaagtagcaggggtctaattatgttctgtctagaactcccctaaccacaaacagggctgagctaggggttagccaaccgggctggggtatcttactggtgatgacagcatggcctcgtcaccttcctgagggagggagtggcaggaaaccccagtcttacctcttttagcaatagcagcactcagagccaggctccactcactcaggagctcccaggcaggtgctggggcctggcgcggcacagcggctgtccgtgtgtccccagacaggcaaggcaggacaggggtcctggaaaggctgcagggaggggtcctggaaagacaaaatccagctcctctgcagctcaggcctggtgttgcccactctcgggccaggcaagcacggagcagggtgacttcccagaggctgtgtcctcccaggagtccctgtccggggtgccaggagtagagaggctgagtgcgcccactgcagccccgggaccaggatggcacctgcatgtcctggaaggctcggcacagccactgcacacaagcaccctcccctccccgcctccctcttcctacatggggcagggccgtgtgggaagaacagcctactgcacactccacattcctcccccagccctacctcaacccctcctgcatccagaaccaagcctggcctggcccaggagccctgcgggtgggcttctctgtgaggggccctgtgggaactggagggtgggcaggcagggttgcctgggacagtccccctcactgtggggcttccggccatgatgggcccagtttccttggacaaagccagctggctgtggacagcacctacaactccactcacctccaggctgcttctgagtttcagggcacagacccaccctggtgcccactcccgagcctgccaagctccatccaagccaggctctttcagcagtggggacagggccgggctgagggaaggagctggggaccacaaatgtctccaagcgacactgcccagcaccgcagcagggacggtcactgagcgaagaagccgccatcctgggtgggtacacccacggccaggagaggccggtggaggccgagcccccagtctacactttcccccagacacgtggatcacagctgccccctgctgcagggccgcatggctggaggctgcctccgaacagcgatttcagagggttttgtgtgggtggcagtggagtccctggaaagctgggctttcccattgccctggcggggaggcgcaggtctcagggcagggcctaccttggctttccagaaacacttgcccaggggacagtgatcctctaggggatctggtgcaaacacacgcctccacaggccactgctcatggggtcactggcctcccgggtctttgggccagggcagccccaccctcggagcagcaatagacgaagcccacatcaggccagtgggggtgatggccagggacagctgtgggttcctgtcgctggccccagcagcctcctaggacctgccccgtcctgcgccccactgggtggtctgtcacgttcaccaggcctcctctgcgcccccggtgaggggtccaggagtgacatgcggacccggctcaggccattgtcaccctccatgccttctggcctttgccaggcagtccgggaatagccgattcaagtgaggtcagttgaatcctctctttgggtccttcactggggtctgggaaaggaaagttgggtcccttgggtggcaggagctgtgggtatgaactggggggttggcagccgtgtaccggctcccctgcccctgccaggtggagaagccaggctggggtggagggcaggcaggagcctgggagtccaaacactgacagcctgggggtgtggactggccctgcctattcccaccgggccttcgggaccagtggaggctgccccgggctgtgcggcacctggggtgttgtctctgagaagcccgtcagggagatggctctccctgctctgaccccagcaaagcgattcatacccagagaatccctcaccaacaggagagcaggtttcagacaggaagtcacccgaacatcccacggctgagtcacgtgccagaacagctccctgcggcccagacacagcagtggtgaggtccaagctgcagacatggggtacaacttcacatcccgatgtgtgcaccagaaaccgccctgctgtccggtgggttcaccagccgttctcctggcctgtctggaccctgcagaagccaaagctggtgattgcttgctaatttgtccagtcagtctgggaaggcctgggcccagggggagacaaggccaggaataagggaagggagggtcagagcaagaaatgtccagggggcaaagttggaaggagctggaaagatgggacgagggacccaaagagcccctgtgcatggggccagtgtggtctgctctacctcccgggcagacacagggccttgctcttgtctggccctaaaaaaccctgaatggccagctctggccttccccacctggtgcatctggagcagaagttcccaagggctaccttgcatgtggggtgcggctgtcccccaagccaggtgtgaccacgctgtgggggcttgtggggctgctcctctggtgacggcggcagggttgggtcgggggcctttgctctataactgtagagagacagtggccggaagggtaggctttgagagtgggggccccaggcctcccagcctcccaggaggacaggtgtggcgggcagatgcccagatccctgtcggtcccgtcgcccaggctggagtacaatggtgcaatctcggctcatgcaacctccgcctgcctggttcaagtgattctcctgcctcagcctcccaagtagctgggattacaggtgtgtgccaccacacccagttaattttttgtatcttttaatagagatagggtttcattatgttggccaggctggtctcgaactcctgacctcatgatctgcctgcctcagcctccaaaagtgctgggattacaggcgtgagccaccacgcctggcttttttttttttttttttcgagacggagttttgctcttgttgcccaggctggagtgcaatggcaggaacttggctcaccgcaacctccacctcccaggttcaagcgattctcccgccttagcctcttgagtcgctgggattacaggcatgtgccaccacgcctgactaattttgtattattagtagagacagggttttgccatgttggtcaggctggtctcgaactcccgacctcaggtgatcctctcaccttggcctcccaaagtgctgggattacaggtgtgtgccactgcacctggccttctctcttgattattaaggactcatagatttgtattttatggtaaaatacaagatgaaaattacacgagatgaaaattaccatcttagccatttctaagtgtaccggtcagtggctctaagcacattcacgctctgcaaccgcccccaccgtccattttcagaaatttttcatcgtgtaaaactgaaactgtcctcactacacagtaacatcccattcctccctgcgcccagccccttccactttctgctctatacacgcggctactccgggtacttcatcgtaagcgcaatcacacagcctttgtccttttgtcctgatgtctggcttattttacttagtgcagtgtcctcaagtctcattcttgcagcacgtgtcagaatttccttcctttttgagggtaaataacatcccttccatgtctctgtgtttagccattcaggtgttgatgggtggatgtcgcttggctgctgtgaatatgggtgtgtgggattcatggacttttatatcttccaagtgtttctgtccaacctagtcattattctttttttatttttattttttcttgagatgacgtgttgccctgtggcccaggctagagtgcagtggcatgattttggctcactgcaacctccgcctcccgggttcaagcgattctcttgcctcagcctcccaagtagctgggattacaggcgcccaccaccactcccagctaatttttatatttttagtagagacggggtttcgccatgttggtcaggctggtcttgaactcctgacctcagatgatctgctcacctcggtctcccaaagtgctgggactgtgctcggcccctagtcattattcttgatgatgctcaaattgtcccagatttgacaagtcacccactctgcctctgtgctgatgactatagggcaaatcctgtgtgtcagtttccaggcacggagcccccctccatcaggtgtgtctgtgtattcacgcctcgccgggcccccctgctcagatggtgattccatccctccctccatcaggtgtgtctgtgtattcacgtctcgccgggcccctctgctcagatggtgattccatccctcggaagaagtcttcccagccttttctgactccttgttcgctcccttggaggagggctctgtcctggcctctcccacccctgggtgttagtgatgcaagcagggggtggggaccggatgacaggccaagtgggaagaggaaaggcggaagtgtcctgaggtttctgttgggggacagctgctctggtaagaaggcaagaggccccaggtctcagccagggaaggggtttttagggaaattttgaagacagcctccccgagacagaagaggcaggggaagataggggcttttgagaagtgtcaacccaagaactggatcattctgaaactccttgttgccagcgcatgttcctttgaccagggcatacccccaatgtgaatcatgagtcatggtttcaacagtcatagtgtgtcctagtgaggccagggagaggctgcctgtgaccccagaaaacccagacgaccatgcctaacccacctaatccacagagtttcctctttctcagggctggcacgacagcctccacagccatgggaagcccccagccttacctcatggtcccagatggcaacttgatctccagccttcacatctgtgttccaggaatgaggaaggagcgaaggagagcagggcacggcccgtcccctgtgtggagaattcccggaattcccacccagttcgcctgctccatcttccctctttcctgggcccaacgtagtcttgtgaccacatctggcagcgagggaggctaggaaacgtagtctttgatgtcactgcgccagctgatgctgggtgttctcctaatcaggaagggggcgcggagtcggcgatgtgtgctgcaatggcacacactgtcaccagcttttcttccacccagcaagggcaggtccctggcagctgagcgaggggcacgctggccaagcccagggactcaattaccccaaatgagaaaagggtcaggggatgttgaactgggaagaaggaggtggagccccgaggccagagaagctgggcgtatgagagaaagcttttcttccatactgtaactcacaacgcctctggcacttcacttctggggttaggttaagggctcagtcacccgtgactgccctgacttcagacaccagtcatggaggggtgggtccccaggttacccactacttctgaatgccttggctgtgacaaatgggaggtctgatgactctctcctcgggttcagtcatttgctagaacagctcacagagactagaacaactgtttgtttcctactactgaattttttttctgtcatgctctctctcagcagaatgttttatattatatatatctatttttattttacatttgcagacaggtctgcctctgtcacccagactggagcacagtggtgcaatcttggttcactgcaacctctgcctcttgggctcaagcgatcctctcaccccagcctcccaagtagctcggactacaggcatgagccgccacgcccagctaatttttgtattttttgtagagagagggtctcaccatgttgcccaggttgattttgaacccctgaactcaagcgatctgtccaccttggcctcccaaaggcgtgagccaccgcacccggccacttctggcttattactaaaggaaacaactcagccagcagagatgctcagggcaaggtatggggatgcgggtggagctcccacggcctctccgggcgcctccctccgagagcctccacgcgtgcaccaacccagacgctctccaaatcccattgttctgacttttcatggaggcttcatcacacaggcttggtctccagcccctcccttccccagagcatggcgggtgaggccagaagtgtcaagctgctcatcgtggcttggtcttgctggcgaccagcccccatcctggagctacccaggagcccagcaagagctgcctcattggaacaaaagatgctcccatcacctaggcaagtctaagggattaggagctctgtgtcagtaatgggggacagagaccaaatatatatgtcttatgatgtcataagaggagccaaaagaggagaaaaagatggaggaggaggaggaacacccagtgggagcgggatttggttcattgtgaaggaattttctccccacgggaaccccgggaaaacccacatcaagcctttgcacgcaggattggtgtcaaccaccaaaaccatccatccacactcccgccgtccatccacacgcccgcctgcccgtccacacgcccgcccgcccgtccacacgcccgcccgtccgtccacatgtctgaccgtccgtccacatgcccgccgtccatccacatggccgccatcgactgacgtcagcagacctcagtattccctgtctccatccacatcactcgctcttccagggcagtcttgcctagggagatgaagatggcaaacaaccttgctgttcagctcaggaacttccaacatgcaatggacacttctgtaggaggcatcaagccgttcttggtgatatctgtgtcttcatcacgtgctggttgcacgggtgtttaggtaggaactctctgtggagctgtgggcatgactgtgtctgtgtcttcagtagagttgagaggtttgagagcagtcatgaggattaacagcagataccaggaggctgctcgctggtcctgtcaacacggccatgtagtcaggatgccagctcccccaccaagtcaactttggggagcttggcagagccgtgactccaggaggcatccctggactctcgaagccccctgctgtgtgtgtgtcagggggctctgagcccagtgagtggctgtccctggggcaggcagggggcacttgaggtgccacagaggacacggaccgtaggaaccacgagaggggcggatggcccagagccagggtgtggatgactgccctgggcagctggggtcgggaggcagccttttcacttcaatgagaatggtgtgcagctgggatgggacagcctctcagaaggagagaagggacgtaacagaaaggtatggtggggacaccagaaagcagaggtgcggacagggcactcccttgctctcacacctgtgggatcatcccatccctggccggctccagctctgcccacatttctcattcctcctttgggtctcatcagagtccccgcatcccgcaggaagtgcccccacaggcaggcctgggtggagctgggtagtcttcctctgtgtccccctcaccgcccccgcttcccagctccaagcaggaggctatgtccctgccgcctctgcccctacaaatggacggttgccagctgaaggaatgagcccaatcccggctcctgctccctgcccgtgggatctgggcaagctgccggacactttgggcctcagtttcccccttacaatgtctgcctttttgtggggtccttgggagctccctgttgttggttacaccagtggagtggacagaggctcagcctaagggtgtttccagaaaggccatctgctggaggggggctgggagcatccctggagacagagagctttagactagctgctggggtgggtgcggtggtgggagtggagctgctgggggcagaaaaaggggcttccaaggggcatgcgggttctggcaagctgaatccctcaccgtaaaccatgcacctgtccaagtgaagaactgctccagggctcgcctgggccaagaaggggctgcagggcaccctacgaggccatggtggctaaagataggctgagcaagccaagggccctaagccggcagccaagggtggcctgggggctgcagtgggggcctgggggctgcagagccggcccccagcctctctccacctctggcctctcagctccctgagggtggtgtccacggccagctgctctcccctcagggtggaagacctggggaagcccccagtctcaagctacagccttgatttctggaacaatcccaggacaggactctggcccatcaggttctgcagcccaccctgggcagagtggctcctcttctgggcagcccatacctagtgtggtcgaggctgggttgcccaggcctggccagacgaatctgggtccttgtgtccagctgggcctcggagcctgccacgcccccggcaccaccacccccctaataaactccccttcctctacctgtttcctccaccagcctctgggtcttgctccctgccagggtccaactcacagccacctccgccactgctcccgcggtgaccatgcgtccacggccccccaggaccatgcttgtcattctcttgccctctctgcttggcgcggggtttggctgcagtctgggctgctcgatgctcccggggcaggggctattcccctgtggtctcaagctctgggctggcaggggatgctccgagaacccatctgttacctggagggtccaggagagattgaagcaggtccctgggggcttcccagagctgggctcctggctgtcccctctctggggactgtcactcccagctctcctctctaggaactggtggggaggaagaccctgcagcagtgggaggccaaggttggggggtccaccctcagtgtggggtgtgggtggctctctggggtaagggcttggtatcatgtggccccctgaaccccagagctggcccctgaaaattctcctcaaccgcagagtacacccctccacctgcagctcagggcccctgccccgaagctcaccctcctcagagaccctcccctggggccccaaggaagggctgggcctggtgggggctgcatccttctcattgcccttcacagcgtggggggctgatcccctttggaatgcacttccctagggaacccgcctcgagcctggctgtccccccaacccctgtggagctgggccttggggcgtgtccactcgccctgtatctgctcctgcccccggcggtccctggtctccactgaccatcctttttcgtccctgggggggtagcagcagcaggcaaaccccggccgaacagtccctgtgacactccttgagggcctggagccagctggagccaacaggtgccacatccagggccagcttccaggactcaggaaggagcgacgtgcagccggctgcggtggctaggtggggccagggatgctgctgaacgtcccaccacacccaggagccatctgcccaggcacagctcttctgtgaagtacctgctgggtgccaggtctgggcggggacccacagagtctccacaggtgggggacttaccctcctcatggccctgggcctcctttgcagccccgctgccccgagctcccccagaccctccctcccacccccacagcccctgccccgagctcccccagaccctccctcccacccccacagcccctgccccgagctcccccagaccctccctcccacccccacagcccctgccccgagctcccccagaccctctcccacccccacagcccctgccccgagctcccccagaccctccctcccacccccacagcccctgccaagccctcagggcctattctcagccgcttttaggaactgcttgttttgccctaatggtgctttgagacaggaaaggcccaagataagggccaccccccaggcctcagggcgggggatagggatggggcggggcagcggagggagcagactgctccccacaggccctctgcggatcagcagaagtgcagctgcttcccctgcccccatccaggccagcaggagctcagcacggaaacccttatgggggaacccggcccagtggctcccaacaggcacctccccttccccgtgccagtgaggggggggtccagtgtcccccgttccacagaggggacagttagggtctctggagacatctttggacttcacggcagggaggggtgccactggcttctagtgggtggagaccaaggaagctggaaaatgtcctgcaacacacaggacagcccctcccgccaccacaaagaagtttccagccccaaatgtccaggcaagaagtcctggtagccttcgggcagccaggggaaagctcagagctgtcctgttttagaatcattgttccgacgcccccacgggagggctggcggctgggagggtggctgggagacggctagtgccaggaggccacgcgatagaggggcagcccttgcgtccctgccagtgtccttcagcccgggggaagcccctaaaggtgcagtgtccaggttggcagctgaggccaggacagcaacccagacaccactggggagacagcaaccccaggtggaaagcaccctggctgatgccagcgctcagcacccatgctggaaacattttggttccctctgcaggctgtcggggttccagccaagctcagctgccaggggtctggttaacaatccagggtcagggacccaaggcttctgggctgcgggacccctcactgtcactaataaaggagggccagtggagtcggggctgaccccacagaaactgggggtttctggcagacagacctgcaggcccgcggcacgccccaccccgggcagcttctgaggtgggggagctctctgcctccaaggacccacagtcctgggagggggctcctcccgtcagcaggccctggagaaaggccaccatcaccaccctgggcatgcgggccaggcccaaatcctggagcaggacgggaagctttgcagaggggctgggcttgagcggagcccgctgaggcaggccagggcatcccgggccgaggggacagtgagggcaaaagcagggaggggtgaggggtgacgcagagtgggcaaggccatgggccaaggaggctgggccaggagacggagggcaggggagcaggagggctcagggctgtccgtgggagaggaggactgggggagtggacatccccaagccacagccaccctcaggctgtgggagaggcgaggcctagaggacatccagcctgaaggcactgcacaggacatcgagagggctcagaggatcctagggcctaagggctaagaggccacgtgaggctggcagggcagagttgcccgcccacggcgggggaggatgaggggcaggccagagggcgggtggggggcatttaccaggtgctcagagttggtggagtccgggcaggagctggagggctgaggaacagcctgtgcatgtgaacacgggcatgccagtatgtgtatacgtgtgtgtgtgagaatgcacacacgtgtgtgcgtgtgaaaggagttctgctgcacggctctgaccggcccgcggcagggcagtggagggcactcctttgcctcacagaaaatgcaggaggttgggggggtgctccacttcctgccccctcacctacagactccacagccttggcctgtgtcccctgctcaggggtgtgacttccttccggggtggaggaacccaacacccgcctggacagggcctcacccccaaagctgcatcttctagccccctcaccccaaagccacaccttccagccctgctcgtgctggcacccatccactgcctcacccacctgagagatctcatctttacacacatgcacactcaacacacaggtgcacacacacaggtgcacacacacactctcacacaggtgcacacacactctctcacatacacaggtgcacacacacacacacacaggtgcacacacactctcacatacacaggtgcacacacactcagacacaggtgcacacacaggcatgcatttgcatatgtgtgttcagacacacactcacacagggacacacacacaaacccccacacatggctccaggccagccaggagcatgggtggccacaggcccggacccctgggccatcttactgctgtgagaccccaagcaggctgcctcaagtctctgggctgggctccctcagggcaagacgggggtgtggaccggacccacggggcccgatgccatgtgcaaactgctcagaggtcctgggggcatcttcccagctgcagctgtgggctccagctctggcctgggcacaaggcttgcctcggcctcagccaggcagctcctgtcaatcctccaccttcagagagagcagttccatcgtcagcagagccccttccttcggctttgaggcaggcaggctctgaggttgctgtcctctggcctctgtgacttcactcgaaaaacgggtccttccagcccaaaatgtctgcatgggaagattatcttttcttagaattgctttttttttttttttgcataaaaaaatcttaatatacatatccaaaaaatgcactgtctggtgttcagttctacaggttttgacaaatgcacaatcacgtcatccactcccacagtcacgattcagaacagtctcgtcaccctcaaatccccctgtgctgcccccatccccaacccctgcaaccaccaatctattttccttctctctagctttgctttttctggaatgtcatattaatgtaattaatcaatcaaccaatatgcagtttagtcaatgcatttaattaatgcaattaatcaattaatatgcacaataatgcttattagtacagatagtaaccttttgaatctggtttctttcacaaagaaaaatgcattggagactcatgcatgacatttgaattgatggcctcttcctttttgttgctgaatagtattccattccacccatgggctgcaggtttgatctactcaccgactgaagaacagtggatttgcttccagttttgttttttttttgttttttttttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtctccctgattacttgagattagggagtggtgatgactcttaacgagcatgctgccttcaagcatctgtttaacaaagcacatcttgcaccacccttaatccatttaaccctgagtggacacagcacacgtttcagagagcacagggttgggggtaaggtcacagatcaacaggatcccaaggcagaagaatttttcttagtacagaacaaaatgaagtctcccatgtctacttctttctacacagacacggcaaccatccgatttctcaatcttttccccacctttcccccctttctattccacaaaaccaccattgttatcatggcccgttctcaatgagctgttgggcacacctcccagacggggtggtggccgggcagaggggctcctcacttcccagtaggggcggccaggcagaggcgcccctcacctcccggacggggcggctggccgggcggggggctgacccccccacctccctcccggacggggcggctgccgggcggagacgctcctcacttcccagacggggtggctgccgggcggaggggctcctcacttctcagacggggcggccgggcagagacgctcctcacctcccagacggggtcgcggccgggcagaggcgctcctcacatcccagatggggcggcggggcagaggtgctccccacatctcagacgatgggcggccgggcagagacgcccctcacttcctagatgtgatggcggccgggaagaggcgctcctcacttcctagatgggatggcggctgggcggagacgctcctcactttccagactgggcagccaggcagaggggctccccacatcccagacgatgggcggccaggcagagacactcctcacttcccagacggggtggcggccgggcagaggctgcaatctcagcactttgggaggccaaggcaggcggctgggaggtgtaggttgtagtgagctgagatcacgctactgcactccagcctgggcaccattgagcactgagtgaaccagactccgtctgcaatcccggcacctcgggaggccgaggctggcagatcactcgcgattaggagctggagaccagcccggccaacaaagcaaaaccccgtctccaccaaaaccagtcaggcgtggcagcgcgtgcctgcaatcgcaggcactcggcaggctgaggcaggagaatcaggcagggaggttgcagtgagcctgagccgagatggcagcagtacagtccagcttcggctccgcatgagagggagactgtggaaagagagggagaccgtggggagagggagagggagagggagagggagagctgcttccagtttttagtgattataaataaagctgctgtgaagatttatgtgagtggcatttctgggtgagaaatggccaatttcttttccacaacggctgcaccattttgcattctcaccagcagtagatgagaatttctcgtgcttcacatctgtgtcagcatgtggcattgtcattttacttgtgtgattatgttttagccatttcgtgactgtgcgatgggatggcatcgtgctttcaatctgcactcgcctaatgagaaattatgttgagcgtcttctcatgtgcttatctgccatctgtataccttctgtggcgctctgtttgcgtggctgtgcaatgggatggcattgcgtttaatctacactcgcctaacgagaaattacgtggcgcgtcttttcatgttcgtatctgccgtctgtataccttctgtgactctgtttcttcagatctttagcctttttttttcctttccttttctcttcctctctttttcttttttgagacagtctcactctgtctcccgggctggaatgcagtagtgcaatcatagctcactgtaacctgcaattcctgggcttcagcaatccttccacctcagcctcccaagaaggtaggactacaggcacatgctaccatgcccagctaattttttatttttatttttgtaaagacagggcctctctatgttgtccaggctggtcttgaactcctggcttcaagctatcctcccaccgcagcctcccaaagtgctaggattacagacataagccaccacacccagctgttagcctttttttttaagacagagttttactctcgttgcccaggctggagtgcaatgacgtgatcttggctcactgcaacttctgcctcccgggttcaagcaactctcctgtctcagcctcccaagtagctggaattacaggcatgcgccaccatgcccagcaaattttgtattttttttttagtagagatggagtttcaccatgttggtcaggctggtctcgaactcctgacctcaagtgatccgcccacctcggcctcccaaagtgctgggattacaggcgtgagccaccgcgcccagcattagcccatttttaaactgggtttttttttttttttattgttcagttctgaattctttatatattctgaatggaagtcctttatctgataaatgatctgaaaattttccaccagtctgtggtaattattatcttttaaatctgcaacttggcctttttttgttcatattatttgtgtctttcctttctttgctccttcttcccagaactgttgatccattttgttggataatttttttcgaagaaccaatttttgtcttcattgttcttctctattgcatctttgctatttcattgatttctgatcttatttttatctccattttctcaactttctgggcttacactgtttttgcttttgtttacctcccaacttcctctttttaaaattcattttttaaaatttaaggtataatttacatacagtgcaattcactcctctggtatgcacagttctgacttgacacatgcgtttagctctgtaaccaccagcacaaccgaactgtaaaacatttccatctcctggccgggcgcagtggctcacgcctgtagtcccagcactttgggaggccaaggcaggtgcatcacctgaggtcaggagtttgagaccagcctggccaacatggtgaaaccccatccctactaaaaatacaaaaattagccaggcgtggtgacgcacgcctgtagtcccagctacttggaggctgagcaggagaatcgaaatttcgccactgcactccagcctgggtgacagagtgagactctgtctcaaaagaaaaaaaaaaaattgccatctcccaaaaggttccctcatgcctcttcacagtcaatcctgccccctaactttctgagatggagacagcttacaaaccttaagatttcttcttttcactgtaagcatcagtagcaatgcttctggaagccccgcttctgtggccccccacaagctgggtgtgcaatgttttcatgatcatccagttctgtttgtttatttatttactgagatgaaatctcactctgttgcccaggctggagtgcaatggcacgatctcggctcactgcaacctctgcctcctgggttcaagtgattcttctgtctcagcctcccgagtagctgggattacaggcatgtgctaccacacccggctaattttttgttatttttagtagagatagggtttcaccatgtggtcaggctggtctcaaactcttgacctcaagtgatccacccacctcggcctcccaaagtgctgggattacaggcatgagccaccacgcccggcccagttctgggtttttaaggtttctattatgatcccttctttagcttatgttatttagcagtgtacatacgtgtgtgtgtgtgtgtgtgtgtgtgtgtgtgtgtgtaaaagtcttgtctataatttccccaacattgcatatttttaaacatatagcaacatgaaaagaatcacacagtgtaaccccactcaccacttgaattctagttaacaatttactgtacttgttccttcacacatctctgcatctacccatccatctctctatacacccttccactcctctatccaccccttcacccaccatctacccatccatccatctctatccttcgatccctctatccatccatccatcccccatcaacccccatccccccctccagccatccatctatccatttctatccatcctcccctctatccacctatccattcctctatccacccctccacccatcccccaggcatccatccatccacccatccatccatctctatccatccttctatccacccatccactcctctccacccctccacccatccatccatctctatccatccttctatccacccatcccctcctctctccacccctccacccacccctccatcatccatccatccacccatctctatccatccttctatccacccattcactcctctctccacccctccgcccacccctccatcatccatccatccacccatccatccatctctatccatccttctatccacccacccactcctctatccacccctccacccaaccctccatcctccatccacccatctctctatccacacatccatcaatccctctatctgcccttccactcctctattcacccctccactcacccctccatccatccacccaccactctatccacccaaccgcttctctatccacccctctacccacccctccatcctccatccacccgtctatccacccatctatccctctatctgcccttccactcctctatccacccctccacccacccctccatccatccacccaccactctatgcacccatccacttctctatccacccctccacccacccctccatcttccatccaccatctctctatccacacatccatctatccctctatctgcccttccactcctctatccacccctccacccacccctccatccatccacccaccactctatccacccatccacttctctatccactcctccacccaccccccaggcatccatccatccacccaaccaaccatctccatccaccactctatccacccatccactcctctatccacccatccacccacccctccatcctccctccacccatccattcctctatccacccctccaccctccatccacccatctctctatccacccatccatctatctctctatctgcccttccactcctctattcaccatccacccatccatctctatccattcatccctgtatccacccacccactcctctattcatccatccatccatccttctatccattcctgtatccacctctccatccatccatttatccacccacccatccctctatccatctttccattcctctatctacccccatccatccatccatccttccacccatccacccacccatccctctatccagccttccactcctctatccacccctccatacatccagctctatccatccattcctctatccatttgtccatcttttcatacatccatatatccatccctctatccatccactcaccactgtatccatccacctctcctccctttgttttccctacaagccccacgtcctggggggctgactccaactgggggtgctgcttccaagcctcatgccttagtgaattggagaccagcagagaaaggcctgacagccagacctaagggctgccacagattgctggtgcagcccacccccacatccatccaccacaggctgaggacagggatgtcatcctctccatgggcacagggctcctcccaggagccagcagaggccaggcttttctttggactgtgcagagtgtgcactcccaggcctgctgagtgacccttttccacgcagattcagagagggctcacagaggcagacgtcaaagcccagctttgcagggtgagtggagggagagcttggagaggctgagccctcgatagctggaaccagaggggagtgagggcaggccttggacatccttttgtcaaagtatacattttgggtttggctatgtctaagttactctgtaataaaagtcatttattctgcccagaggtctgtggcagttctgccatcaagtgatggtgagtctcaggacagggaggacacaacacatcccacctgtccagtgaagtgatgctcagtggccggtcccagggctgggcttggacgggagagtggggacgctttgtccactaatcactttctaagtcaccacagccttgggacagccataccttgtggtctctagggatcctggtgttctggcctgaggtctgaggtcaaacaaggtctgtgctctcacaccaaccctccactggcaagcaggacccagggagggggtcaggaggcagctgggtgctcccctgggacacaggcctgccctctgccttcacttcccacagctgcccaagcccatcatgttctgggcctcacccttccacatctgggaccctgaacagccgcctgtgaacaccgacaggaagaacaggggagcgtccagcattgaggcacgcgaagagccctgacccctggcccttccctccagctacctgggacagcctgaaaccagcctgaacccagcgagggaagtctcggaccctggagacgaccttgtgttctccctgcgcgatggtgaaactccaggcactgccacagcttgggagagggggtccagccagccctgctcctccctccatggagctggccctgggagggcagacagctggtagtgcccactgcactggaggcagcagcccctcagactctgtgcctgcagcccagccttgggaaacagcatactgggcatggggcagaggcccattcagttccccggacactgaataactaatgacccaggctcagccattcattagaaattttcttgattcagagaaacccccatcaccctcagccggaaaatctcttggtcccctggtcacagtgattgaagtacccccgaccacaaccacacaacagggagtgatgtgggggagtcctgggcttctagaggctggttgtggcttcctgcctcagtttctttgtgggcaagaaggcaccagaggcctgtgacctcccctgctctcactgggactggcccccatcaggtttatgcagtgaggcgcagaccctcagcaaccgtgtcctgggccttctccatccccaatccctcccatgtcacctcccgtttcccattactgccaagctccagtgcctggggcaggaggacaacccatgcagccagccaggccatgctggcagaagctgctggtgggggcatctgggcatgctcaatggcaccccaagagctaaaatggactctaggggggtggccaggccctggtgggggaggtacactcccactgcccagatccaaacccgatggctgggccctgacctgcagggtcccaggctcaccagcccctcctcctctaacaggccggtgctcagttcctcttcccctccggagagacccagcttcccacagcctgtttctctgggggacaattccctgcagcttgggaattctcaccgtcccacctcccattttatcttctcttctttctctctctcgctctctttttttttttttttttttttttttgagatggagtctcactctgtcacccaggctggggtgcaatggcccaatttcggctcactgcaacctctgcctcctgggttcaaatgattctcccgcctcagcctcccaagtagctgggactacagggacccgccatcatgcccggctaattttcgtatttttgtagagaccgggtttcaccatgttggccaggccagtcttgaactcctgacctcaggtgatccgcccacctcggcttcccaaagtgctgggattacaggcgtgagccaccgcgcccagcccacctcccattttcttagaagaaactgagacacaaagagcctgagaaagttgcttaaggtcacacagcccatcagaggcagggtgcagggtgaggcacagggaccagaaacttcttccacctgatatctctgagacagcggcctccctgttcccctcttgccacagtctctccaggataaggtgagggtgtcaggggcctgggtccccacttgcgaccccaccgggctgctcctgggacgggctgtgcaggccaggagactggcggacctaagaaactgagacgtgtttctcagctcccccaaccacgtccccagccccgccggtcccggagctgccctgccgcctggtggctgcggctgcgctgcgcccgaccggcccgcgctccagggcatccgacctccagttcccccgcccgcgcccgggagtgcgccgagagcagcagaggtcgagacagcagcccggaggtggtgttacccgcaacctcggctcctgcgctcggggccgcttctctcctgggtgcagtcagctctgcgcgggggaccctcagcacgccgtccacggacacggctccctcggccacagtctcctccccgccatcagacgcactgcagacctggggcctttgtttcccaggcagggaaatgggcgtgctgcgcccacgggcgcagggaggacgggggagcccgccctgggggcctggaggattcgcgtggcctccgcggtccagaagtactcctctcccctagcgatccccaggattctcttccccagttccctccctggtctagaaccgagactcacagctccccacccctcggtcccgagttccctgtcccctccccccaggccgggaaccacccagtcccctccgcgcctccccaacccccagcccagagcattcctgcccgcaccgtacccttcaatctccgcccccggccaggagcctccctggcccttcccgcccggcggggcaggctccgggcaggcgggcagcctcgcggcggcggcatccgcgcccaccttcatgccgccgcaggctggagcgcgcctgggcctgtcgaggccgctggcggagcagcggcggggcgggcggggaggctgcgtctgcgcggcccggaggagcccccgcagaggctggagcgagcccaggcaggctggggcgctggcgcggggcgagctggcgggggcgggagagctggcccagcgctgggtttcctgggtcccagcacgcacgcgcgccttagtggggcgccggcccgcttcccaggcagatcgcccttggcctcgcctctggctcttttatttgcacaatcaccccgaggtgggtgatgctattgttcccacttttcagattcgaaagtcgagacacaactggaattcgtatccaggttccagacaccgcccgtcctcgggcagaggtttgcgcagaaacaagcatcattcctgaccttagggacctcaccgagcctgcctgcgggcagggcagggaggtgctgagaattcgggtgcacgtgccagcacccggggccccagagctcccctccccatgaagccctccctcagccccctccctggagaaatggcgagccatctggaaggaggtcgagaggggacccgctcccgccaggacctctcttctgggagtggaggagtgggcggaggagaagggttcctgagtccccaacccggtcccaggccctgggagccgcccctcgccccctcgggaatctagttctctttgccaaaccgccagcccgggcggagggctgggggcgggggcgaagccgagcgcgctgacacacgcgcctggaattcccaggagagccggccgcggcctgtgacctcttctgctcttggccggccccagccagcggggccgaggggaggacaggctccctccacgggggtggggcgcacacccacctcgttcctcctgctggagcccgccctgtccgtgtccctccccctcccaggcagcctgcctggaggtagcagtaccctctgtgctccggacccaggcagatgtgaactcccctcactccacaaccaccagagacagcccggggcagaccctgtccagctcctgccccagggccttgagcacattaccaaatgctctgtgcctgtttccccatctctgcaaagggtgctaacggccatctcagaatggctcgttgagattcaaagtgtcttgtaaatggttgttacaattgcatggaaggtaaactgaggcccagaggccccaacaccacagagccacgtctactcaccagcccccagcccccaccactccccgcacagtgtcctccatcatgctgtgggttttggaggttcagagggcacccagctgggagctcgaggcaggctgagctgtacacagtggtgtgaatgggcgtgcatgtcatgcaaggcagtgtgctgtgtgccctccacgtgtgaaggtgtgtgcctgtgtgtgagtgctggtgtgaacatgtgtgtgtaccctgtgctcatgcaagtgtgcatcgtgtgtatgctggaagcagtgtgtgcgcgcacgcatactctgggcaatccactcctcgggtgtggtgttgtgtaaacagtggaggtctcagatgccagtccctggggacactgggcccccgccccaggtttggctggcccagcttgtcccctcccctgatcagcccttgccaaggagtgctttgccatctgggggctagagggagttgtggtgggttcagcgccctgcaagggcaggcctgtgccctgagagcagatggtccccggcttaccctccaggccaagaagtcccccagctcaggtgacagcagagcccaggaaggagggccagccaggtcagccaaccccagggaaccccccaccccgacggcgctgggcactcaggatgggggactccgcagaagccttaaggactgacagtccagggagctggggtcctgccgtgcagacacactgggggacccaggtctgcagggactcgctgcagaaccaggagtcccagggcacacgagcctccctgcccaggttgctggcaagcccctggggtgagtgggggcccagctgccccgccctgagcaggctcaagcccgcttcccagatcccccctgaacccactgcccgcgaagcagggtaggagatggagcaggggaccacaaactcacaaactgagacctgtcccttcaccctgggcccagagaccaggcagaccacttcccacccagacccagagcccagaggggtctcatgggctggcccaccccaccacatccccgtatggcctccgccctgacagctcccgaaggccagggatgctccctcccctggtgtggggggctgggatgggtgagccagggcccccacccacccctagccttgtcgctcctgccgcaggttcctcagcacctgcccatcacagcctgctgactgacaaggaccccatgctgcaggaggcaagctggggcccaggagggaccgcagccccgggaggctcctcattcattcacatctccaccaaagaagccccacggctgcccagtgccagacctggcctgatgcctggatggctgccactgggatgatcagggtcaagtagtgtgggcctttgagcatcctggagagggcggggaggcctctagaggcacccagggtgcaggtctgaagagggatgggctcagctggccaacacacggacaccttgggcctggcctccacttctcccagcctggctgcccacactccccaccctagcagcgggcagtgtctggcgcaccagtcctgctccccctgctgccatcctccgggggatggtgtccttgggccctaatgggcttcaactgcccatggaagccctgccaaggtcccgacttgcagcctcctggcgggaccaatgtcctctccaggcccttcctgcatggaccagcccccaggggcattgctccaagccagcagcccctctgccctggcctgcagccctcccagcgcctgctccaggcttgacctctccctcaccttctcctccttcagctcctatcacccaagggcacagaaaggcactgtcgcaccaccagggggcgccctgcctcaggggcgggcttaggacacagcagtgctgcttatctgggagcccaggggctggggacagaagaggctaactgacctctggctggtaccttccgggcttcaggacaactcagccaggtggtcactgtgggcccactccccagatgaggaaacaggccagagaggaggatgccaccggccctggctcttgggagtgggaggtctgtgtctccaggattcctccaagccaccaatttgggaaagtcatctgacctctctgggcttccgtttccccacctgtacagtgggggtgggaaggcatcactgctggggctgagcatgggactacaggacagagcttggggccctggctccagcaggctggtctccagcccctgggagcagggacccaccccacccagcacaggtgcctaaaggctgttgtctccgccagcaggtgaccctgcacccatgggtgggggtccacagggccaactcagccctgcacctgccagctgaggacaaactctcctggggagcttttgggctgtggccagaacaagcgaggctgcctttgagcggctgcctttctgctttctgctgtgtgcgtgtgtgagcatatctgtgtgtgccaggggcctgggctcggtgtgacccctagcaggtatgccccagctgtcaacaccctctccctcctgtggtccccactggccccagatggaggccgagtcccccagcccagagcgccccgggggtcgggagtgcccactgctttgagccacagaaacccaggccccaacctcctcaggacccccaggcctcctgggccaccaggatgcaaaccccacctccaggcaaggtggaagcccatttggcagctgaggccctggtgcctgaggccatcaagggaggtcagaagggacaaaggccacggctcggccgagaggagggtgccgtccgctctgctcaggcactgggccgggtgccagcagcaccacgttcccacgctctatggtgccaatcttggcaccccagccctgccccacccttgccttgcagggaccagggcaccgggaatgtggctgtggattccgccccctggggccacggattcctgtctcagtgggcgggggtggaggacggctttccaccctttgatccttgccagttccagggagcgaggccacgcccaggccctgccagccaggccacaggggaggccaggaggcaggcccaggcgagacagagctgactccctcagctcaggaaccccagctcccagggcctgggcctgctccccaggtgccccagaagctcctgcctcacctcttgccagctgggcacggggcctggtgcccagactaatcgggcagagaccagcactgggcaatggcccagtccccaccttcagcctgtgatggccacagcaaccccttccctcacctccccagtctgccacagggcacagagtcccagcccctctccgccagcctggcctcacatgctcaccctcctgccctagcaccccccattcggcagccacaactgccccacccagagactcctgggcgcctggtgctgttcaggacactggcctgctcagcatcaagacagatcccagaatgtcctgggcttctgaccacaaaggagccagcataggctaaagcctggcacgcggctcagaaccctcaaccctatgtgcttgtttcctgctcccccagcctctggagccggctgacagctaccccctcagtacaccttcatgcgtccccgacccctgttcaagcaccactgagcaccccaaccagtggacaaggggacaaggggtcccacaggaaacaggaccaccctctgagcctgggggaggggagagcaatctcaaaatcccacgtgggaggggcccagggccaggagtccagataaaggaggggcccaaggaaggatctcgcccgggctcctgagaggcaggaggatggctccactctgccagccgtcctgatctgctaagtggaaattacagtcattagcgtcccctcccagaggcccgtggtgccctgtgggcctggaacttgccccaccccctctgccacatatggcccagggagaaggcgctaaaggtgagcgccggctgcagggcggaggactctggcctctgcggggccgagccacggagccacctggcttgcggggatccctgggacccagccttgttctactgcccacttgacgcggcgggcaccctccttcctggtgggtccttactcccaaccctggcctggccatgggattgccagggtctggtggggggggggtccctttccaatggggcgccttcctatgcagacagaggagaggggagtggtcaggctgggtcctcaaggtgcccagacaggggtgcgaggaggcaagtgctcaccggagcagccaggaacgctccctggaggagggggcccggaagctccctggctgcaagagtggattcctgagcaaaagctccgcgggtggagaaagagagtatggcgggggccacgggggtccgagtcccgacacgcggctgcgcactcgctcccctgcaccgcgggcggggctggggccggaaacgcgcgcggcggcctcggattcctgcgcggtgggacaagcccgcgcctgcgcgccgcccggacagggcacgtcgcccgcgaggggggtggcgggcccaggaggaggggaccccgacagcccctcaccgcctgccggggcgggccgccacgctggacgggggcagcgcggggcggggtcggggggcggcagaaggcgcctttgtgcgtcgcgtccccgagcgtgtcgcggcgggcccggcaccggccccgctccagcgcccgcccccggcccgcgccccgggccccgcgcgcatacctggcgaggccacgaggggattctgcgggccgagccccgcctgggctgcgccgccgcaggcgggagaggctgaggattcttttgggaagcccctccgccggctgtaaccccagggccgtgccaccctcctgatcaccgcaagcatggaccccccagcacgctgcgggtgggacaggcagggcccctgtggggtggcttgactggcctggagttggggacgaagtccccgggcttggtcccccgagggcttggttgggcgtcccggggtaggtggctgccgcggcgatgtgggcggcttgcgtgtggccgatcggggtcgctgctgagccccggagagcggagggtccaggctaggctgggggagcgagaggcgagggcggagccgcggaggtgtgggcggctttcgtggtccgagaggccccaggttcccggcagggcggggaaggctggggcggggccagagccggagccgcgaagccgcgatggagagggcctggagggtgcgccaggagccggcgtcagggcctgcctccatctcctccaacccccaccccatttattcctgtaacaaatccctaccgggagctggcacagcagctgtgcgctggggacacacgagatgctcaccctccctgccctccaggagcttggactcagctgaggtctgcaggggccagcaggagcagggccgagggccctggtgggaaggtcgtggcccactagggaaggctgggcccggggggtcaggtggagggcaggctgagctgcgagctgtgtcttcagcctacagcaaggccaccactcccagcgcctggcctcctcgctcccgaaagctcagctcagcctacatgtgccgacccctctgtcccccaggcccaggttgggcactggtcaggacggtgctcccagagggacccagtaacaggaggagctagggtgagagcatgagggtggggggagcggcagagaggagggagaggcaggaggtgctcagggcaggagtgtctggagtgaggagggagaggcaggaggtgctcagggcaggagtgtctcgagtgggtctggacaggaacaggaagggcattccaggcagaggggcccaaagaagcaaaggtgcaccagggagaaatgcccgctgtgctccaccacagtggaggtgcaaacctcagcatggaagatgaggctggagggaggggcctgggctggaacatggccaggatggcagtggggagccattggagatgtttgagccggggagtgacagggtcagattcgagttttggaaagataacatcttgagccattaaacagatttctaggatttcaggtttatttatttatttatttagagactcacttcactctgttacccaggctgtagtgcagtggtgcgatctctgctcactgcaatcactcaaggccaagtgattctcatgcctcagcctcctgagtagctgggactacaggcgtgcaccaccatgcccagctaatttttgtatttttagtagaggcggggtttcgccatgttggccaggctggtctcgaattcctggctgggattacaggcgtgagccaccacgccctgctggattttggattcttgatacgtatcatcaaccactctccagagtttggccagcttcacgctccatcagtggtctcaccatagaccttctaatcttgattgtgttggctggtgtctattttctaatggtgtttggttttggaacctgcatttctttgaaaaagagtgagcatgtgcattttcccagatgcctggtatccaactgcacttctccatgtgtgcattgtcccctgagctggcaagaagatcctactagttggtctgcatgccatgccagctcggccttgcaccctgggggcccaggtaactagctctcaccaacagaaagagatgtgatggacatcacctgaggccagaccctaagacctctgtgtgccccctccgtgtctcctgtctgcagctgttgtccacaccaagggtggcctacagagggaagtgaggaccttgggacttcctccaggacagccctcgctgtccaaatctccacctgctgcagagctgcctccagtcaagcccttgtttccagctttctgtgccctaaataaacttctgctgggattgagccatcagcattctgtggtgggcgtcgctgctgcgaggttgccctcgtgcacacaagctcctcacaggtaaaggtgatctgcctgtggacatacttgttacagaagtttcccacctgctgtgcgcatcttgcctgtgtgcagtcaccattctttatgcagttggtgcctccatctgctcctgtgtggtttcttcttttggttcctttattatctctcttttggtgctgtttcccagggacttaactgctggaagtttgataaatcctcaactctcaaattcacccttttctatagatttaaacagacattgaatgtttcacctagcattggggcagaaggaaggtgcaggctcggcccttggcccttctcggccaaattgatctcgcgcccttgagaagctccagaatgagtctgagaagcctcaccggggctgatacatccctccaaggtgggggtcgggagactccctggccaggggaggcctcccctgggccagctccaggctttgccaggcccccttggagcctgcaccagccgtgcccaccaggcacaggccagcacgcacggaggctggcaggtctgtgagcccaggattaggggcccacagaggcagacccaggggtcctggaggtcacagacaaggccgtcagcttctctcagcccgtgcagcctggccctggcccaccaggccaaccttgtgtgggtgtgtacaccacccccatcccaggggccacaccccacctggctcccgtcccatggctgccccagggaggtcttcctctcttctctgcccacaattcaccctctccctgagccctcttctctcacctgggatctgatctttcctcctggacactcatgatgcccacagcttggtcaccagctctgtgctagagatcctgacaatccctaagccccttccccagcctcggtctccccatcccgggagcagggcggtgatgccaccctgtacatgcctctgtccccagccccggctcttctccaaagtgcgacgcgggtctccagtggcctgggacctccatctctcagaggcacccctcccctggcagttcaggctcaggagccacctctttccctccgtctctgatcaattcaacctcctaaacgtctatccactctgagccctgtcccattcctggctccccaactcaccttgtctccatcctggctgccaagagagcatctcaaacacacatctgacttgccccctcctctgctctgaagcacacacaccattgctccccagtacctgcaagatcaaacccaagctgttgttgtggccacaacctcaatagagcccacaccccgtcaggctatgtctggctatttacaggtccgcccacccgggttctgtgccccacactgaaactcaggtgttactgcttctgcaaaccctgtcctgcctctgcccccttctgagtcccacccagctctaccccctcctttgtgcccccgacctggcctgtgtctgcatcagttgagaagcccttgcctctctggccttccccggctgggtttcagggccctgccatttcagccccaagccggagtcaaatactgtgtttccccaaaccacagcaaggagagccctcaccaagagcctgcagaatgagatgctcagcccctgtctgggatgcagcctcccagagaggcggagtgactggcttggtgtcacacagcacatccaagtcccaggtagctaaacagaagggaggagccctgggcctgtgcccttcaagtcgtcctggaagctcaagctgccctctgggctcagggagccgactccattccctgcaggtccagcccgtccccctgcctcccaaccctctacaacacacacacgtacacacacacacacacacacacacacacacacacacacacacctgaagcagcttggttgagccaggcattagacaggcaggctccagcacgccctggcatcctggcccagtggctgggaagatccctgacaggcctggtcagcacccggcatctcaggagctcaggccctggaggtctgaacagagagcaccagcacggcccactgacctgtgactgagctgtagggccaaggggccagggcgtcctgtccctgaaccacgtagcccagcaggggaggggctgccacaggaaggccaggtcccagcattgcttatggggagggcagagggggccagggcagctcaatgcagcgctgggccagctggggtgcaaggcaggcctcgaggggccatgacacctgccacggcccagagcctcccctaggcctccaaactgcaggaatgtgagcactggaacctggcaagcacggccagggcaatggtgggcacctcccgccaggcccctccacacagggctgaatggcactctctagcccagtcttctgacatggcctggaaagagatttcaggttgcttagttttttgtttttgcttttttttcccccataaaagataggtggatttcaagattaattcttgaatattttataatttttgttcttttggaaaatgagctcttccctgttattttttttttttactggctttaaagaatgctattgacttctttgtattgggcccccttgttgacctctgatcagtgctaatagttaactgttggttatttgggaaattcaacattaagcaaccatgttaccatgaaagacacggtaatataactttgccttccttgatattgctcctcaaaggctgatttctttttcctgtctcgttgcatcggccaggacttccaggatgatatggaagagtgactgagagcagccgcccggtgcttcccaaccttagagggaggtcacgggcagtctccctgcgatgctggccacaggtgtgaggaagacagtccttataggaaaatgccctctcgttcttattctctactttaaaaaatctttaaatcatgagtataataaatgttatcaaatgccatattccacatcaatataatgattacaattttttttttgagacagggtctcgctgtgtcgcccaggctggagggcagtggtgtgatctggactcactgcagcctcgacctgttgggctcaagtgatcctctcacgtcagcctccaagtagccaagaccacaggcaggcgtcaccatgcccagcccccatgatgactttacttttcttcttgaacctggtgaatttctgtgttaacatgtctgatttgaacccttctgatattcctgagataaactttatgtgaccttggtattctgttggattttggttagctgatacttcaagatttttataaaactgggttgcaatttatttgtgttcccgtttctagctgtctatgagcttcatcaaatgggcaggaccactttcccttaacttctccttttctggaacaacggacatatcctgtggattatctgttccccacaggtttgggatatgggtgctgtgaatgccactgtgctgggggctttgggaagtgtgtgtttgttttcgtgcgtgtgcggtgggatacaggtgtggttactactttgatttctttctttcttttttttttttttttttttgagatggagtctcactctgttgcccaggctgaagtgcaatggcgcgatcatgactcactgcaacctccgcctcctgggttcaagcgactctcctgcctcagcctccagagttgctgggattacaggcacccacaaccataccctaaattttgtacttttagtaaagatggggtttcaccatttggccaggcttgtcttgaactcccaattaccaatttcttatgtgtccttttgaagactttctaagtacgaccaacctagtaaagtgagtcacccaccactgttttgtttgtttttgtttgtttgtttgttttttagaatggggtttcaccttgttgcccaggctagtcttgaactcttgggctccagcaatctaccctcctcagcttcccaaagtgctgggattataggcatgagccaccatgcctggccccaccactcattcttaacctcttcttctttgcctttctctgttgcagagtcctggaagttaaatgctctatttcccagcctcccttgcagctaggagcagtcatgtgactccattctggccaacgagatacaagaaacacttgctgacaggtgcaatcagaaagcgtttgcttttccagtaacatgtaggaccagtcacctttttgcatttcccctttcttcttgattcgaacattgcattgccgtcatgtttggagatgagtcagccatcttgcaaataggaggcagcaagactgagggaaatgccatcctgcttcagagggcagaatggaaagagaagcctaagatggcaatggtacggttgggcagctgagtcaggactggggccactgcctctcggtttcaagggagaaaaataaacccctgtttgttggcctcatgctaggttggattttcttttacttaaagccaagacatttctaacatacaaaaccagacacatgtgcatgccacacgtacatcacaagtgatcacatgctgtccgactagcacctcgatttttccactgaaccatcagtcttgcagatcatcctttatcagtgcctggcaacttgtcttgcccttgttttcttgggtttttgtttttgtttttgtttaagacaaggtctcatctgttgcccaggctggagtgcattggcacaatcatagctcactacagcctggaccttctgggctcagcagtcctccgtcctcagcctcccgagtagctggtactaaaggcatgtgccaccatgcccggctaattttcacatgttcttttagagactgggtcttgctttgttgcccaggctggtcttgaactcctggactcaagcagtccccctgcctaggcctcccaaactgctgacactacaggcatgagccactccacccagcctcgtttttgttaatggcagtataccaccactctggatgtgtaatatgatttatttaaccagcctcatcgaccttttgagttgtttccaaactctttgctattgaggtaggaaacagaactcaactctggaggtagggctcagacactggaccaaattgaggactacctaagcaggtccagggcagaggcacctccctataagacacacccaccagtgtgccatgtcagtttaccactaccatggcaacatctagaagttatggcatctttccatggcaatgacctggcaacccagaagttaccaccctcaccctagaaatgtctgcataaactaccccttaatttgcatgtaattaaaagtgggtataaatctgagtgcagagctgcctctgagcgctgctctgggcatactgcctgtgggtggccctgctccacaagggacagttcctgtgttgctgccatgcatggctgctctgctatgcacagcagcttgcctctgaattcttccctgggtgaagccaggaaccctcctgggctaagccccgatttgggggtgtgcctgccctgcaccactgttatggacaatgctacaatgaataaccttgcacatacctcacttcacacacgagaacatatccataggataagttcctcgcagtgaagattgttgtcttatgatgttcaaccactggatctgagaacacgatatgcctttcattctctcaggtctcctttcatgtccctcagtggatttaaagtgttcttctttttgattgtacatgtttctttttaggtttattcctaggttttatttttttttttttggtgctgtggtaaatgagatattttttctcatcaatattcctgctcacaagtcattttttatgtagatgaaggctaattatcatgttactttcgtcccagccacaaaactttttttttttttttttagatggagtctcgctctgtcacccaggccggagtgcagtggtgtgatcttggctcactgcaagctctgcctccagagttcacaccattctcctgcctcagcctcctgagtagctgggactacaggcacctgccaccaggcccggctaattgtttttgtattttcagtagagatggggtttcactgtgttagccaagatggtcttgatctcctgacctcgtgatccgcccacctcggcctcccaaagtgctggaattacaggtgtgagccaccgtgcccggcctccagccacaaaacttaaatattgtttgtcatagaaattaaattgattctcttggattttccaaggacttaatcatgtcatctgcaaaaagtgatattgtatttcctcctttgcattttttaaacttaatttctttctctcttccaattgcaaaaaaattaaataacagtgatgatagaagacaccttcctgagctttcaccttgacagagatgcttctagtatcttccccatttgacacaggagtagctttgaggctgacataaatgaatggcagcacattgagaaagtattactgagaatgcaagttgattctgggcacgacgagtaatgagatttatacttagcctcctgccataaacaacgataaagttgggccaaatgtataaggcagttatgtacaggaattggacaactggtaggactgtgatagctgagagaagggaaatacctgaagtgagtccaagtttgccctgtctttttaccttgggttttcctaccaaggtatgagagataaagccgcagcagagatcatcagccagcgatcactggctgggaaagcagagatcagtgctgaggtggctacgattggtagagcagggcactggaggggagggtgctacgtagaatgagggtgcagaggctgcatgggggtccctcaggtccctggatgaggccaggctgtacatgtgcaaggtgatccttcacaaggcctagcgggaagctgctgctgtggggctgggagctgacagacaagcccagcagtgtgcagtgctaggcgacattgcagttcttgcccagctagggtggagaaacctcaccaagcccctcaggcaatcagttgagaaatcagaaaggccatggcttaagaataagaatcgcactccagaataatggccaaagcacagaactaagaacacaaccaaaacagactcacccttacaaagcataaaatcaagcctgcagtgatatcagcaaaatgatggaattggaagctctggactctccttttcaaaaccatgaacacatcaactcaacaacaattcctgaaaattccctttgcaagaaatccagaaactagctgagcatctcacgcattccaggtaagcatgaatctactcacattgaaactggcagggaaattcaagacaccctcttggcataatccctacccccagcacagtgccatatgactgagaggaaatcccctagctcccagcttaccatggagtgagaaagagatgagctgtgtattcaacacctcaacttttctgagggctacctagggggctgacttctgtgttgcctgtctcagagtgcggatgggacgtagcataaccccactgcctcagggccatggaaagagacctggtgggatgatctaaagtgcaactagtcaccacagtccaactcagcacagagtgaacaggaaaaacaacaaaaacacaccttagattcaggcttctccctagggaagaaaagagttggacagaacacccaacaatccagttttctggaggctacctgaggaacttctttcagtcacttgtctaaaatgctgacaggacttggcatactccagacacccgggggctccagaaaacagagaaagtgggttgggccagcaggaagtttagagaggcccccagaatctttggcttggctgattggtgagggtctcctcctgtacctggccagttcgtgaaaacttgacagaggcctgctttgttgaatgttcagacagcaacagagaaaggcaagaaaatgaagaaacagggaacaatgtttcaaacaaaggaataagataaatctccagaaactgaccctagtgatatggagttatatgatttatcagacagagaattttaaataactatcataaaattgctcactgaagacaggaaaacaatgtatgaacaatgggagaatttcaacaaagagacagaaaatgctaaaaagtaccaaacagaaatcatggagctgaagaatatgataactgcactgaaaaagtcactagatgaggggaacagtagactggatcaagcagaaaaaaggatcagtgaactcaaagaaaggtcattggaaattaatcataggagcaaacggaaaaaaagaaaaagagtaaagaaagtagaagggacttatgggacaccatcaatcagaccaatagatgcattaagggagtcccagaaagataagggaaagaatcattatattcaaagaaataacggttgaaaactcctcagatctgtggaagaaaatggacacccagattcaagaagcccaaaagatcccaaataagatgaactcaaagacatttacagcaagggacattaaaatcaagttgtcaaagacaaagaattagaaagcagcagggaaaagtgacttgtcacatttaaaagaatctccataagaaataagctaatttttcagaaatcttgcaaaccagagggaatgggatgacatactcaaagtgctgacatttttaaaactaccaagcaagaatactgtgcctgggaaaaaactgtctttcagaaatgaagatgagcgacatactttccagacaaacaaaagctgacactgttcttcactatgaacttgccttgtaagaaataatgaagggagttatttcactggaaatgaaaggacaataaacagcaacatgatagcataagaaaacataaaactctttttatttatttgttttttgtttttggttttttttgagatggagtttcgctcttgtcgcccaggctagagtacaatgacaccatctcagctcactacaacctccacctcccaggttcaagcaattctcctgcctcagcctcccaagtagctgggattacaggcatgcgccaccacacccggctaatttttgtatttttagtagagacggggtttcaccatgttggccaggctggtcgtgaacttctgacctcaggtaatccgcccttctcggcctctcaaagtgctgggattacagatatgagccaccgtgcccagccacataaaactctttgacaagggtaactatatacacaaatacagaatactgtattactgtcatggtggtgggtaaatcacttttagttctaacataaaagttaaattacagaattattgaagataactacagctaaaaatattttaatgggtgcacaatataagtcgatgttaattgtgacatcagtaacataaagtaggaggaatggtaaaagtgtagaatttacttatgtgattgaagttaagttgttatcagcttaaaacacactattttaattataagatattttatgtaagcgctatggtaaacacaaagaaaatacctatagaagttacaaaaaagaaaaggagaaaggaatcaaagcatagcaacacaaaaatatcaacaaacccaaaaaagaaaacacgagaagagggataaggcacaggaaaacaggaaaagaagacagaaacaaaaacaggaagtcaaacgctacctgattccgcttatgtgaggtatctgaaagagtcaaactcataaagtcagggaatagaatgttgtttgcctgccaggagctgggaggagggggaaatggggagtttctaatcaatgggcataaagtatcaattacgcaagacgaataagttctagagatctcctatacaacatcgtccccatagttaacattactgcagtgtactaccctacagaggagtgcagatcccatgtgaagtgttcttatcacataaaaataaaagcttgagataaggaaaaccgaggacatctacaagcatattcattgcagaaaaccgaaggctcagagaagactaaagtcatttgctgtggttgtaaaatatttccttctagtcctttctatgcttacatagccattgtcaaatttttacaaataagggatggtatcagagatattattttataatgtataattttgctcaatttacaattaagaataaacatttttctttttgagacagggtctccctgttttccaggctgaagtacagtggtacaatcatagttcactttaacctcctgggttcaaacaatcctcccacttcagcctctcaagtagctgggattacagacacgcgacaccatgcccagctaatttatttttattttttaattattttgtttgaaaagacagggtctcacgatgttgcagaaacttgtctccaatttcggggctcaagcaatcctctcgccttggcctcccaaagtgttgagattacaggcatgagccatatgaatgttttgataacattattttctattatcacaaaacaaccagccaggtgctgtggtgggtacttgtagttccagctatccaggaggctgagatgggaggatcacttgagcctaggagtttgaggctgcagtgagccatgatcacaccactgcattcaagcctaggcaacagagtgagaccccgtctcaaaacaaaataaaaataaatttaaaaacaagcagaagccgagcttgatatgttcaagatgattttccagtacaatagaagtaaacagaaatagatctccaggtgaacagatgttggaattagcagaccttaactttaaaagatctattgtaaatctgtccaaagattaaaggagcaaatgaggaaaatgaatagacaaacatgaaatctccatggtgaaatcaaaactataaggccaggcatggtggctcacactgtaaccccaccgttttgggaagctgaggtgggaggattgccttaggccaagagttcaagaccagcctgggcaatatagcaaaaccccatctgcacacacacatacacacacgcacacacacagagtcaggaatggtggcacaatcctgtagtcttagttacttgggagactgaagcaggactatgacttgaacccaggagttcgaggctgcagtgagctatgatcaccactgcactccagcccgggtgacagagcaagaccctgtctccagaaaagagagaaagagagagagaagggtcaggcatggtggctaatgcctataatgccagagcattatcaaggtgataaagaaattgtggtagagccctaccatgaaatactacgtggcaaaaacaaaaatgaatgactgatgtatgccacaacatgaatgaacctcaaaaactttagattgaataaaaaatgccaaacacaaaaaacatgtgtacttaatatttctattcaaatgaagaataaatgaattcatttgactataatcatgaattcacaggcaaaatgaatctgtgttgagagaaatcagaagagtgattacttatggggttaggaataatcttcaagaggcaaagtgactttttggggtgatggaaatggcttatactttggggctattgtctgcagtggtgcatacatttctcaaatctcattgaattgtacacttcagatctgtatattgaaataccatcttccaccaaaaggaattagggatccttgaaggaatggctagttactaggttggttcagggaacatataaggggagcctggaacactgtgtttatcagagagtaagttgtgcttcaagaatgaaggggcctgtgtggtggtgcacacctgtaatcccagatgcttgggaggctgaggtgggaggatcccttgagcccaggacttcgcgaccagcctgggcaacatagctagaccctggttctacaaacagttttgtaaaaatcagctgggactcgctgggcgcagtggctcatgcctgtaatcccagcactttaggaggctgaggagggtggattgcctgagctcaggagttcgagaccagctttggaaacatggtgaaacccgtctctactaaaatataaaaaattagccaggcatgttggcgcacacctgtagtcctagctactcgggaggctgaggcaggagaattacttgaaccagggaggtggaggttgcagtgagccgagatcacgccactgcactccatcctgggtggcagagccagactctgtctcaaaaaaaaaaaaaaaaaacagaaaattagccgggactggtagcaagcacctatagtctcagctacctgggaggctgaggtgggagggtcccgtgaacccaggagctgcagctgcagtgagccgtgatcacgccactgtacaccagcctgggtgactgagcaagactctgtctcaaacaaacaaacaaacaaaaaaacaaaggaaggcggcatgtcaaaaagacacagaagctagcttaaaggcactcccagtggccaaatctgggatgatttgagctataaaataaatactgaaagttacaattagaatgcattgaataaataagaattcatgaatccacactgataggtattaattatatgacttatgaggactaggatatttgcatagtctcaatataccttctcacaaaattctcagtaattacagagggagagagagcagcttcacattctgagaactgatcaaggtgcagaccgtgtgtaacagggcaaagtgaaatgtgtgttcacctgatggggtgccctgggaacacagcctgtcttctgagatgttcctaacaacaatgtacatcctgaatctaacaatgaggaaacctcaggcagatccagactgagaaacatcctacaaaataactggcgtgtgatttttcccatgtgtcaaggacataaaagtaaaggaaatcctgaagaacaaatccaaatggaaggagactggagagatggggcaaccaaatgcagtgtggagttccaggcgggatcgtgtgaggaaaatgatgaaatctgcagggattttatcaactagaaggcactgctctatcagcgtcagtttcctgactttgtttggtgttttttgtttgtttgtttgtttttgagatggagtgtagctctgttgccaggctggagtacagtggcgcaatctcggctcagtgcaacccccacctcctgggttccagcgattcttctgcctcagcctcccgagtagctgggattacaggcgcccgccaccacgtctggctaaattttgtatttttagtagagacgggatttcaccatgttggccaggatggtctcgatctcctgacctcgtgatctgcccaccttggcctcccaaagtgctgggattacaggcgtgagccactacgcccggccagtttcctgactttgagagttggatttttattatttaggagaatattcttgctctaaccacacactaaagtatctgagggtgatggggcatcgggtcagcaacttactctcaaatggttccagaaactaagttgaaacttttctgtaggtttaggattgttttaaaaatctgtccatttgactgtatgtaaattacctcaacaaaataaaatatgttaaattttataaaatgcctcttcaagtatctaaggagaggttaataatttctgccttctgatttgttaatatggtgaattgtattaaaatattctccattaatgagccatcccggctggccgcagtggttcacgcctgtaatcctggcactttgggaggctgaggcaggtggatcacttgaggtcaggagttagagaccagcctggccaacaaggtgaaacctcgtctctactaaaaaatacaaaaaagtcctggtgcggtggctcgtgcctgtaatcccagcacttttggaggccgaggcgggcagatcacctgaggtcaggggttggagaccagcctggccagcatggtgaaaccctgtctctactaaacatacaaaaattagctgggcatggtggcatgtgcctgtaatcccagctactcaggaggctgtgacaggaaaattgcttgaacccaggaggcagaggttgcagtgagccgagatctcaccactgcattccagcctggggagagagagagagactgtctcaaaaaaaaaaaaaaaaaaaaaagagccattcttaacattgcatgattccatggtagacgtcactcggtttcagagtttggttgtgtgggttttttttgttgttgtttgtttttttaagtgtatgttgttgtttttttctgtcaccccggctgtagtggagtggtgtgatcatagctcactgtaacgtcgaattcctaggctcaagcgctcctcctggctcagcctcccgagtagctaggactataggtgtgcaccaccacgcccaggcaatttttcaaacactgtagagccaggatcttgttacgtttcccaggctggtctcacctggcctcaagcaatccttccgccttgacctcccaacacacggggattacaggcgtgagccattatacctggccccagagtgtaatttttaaaaatgtgctgcttgatcctatttactaatatcttatttagtatttttgcattgtcgttattgcaaacgacaataacattgcagtgattgtcattacggcctgtaattttacattattgtgctacattttggagttttgttatcaatattattattatttttttgttttgtttttttttttttagtaaaggacatatcatatttattcatacacatgctggaattattggtgcagacatttaaatacattttctttgagaaagtcctttttttttttttttttttatggagtttccctcttgttgcccaggctggagtgcaatggtgcaatctcagctcacaacaacctctgcctcctgggttcaagcaattctcctgcctcagcctcccaagtagctgggattacaggcatgcaccaccacgcccagctatttttttttatttttagtagagacggggtttctccgtgttggtcaggctggtcttgaactcctgatctcaggtgatctgcccgccttggcctgccacagtgctgggattacagtcgtgagccaccacagctggcctgggaaagtccattctttttttttttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccaggcagaggcgcccctcacctcccggacggggcggctggccgggcggggggccgacccccccacctccctcccggacggggcggctggccgggcagaggggctcctcacttcccagtaggggcggccgggcagaggcgcccctcacctcccagacggggcggctggccgggcggagggctgagccccccacctccctcccggacggggcggctggccaggcggggggctgacccccctacctccctcccggacggggcggctggccgggtgggggggctgacccccccatctccctcccggacggggtggctggccgggctgaggggctcctcacttcccagtaggggcggccgggcagaggcgcccctcacctcccggacggggcggctggccgggcggggggccgacccccccacctccctcccggacggggcggctggccgggcagaggggctcctcacttcccagtaggggcggccgggcagaggcgcccctcacctcccagacggggcggctggccgggcggagggctgagccccccacctccctcccggacggggcggctggccaggcggggggctgacccccctacctccctcccggacggggcggctggccaggcggggggctgacccccccatctccctcccggacggggtggctggccaggctgaggggctcctcacttcccagtaggggcggccgggcagaggcgcccctcacctcccggacggggcggctggccgggcggggggccgacccccccacctccctcccggatggcacggctggccgggcgggggggctgaccccccccccccccacctccctcccggacggggtggctgccgggcggagacgctcctcacttcccagatggggtggctgccgggcggagaggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcagccgggcagaggctgcaatctcggcactttgggaggccaaggcaggcggctgctccttgccctcgggccccgcggggcccgtccgctcctccagccgctgcctcccgggcggcgctcgccggcgcggcggcaaagactgagacagctccgctgcccgctgaactccatcctcccggcggtcgggcggcggcggctgcggtcggtcgcggcagcggctccgcttcatatctgcagctggggcccgcgggcgtcagcgccgcgactgtcctggctccgcactgccccgggccgcagcgcagccgcgccaaccaccagccgcggccaccatggccggacgggctccctaagccaccgaccccagcccgcggcgccttcgacccttctggggcctccggcgccgcgacttcctctgcctgaaatttcttttttcttttccttttattttattttattttttgagacggagtcttgctctgttgtctgggtggagtgcagtggtgcaatctcggctcactgcaacctctgcctcccaggttgaagcgattttcctgcctcagcctcagcctcctgagtagctgggactacaggtgtgcaccaccacgcccagctatcaatattattttttaaatatgttatttttattaatagatttcttttcttttctttttttttttaagacaaaatctaggccaggcgtggtggctcacgcctgtaatcctagtactttgggaggccaaggcgggtggattgcctaagctcaggagttcgagaccagcctgggcaacatggtgaaaccctgtctctactaaaatacaaaagaaattagctgggcatgacagcatgcacctgtagtcccagctacttgggaggatgaggcaggagaattgcttgaacccaggaggtggaggttgcagtgagccaagattgcgccactgcactcagcctgggcgacagagtgagctgtttcaaaaaaaaaatttgttttaacatttttaaaaattaaaaatggggttgagtgcggtggctcactgagcctgtaatcccagcactttgggaggccgaggcgggtggatcatctgaggtcaggagtttgagaccagcctggccaacatggtgaaaccctgtctctactaaaaatacaaaaaagtgggggccaggcacggtggctcacacctgtaatcccagcactttgggaggccgaggcgggcagatcacgaggtcaggagatcgagaccatcttggctaacacggtgaaaccctgtctcttaaaaatacaaaaaattatccgggcgcggtggcgggcgcctgtagtcccagctactcgggaggctgaggcaggagaatggcgtgaacccgggaggcggagcttgcagtgagccaagatcgcaccactgcactccagcctgggcgacagagcgagactccgtctcaaaaaataaataaatacaaaaaagtagccaggcgtggtggtgggtgcctgtagtcccagcttcttgggaggctgaggcaggagaatcgcctgaacccgggaggcggagcttgcagggagctaagaccacgccattatactctagcctgggcaacaagagcgaaattccatctcgaaaaataaataaataaaaataaaaatacaaaaactagtctgtaatctcagctgcttgggaggctgaagcaggagaattgtttgaacccgggaggcggaggttgcagtgagccaagatcacaccactgcactccagcctggattatagagcaagactctgtctcaaaaaataataataaataaaaggttcacattttaaaaatggtctgcatcacttcgtgtgcttagatttttaaatctcttcagagatctgctataatattattataatcattcattataatattttctgtaagaataatgtcgtaaccaaggcctgatttatttgcttggtgttcatcaaaatgtgctcttgtaatgtaaacaatctttttgatatctgggattattttcttcttgttgtatatttcaactttctcttcttttttttaaaaaaataagcgtgactctcaggggatgtctgcacgggaacccatgtctctgctgccccacaaacacagcaagagccgcgagcacgcgaatgcatggccaagttgggaggtcagaaggagggatgggaccaaaggagggagtgtgtgtttttttttgtttgttttggtttttttgagacggagtctcgctctgtcgcccaggctggagggcagtggtgcgatcttggctcactgcaagctccgcctcccgggttcacgccattctcctgcctcagcctcccgagtagctgggactacaggtgcccactgccacgcctggctaatttttgtgtttttagtagagacggagtttcaccatgttggccaggatggtctccatctcctgacctcgtgatctgcctgcctaggcctaccaaagtgctgggattacaggcatgagccaacacgcccggccagggagtgtgtttaagaagtcacgtggcacacggggtggaagcagaggtagatggtccgcctgggtgctgaaggccctttcagaacacaaagagaaattaggagaatgggcagtgcaggtttttgggaaaagagctggtttttgttgaaaaagcagaggaaaccccagacattgcatgggtttaggccttagcctcaccactgtcgagagcctcctgcccaggagggccaaattctaacctccaatctgcttggtgaggaccttaagatcctttccaccctggcaagccacctgccagggtgagctgagaaatcagccaggggagcagagtcacttatggccaagaggaattgttctggggtttggttagtaagcaggagaaagaggagaagaaaactgcgtatgggggttgaatgcctctagcagaagaaggtgaggcatagaggcctcttaccactagggaacatattggagtcacgcagcaaagtatgttaacagcagaagttacccaagtcacagagcaccaacatatgctattggtggcaggaatccgagctaccggtggtgagtctgtaggggtctgcagcaacctcaattcttgcctcctcagaagaaagaatttgactgtggggcacaaggcagaaggagagaccgaggccagtttcagagcagaggcaaaggttcattaaaaagttttagagcaggaaggaaaggaaggaaagtgcacttggaagagggccaggcgggcgacgtggagggcaagtgcctcttttctctccttgattgggttttctcattgcttttctattttattttgatttcatccccaaataattagctcctagacttacttatttgttctaaccaacctgagtccgttcatttttgcttctgtctttacgatctgaccctttgggatgtggtcgcccatcatccccatggcaggcagggagccgttttgacagcagcatctccctctctcactcccacctgtggaggacagcctcgggactggcccaaatgccagcatttgctctcctgcctatttcccaggccgtggtgaggggcttttcctcagggtcttcatggggagagtcaggggatgagtgcctctctcctcactttgcactccttcctctatgtcatgccaaggcacttcagcggctcagcctccaatgatggaggtgactctggagctcaggcttcaatcaaccaacgaagaaaaatgttagagacacttccagctttttctttttttttttttttttttgagatggagtcttgctctgtcgcccaggctggagtgcagtggcgcaatctccactcactgcaagctccacctcccgggttcacaccattctcctggctcagcctcctgtgtagctggggctacaggtgcccgccaccatgcccggctaattttttgtatatttagtagagacagggtttcactgtgttagccacgatggtctcaatctcctgacctcgtgatccgcctacctcggactcccaaagtgctgggattacaggcatgagcccccacgcccggccacttccagcttcttgaactaaaaatattgaattcagaatctcttgtaaatgcacacagctcaacagactctaatctttaagtttgtgcttccctcccaggtctagtgtttgcagaagccacccacccccacacacacacccccagtcttctaacaatataaatgacaaatcttgcaaaccttttgatgtgtaagccttcttttcccaaattaggtttgtgctgatacccctgggacatgccgggatctgattgtaattgcaggtttggaagtggtgaggttggtagtggtggagtgggatggaaatcagcacctgcttgcaaagtaaccacatcaggtgaggtcacagagaggtcttcaaacaatgcaggaccagacccatcaaacaggggctacttctcttggtgtgattgtcagggtatgcagctcatcgcccccctcctgattctggggtccaacaccttcccagtccatgccctgattctcacagaagagacctgagggagggtgaaagtccggtctacattggcattcagcaaacctcccaataatgccctgaggctgacctgagggcacaccagactcaacagccttaagagagaagagattctttcagtgatgatggaaaccttgttctctgaccaggccttgagctcagcatttgaaaagcccaactgtgtcatcttgtttcctgagactctccagtgcagctcagagcagccacctcagcccacaggcctgtgcccctcctgcccgctgtactgtgctgccatcaccagacccacactgcacaggagcttcactctaggtgagcacaggtggttacttaattaactgtctcaccaggtgccacggactccaaatatcccttcatcctcatggcccccaaacccaaccaggtcatagaaaccatccagaatctcacccaccaaggtctgttatctgcagtcacttctggtgtcaaatactgtaggagtcaggattcagctgtggataacaaaaacttatcctggctactttgggtagaaagggattgaatcaaggcagaatggagagaattaagggcactgtgacagcaggaagagcagggtttcagctgggcctcagccacggctctcacagtggtactccagaattgtcctgctgtggtagattagaaatggccacagatcctttgcagctcctgcagtcaagaagtagatccatttcgccgcctcccccgaccccctcattagggactgacttgtgactagctttgaccaaagaaggtattgaaagtaaagctctggagctcctgctctggtgctcttggagagctgggacaatgtgaacaagtattggtgaggctaagaaactgggtaagtgttgaagcaccccagccccaaaccaatcaactgataaacctgtgtgtgatgccaataagaaccagctagatcccagctgacccaccgactaactacagaaccaacagctgagcacagatgcaagcgtgaacccagccaagcccagcagaaccatcctgctgagcccagcccaaattgtcaacccacagaaccatgacctgaatgcatggtcattgagctttgggatgattcattacacagcaaaaagatatccaatgcgcctctccaggaagcttccattcctgccacaatccagaaactggggaaaccataagatgcccctatgtttggctccaggaccatattcccctaggcaagacaaataacagcaaaatgaatatcctatgacatgaggtctaggggtgagactctgaggcttctgttactgccgcctcagaaatgctgaccatctccctgtctgggcttgctagtggaaaacgagggaagcaacaatgacagattctacctcatttttcccatccaactgtcaccagagggtgtctgttggaggggcacactccatggagcccatggcagctgcttatctaatccacagcctcaacccagccctgtcagtactgaaccagattttcatttccaccagtttgactcatgggcctcacttggtctgaatttggtgtgtgtatgtgtggggggagggatgggctatcattcgtggtcctcctcaacaaccccaccacaaaagcacagaagccacaaagaaagactgacagacctgactacacaaaaattccaaacttctgatcagttaagagaaccacagtgaacaaactgagggacgcttcttgcaacacacatcccaaaacgatggacagattcaaccataagcatttaagacttttactcagcaaagactccaccaggaactctgaatttgcaaaaaaaatatatatacatttgcaatatacatgatggaagaaatgacagatttatccatgtaaaaattaaaaatatctcatggcaaaagacattatagacaaacatagccagtgcaacctgttctaccagcttggggtacaaataaggtcacatatttttgttcttcataggagccccacccactcccagtgctggaaagggaactctattccctctctgggtgagctcacacagagcacagcctctgtgcagagcagcgccactgcccccaccgacatcttcagacgtgttcgctcttgacacggtacacccacagtgatagagccatccctcaaaaaaacctgcacacaggcggctccacagcaacagcttgaaatgtccgtcactggggcaccgggagaatgttctgtgcacaggtgcttcctgacaacggaatccttgctgtggttgggaagactggagtggacccctaggccccaggcaaaaggctggtttctcctgcccaagacgcctgaacaggcagggccgagagctctgtttataaccccaagcgccagaagtgctgattttctaaaataagggtaaaatgcatagccaagttgggaggtcagaaggagggatggggccaaatgcagatgagccgatgtggaaccgcaggggcagggctgtcggacccagctgcgtctgggaggtactgggctctggggacacagccaggccacaggctctgcccagacagggactggaactgggctctgcacaaggctgggcctgtgagggtctgtcccgcaggaagggggacaagagagggcagaggcgcccagcaggggcacccttccagagttggcatagcatccttgagaatcctgtctgctctggggaggctcatgtgcttcttgtccatgtatgtgctcacaggacatttggagaccaaattcatgccaaggagagaggtgcgggcctgggacctctcccccttgtgtgcaggtgggagcttcatgctgagtgacccggaaaggggtcaggatgctctgtcagctctgtggccatggccatccatgtagcccttttatgcatttcttacctgcaaaatgggaatcataagagtatcaccagcaaaacacctgtggtgctgcgggttaagtgaattatttttgcaaagttttcagagcaagatctggcatagagtgaacactgtgaagcatttgttaaaggaatgaagaaatatgacgtggttagctagtctctgaggccgagctctggagtaaaattcctttccccattcagaggaaaggatccacccactaagaggtgggaacatctacaaggcatagaggtgcagggatgagctacacaggacaaaaccgttccagtatcccattcactaagccctctcattctttctcagctacaccagaggtgtgctggcgtcttgacctcagtcagtgagggccactgagtgcatgtctcggctgtctaaccaagcaaaccagtgacccctcctcactggtgagcaatcacccacaggccagcagctccaataaggaaatacacatggataagcgtgaccggatccacccttggaagctgctatggactgaatatttgaatccccccaaatgcatatgttgaagtcttcacctccaaggtgatagccttaggaggtgagttggggaggtgaatacatcataagggcacagccttcatgagtgggtttagtgccttttaaaagaggccctaggaagctgttcacccttggccacgtgaggacagagtgagaaggcactgtctatgaagaacaagccctcaacagacacggaatctgccagcattttgatctcagactttcagcctccaaaactgtgaacaataaatatctgttgtttataaaccatttagtctatggtagcctcttaaagcagaccaaacagacgaagagagaagccatccccacactcaacccaagagtttctacccatatgaattttggggtgtcaaccatctctcattgggtttagactttatatgtgtccccatggggcatgctgggctctgccttgagttacgaatctagaggcaaaaagggatgctgaggctgttgtgagaagggagaatcccccagcaaacaactgccttgggggaggtgattacagggcaggcatgaagttagggggtgcattctgcaagactgcccttacttctgacacccactgtaggtttggagggttcccaagatcactctgtggttcaacaatttaccagaagggcccacagaactcactgaaagctgttatactcgtgtttatggttgattacagcaaaaagatacggattaaaagcagccaaaggaagagacactggggtcaggggccagcagacaccatgtgcaagcttctaggtgtcctctccctacagagctgtagatggtgtgacttcttggtattgatgtgtgacagtctgcatggagtatggccaagcagggaagctcacttgagcctcagtgtccaaagtctttattggactccatggttgattgcctttgtggccaacctcagtctctggtccctctggacattaggcaatcccatgtgacctgagactcccaccataaatcacattgtaagcgtagactctctggtgtggcccaaaacctccacagaaacaaagaccctcttattaggctggacatcctaaggacctggagattagcacccaggagctgaaggcaaagaccggacttcctgttgggcaaggttaaaaatctgtaccactcacctgtcaagcaaaggaaggccagtctacaaaggaaggccagtgtagacacagtctacacaggggaggagaggctactttgctagccagggagtctggagggcggttggaagttcaagttcatcagactcattccaacccaggtaatattctcattctgattctcaggaccctattcttctccagatgatgcaaactttcacatacatgacctggtgaggctctagattcagctttccttggacttctgcaacctccaaggccaatttggggtgactttcaactaagtcagtgctgaggctacacgaggtaagtggttagggccacgatagatgctccatttttggtcatttgtaaatgaagacgtttggcaataggattggcactgactttcattaagttccccagtgcaggcatcagcagctgcccaatcctcattcctcatagtcatcattcacacctgtgctaaaaaggtgagagcaatggccacatttcttcaccatccccggatccacactctgtaccacgtggccttgcaatgcttcctaccaacaggggtagtctctttccccatgtcttgtatctggtgcgtggaccccagaactgtgtccacagagtgtgttagacacgtcacgtaacagtcccaggactggatctcaagaccccttgagcaagtgcagtcctgtccactgaaaattacaaaatgttgttgaaagaagatctaaatggagagacatcccatgttcatggattgggcaactcaacacggttaagatagcgataattcccacattcatctacagattgattgtggtccttaccaaaattccagctggctttattttgttttgttttgtttgctttcctagaaattggcatgccaataaagtaccccaaatagccaatataatctttaaaaaaggtcaaagctggaagactcacacgtcctaatttcaaaacttactacaaagccacagtaatcaagacaatgtggtactagaaatatgatagacatacagataaacggaaaagaactgaaaatccataagtaatcttttacatttatggtcaatcgatttttcaacaaggagccagcccagagaatgcaagaaaacactcaaatcttatatattccctaaaggacttatattaacaatatgtgttgcctgtatcatacaactaagtaagaagacaaacatcccaatttaaaatggctgaaagatttgaagagctatttctccaaaggacatattcagatgctttcagaaatgcttggcaacattagttaatagagaaatgcaaattataaccacaagataccactaggcacaccctggggtgcctgtaatcagaaagacggataagagttggagaggctgtggagaagctggaaccctcgcgcattggtaacaggaatggaaaatggtgcagcaactgctttggagacagtttggcaggttcttggattgttaaacatagagtcaccatatggcccagcaatcccactcctaggtatccacccaagagaaatggaaacatatctgcacatagaaacttgtacatgaatatttatagcagctttattcatagtagcctccaaactggaaataacccaagtgtctatccactggtgaatggagaaacagtgtggtctattcatgcagtgggatatgatatggcaataaaaaggaacaaagttctgatacatggaataacatcacattatgctgagtggaagccatcagacacaaaagaccacagatcttgtgatcccactgatacaaaatgtctggaaaaggcaaatctacagagacaggaaatgaatggaatggttcagtccccggggaccatgggtgggaacagggagtgactgcaagggtgtgcagcctccttttggggtgacggaggtgttctaagcttagcgtcgttaccattgcatgactctccatttgtgaaaagtaattgaattgtatgccagaaatgagtgcattttatcagacgggatcaggcgcgttcagggtggtatggccgtagataagagtgtattttatggtatgtgaaatatatgttaataaagctggaaagaaagacaggaaggaaagagagaaagaagaagacagggcagcggtgatcactcctccctctgttcctgccgtgctgctatgggaacgagcccaggctagagtgctggaggatgagaggcattgtggcccggtcactcccattgccccagctgaccttcagccacccccagaggtgatagtgagaccaccctaaactagtcaaccctcaactgacctgccaggtggccacaggctcataagcaagctcagcaaagaccaggtccagatcagcagaaccccagctgagccagagcctttcaagcaacagtaagtgcccacttaatgtcttcagccacggaggtgcacggctgtgacacagctctggctaactgatgtgccaccccaacagcctatcgcagcatttcattgcagacaacgccaggtggtaatttgggtgaatgttcgcaggggtgatacaggccatcgcattccattttccatcagaatgaggccatcaccacgttcgagcccagtcttgtgaaccaaccccagattatcatagagtcggactccgtttttgctctttgactgctgacaactttcaggtaagcccctccccagcaaccttttgccctgcgtctgagcaagccaataagaaatcctgtgttgtctctcccttggcaggaagttcaaaccgctcaagctccagccccggccccggccccaataaatatcaaagcaatgcacgccctctttgctcagccattcgggactgcttgtgcctgccctgcctcctcagaaagctcattatctgagcaacacaacttcccatacactctgagggtgtgagccttcttcagtctcaacatctggacccctgggtgaagcaactgcagaatgcaggtcgggattctccacagagcacagatcagagtccttctcttggatgcactcctgatgctcagtgtggatcagctcgggtgcagacaggaaacagaaaccactctgcgtgtttctaacagaaagggtttaatacagagaatctgtacagaatacaaggggataggggtgttgctcaaagaccctgacccatgggaagtagctacgacgcctgtaggaacctgagctagacatcccacctgctgcacagccacgaccagggatgggctttgggtggcctccaccctgcaaatcctccatcatctgagcctgagctcctctgctacgacgtcactttgagacagctgctgctgctgccaaggtcaaaagcagagtggtccttcctagcccctgcattctaaccccacataagtgcctccaagtacagaaccccatggaaatccatctggcagtgggtctggggaatgtagttttcagacttctagccccagtggtatggaggagagtgagaagagctggtaagggctgagtagccagaaacaacacctgctataaatcctacagccacacaggcagaaaaatcaagttaccacaaggagtgaaacaacactgaccacaagcttctccacagcaatatgcaaggctgaaggacagcagtgattgaagcattttatacctgtcttttcaaacatgtcagaatccaggtattagggcacctatgagttcttatttctcacacacacagttggaaactgggcacggtggtgcacacctgtggtcccaactactcaggaggccgaggcaggaggatcacttgagcccaggagttcgtggctgcagtgagccatgatcatgccactgcactccagcctgggtgacagagaaagaccccatctctaaaacaaacaaacaaacaaacaaacaaacccacttggtattgaaatgtaacagcaaaattgaagtgaagcccgtgtaggaaatcctggattgcccaacaaacagtatcctacacacacccttaggcacaagcaaaacagggacaagaaaagggattttttttttttgagacaaagttttgctcttgttgcccaggctggagcacaatggcacaatctcagcccactgcaacctccgcctcatgggttcaagcgattctcctgcctcagccttgcgagtagctgggattacaggcaacccccaccatgcccagctaatttttgtatttttagtagagacagggtttcactatgttgaccaggctggtcttgaacttctgacctcaggtgatccacctgccttggcctcccaaagtgctgggattacaggtgtgagccgccatgcccagccgaaaagggaacttttatgaaaagtaatttgacgttgatattcatccattcgtgcatgcagtatctgctgggtgtctgcaacataccaggtcacacctggggacaggacaggggaaatccagtctgtctctgccctactggaccttgggttctgggggcagacagacaataaacagctccagcaatgagaggcaccgtggggctgtgaatcacagagacactcccgcgaccagggaggggtgctgggcaacaggcagaggctttcagacgcgagggagcaggcaagtgcactcacctggaggccgcccaaggagccagcaggagccagggcagggtggaggtcggggagctggaccgtggggtgacctttgaggacttgggctttttctctgaataaggtggaaagccactggaaggttctgctatttccagaggagaggaagaaggatgaggaaggtgaggtctccctgcccctctagctgctcaggttaggatgcacttggtcaggaaaggccgctgtaaggagggcccctctgtttcccatgcttgggccctgaggggctgctcggccagggaaccgcgtgcggagaaaattgacactgagcatcagctgcacttcaataatttggttgaactgcacggaattgctgacaggtggctgttttgacgaaaaagaggcaatttcataccattcaatcaagcaggatgaaaggccgcccagctgcggaggttaggtgggtgagcagaatgcgatggactgggccctggccagcaaggactgacaggagggcgagaaccaggtgggggaagtcgcctcctcgtccctcactatggagttgcttgactctgtccaaagtccattagttcaatgcctgcagccatttgtatttagacaacggcacaaaaagtgtcctttaacatgacactccatgctataggacaggaactcacacagaaccctctttccatttgttgacactcagataaatcgcccacaggatgcctggaaaagccgtgaggatgacgctcgtagtgcagagccaggtgcaggaccgggagctgtttcacagacagccccatggctctgccccaaatcccacagcctgcctagcgggatggggaagacaggaatgcccgtactgtagtagaagtcagcagctctttttggaagtagtttggcagcgcttattcaaaatgcttcattgtcctgcaacccggcaatttcatgtctaggaaacagcaggttggcttggatgactcaggcaacacctccatcattagcagagctcgtgtcagttttctaaaagacagaagccagaacaagtaagggaatttagcaaggttgtgggatataagagcattaaacaaaaatcaaccgcttttttttttttttttttttttttcggagacagatttttgctcttgtcgcccaggctggagtgcaatggaacgatctcagctcactgcaacctccgcctcccaggttcaagagattctcctgcctcagcctcccaagtagctgggattacaggtgcccaccatcatgcccggataatttttgtatttttagtagagacagggtttcaccatgctggccaggctcgtctcgaactcctgacctcaggtaatccgcctgcctcagcctcccaaagtgctgggattataggtgtgagccaccacgcccagataaatcaattgtatttttatttacttgcaagaaacaattggaaattgagaaattttaaaacaccacccacaaaggcatcacctagtatgaaatactaaggataaatttgacaaaagagacgtcaggtgtataaactgaaaactacgaagcatgaactgcacacctaaagatggttaggatggtacatcttatagtatgtgattttaccacaataaaaaattaaatagaataaaaggacagaaaacaaaacaaaaatcccaaaatattaactgtggttgtttctgagtagtgggatgatggatttttcccccttagtttctgtattttgtccttttcaaatcctctctaatgcacaagtgttacttttgcaaaacaaagtagcaaatgtaagaagccacgtgtgctcctttctgcttgcagtataatttcacaaagccctgactcttccacaatgtgtagctctccagaaagatgctttgaagacaaagcaggacagagcgcacggcccccacatctcttgcctgagtcactacattccttcaaagataacatgacccctgccaggagcggtgcctcacacctgtaatcccagtgctttgggatgccaacgtgggatgatcatttgaggccaagggtttgagaccagcctgggcaacatggcaagaccctgtctctattttaaaatttttatttttatttttgagagagtctagctctgtcacccaggctggagtgcagtggcaggatcttggctcactgcaacctctgcagttcaagtgatcttgggttcaagtgattctcctgcctcagtctcctgagtagctgggattacaggcatgccccatcacacccagctaatttttatatttttagtagagatggggtttcaccatactggccaggttgatctcaaactcctgacctcaagtgatccacctgcctcggcctcccaaagtgctgggattacaggcatgagccacagtgcttggccttaaaattttttttaagtagctgggcatggtggtgcatgcctagctgcttgggagtctgaggcaggaggatcacttgagctcaggagtttgaggttacacagtgagctatgatcagacaaccctggagaatcggctctgagtcccctcatggtcaccatgattgttgattaaattaaaaaaaatcaatcactgcgctccagcctggatgacagtgcaagactctgactctaaaaaaaaaaaaaaaaaaattattgcctcttcctacacataagatgaccaacacctgaaggggttcgtgatgatgccgctgtcatctataagcagatgtactctaccaccagacctcgacgggactctgcttcaatgtcactcccgagcatgtttgatgtgctcttgtgcatattaagcccccactctgtacacaagcagtgagctgaaacactgtgttggagcagcctgacagagctgctcccaggctataggcctcaatctgtagtcctcagtaagacttcagaataaaactaactttagttatttgaaagcttgattttttctcctttagtcaacaatcatggtgaccatgagggaactccaagccaactgcccagagttgtccaaaacatcaccaggacccggtgccttggtaccagcatgggccctttgagtccctctgggtccccagtggttaaagaccactgagtgagtctctcctcacacatagctggtggtcttgagatttatttacacatagttgctacgactccttgatgaagggggaagttcttccttgcgacttctgtttcttgagaaggggatttctcctagctgaaacactaggaagaaatgatcacgtgaggtgtctgattggctaggttgtgcccgtgctccccctttccgtttgactctgtaagtaaacctcagcaggacagaagctcttaaaaatctatgagagtttgacctgagtcaactccaaagaccgggaatatttgctccttccagctggattctgatttggcaaccctcggtgattagagggctcgtggaggtgttggaggtgcaatccttgcaatgcacagaggtcccataggaaattccttgtcacaagcaattgacaatcggctcttctgaggccccacaagtttttagataaccagagggagaaagagagacaatgatttaacactgaaatgaccaaaaattggattttcaaacattaaggcatgccaggttttctgggactgcagccagctacatactattgcccattcttgtccacttgtttaaactgatggacaaataacatcaaagaaaattcagagctcaagcaaccaatctgcagctagagttattaacatgtagagtcttctaagttctctctcttttttttttcttttctttctgaatacgttgaatctgctgacttttcttttctttttttttttttttttttgagacagagtctcgctctgttgcccaggctggagtgcagtggcacaatctcggctcactgtaagctccgcctcccaggttcacgccgttctcctgcctcagcctcccgagtagctgggactataggcacccgccaccatgcctggctaatattttctatttttttagtagagacgggatttcactgtgttagccaggttggtctcgatctcctgacctcgtgatccgcccaccttggcctcccaaagtgctggaattacaggcgtgagccaccatgcccagcctgaatctactgacttttctagtgctttccagataaaactcattgtttatggtgttactagttcaagactacctggagattttgtttttcttacagaattcagccagttctaactaaaatgtagacactgaatttttaaccctaaactcatgtaaaactaaaaaaaaaaaaatgtaaaaggggtgttaaaaatcaaactgccatggaaactgctttacccaaaatttgggttcacagccttcattacattactcattaaagcaaataaagtttagccacgtgaacatgtcccaattttgtcagaaatgtaacttggggccaggcgtggtggctcacacctgtaatcccagcactttggaaggccaaggcgggtagatcacttgaggtaaggagttcaagaccagcctgaccaacctagtgaaaccccatcctcactaaagatacaaatattagctgggcgtggtggtgggtacctgtaatcccagctactcgggaggctgaggcacaagattcgcttgaacctgggaggtggaggttgcagtgagccaagattgtgccactgcactccagcctgggcaagaagagcgagagagtctgtctcaaaaaaaaaaaaaaaaaagtgtaacttggatccaaacatcttttataaaccagtgagtttcttattaatgtctcatgactaaaattctaaaatgaaagctgtaagacatttgtgtgtgtgtatgtgtttgatgtgtttacaaatatgtacatttattatatgttgtgtctacgtagtaccaaatgacttataaataaatgagtgctcataaattagtaagcccaaatatttttgaagttcatctgacttaagtaaatctctaagaaataagatgggtttgaaattagtggtaaaataaaagatagaaatgtcttcggaattgtcagcatatgtttttgcctgggttgagtggtcagacaggtttatatgagctaataaatatttaagatgtcagggtttagcatgaaggctataaaactataaacccagccagaaacagaatgatctttatgtaattttttataagaaaaattatttcatattgttggtttaataaaaacagctaaatcttctgagttatcagaaaaatagccatatatatttaactttaatgttcttacttaggtgaacacctaatattcacaggctgtaaaaatggttagcaggaaaataacttataaaatgatgattcactttgtctaatatctcagtttttataattaatctagccaaagaccttatcttgagggtctagaaaagcaatttactaaataagtaaatgtcaatgggataaatgcctataaataaacttttcatgtttgaaatcttaaattaaatgtctccatttccaactaagaaaaattatgttacatgtttctaaaaattataatataagctgtgcatggtggctcatgcctgaaatctcagtactttgggaggctgaggcgggcagatcacctgaggtcaggagttcaagaccagcctggctgacatggcaaaaccccatcactacaaaaatacaaaaattagctgggcatggtggcatacacctgtagtcccagctgtttgggaggctgaggtgggagaatcacttgaacctgggagaaggaggttgcagtgagccgagatcatgccactgcactccagcctgggtgatagagcgagactccatctcaaaaataaaattataatatggttctcatcaataaaattctaatatgtgacagacaattcaagatttctggcttcctaggtttttactaaatttaagtttactaagagttaaaaattctaatttatatatgattctgtatataaatgtgcctaaaatgtgtttttaatttaaaaattatttaaaaggcataaaaatatgttatttattaagaaaaaataatttttgtctaattttcaggtttttaaaaatatgaaacaaaattaaaagaagccagcaagtaggagggagagatgtaaagaagcttacggatatgaagttatatttttggtaagaaaagtttaaaaaagagagagagaataattttgtatgagaaagaatcttgtatggtgaagtttttgtcctaaaggaaaatgactgattataggacaaagcaaaaagtccacacataacttaaatggcctgtgtaaattgtgataaggttcatgaaaagaaaattttataaaaggaattttgtatgtgattaagttagctataattttgaataattatttataacaatctttctaaggtttgagttttgatattaaaaatacactactacaaaactaaaaattggttccctgtattagaacaaagttttcttaaagtcttgatttgctcttagtaaaattataagaggttttgattcttatctgtttcttttcttaaacttctcaaatttacatatcagaagttcaacttttgccatgtgatctgcagccatgtatcattgccttctgttccttttcccttgaaaaggtgtatctttttgtttggctgggattataactctctccttcaatcttttcatcaactcctgttctaactttgctattgtggtctgatgcttaagtgcttatcttcacagtttagaaagcaatgtttcctctagtataactggattctgtgctgttggcttttctttttgtttcctttctttttcagacatggtctcactttgtcaccaggctggagtgcagtggcttgatcacatttggcttttctttttctgtgtgtgtgtgtgtgtgtgtgtgtgtgtgtgtgcagatagggtcttgctatattgatcagattagtttcaaactcctggcctcaagggatcctcctacctcagcttcctaaagtgttagaattacagtgtgagccactgtgcctggttggcttttcttaatatgtctgaattgttcagtgtaaccaggatacttcccacgccgtttctaagagccatgtattcccccgttcaagttactagttttcttgtttacactctcctagaatgtagtgtacactgattaccctggacgcattcttcctgtgtcagattaagtacaaatgccctttcttaatgaggttgatttctaggttacctaaatgggtttcccataaggagaagcaatcacacattacaggaggtttttccttacctttttagtaactggcctaaatcacacacacacacaagattttacattttgtcgtgatgatttctgtgttgtctttattagttttttgattacttagaagaactgagctttgaaagggttaaggcttttacatccatgtaacttttgtattgcctttgaggtcttaattatcactctggttaaacaaataactattatttttcaatgacctgtgattctgttttgatcaagtgctttaaaccttttgacattttttacaggtttctccaggaccaaaatcctgaattaagcctttttgaattacatgattagacttatgtggtaaactgtatgggaaacattgtcaaatggtaagtgatgctagaccttctttcaattacatttatgggtatattattgatatcaatgttccaaaattatgtaaatttaaaaaaccaaatatcagtcataactttgttatattaaaacctgttctaaacctatgtttacatcgatgttattaatgtgagtattttaaagactgcgtaaaatttataaaagccagatagtcctcatgtgacacagtcagtcatgattcttattgttatcttaaaatgctgcaggtaacaaaaataactacatttccttgtactgtgggaacttttatcaaattttaaccatgactaatctaagttttatcgttcaaagttattgttctaaattcttctctacaaacatttacaatcagctctagtccaaaatttcttttcataaaaaagactctaataagtgtgagtacagaaaaaggggaaaaatagtacaattaatataaaaataggccgtctcaaaaaaagaaaagaacacagatcatctcaacatcattaatcattagagaaatgcaaatcgaaaccacagtgagataccacctcccacccaataggatggttgttattaaaacaaaacaaaacaagttaaggctgtggataaattggaacctttgtgcgctgctggtgggaatgtcgtcttggacggaggtatggcagtttctcaaaaaattaaaagcagaatgaccccagaatggatcccacaattttgcttctgggtgtactcccagcaaaaccaaaaggagggtctcaaagggctgcttgcacagtcatgctcatagcagcattaggcacggtagccaggggccatcaacagatgactgaatgagcaaagtgcggtctgtgcatcccaggaactatgcttctgccttaaaaggaaggaaattctgccatatgcaacagcgtggatgaaccttgagaacatgaagtcaagcaaaataagccaggctcagaaagacaaacactgcttgactccactcacacgaggcatccggtcaaactcatagagacaggcagtagaatggtggatgccaggggctgccgggagaagggaatggggagttggtgtttaatggggacagagtttcagatttgccagatgaaaaacttctggagacccagtgtcatcagcaatgtgaatggacttagcgctgtggaattatacacttaaaaatggttaagagaggccgggcgcagtggctcacgcctgtaatcccagcactttgggaggctgaggcgggcggatcataaggtcaggagatcgacaccaccctggctaacacggtgaaaccccgtctctattaaaaatacaaaaaaaaaaaaattagccaggcgtggtggcgggtgcctgtagtcccagctaccagggaggctgaggcaggagaatggcgtgaacccgggaggcggagcttgcagtgagctgagatggggccactgcactccagcctgggcgaaagagcgagactgcatatcaaaaaaaaaaaatggttaagagatatattttatgtgtatttatcacaattgaaatttttttaggccaggtacagtggctcatgcctgtaatcccaacactttgggaggccgaggtaggagaatcacttgaggccaggagtttgagaccagcctgggcaacataggaagacccccatctctacaaaaaattaaaaattagctgggtgtggtggcacacacctgtagtgtcagagagtcgggaggttgaggctggggcaggaggatcctttgagcctaggaggtagaggctgcagcgagccatgatcacaccactgcactccagcctgggcaagagtgagaccctgtctcaaaaaaaaaaagaaaagaaaagaaagaaatttttaaaggcaaaccatgatgattgcacaacaattggatgtacttaatgccactaaactgtacacttaagaatgtttaaaatggggctgggggccgtggttcactccgataattccagaactttgggagctaaggcaggaggatcacttgaggacaggaattcaagactagcctgggcaacatagggagaactcatctctacagaaaagtttttaaaaaattagctgggcccgatggtgcgtgcctgtagtcccagctactccagaggctgaggtgggaggatcccttgatcccaggaggacgaggctgaagtggactatgaccgtgccaccgccctcaagcctgggtgacagagtgagaccttgtctcaaaaaaaaaaaaaaaaaaagcacaagcacagatcgtatcgtatggactgcaccttgcctaaaaaaatttcaattgtgataaatacacataaaatatctctcttaaccattttttttttttatatgcagtctcgctctttcgcccaggctggagtgcagcggccccatttcagcaatctgcggcaatgtgcttgctccgtgaacctgcgcactgccctgcgaggccccacagcccggtggcctcccccgtggtggccttgtctggtgcctggtccatgccatgcgtggctgtgcagctgcagccctcctaggcctgggaccctcgcggctggcgctccaggtcgctgcaccgaagggcacctgcattggaaactagtggctttgccgggcgccttcccaagggactggtgcatttgccttccttctgcagggtctgcaccccacccccatcccaccatccacagtgggcaggggcgctcgttctgaggggctcgccgcactagctcaccacacagtccgttctctttccccctcggcggggcatctgcctgtggcttcggaaggtttccgtttccccaggccttaccgtggcgccaggttcccagcctgcagccggtgggcccctcgcttggccggctcgggtcttcacttagctcagagaaatgctctctttcatgtaatgttctcacctccgtctgtccctccctttccctctgcagctcctggtactcagaggctgtgtcccgagtctcctctccccgtccccggctccaggccctcgtgtgagtctcggcacccgctcccttcccccaacccccgcgccgttcttctgttctgctgcccggttgctctttgggacctcagggatctagctccggaaagccattttgtgccgcactttgatcacgtcaaatgagcatctttgacgatgagccaagcgcctggccactcctctgcgcctgcacgctgtgggtccaggcagggcctatctctggctaccgagcccctcagggctgttgtggcctcgggggctcctggcctccatgatgagtgtgtccttgccagctgtcggggtcaggcccccttgggccaccccaaacctgtgatggacaaggaagcgacctggccattccatcagagcaaggatgccggatgctgcagccccagaggcctctcgacagccttttccagcccctccgtgcttctagaatcctcctcaccatttgggcttccttcttccgcagaaggctttcaagcagacgcttcctggtccccagatcgacagcaggataacaatattgctgcagaacaggtgacccccacaggccacaccttctagcctagagcgagcttcctagggcccctgcctctgcccctacacgtgctccacagcgccactctgcccagaggagaagcccccggtgccgcctagctgccgccctggtcccctggcccagagccgcactgacaccactgtccccagcaagccctcccgtggctccatgcctcctgccggctgccctcctctcagaacgccaccccaagactcacatcctagcccctgaatccaccagggctggggaaccatgaggaatgtcacagggcaggtcccatcctcccgggcctcagtttccccttttgtataaaggtcttcaagtcctggcatccagatgctgtccatccgagacctcacaggtccctgctgacctcaggggctccttggaagaccctgggtctgggggtctgatggggaaggggtgagccctgtgggtcttgggacagctggagttgggcctgtggccaccatgaggcccacaccacccagctgctgctgcctggcctgcaggggttaatgggtctggcccccccagggaccaggctcctttgtggagcctcctctctgcaccctggggcctggtttcttcggagacgcagctgtcagagctgtcgccaagcagaaccagcagacgcagtcccaggggccgaacagcaaggacgcagcaggggaccctggcagcagtgggtgcgggaggtgctgcttcaccacctgagaggggctctgcacccacagcaggcccctgccatgacttggtcccaggctgggtcagacagcgcggtcaggacgcacccctcgggccaggccaggcagggccgaccctttgctccctgctctgacggtgcagaatgagaagaggcaggagtctccggggcatgtgcgcacatggccccgcccacgccgtctagcctgcaggttggcctttgtgcacaggtcactctgcctggaaagtggtggcaggggtggtggcacggctccctgtaaccctctgcctgagtgagcgcctgctgcccagggccgcctcagccaggcaccccccggggctgcagtggccacctcaaagttccctctgcatccagacccttcccatccgagccacaaagccaacagccatgtagcctctgggcccagctgggagcagctccaaagtgtggggaacaggccctgccccgccagtcgccggcacatgcctcggagcctggtgtcccccaagctcactgcccaccaggcttggggaggcccaggtgctcattttggggacatgtgccccagtgacagaggagctctccctctgtatggcaggtcacagccccagacctgtcaacaggaagagcaaagagtggaggcagtggggagactggccgttgggggcccccgcttcatggcagtgcaagacacagcgggctccaggaacttggcagccaggacgggtagcagggcacgcctgtgtgtcctgaggggcaaacaggagtggcacaggtcccaagcccagcggccagagtaggggtgaccaccggggttcctgcagccacagccagaggggccccaggggcctagcaccagcctgggggtgccagggagcctgcctttcttcgctagatttgctgaccacacagcgccctctctgggggcagccactcacccacccacccacccacccacaagggaacaaggctttggtggcagcaggatggaccctgaggcctaaccctcacttgtggaccctggcctctgcatagcggactctgtgaggcaggtgagtggcactcaggaggtgtggaggtggcctagggtctgagggcagggactgccaggcttaccccagggggttgggccagaacctagcccggcttcatgaccacaccatgggggcagtagcactgagatgaagaagagccccatcgtctgccctgacatggcgtgagacagcaagcaggaagcctgctggccgggcctggacctcttgacactgccatccacatgggctggccatggccaggcaccagccaggcctgaaaaggtgcaaggtcccctaagtggggggttatgactgagtatggggtggagggaggccatgaactcccagtgggctcaggacactggatggcgagctcagggtggggggcggcaggcccgcccaccatggacacacgcaggcaactgcagaggctctcagctcaacccatgcacacttggtgcatgaatgatccctgagtgccacccctccacctccaacagccacacacccttacacgggcatggaggccagactacgtcctgtgagactccaagccagatgcatctcccggaggttacaggggcttccccagaatctggggaacacattggcacagccagaaagggccaggcctgtgggacacttcctgcagaagtaactgggcaacccagccccacctatgacacccgctatacctgccgcacctacttactgctcaccctatgcctgatgggctcctgtgggcctcaggacagcccctgccaggcccttgcctggggccccctcctcagctgctgatgctattttctatctcttgtcctggggggcagcctggatcatttcttctcacctgtcttctagttcacaaattctctctttagcagtgtctaagcgtggctgccaaactacttctggagtgtttggtttgaaggctgtatttttttttccatttctagaagttctacttggtgctaggttgaagtttggcctatcagcttttccaagccatctttgagcacagcaagctttttacaatccatgtctgagaattccagtacactcggatgcctctgcacacatttctcatggctttcgatcatggtgccaggttcccgtgtacttggtttgattgtggtctactcactgacctggaaaactcattcatgaggtgtacagatgtctaggacaaaggtgatttgcatttggttctaccaggaacctagggaactgcaagttaggtacacaccgtttaaaaggaaactcaaagcctgccgtctttttggccaacctggtggtgggaacatgggcttcaggtccacacgagtcatggtgtacacgactcctcagtggctgcccttctgcctgaactgcctggccaaccccttggggccacggcaggaggtgggtttaacccttgcccccaccctgagggcacaagccttgggcttgtgagcaactgatggcaagcagggtctcctaccagctcctctgtgtgtccctgcagacctggctcaatacaatggagaagccgatgggaggactccagccggagtgagggagactgtccctctagtgcacaccatagctcatttgcatggcttcctggagtccacagcagcagtgctcaacaacagacatccagagtaacttctgcagcaacgagcgggtcttaaggaattaccaggtcaaaatttttattcgttcattcatttattcatttgttctgcctgtgcaaggcagcctcactcccaggctgtcagcaggactttttttttctcttttgtacagatctggttcttggctttgctccttgactcagttgacctcctacccctcacagcagggtaaagacttgcacatcactgacaggcggctcggagtcagccttggagtcggccttccatgcccagccctgaggccaccatgccacgttccagttggctcaagcagtgaggggcaaaaccagctccagggccaggtggaagggctgcttctctcctgcctccatcaaatgctgaccttgcctctgaatgaccaagcaaaacaaaggaataaatgaatgaataaaaattttgacctgttaattccttaagaccttgatacgtattcgtgggtaagcaattttatactattttataaaactgttttcagctgttttagtcagggtcgggtgccaggcacctagacacccccctccccattcccaggaaggttttggccaaacctgcatccaccaccttggcatgccaacgcattcgaggccctggcaggccccgactcaacagaaccgtctcgccctctacagccaccacagccacgtgggccaatacccagcacgcgccccactgccccaagcctctctgccggcgtggctctcccccaacctcactctcaatacaaaagggacagcaccgaaagaacaagggaggccggaatggtggcattattcaatcaaatatacagagtgcttcctttaatatgtacacatttacaaaaatgcactttcacgaggaggggcggccggggccggcaggtgggcagcgcctggtgccacggcacgcgtggacagttgcgaggggtctgtgtgaaggcacttgtcacgagcttcaatactgccgccgtcccaggatgggagaactgcgcagcaggaagggcacttctgaaagcacagtggagagatcgctggagcgggcgttctgggcaggaggaagcacagacggcaggcagggtggactggccagcaagcgcgaggttgacctgccagccttgggccacgccgatgacctcaggccccactaacaaccacaggtgcgtcaacagccacgggccgtgccggcagccagggccacatcaataaccagggtcccaccgaccaccgtaggtcccaccgacagccacaggtcccattgacagccacgagtcccaccgacagccacaggccacaccatcagccacgggtcccaccaacagccatgggccacaccaacacagccatgggtctcaccggcactttggcctggagccacagagaaacccgagtgaggaataaaaggaagattctgtaaacagtgcacaacctctggtaacaaacgctacgatttggtgacgacgcagacaccctttgctctctcctttcatacagcgagtgccacgcacggaaactttacaaaaatagcaactatccgagaatactccattgttttcagcctgacagttactgaataatttatacaaggttaaagaaacgtagaaaataaacatttggtttttgtttttggtggtttttttacacaaaataaagaaactatgcacatggcctcggcctccgggtccggcagacggcatggctcccaccgagggccctgggtcccggcccagctggcagccgcccctactccttgccggcgtagcgggcctcattgatgctcctgaccgcgcggttgtccactttggggcctgaggcccagtgggccggcctccccggcgagcggccaggatctttggtgaatttgtgtgagaggaacttctccgcctccagggagtcctcctcaccgcggcccagatcctcgtcctcctcatcctccctgacggccgcgtggccggccggcccgggcagcgcctcgtccgccctgcgcggcggcggcgtgaagttcttgcactggtagagcacgtccttgtggccccccggccgctcaatggggttgcggatggggttgagcggggcccactggttgttggcgctctcctcccgcggcagccggctcctctcccgctctttcctgcgcttgcgtgtccaccacacgcacaggaccacgcacgccagccacagcacgctgaaggcaccacacagcacaggcaccagcagacctggggaccggggagaagagccggtgggcaatgaggcctgggcacctgcggggcactagccacacacccaggcctgggagggccctgcgggccaggcggccgggccccaccctccggttgctggctcgtggggagggtcccaggacgggggctgggaaggtcaggttgtggggctgggcggctggggcagcaggtgccagggacttctgtgttcctggtggctggcaggatcggcaggatcggccggctctgtgcccaatgcctgagttgcctgcctggtgccttcccaggggcccacctcccgcgcttacctgtggaagagccgcccgtaacaaccgtctccaccttgacctcggtgacagccaggagcagtgagctgttcccccgctgggtgatggcggccacgatggcgtgggccgcgccctggatcaggctgctgtcaggcaggtccctggcagggctgaaggactgcggcaaagaacggcattgtggggatggctcgagggctccaggctcccagcagcctgcccccaacactgaggccctggccacactggagcaaggtgggcgcacgggagacgagagcccggggtcctgcagtggcgacttcaccaccaggcagtgagtggggagtagcggggggaggagtggaggggtggaggctgtccccatccgggcacacaggagagcccagggtcctgaggtgtggggacctcaccaccaggcagcgagcagtggggggaaggggaggggtggaggatgtccccatccgggcgcacgggacagcccagggtcctgcggtggggacctcaccagcaggcagtgaggggtggggggaagtggaggggtggagggtgtccccgtccgggcacacaggagagcccggggtcctgcggtggggacctcgccaccaggcagtgagttggggaggtgtgtggccccattcgctgacacctgctccgtgatggccatcccttcttgtcagttcccagcccccacccccacctatgggccacaccccaggggcaccacaaacctagtgccttcacgaggccacagcaacccggggctgtgcccctgcctccaccacatccctgatggcgccctgacctgtgctggcacacttcttacatcttcccctgcccctactgcccttccatcacccagcagcacccatccatgtcccccaccccctctgcggcctcagggcaccaaaacactgcacgtccttcctgtgcctggccatggcctccaccagccacactgtgccatggccacacccactgctctgcacacccacccaccatgttccagaacattccctcccctctccgggcatgtctccaccccagtctcacccgacccccttggtatccattcacatctgacaccccccaggtccagggcaggtgccagtcccaaagcaggcctcccagggcagactaagcccacggactctcctgctgcctgtgacgtagggacacagagacaaaaacagagcaggggaccgggcgaggatgcagctgcaggggaagcgggctccacaccacagccctgcatctccctcatgctggccaggcccagggagcagttccacgggtctgcggcatggacagcgaggggccgcagggagacaggcctgcccgcagtccttccgcaccaggactagcctcgccagagcctctgtccagcatagccaggacctgcatagtacgggacccagggcccacccaggtgctgctccccactgggcactcaccacggccacctccacagcactggcccccgaggacgcccggtcgcaaagcaacaccagcaggcggtcccgtgccacagcccttgtggctggcagggagcggatcccggagcaaatggcgcccaccgtggtgccctgggcagagacaggcagtgcgtgggcagggcagggccgtgaacctgacacctacatccctggactggcgctgtgggtacacgtgggacacaccctacagcccgcccaggagagcacagcaaggatgccaagggcctgggggggcagcttcccacccggctgtgccctataccaggaggcaggagtgacggtgcccacccgcccatcctcagggcggacccagctccacctgcaggccagtgggggaaggagaggcagggcggggtacagtgggtctcctccagttctgagcccctcctgggagacaggggcccagctccaagcacacagcaggcaaaggtggctcctaggccagggcaaaactgcccacggagctacagcccaagagctggggccaggcagccatggcgccgtcagtccaggccctcagggcagctggacaaacaggcacccccagctggctgctctcccagcctcctctgccacctccacccagcaccaggcccaatgcccctctcatctgaccccacagggccactctctgtgaccaagagtgactctgctcagccaaccagggcctccctgccctgcggggctaggctttcgccatgccacgagcagatgccggcgtgtggcctctgcaagctcagatgccaccaggcccctcacctggggcacgtggtcacggttgaaatgcaaggtgaggcgggcacagttattgtccaggtggccggagcgtggcaggcagggggtgctcggtggctcttctgcgccgcactccccccaggcctcacagggtggtcgcagacactggcctggggccttctccaggcacctttgccccagtgggcactgggcgctcagggcctcgggctggccggccagcagacaaggcttccatccgcaccacacctgggcaggcacgcacaggagggtcaggcgcaggcgcacaggagggtcagatgcaggcacacagatgagaacccacaggcaggcacgggccccatgccaaggagggacaccgcccaagtctgtgagccccagggcccagcccaccccctacccagggctcccagggaggcaggccaagctcgacatcagaaagggcaggcggagcaaggcaggacccagaccaggcctgttttcccaactgcacatcgaagcatggggcctggctgagctctcgcctccctgggtgtccctgagggcagacggctctcagtccatccggaccccagcacccgcctcctgatctcacagagtggccagggtcagcgtgcaccagcctcgggtagggcagggcggctcacgggctgccctcaccttgctgcagtcacggcggccatccaggcagcggcagctgttgcagtcttccacccaggagcttccgtgtgggaacggagtgccccgggaccagcaggatctcccgaacccgatcactgtggggagaaggggctcgagggtcagcagtgggcatctggccctcggggctgggtgtcacccatgccccccaacccgccccaacccagggcaatcacacggggcctaccttcctggcaccgggggccggctcggccgggtgggcagctacagcgatacccgttgatctcatccacacacgtggccccgtaggcacagggcgaggactggcactcgtcgatgtctgcagggagagccaccgctgctcagtgcagtgaggccaacgcccaccgcaggaccggcatggcctagggcagcggggagccagtggcacacaggcgcaagccccaggacaatgaggagcagcccctgcccccgagcccaagctgctgcctgcctgaggccttcctgagcccagcctgaccctggcccaacagcaccctcctccgtctgcttctgcagtgggcctgtcccatcctggattagccccagctgctgcgtcggaccagccaaggggtgctggacagacagctgggccaacacccagggacaacagccctgcggccacagaggagcccacgtcaggctgcacgctccaacccccacagctccctgggccccggactggtcccccaggctggggctccccacttaatcacttggcagggtatacagcaggaaccccacagggcacagacatgtggggaaactgaggctcagaagagaggcaggaagtagttgtggccacactgcccttcaagggacgtggacgttgatgtccccagactcctgacaccgcggctgggctgaggggctcccagggctggggctgtctggccactcactgatgcggcagtcaggccccgcgaagccaggtgcacactcgcagcggaaccagttgacgccgtcaacacagatgccaccattgtagctgcagagcagagggtgggcatcaggtggccccccgtggtatgccaagtcccacccacccctgctgtggcccccagggtgccactcaccaaggcagagggttgcagtcgttggtatctggtttgggagaagagaacgcaggggatcagtacccaccccccaagcgtgccaggcactgtccaggctggcttggcgtgatcaggctgtggggctggggagggtcatcaaggagggtgccttttgctgggggcaggggcagcagggggaggggctggcagaagggactggggggcgagtcgggggcagggatgtcatctgggtggaggaaagcggcccccgcccacacccctcccacactcactgtgagtgcaagtacgaccctcccagccgtcccggcagatgcaggagaaggaggccccgctgcccacgcaggtgccaccattcacacaggggttgggcaggcagctgctgttcttggctgtaaggagaggaggaggagggagcgtctcacctggccctgggctggccctgggtctccataccgcgcccccaacccagacagggcagacagacccgggggcagggggcagggggcaggtggcaggtgtggccctcaaaaaagacccctcggcccatcgcgcccgagggagcggtgcctgggagggcatatgcccggcggtcgcagaggcagcgggggctcctcaccgacggcgcaggtgctgcccttccagccgggggggcaggcgcagcggaaggtgtcgccgctgtcgtagcaggtgccaccgttgctgcaggtgtaggcatcgcactggaactcgcctgttggcacatgggccgctcagcaggcaggccccagaccgccagggccagggtcctgggggcagccccaggcggccagggcctgcggacactcacgtgagtggcaggtcttgcccttccagccgtcgtcgcacgcacagtagaagtcattgaccaggtcgtagcagcggccgcggctgtggcagggatcgggaaggcagtcgttgggatctgggggcgaggacgccggtcagcgggcggggggtcaccggcgctcagggagggcttcccgggggaggaagcactggagctgggccaggtgaggacagagaggggcgggggaggagcgtcgggccgggggagctggcctcgggcatgggggcagcctgggactccaccccatggtggcagcaccccctggccaggcctttctgggtacggggcctgccgcacccagacagcggtccatctcagggtgataaggggcccacaggggtggaggcacaggccgtgtgggcgggtgctggaacactcactggtgtcgcagagctcgccctcccagccgctggggcagaagcagcggaaggcgtccacctcatcgatgcatgtgcccccattgcggcagggctggcccaggcagtcgtcaatgtctgcagaggcgagcggggtgagccagggcctcaggccagcccagccccaccaccagcccgccgttcgtggccactcactctcatggcagtaggtgccagtaaagccactgtcacagatgcaggaaaagttgccccctggctggctgacgcagcgtccatgggggccacacacgccggaggctgctgtgccaggcatcccaggccccgcgtctgacccgcagccatcgatcactatggcaggcagtacagtcaggagtcaggcccgcccctgccccaccacctcccccaccaccccatgccgcacccagcacctctgcaggccccgccagggcacggctcgcggggcacggagcagttcttgccaccaaagtcatcagggcaggcgcagtaatagtcaccctccaggttatagcagcgagcgccgttccggcaggggcttggctcacaaaggtcgacatccacctgcagggtggggggtgcctgtgagagcctaggcccaggcccaggccgggaacacaggccaggcctctgtccatacgaaggtagatccctggggacccccaggcccctccgccctgggcctaacagtgccagccagagcccaagacccctgcccacctgagactgcccaggccttagctgaacgcagatacctgtgggcccccacccccacctccactgcagcccagcttcctcactgtccctcgggaggagtgtggccttggcccctgctgctggcaggaaggacagctcctgagcccctcacacactgcctggccaccctcagagccaagactgtgggtcttttccagggccagccactgccatgcttgcaggtcctgaggtcagacccctgccctgggccccaagaagccctctggacaggaggcccatcctctgcaccaaggccagggcaggatcgtgggcggccgagggtggtagggaggtgggtggggggaggcagggaaaaaggggaagtaaggggagggggtggtagggaggcaggtaatggggaggcagggttgggggaggtggggaagggggtggtagggaggtgggtggggggaggcagggttgggggaggtggggaagggggtggtagggaggtgggtggggggaggcagggttgggggaggtaggggaggggtgatagtgaggtgggtggggggaggcagggttgggggaggtggggaagggggaggtggggaagggggtggtaggggtggtggggaagggggaaggcaggttactttggaggcaggggggaaggggaggttgggggagggggtccagtaccaacagatggtcagagggaggcgagagcatcagccctgagagagatgcccactccgacccaggactcacctatgacaggtgtatacctctccaccatcaggcacccaccctaccccatgtgctctgcccaccagagccccctgccctccagtcccgagggagtgcacagatggacagataggcctgggcagccagcagcccgggggctcctagcccaggccaccaggaaacccatcacaacaagcaatggccacagggggccaagcctggtgacctgtgacagccccgcctgcccacctggcacccagtggagagctgagcctgggacgccttggggacaacttcccctgcagcacccctgggtcactcaggccccatggtcaggggacgaggcctgccctacagctcccagagcagcaggtggggcagggtgaccaggcagacctcacctcacagagaggcccggagaagccctgggggcagtggcagtggaagccgtcggccaggtcctcgcagaggccgccgctgtggcaggggctgctggcacactcgtctcgttccagctcgcaatgccggcctccgaagccccgtgggcacacacactggtacccgttcaccaggtcctgggcgggccagccaggtgagcgtcccgcaggcaccctgacggccccgcagcacccacgccacacaccctcctggccccgcctcaccttgcaggtgcccccatgctgacactgcccgcgacagtcgttgacgtctgggggcagaggagcagggtcagaggcggggtcccatgtgcctcggcccacccgccggcgcccaccccccatactgactgatatggcagttgatgcccttccagcccgggatgcaatcacagtaatagccgccaatcaggtttttgcaagaaaaagcgttaaggcatggcttcccttcacactcattggcgtctgtgaaagagacaaggtgggagccgtggggctcgggccctgcctgccccctgcagcacgggcacctggcacccgcagcccagcagccccagcagccccagcagcccccgcagccccagcagcccccgcagcccgcatgcgcggcccacgttcccatgcactcgctcggagcccttacccagctggcaggtggcccccacccactgctcggggcagatgcactcaaagccgtccacctggtccacacaggtgccaccggccgcacacgggttcgaagcacactcatcgatgtctgcagagggtggagaaaggtggggccctggcagtgtgagccgtgggaataaggtccccatgggcaggtggcgctgcaagcctgggtcttcctgccatttgtcctcgccaagccagccgcagccacacgtgtggacttgaccactgcaccccatccccagcgagttgccccactcccagacccccactgatactaggcaggagtcccctactcacgtgcagacactcaccaagggcacaggtgggcccgctccagcccgatgggcagtggcattcgaagccggacggcacctcatggcaagagcccccgttggcacacgggttggaggtgcaggcgtgctcagctgtagaaccgcggggagggggcagagctggcagccaggcccccagctttccacaagcactcctccccaagcccacaggttcccaagctgggggtcaggggcccaccacacaggacgccagagggatggggcctgaccggctccccagggaaccagtccctgcctggccagaatttgggtggccagccccccacgtacccttctcacagttcctgcccgagtagccgtcagggcaggtgcagcggtactggtcaggctcggcgttgatgcacgtgcctccgttggtgcaggggtggtggctgccacagtagttcaggtctgggggcaggggtgggatgctcaggggaaaagccggccccccgctcccccacaacccacacttcgatggcagagcattaggcctgccgccccctaccactacctttgtcacagagcaggccgccccagttggtctcacagttgcactgccagggctccacacaactgccatgcacgcagccggggtaggggacacactcatcgcagaacctcccttgccagccgtagctgcacctgggggaaggaggaggggcgcaagacccagtgagctgtggtgcctgaaagggtggcaggggagccaggcacagtcacccacgccacacccagggccggcgggcggcctcaggcctttgaactggagcagccccagccaggcaggggttgcagccctgccggccagccccactgtcacgggcattcccggccgctggctgccgacggtcagccccagctgtcccgtcactcctccctgagctattttgggattcacccgtgagctgggccccgagagcaggcaccaggaaaggaaggccctgccgggaccccggggatgagaatgccggctcggactcacaaggtgctgccagggccgggaggcaccaggggctgggtaggccagcgggcagcaggggagcactcctggctctgcctcggccatgtggccctgggcacagcacgtgccctcgcccccacctcaaaggcagtcatttcgctcgctcccagtaaagtcccacaaggtacccatctcacagatggggctactgaggcccacaggctggcctgggccagccctgcccagggtagttcctgattctgcaggagctccagctgcacccccagctgcaccccccaggacacaaccaccaggactcgccctgccccaggctatcggccaacgtcctgtcttgggagtcccccaggagagggcaggtggccagggtagaacatggcctgacttgagggtgcctccgtcaggggagagagcctgcaacgaccccaaggctcagcaggctgccatccaggccctgccgggactcccggggggcccttcctagaactctccggtcctgcaggacgggaatgtcatccaggccacgtcacttccacaccggcacccgccacactttatttttgtaaaaggaaagaaccacggcccttcctgagccgccctcaagccacacagccagcaccgaaggcctatcagcccagttcagctgccacaaatggggaaactgaggccgggaagaacgtgtctccagtatccagcccagcatgcacagtggtccgcgtgggtggcctcacatcccgcctagaatccctcctccacagacacagagacccaggctcagggcggggctgtgacacaccttgggtcatcggccagagagcggccacagccgggctcagagcccagacctcgtgggtcccaagggcgtgctctcgaccctgggcagggcagcccacaccaggcccccacctcctggtttccccagccagcagccccagggccctggagaggcggcggcaggaaggcatggccatctccgcagcatccggtgggggggcgtcctgcactggaacctgagccgaggctgtcagcaacagctgggcctccccgacagggccagcaagaggggcaggcggagctcacctactgcccccacccaccaggccccccagactccggctcatcttcctgcgggtaaagggcagggatggccaacttctctgctgccttcctccagccttggtgtgacattcaagctgccagccagcagccatccagggagggtggcactgccatccaggttgtgtgatgcacactgggccaggcgagggtgagtggggccgactcccgtagatctacatctacatctgcccagaccaggtccaccttgttgcactttctgagctgacttgggactcgctcaacctgccgggaatccctgtgtgtgcaagtgaccgggtgggcggccccagccctgcttgcctccccgctctgggactggccgggaaagctcctcactgtaccctccaggccactcaaccgtggggcctgtggaagggtcacccacctccccaccttggctcccaactcagctggttcccaaactccccgactcctctccaaaacgccacgctgtgtgaccctggggaaatcagtaggctctctgtgccccagtgtcctcgtcccatggaggcaaacccactccacagagggaggtcctgggacccctgcaatccaaggctggctggagggcggtgctcacctccacctgctgtctctccacccgctcgcgcccctctctcgggctccccagcttgctcacgcacagtgagcgccacggctcgaagcccgtgcccaccccagaccctgggccccagcccctctggttgccctgctgacttctctgctccactctagggcaaagctgccagcccccctggctggatcccccacactctggtctgggtccagaggcctccaccatctggacttggctgtaagaccccggacactcccttgtggaggcccttgctgactcctcatccatccgccctgacctgtggcagccgggacttgctccttggcctccctcctctctgccttccccactttcccgtcaccgcctgaatgccaccccccacaggccccgcgtggcgcaggccaggcctctcccacgagctttctgggtgtctccagggacagggcaggcatcgcctctccacatccagctaaccccggccccgcctgctcctctgtggcattcctcctgccaccatggctctgctactcagcagcttggggttctccctgactccacacccttcctgcttgatcaaatccatccacaaacccctgggctccaccccaggatgtctgcaggacccgtgcgcctctcccccttccactgaccccctccccatcccgctggcccctcccccaccacccccacatgccccacagcggcctccccctcacagcctcccgtctggtgcttccccactcaacagctaccacagcccttccacccaccttgcccagctacaaacctgccagcagccccttcctctgtccctggtcctgcaggcctcagctcccaccactggtctgctctgccgcccctcgcctgctggtgtcacttgccggccgctcgccgcccaccccctccccatgggcagggttaccgtgtcctctgcccatgccccatctctgggtggcttgcagcctccgggtctctgcccctcggtgacgtgactgtccagccagcctccccagtctctcctcactgtcctcacatggctgccgccatcagacacatcccatgctcagacacgcacctactgcactaaggagcctcccgagctcagggcccggctctcacagctgtgtgcccaacctccagccagctccgggcgactcctgacagcaaggctgtgtgtgccagtgaggacgtgagggcaaaggttgggagggcaaagacgggccggcggcacactcacctgcactccccaggcacggtgcatcccccgtggagcaaattacacccttgtttacacacagctgcgaacagagaggagcgagaggcacagctgcagccagcctggccgcaaggcctgtgcccggggccctgcccgaggccctccctgccctccacgcagcccagcggccccctcaccttccttgcactccttgcccatccagccgtccatgcaggccttgttgccgtactggtcgcaggtgtagtggccgaaaaagtcgttgcggggccggcagaacttgttgcaagtggcgctgtagtagttctcgtcgcagcgcacgcggatctgcagctccaggtgcgccacgtggccgctgaagtgcaggctcttccagcggtcctccgggttgatcatgccggcatgcgacactcgctcgatcagcagctcctcttggggaggcggcagagtcagcacaggccagagaaaccagcccggccaggggtcctccaggaacaacggggacggggcagaagcctgcggctgctgcaaggccggggcacagcaggcagcagcacacggagggcagggcccccggccaggctgctacagaaagctcagggccccgagaggcctctccctcccgccaccaagcctgcgccccgctcccaccctaaacgcagagggtcggggggcccggctaggggctaggggccctgcagggagggctgctgagaccacaggctccacagagaaggcacggctgctgccagggcgtgagtctcacgtcccacacctgtgcccacccacctgcagccctgctccaacacctgcacccacctgcgccgtgtccagccctcgacagcacggacatggtgctcagttgccctcccctctcctgcgctgtgacttgctcccagaagtgccaaacaccactaccgtccccaccttaagacaagcctcccctcaggcccccaagacaggcataggtcccgtgacccgctgtctaagcctcactttaagtaagccaccaggagaccaggggccaggggcaccacagctgctggcgctggtatgcaaagtccgtgatgccggtccctgcgcttaggcacaggctcgacgttttgcacaataaaaggtgaacgggtcctccagaccccacctctcccgcctcgggccaaggcctgggaggacactgtgctggcccactccccaaggggcgtcccggccgccccagcctctccaggctcacgttgtcaagagccctgacgaccttgcttgggactcagcccacctgtctctctgccaccccctcaggaaacacccctgccctgagccgctggggtccccacaactgctgctccccacctgggcacccccaccgccgtccctgccctgaaaacagcccctccactctgctggcagccaggatgccctggccccgctctccctcctccaacccattggccaaccccatgcctccacttctgagagcccctctcacccccagactgcccctggtccaagtcaccctgacacgcccagattcacgtggcagctcctcctcggtctgtgtcctggccccacagcccaccctccataaggcagccacagcttgccaggcggagcccgtgtcctctcagtggcttgccagcctccatgatctgagcccagccccggctgctccccctgcacagccagcccgctcctgcccagaccttcacacgagctgctcccttggcctgtgggtgcttctgcattcacccatggaagtcatcccgttacccctgcagggccctgcagagcccctgcctcagggagagggccaccaaggctccatgctccagtacagacaagcagagggggccacaaagccagagacacactcaagggtgtcccctccactaagtcactgccatgggccccaaaagagcacacccaagaggagaacaacataggcaaagccaggactggggaagagagtgcatgcacagctctgcaagtcccaaacgtggcagagcttcctggcagccaaagcaaaaagggaaacagcacacatgatcctcagggtaaagcaaggctttgtcccaagcagacagaggagctgggccctgccacaggcacgctgaagctgagaggagctgccacctggcccagggctcactcaccattcggggtggtatcgttgtcccagtcccaggcctccacgatgagggtaaaggagcgctgcagacatggggaggcgggtcaggtacctgaggccacacctgcctgcctcgttcagggtgggacaaggcccagggctcagacgctgcccctgggtctgccaggctctggcccttcctccccagccagggacccaccaccctcctcatcctcaggccacatcctctgcagacccaaaaatgacccagctcaagggagggagactgcccctccaggccacgcgggctcaggggcctgggctccctaccgttggggtgccagaggcccagcctgccctgagctggctcaagtcagcacggagcacaggaagagcgaccggggggagaggtgggcaaagggcagcctggctggagtggccacagacaggggccccatgggcagccgggacccgagcgtttcctgtggaacgccccttggtgcctcactgggggtgaccacgggggagaacgtggggccccatcaccacgctggcggcctccaccaagtgcacggggtggccaagtacagggcgcccagccagaggccccaacaggccggagctcaggtcctgcaggcatacagcacacaggcaaacccacacctacctccaccctcacacagaacaggtggcaggaggggcccttgcggtacagttggggaaactgaggccaagaggtcctgggactgcccagcacagcctcagaccatggccactatgccccctctgcccccgggccacctggcccttgtaccccagccatggcgacaggcgatgctgtcagccaagcaaagagaccacagggctggccccctgctccgcctagtgcagcccacggagaccgtcactcacagacatgctcagacaggtgggacccccgggacatgccctgtactacccagcactgggtacccacattccacagcctctcagccctcactgcccaggaaccccccagtctacccctggtgtgctcttgacccctgagcccagccctggctccttccaggtggggcccagaggagggggctggggctgagtcacctcagggcctgctggcttcccaccccggggggatgctgcgttgggcagtgtccaggcaggccaggctcactccatccctcagcacaccccatccaaccagccccaaggcctggctaagctggggaaaaccacacttccccagcaaggcccaaccccacgcctgccagcccttccctggtcctcacccgccgcccaccccacgcacgtcccagtgcctcggcctcatccagctaaggacaggcctggcctcccaagatgtctcagaagactgcactcccacgtccagcccctcccctaaccaacgtgctaccagccacacccagcccagcctccaggacccccacccagtcccccgccccacacctccgactgtccctcaaatacagacaactagggcccaacatgactgctgaccctgggcctcactcacagctgggcaaccccggccccgcccccgagcccctgcctgcagaacacccggggacggcccgaggaggctcacccaggtaggagcacaggatggaagtggggggccatccccaacccgctcctagaaccctccctagccacgtcgagctgacaacagaccctcaatcccacctcttaagctccccttaaacccgttttcccacatccgccatggccccgccaggccacggggcccagtccccgcccatctccagggctccctgaggtcaccagggcccgcaaacctctgcctacaggcgccagacaatccccagagttccatccacatgcctcccaaggctccgtccacaccccccgccgagctctgtttacaccccccagagctccatccacacccccaaagaactcaatccacatcccccaacggggttccatccacaccccccaacaggctccatcacctccccagggctccatccacaccccgcaacatgctccatccacacccccccagagctccatccacacccccccagggctccatccacacccccccagagttccatccacacaccccaacatgctccgtccacacccccccccagagctctgtccacaccccccaacatgctccatccacaccccccagggctccatccataccccccagagctccatccacaccccccgagttccatccacaccccccaacatgctccatccacacaccccaacatgctccatccacaccccccaacagggctccgtccacaccccccccagagctctgtccaccccccccaacatgctccatccacacccccccagggctccatccatacccccccagagctccatccacaccccccaacatgctccatccatacccccccagggctccatccacaccccccaggactctgtccacaccacccccaggactgtgtccacaccccccaagggctctgtccacaaaccacccccgtcagctccatccacaccccccagggctccatccacacccccaccaggactctgtccacgccctctcagctcagagcacccttggggttcccaaggctcctgcccacccccacccacccaccccagcctatcaacccatctgcctggagcaccaccctcgcagctgcacctggccaagcccttccccacccccggtaacacctggagcacccagccgcttcccaggcgtctggcatttggctccttccttcgttccttccttccttcgttcacatcaagtgtacagcaggcatgcctctgccaccaaggacggcaacctatagccagcggggctcggggaaagcaacagggggcaggggctgttgttccaataaggccaggccaacgggtcacagtggctcacgcctgtaatcccaacactttaagaggctgaggcaggcagatcacctgaggtcaggagttcgagactagtctggtcaacacggttaatcctcatctctactaaaaatataaaaattagccagccatggtggcaggtgtctgtagtcccagctactctggaggctgaggcaggagaatcacctgaacccaggaggccgaggttgcagcgagccgagatcgcaccattgcactccagcctgggcaacgagggcaaaactccatctcaaaaaaaaaaaaaaaaggccaggccaggctttgaacaggtggcattgagattgaggctgcagggcatgaggaagtgaaggagctgcatggcagagcccacaagaaggcccaggggctgagaacgcatagcccacggggacagtggggtcataccacagatccagaccccaccacggacttccttcctgaggctaagcgaagtgggtgactgttgcgggtctgagtgaggtctgttcgggtgttgggggtccgagtgaggtctgttgggggtctgagtgaggtctgttgggggtctgagtgaggtctgttgttgggggtctgagtgaggtctgttgttgggggtctgagtgaggtctgttgttgggggtctgagtgaggactgggacccaccaggctttaacagtcactgtagccgctggacaggaaccagcaggaccaggaagcagcaatagtgaggtcagaggatggggccagcatgggtctgagagcagctctggccacggggcaggcagagaaaagccaggccacccggtctcccggcacagccacacctgggcttcagggccagcagggagttcctctcgactcccaggaaacctcatgccagccactcaggtaagattactgccaccttcgcctgagcccagggctccggttacctgctcccgcagggacgtgtgcctgcccgcccgccgagagggcctcaccgcccgccagctggggtccctacacctggatggcaggaagtcatccagagtgaacctgagctggctgacggggcggtacctgcctcaccccacctgccagctctcccagctccccttcttccctaggggccagcctccaggacttatttgcctcttctgtgaataacaacctctcacccccgtccttccaggactcagttgcctcctctgcgaatagcaacctctcatccctgtccttccaggactcagttgcctcctctgcgaatagcaacctctcacccctgtccttccaggactcagttgcctcctctgcgaatagcaacctctcacccctgtccttcctgcctggcgggccacgatctgggacagggttttgtcaacaccaaacccctagaacacaggagggactatagggcctggattgggcgggggttggcgggcatgttgcccttctaggaacggggctgggacatgtggggatgtgggcctggcgctggcaggggcaataggcgatgtgtgggctgggggtctggggacaggtgagagacccatcacctgcccaggttccccggcaagcagggagaggaacccaggccctccctcaaggccagcctagcagggctatgcccctgcccagtctctggaggccaagggggaagggcttcacccctgcaggcccagctaagcctctccctacaagcccggcctgacccacccccaccgcacaagcagacccgcagcccaacttcatctcccaccatctgattgcctcctccccagcccgaaccctcaaggctaagtctaaacccctcctcctgtccccaggcaggggcaacagcagtggcacaagccagaggacaggcagacaagacaatagatgttccaccccaggccagggcacctcaaagcccagggtaccccaggtccagggcaccccaaagcccagagtatcccacagcccagggcactgcatggcccagcatactccaagacccagggcaccccagttccagggcaccccaaagcccagggtaccccagagccccaaagcactgcatggcccagcacaccccaaggtccagggcaccttaaagcccaggacacctcaggtccaaggcacccaaagtacagagtaccctcctgcccagggcaccctagatccagtacaccccacagccttgtgcaccccatggcccagtgtacccacagtccagggcaccccaaagctcagggcactccaggtccagggcacccccagcccagggcactgcatggcccagcacacctcatggcccagggtactccaaatgccaagcaccctaagtccacggcaccccactgcccactgtaccccaatctacagcatcccaaaactcaggcaacccaagtctagggccctgcacggtcaaggccaacacagcctccctgctgccccgctaacggcccccccaggtccagggccctgcacggtccaggccaacacaacacagcctcctagacctgctgccccaccaacgccccgacttggtttcttctcctcggcctcccgcatcagcctcccgccccctacggagcacagcgcttggtgcaggcgccaggagctccaagcacagatacatttcctgaaacctgagcttctgagaggcccaggcctctgccaccattgtcacccgaggcagggaagaaggggtgggggcaaacaccatccccagggctctgggccccagggccgcagcaggaggagcagaccaaagcccatcccacgcaggaacacacacacccatgctccacaccagagaccagccagggccttgcctgggtgtacccccactccccagcacaccccctctaggtcccaggtcccccaccgtgaagacggtggcagccagggccggctagcacctgccacaaagcccagggtacaactgatgccagccacaccctgctcaggcctgggatgtggggataggaatcccgctcaggcctgtggtctggggacagggactccgctcaggcctgtggtctggggacagggcctccgctcaggcctgtggtcttgaggacagggactccgctcaggcctgtggtctggggacagtgacctcactcagatctggggtctggggacagggaccctgcttaggcctcaggtctgcagacagggaccctgctcagtcctgggacctggggacagggacccagctcaggcctggggcctgaggataggggccccactcaggcctggggtctagggacagggactccaatcaggcctagggtctggggacagggaccccgctcaggcctggggtctggggatagcgactgtggctggggcctgggattgcagatccttgtcttcctgcccccactccaccaccagcagcagctcaggccgaagcctggctccacaagcaccccttcactggcctagcttgctcccctcataaagacaccatggagcagcccaggagggcccctgagagcagcagtcccctcccacccaggcctgccgcctgctccccaacccgcccctccacctcccagccttcctatcgtgctgcggctttgacccttcagcccaccctcagggaccagcgacaaacccccagcccactctccaatcctccctggccaagggcagtcctccctggctccaatggtccccgtgttgcctgggcactgaatgccccaccctgcccccataccaaagctttgaaccagacccccaatgtacaaggcggacatgccctgagttctccccagggctctgggccccagggccatggcaggaggaacagaccgatgcccacccaacacaggaacccagatgcccacattccataccagaccagccagctctcctggtccctactgggaaggtgtgggaaggaggggggtggtccccagtgtgcagacaggatcccctgaaggtagggtggggaggccagggccctgtcatccccagcccaagctcagaaaaaacaggaagcagagtggtgctgaacctcacacctgccacgagcagcttaggtagctccaggcacagacctcagcctggcccaccttgagccctagggcggctggatgcagggggtgggctctgtaaaaaccttcctccctagggggcaaaggagagggtagggaaggctgggaaggggaggaactggacaggtctgggagccgggctgggggcacaagcagagcccgagctgggagtccagcagccccatctgacttcgtgagacctgcaatgaaaaagcggcagtgtgcccctttcacaggtgagaaaagctcagcccttctgatggcccaggacctcaggcctcctgagctgatagacgcagggtcagccccaggcccacctcctgtatctacagggccttcacccatcccgttctcctcataagcccagatctgtcacggggaccatgctccagccacaccaccccgcacagctgccctggagcccagcacacacatgccaagacagaacaagaaagaccctcgctggcaggcaggctcctgggctcctggctccagagatgggccagccaggcaggcacgacttccagctgcacctctgagggtggggccctggctgcccaggtcacggccaactgccaccaccctgctcctccctcagccagcaggtgtcccctgggcctgccacctaccaggccccagagcaaagctccctgctgcccccagcatgacactactcctccccaaacctccatcaccacctgccatgcctacagagcacccggggtgcgtgcacacacgcagctgggagaatgtggcctcaccctgccagctacaagccaggcaccagaaccaacccaggctgacaccggcctcctggggacgtctgggggtggagccaggagaggaggggcagccaggcagcctgctggcatgtggtccaccacctctccacattcaagaccctgggcccacccactgagggaagctgagcccgagaccagcacagatccatgactaatagcacacagaccccggccacaagaagccaggccagggggcagagggccacccagccaggcctgggtcaacagcagagaccacaaggtgggagagtcactcagggggcagggggtggagggagcgaatgcagagcccagactcccccactcctcttccacaaggccctctcattccctttactccaaggagcccaaaagccccacgggcctgggcaggatgccaccctagcctccaggctgaaacccctcctcaggtcccagggagcctgaactcggtccttgccttcccatcacagccaagtacacctcagctcaccgcacagagctggacctcagcaagccagggcagcatggccagggactgccgccgcccgagtgcaaataccagggtgctggcatcacggcacagctcccgcccggcagccaggccacatggcaggagaccagggctgcccccaaacacgcagctatgactctgccctggcccccaacccagagacaggccgcctgccccctcctggggcattcgaggaaccggctggaagcaagaggcagggaggtgagctggccccgaaacccagtgcccggactccaaggaaggcaagggcctacccggtcccatcccacacctgaccggctggcccgcggggcgaagagccagggcggacacgcgatagcccgccacattcctccaagacctccctgcccccacacccactgctgccaactcgagcagaaaacacatcctcaggtagcgatgtggggccacgctggctcaggcccaggtgcagatgacaggctgcgggccctgctcagacctgcctgctgcaccgccgtgggggcgaggggctgggcttctcacaactgcctgggccctcccatgcccgcccctgccttttccatctgggggacactttcccctctctggggcccccctggtcaagggatactcggcggggtgctcacgggttgaggacatggccagaggagactgtggccagcttccacgggtgggagctcaggaagcggtgaggatgggggcagcaggcaaggctgccagccagggctgcaaaggtacagcacaggactgggagccacacacggcaggcccaactggcgtgagctcggcagggattgccctcaactcacaatcacttcagggcccaggataccaggtgggcacactccggtgcctcctgctgactggagccacttcctggctcccagatccatctactccctgatcacaggtctgcatggtgctctcattcccgcactcacccagttccaggcccccagcacaatgaccaagcagggaaggacctctgggcaccagggcaaggccgtgctccaggcaatgaggtaaggcgcccgaggcctgggcctgcccacctaccactacccacctgccagcccactgggatgagtacctgtttcccagtgacactggacccctaccacccctcctcccagcacgcccaggccagggctcctgcctgactggccacctgccaggggagaccagacagccccgactcagcttctgcccctccagaataacaaaaccaaaaaaacccacaaacagggcagtgccacagaaggtcactgcaccaggatccactatctctgtctctgaacgatcttgggtcaccatcgggggcttctgccgacataagcgttaggcgttaggctctcccgggcctaggtcccacggcgcccgcccgtgccccccaggcatccaggaaactgcagggcaggcgcaggctggccacgggcccggggcggctcagtcagggcctgccctagaccagccccagcacgcgctgcgcacatgccaccgcggcctgcccgggaccggggcgcctcgcctcgcctccccacccagacagacacgcgcagggcgacgcaggcacacgccgcacaccgccgcgcacgcgggacgccgccgccccgcccccgccgcgaccccgctcccggtggccccggggccccggcgcgcccacgtggccaggcgcggaccaagtccccagagcacgcgccccctgccggccccgccccgcctgggcgcgcgcggctcgcacgcagacccggccgcaggtgttgggggtcgcgaagcgcgcggggccggggcgcggagagagagggaagggctggagcacgagggatggagcgcacgtaccggccaggcgaactggaaggggatgacgacgaggcccgggtcctggtcgccgccggcccgggcccgcgcccgcgctcggtcccccgcagcgcccgccggcggcaggtagaaggagttgccgcccagcacgggcgtggcgccgtggccgtagctgcagggccccgtgggcgtcaccttggcctggtactccttaaggcacacgcgcacgtacgtgtcgcactcgtcgtggccgcagccccccgcgcgcgttgtccggccgtcgccgtcacagcaggcgccgctcagcagctccccgttcacgttccgcagcgcgctcagctgcagctcgaaatagcccatgggccgcgccgcctaaaaataaggcagcgggagagcggagggaggcgcgggccggggtcggcgggccgggcgccaggggtgggggaacaggccccgccgccccgcccccacccagccgcgcccgcccggagccccagccgccgcgcgcagcctcgagggcttccgaaccacggcggccccaggcagtgcccgcccggcccctaggggcggcccggtgtgccccgtccgcgacccccgccgcccccgccgccccgctcacctgcacccagagcgccagcagcagcagcagccgccggggaaggcgcccccggccctgcgcccgcattgcccccgcgacccgcccgcccggccccgccgccgccgcccgcgcccggctcccagccgccgcgccggcctcccagcgcccgcccgccctccgagcgcccgcagaggcagcggcagcggcagaggcggcggcggcggcggcgcgggcggggtcgagcgcagcgccgcggcgcgcgggcctgggcggcgggcgtgcaggggcggcggcagctccggctcgctggcggccgcgctccggctgcccggcccggctcccacccggcggcgacggcggcggcggtgaaggcagcgggtcccggcctcggctctgcgcgcccgcgctcccggcaccgcagccaacaagttcggaacgagactgacagctcgctcgcccattcgtcacccgcgcacctgcatatgcatgagggggcggggccgcgccgcggggtggggccgggggggggtccgggggcgccccaggctttaaaggcggtggagggcgtcgcctgccagcgccccggcccggcgcgcgccccccagggcgcccgggcggcgggggcacggggcctcggggtcagcgcgggccgcgggggccccgctcacacctccgcgtgagtcggcgaggcgtgcgccggcgccgcaaagctgcctcccctcctccgcctgggctcctgccgggtgtcagaaaccgggggtggggcgccccgaggttgccgtgtggtcccctcccatcagtgcgccaccgccgcgctcctcgcagtcccagaggagatgccgcctcctactctgatcagggctcggcccccacgcggggtggcgcggccctggggccagagccgggcccagcccctactgcgcgccccccacctcctccgagaatctccccttctccgcgccgctcctaccgcctccacgccggctgcagggggcgctgcgcccctccgacgcccctgccttcccctctgcgaggcgcgctggtcaagcagccagtcaacaaatgctccagggtgcagactgctcagctcggcgctggcgtcgaggtagccaggccatgccctcaggaaatgctcaggccacattccccgtttcccgcctctcgccccccaaactcaggtctgggcttggggggcgagaggcgggaaatggggaacaaaagtcggcagtgcctgtccctgaaggctaccccgagagaggcctcccactgctgccctggtcaccaggcttccacaccccatcctctgcggtcacctccttgccctctccctgggtgacctcgcagctcctccacagggtcaaaaccaatggcaccttcctctcctccagtgagcacggtcctttccagagctaggggtcaccttggtggttaaagatccccatatggtccagaggggtcctcaacccatccccatgataactgagctgtcttctctccccctagctcctctcgcaaatttgccctgtgcccggagctgggtggctgtgcagccccccagcctggagcaagtcactgccaccatgctgctggggctgagggctgaaggaagagagctttggaggcacagggcctgtgaacaccccatgcgcagggtctgcctgctccatccctgtttagcagctcctccaggatccaggccgcaggctcagctgaaggtccctaaaggggtgggtgggagccccccatgcccacctcagctggctctgctcagagtgcccaccccaaacttggtggtgggtaggcttcgtggggattaagacacaagccaggatgaggcccgcacagagacccccaccaaacaagagaatccaagctgtgttcagagccttccagttgccgccttccggtgtgtgggcggtgattaccgcctacggggggaggggctccctgtggagatgccacctctcctgtgctttggcctgggggcaggtactcgggtactcgagagagggaagccccaggacagagaagccccctgcccggctccagaggcccagggctccatccccacctgcgcccactgccccactatggtgggggagggggtgctgggtgcctctgctgggcacttggccaagtggtgaacaagggagactccgcccctgcacaccctcaggagcccccagcccgggggtggacagaggacttagacaagtcatacagaagctggcatagggggccgccagagcgtggacgggcatgggtcagccagacctcacgatgtccatgagagcacccaggtcaggaaggtggccgcacctgcccttaggaaggagggggacataggaggcatcggagagggggtcccttccctgcaggaatttcagcagcccttgagccagaaatgccaggcagctggaccctggtttgagtttccagaaggcagcagtgggaaccctcgcccctcatacatatttcacaaaacacatttgccccctgctgcaccttgctggggtgaggggctgagatcagtggcggccagggctccagccccaaccctcaccagaccaggctacctggtctcttctagtaagggacctcgtcattgttctggggcccactggaccacagcaccctccagcctcccagagccacccgtcccccagcctggagggctcccactctgagcgctgggcggtgcccagcttgtatgcagagggcaagggtgcagctgctcagcctggccaggggctctgggcccatagggcagtcctggggaccaggctgaggacgggctgccaggggtttggacagagccggcgaggctccagagtaagctgtgcttccgctgggtcctgcagtgctaaatatagcagacggggaggggagtttccggttacaaccccccctccagtgccgggaaatcaatgccagctccattaggcccggcagcactgcctgctgacccaccccatcgggctgcggagcaaagtgaggggctggactacacccaggtccgggtgccctgtcacctgtcccctcagtgcttcaggggccagacccacctggtgcctgcgagaggtccctctgaggtagtgggaggcctctgctggtcaacccggagggcccatcgcactctcgtggtgtcaccaggcaggctgctggtaagggcagcacagcaaggctgctgtgggtcaggcagagctcctgtcctgtgaatgtcctgctggggcctcatctgggtagagtgaagctgaggctggccaagacccgcacaccccatacctggcagcccctccctggcacacaccccatacctgacagcccctccccggcagccctgtcgctggccttgctgatgcccacagggccccacctgggccacagccagcatttgcatacaggtggcactgcttttgtgggcccctgaggcacagcctcctcaggacagcctccaatgccaggctgtccagcactgtgctggatgacaacagggggtcagtctccacctccctgcccagggttccaccctgcagggtactgaggctcccttcacttcactgtccccttctctactttcctcctgggagccacagcctggacctaatgatgtccaggagcggatcgatcctgccgcagactgatggcccagcagtgccctcgaatgcccacaaccagtgccaacacacccattcacctgcagaacccttactgtgcacctgtggcccaggaagcagaccaggcgagctgggtcccctcctgcctcacaagcattctgggcacctggggagcagctctgagctgcacgcatctcccacagccccaccctcaggacaggtcagaaggcaaggccagggcatacaggccagagatgctcaggggccagtagagcctggtgctgggcggcccaggctgaggccgtgccccgggaccaggaccgggctggcaccaggaacctggcccatgtcaagaccactggccttgtgtccccaccctgtgccgccacctgctcctcttggagcaagcctgcagacatttctgcataccccacaggccgaggaaggtcccttggaaaacttccaaggctgggggtgcacggatcagctactggggcccccgacacagggcagctttggctccgggctcctgtggagtggctctagcccagccccagtcagggtggggacccctcacttgccccaggagcagggaacatactttccctgcagcgtgcagcctgcagtgctgcccaccccatcctaactcctgaggactggctcagccaccactctcgtgagcacagctcatgctgcagccccgtgaccagcaggcccacccccaggcctgccatgccaccctccatgagtcccggaccccacccctcccagctccaagaggaggcacagcctggccctgcccatggcatccccaggcctgtcctcagccccacagcaaccacctgcatggcctgccaccagctactcctcctacaggagagctcgccgtgtcccgagggccatctcaggtcagggtcactgcttcccgccccttccccagtcctctccaaggccctggtcacagagctcagaaccagcaggcagaagctggagctatgcaagcctttattggggtccgcggggtgtggggtgagtggccaagactggcctctgtctagaaccctggagtctcactggagatccaggttgggggccacctggctgaggaaccatgagacaccaaagatgacgccgagggtcttggggatgtccgggtcgtctgcaaaggcctgggcgccttccaggggcaggtgcaccacctcaatgagctcaccctcctccaccaggcccccacctggaccgctacgctgggcatctgtcacctctgtgtagaacatggtctgtctggagccagtcagtcccactccagacctacgggttgagacagggtctgctgagtcacccacgctggccccgctggccccctggcccttctaccaccctccaacccaccctctccactctgctccctccagccctccagtaggcaggactctgggatgccctctcccacccggattcccacctggtgtgcacgcccgtggcccctcccgcagcagggcatcccttccctgatcacgttgtactcgccaggtggggtgggtgttgtcgatgtgattaaggaccctaaccggtgacttgagctcatcagaagggagagcatcctaggcgggcatggcccgatcacgaagccctccagagggtgtttcaacgccagaaagggagaaattcaggccagtcctgctggccctgaaggggaagcaaccgccatgctgggaagggccaacagccagcagggaggtgggacccagtccccagccaccaggagctgaattctgccataacctcgtgagccgggaagaccccaagcccccatgagattgcagatccggctgacaacctgcctgcaacctgtcaaggccaagcagaagaccccacccctgtctgcagcccccaaccagataccctgaggctgttcccagtgctgtttggagcccctcagtctgtggccagctgcagaggcccatgccagaccccagcccatacccggggacacaggctggctgggaagcagggacaaacccaccaggccttcccgcaagggttccccaccaggcacccacaggacacaagtttcagactaggaacagcatgcactgaccgcccccccaccccccgtagcatggcagagtggggtggggtggcagcgaggtcctcagtaccaggcccagtggcccaggctggggaggggtaagaggaagccccctccctcagtgggcagtggccagaagggggctgctggcagccaggaggggtcaggcaccaagggaaggagcctggactggcgtgtgtggagggagaccacgggctaggaggacaggatggcagaggggctgggctgcattctggaacaggagggggagggccaggtgtggatctggggagaaacgggactgaggggcatctgggaagatgaccagggggtgggggagccctggctcgccgcaggaggggctgtcgggtgccatgaaccaaggccagccggaggcctgcagggtagaggccgccctctgagatgtacccaacatacaggggcagggacagaactgggggcttccatgccccacccccaaggcctccccacctccggggggactcaccccagaccgaccttacccagctgcttccttgccctctagcccctcacctcccgcagaccccttcctgatggcccatttccggcggcggccgcggctgcgcctctgagggaagtggcgggtctggggtttccagccccggtttccgccggcttgtgaaggagacaggcccggcccttggcccgggctgagaggaatctgccagccaggctgggcaacgcctcccccaccccagggcacgttccaacttcactccatcacgccccaagctgactgcctccctgggccttgtcctttgcagcggcaggtaagaggcctggctcacctccagaatcagagacagggagccacgggccctgccacagggtgggtgaactttgctgtcagtccagccccccatcaggccctcagagacggacaccctgacccctagtcagcagcatctccagtcctgcatccctgaagccacggcctgctcttcccgatgcgagtctaagcaggatgcctacttcccagagccctccttggctccccagcaccctcacaatcaggctgtggcccagaggctgtaccagtagaaccaccgcggccagggctgcttgaccacttgccctgagagcctgtgcggtccctctgccaggaacctgcccaggcccacctcctccagggggaccaaggggactccagcccctcccatgcctcccggctgtgctcagtactatgggctggggagctgggggcacagtgggcgtggcccaccacggggtagacacctgcagaaaaccaaggcccatccttcacacccaagtccacccttcggcatggaaattctgttttgttgagacagagtttcgctcttgttgcccaggctagagtgcaatggcgcgatctcggctcaccgcaacctccgcctcctgggttcaggctcaccgcaacctccgcctcctgggttcaagcgattctcctgcctcagtctcctgagtagctggaattacaggctcctgccaccacgcctggctaattttgtacttttagcagaggcggggtttctccatgtggtcaggctggtctcgaactcctgacctcaggtgatccgcctgcctcggcctcccaaagtgctgggattacaggcgtgagccaccgtgcctggcccagcgtggaaatgctgcctttaacttgggagtccacccatccagccaggaacgtgcccaggtgaagtccttgaggctgctgaggtgggagggccccaggctcaaccctgagtggcccatgtgccaggctgacaggtgcagagacttccggtgcttctcccagtggagcgggccctggcctctggaggaggctgtggaggctggtgctcagctggtgggggtgggggtctgtgacaccctcctccttccccaagacctcagctggggtcaggagcccatcgtagcgtccctggggaagtggatgggcttcataccaacatctagtcctgggaaggcaaccccaccccagctggcagccctcgcggggcaagagttggtgcctcgagtttggtgggtcaggtcccaaagcgcaggctctagtgcctgttccccaggagagctggagccaccccttctccagcccaggacacagcttctccctcattcctaagccaccctctgagaacagagctgtgagtcacccccacccccagcgcccggtcttaatcctacaggaagtagaggcacctgtcagcagcagctgtcacccggcctgcctcacacagctgggggccgcaggctgggggcatggggccgagacgctgcagagagagccccaagagcccagattctggcctggcttaggagctgaggcgcattcggtccaaccctcccctaatcccatgttggaaaacaaggaggaatccatcctgcttgcacactcccagggacggggccctcactctctcccatctcctgagtcacaccacaggcctgagggcctggtcccactcaccagtatgtggcgacccggcgcagatcagagggggccaagtggtagccacactcctcccaagcctccttgcaagccacttcctccagcgagagcccaggctggtccacgaggccggcacacagctcaactgtcacccccgctgagccgggcagggctggctgtagctcccgaggcccgtcctggtctacagctgctagggaccctgggaagcggcgctccacctcacccgcatacacagctgcgtgggaagaagccagactgtgctcacagccacgtggtggccacctccaggtcacccacacagccaagccccctcccagggcctcagcttcccctggagccccctcccacatctgtattcagaccctcaggaccacagggacctgaaggtgaccctgcagatccccttcccaccccagctggcctcacctggccggaactgcttcaccaacaccaggctcctccgagaagagttgaataagagaacggtcacgctgtgtacggggggaggggctcagcacagaagcactccactggccctcgtggggccccacctcccatctttctgttcccagcgtggccatcccacctccttgccagcagcccagggaggtcaggccccttgctcagataggatggctgaggcccaggcgggaccagagctttccagggtcacagtctggccaggacccagacctgctgtattccagctggcaggatgggaggcggggggcagggaaggacacacgggcagctgagtaggtcagggtgctcgcagctgaggccgggtgactgacaggacgtttggccctcactgagcagctgcccaccagccacactcctcgagccacgtcgccatccagcccagaccctggatgctaggggcaaaggctccaggacagcctctccctgccctgagagggcctgcccaccatcatggtcccggtggcctgagcaaagacctgactcagcccccaggcctcaggctgacccctcagggataggaaacccagaggccgggcagagagaagggacttttggagcccacgcagggaacagcaacgtcagggaggagagggcaccttcgccctgggcccagtgtccccgtagacatcagtctggggcttccccagtggccaggctgggccaggctctcacctgtcatgcgtcttcatgaagtcccaggacttctgggcaccattctagaaggggcaggtcagcggttagaatgtcccaggatgggcggaggtgctcggggaaccgaggaggccacagacccattgcacccactcctaaccagggagatcggctcgtggcctgggcccacgggagccaggaactgcagctcccgtgggcagaggagcaagcagcctgggaggggcagggaggtcaaggacagcctaataccctacgagtgaggcagaagaccagggcaaagggcagggaaggtgtccaggcacctcatgaaacactgcccagcacagaccgagcacaaggggctgcagagagacgtacaccgtcaccaagtataggaaggctcatggaggctcggggagggcaggcgtgactccctcacagcagggcaggagggccctgcaggcagaggagaggtcaggttttcctgctgatgcttccttgggccactgaacaggtggagacgggagggcaggaggggccggcaccaggagtggatggggaagggtggcaggaggggctggcaccaggagcagatgaggaagggtggcgccccagccaggtaggagatcgcactgcaggactcggtgactgtcatgatggtgaccaggctcggcagcccccccacacacccctacccccagtttctggcctcgactctcccacataccctgtggtcccgttctcctgtggccaccctccaccttcccactcccccacactgggcacaccaccctggcaggcccctgcaccctgggtggcactcagtgaacggaggaggcagggtgggcaggtgtgtgggctgggcctgctgggggaggctggaactgatgcattctgagatgcactcccatcctgggggctgagcctggggtcccgcggggtcccatctccggcacgctcagcccatctgccactctgaggcccaggccagctgctcatcccccaccgggggctctgcccagggctgtgaaatggacaagaggtctgagcagcagagacacagaagtgcagccaggactgcagaagagagaagaagccttcctgaggactttctggaggaggtgacggaagtgagggaagggactctgggcaggcagaggcgcagaggccctctgagcttggccgggaggcaaaggcgtcctgggaggagagtaccggtttccaagggaagggagggccggcgtcccgcgcaggtcaggcagcccgagaggccgtggggtaccactcccgggaggcgaccccaggcctgcctgacacccagccacccccgaaccaccacccagccagggcaggctccagggaagccccctgcccacagcctgccatgtgcctgctgtgcccatgccccttccccaccactgcttccccccgagtaacatcaccccatgcaggtctcaaggaccctctcagctcaaggtcaaaagcgtgtcagacccttaggtccagccaggtcaaggtgcagggaggtttagggaggctgctgaggcctgggagggaggggcagggctgggtgcaaagaagaccccatcgcctcggagccacgggggtcccctgcctttggtctgcctgacatcacaggcctcccctggctggacgcagcaaaaagctgagggctgcagctgcccctgggtggcagccagcgtccagcccaatgtcccttggccctgaggagatgccgcccagcccgagcctacatccgtgtccaccacagccacagcccgaaccagctcagctctggtcaccagaacccttcagcagagctgtgccggcgggctgcccgctgaggctgcaagggctgccctgaggcttcacggggagtgagggagagagtgctgccaccagggccacagagggcacctgcctgggcctgcacctgctgcctgagacccagccctgtggggactgtgcagccacaagcaggcatcccatatggccaacgtcagggaaaagggcagtgaccccatgtctccacctgctgtaccccgactgatcccagctgccccctgccagcaccaccagcttagcttcgccttggggagagggatcccctgtcctccagcgccaacaggactcccgcaacagggaaagtgaggggcacagggcctctctcaggctgggggccaagagggcttctccaggatggcgaggggcagagtcctggatgtgatgggggggacaggatgccccctgagggagggaggcaggcaggcagagaggcactgcgacctggaccacctgacctgataggctggggggctggactgactgtgaccaggaaggtggtctttgccttaatggcatgaaggagctctggcagaggggagatctgctgggggcaggtgggcatgcaagcaaaaggtggggccctaactggacagggctgggcttggaggaagacggcccgggactcagtgatccactggatgtgggaaaaggatggcagcagctccttcacccaacacatatgcctcatgcctgtaatccccatgctttgggaagccaaggcaggaggatcggttgaggccagaagttcaagaccagcctgggcaacagtgagacgtcgtctctacaaaaaaatttaaacattagccaggtgtggtggtgtgcacctgtggtcccagctactggggcgggggctgaggcaggaggatcgcttgagcccaggaggttgaggctgcagtgagctgtgaccatgccactgcactccagcctgggcgacagcaagaccctgtctcaaaaacaaaacaaaacaaaatattccttgtgaacctaccatgtgcctggtgctaagtgaggcaatacagcctcttgtgccgtggcctggcatgggagaaggtgacaccctaggaggtggggaaggctgagcttaggcagatggagactccaaggaggtgccctccctggaaaaaaccccaaggaggaagcctgctttgagaggctctctcaagttctcactcagctccttctcctacctccctgcgcccggcctctgcgctccttgctccctcctcctcggcccagctatctcctccttcaagtggtagcatgaaagccaccacttccaggaagccttccctgatccccagggcaaccaaggagttccactgccaagagggtcggattgggcgggcgggaaggatggggcccagcaatgcttccttgaaaggatgagtggtgccccctcagatgtccctcccgcggcccctccccggcctgggggctcactgggtctgggaacccgcgatccggcgggcggacaagcggccgcccgggagatcggcgggaggcgggggcggggctccggggcggggccggcagcgcggaagatggtgggcggggcgcgggtcgtgggccgggccgccggcgggggcgcgggggacgcgggggcgcgggctcacctggcggtaatgcagcgtgagcggccgcaggtagggtgaggcggcgcagcggcccacggacgccccctcgatgcgctccatggcggcgcccggacaggcgggggccgcgagctctgcgggggccgacacggggcggcgccctgtcccgacaggagccttcgggcgggcgcgtgaccgcggctctgagcatgctccgtgggcgcgcggggcggggcggccgaggtgggcggggcggccgaggtgggcggggctcgcaggtgccacctgtcgggtgccgcgcgcctcggggcgctggtcgccgcggtgccagggaagccgcgcaggcacgtgggcgtcgcccgggggaaggactggccgggtcgaccccggccgccgggcggggccagccgggccggggtacagtgcttgggtgggactcgggacctcttggctgggggagggagggcctggcggtggttggagctaagggcctgcagctttggggtgcgatgggccgagcggatgcctccccactctggggatggaccacaaccccgagattaagttactccaggggtccgcgggcggggccgggggcggggcagccccccagggagggagggactgtgggcccaggaagaaaatcacaggagaccaaagagagagggccctggaaggaagctaggggagaggagagtagggagctggaggggccagagcttgggccgagggggcctcccctcgaggttcctggtggcgagggtggctgggagctgccacgctgtctctggagctgtccctcctccactcaaaagccagctgcccttccctccccctgcaagtcctaccttgatgacggcccttcctgggtgtgggagggtcccaggcagcttcagtgcttccttgggcatggattccaaggaccccctccaaatgccaccacggcctccacgggggcaggaaacaatattgaggcccacactggccctgaaccctgacctgcacctgctttctgaactatggcccaggggacatgctcagggtggactggccatgtgagcttgaaatcgactcccagttccctgttaactattgccgtgtaacaaaacactcctccaaagcttagtgccttaaagcaccccgttatcgcctggcctgtgggttgcccagctcagccaggcagccctgtcttggggtctctctgcagttgtaatcaggtggcagctggggctggagtcgtctgaaggccaaacggggtggaccgtccaggatggcctcttcgcccccgccctcagttgggtggctggaacagctagggccggctggcctcccatgtggctggcgtgggcttccctgcagcatggtggtctcggggtagttggattctcccgtggcagctggctccctccagagcacgttcaccaggccaggccaagctgccaggctttgtgtgacctggcctcagatgtcatatggtgtcattcctggggcatcctgtgggtcagaaagtcctgggcctccggcagattccaggggagggacatcaccaggtgggaacgctggggagcacggtcatgaagccagcatccaagtccagctgtcaccgccccagtagctctacaggggcctgtgtctccctgctttagccattccgcctggtgtcccggaagccagagcgcccagcccagaagctggccccaccctaccccacagccaggcaggcctcttcctccggtgcacgaggggcccagggtaagcgcgcaccctggcatgtcgcgtgcaggctccttcctgcccgtggttgcatggaaaatgaggatgagtctcagcttccagcagcagcagccccgggacaggcagaggcaacaggagccccatcaaggagcccctgggagagccagcagctcctcaaagcaccgtgctcctcagactcactcgggtccaggtgtctggcagtgcagactgcagagctgagtgcctgaaaatatcagcaaggagcccactgtgggacgcagcctggcggctcctcaaaaagttaagcatagaattaccctgtggtccagcaactgtcttcctgggtatccacccaaaggagttgaaaacagacactcagacagatgcttcctcacagcagccaaagggaagaacaacccaagcatccgttgccaggtgaatggatccagaaaatgcagtgtagacgtgtaaggtagcacaactcagccatgaggagagaaattcccacacaagcgacagcgacactatgctcagcaaaagaagccagacacaaaggccgtgtcctctgcgattttgtgtatatgaaatgtccaggccgggcgcggtggctcatgcctgtaatcccagcactttgggaggccgaggcaggcagatcacgtgatgtcaagagttcgagaccagcctggacaacatggtgaaaccctgtctctactaaaagccagccgtggtggtgtgtgcttgtaatcccagcttctcgggaggctgaggcacgagaatcgcttgcacacgggagggagaggttgcggtgagctgagatcttgacactgcattccagcctgggtgacagagtaagactccatcaagaaaggcaaaggcaaaggcaaaggcaaagcaaggcaaggcaaggcagagaaagggagggagggagacaaaaagcaagaaagaaaaaagaaaatgtccagaacaggtaaatccatgagacggaaaagcagctgcggactggtggggctgagggcgggagaatgaagaatgctgactaatgggtgccggctttcctttccgtttggggtgaagaaggcattctggaagcaggcagtgctggtggccgcacagcagtatgaatgtactgaatgccgctcagtgtgcactgtgaagtgtttaatgttctgtgaatttcagttccattttaaacaaattttatttagagatagggtctcatgatgtggctcaggctggacttgaactcctggccccaagcaattcccccacctcggcctgctgagtagctgggactacaggttcacactaccatgcctggctcggttcaatttttttttttttaaaaaaaggaaaaaccagtgtcactgaggctattcaggaacattccatgctgtctatgaccacaaggccactgcccacacgtggagctgaggacagggcaagtgaggcctgctgtccctccgagatggaaagggagaaaaggcagaagcagcccaggcactttaccagttcctgctgtgcactggggtggctcgaacaggtgattcggggcaggcctgatgtcacaagaagttaggacaggcatgccaagaggcagaggacagcctccccgaggacacgacactccccagaaacccgaagatccaaggcaggagaaaggaagctgtcctggcaggaggagaccgaggccagaagaggcgttgtggccctgggggcagctcccttggcctgtgcttggcacatcccctggggccactggaagtctcggaggggttgggcagggcaggtggtcagatgcccctctgggaggtcaccgtggctgcctggggccgggggaggaggagactggtccgagggcctttggctgttgtccagagtggtggctgtgcagaggatggcttcgttccccatggaagcaggtgcaggaggaggaggaggagcttgatttggggaggggctccaggagggggaatgagaggactccgtgtggccaggtggcctgagagccacagtggagagctctgaaaagccacctctggctttggcagtgtggaggcttcaaagaccctgctgagcatagtggcagaggcccctgcagatgccctgtagcggggccagagggcatgtggggtgagagcaccagtgtcagctccccagggctgccaagacaaaccactgccaacccagcagctgggaacagcacggccatggccttccagccctgggggacgggtgtccaaaacgcatcccaccgggtgaaggtcaagggtcacagggcggctccttctgggggctccaggggaagatccattccttgtcttctccagcttccggaggcggcccccgccccctcctcaccttcaaggccagcagagcgcccctccgtcctcccccgactctgcctccgtcctcgcgtctccaccctcctgctccctcttctgaggtccttgtgaccacaatttagggcccccccgggtcatccggggccatccggggccatctcccacctcgggtccttctgttagtcaaacctgctaagtcccctttgccacagaaggtccatactcgcaggttctggggatccaggtgtggactctggggaggatgcgtcgggagggcatcaccaccagggcaggaccctgtggcgccaggatctgcagcctggggcctcgccccgcagcaagtgggcgggtttcttgcaggacacctaggagaccgctgtgggcttctgtcccccttcctctgtaaggggagtgaggcaagggcccctgccaaggatgagatgggaggggagggaggcgaagtggcccctgttggcagggggcttgggtgcgggctccgagggggcctggggagcaaggcttcctggtggcaccgggctggggatgctcctgggccatgctggaggcagggcaggtacaaggggggcccctgggctcctccatggctcagctccttcccagtaaggtcacaggcagcaggtggattggagagttgaggacactgagcagggagctacaggcatgacagagcccaggtgggggtgcggggggtggggaggacgtgggggagtcaggggcgggaggggtgcaggaaagccaggggcggggattccgaggtaagtgcagagggagtgtcccgagagaggctgagttgaggggaagctggaggaggatcaggatggggggtcaggaggtcgggggtgtggggcacagaagtccactgggtgtgggcaggagttgagtgcagagtgctcataagtgagcagagtggtgggctccaggactggcagtggggtgctggggggatacagcagagaccacacccggaggagcagcagggggctgggccgtgtgtgtgtgtgtgtgtgtgtgtgtgtgtatctgtgcatctctgtgtgtctgtgtgtgtaatggagagaagcagtatgtgtgtgtgtggaggtgtgtgtggggggctgtgtgtggggggtgtacatgagtgtgtggggggtatgtgtgtgagtgtgggggagtatgtgggggggtgtgtgggagtgaatgtgggggtatgtgtgtgggggggtgtgtgtgtatggggtgtgtgtgtggggtatgtgagtgggtgtgggggtatgtgtgtgggggggtatgtgtgtgagtgtgggggagtatgtgggggggtgtgtgggagtgaatgtgggggtatgtgtgtgggggggtgtgtgtgtatggggtgtgtgtgtggggtatgtgagtgggtgtgggggtatgtgtgtgggggggtatgtgtgtgagtgtgggggagtatgtgggggggtgtgtgggagtgaatgtgggggtatgtgtgtgggggggtgtgtgtgtatggggtgtgtgtgtggggtatgtgagtgggtgtgggggtatgtgtgggtgtgtatagggggtgtgtgggaggtgtgtgtgtgggctgtgtgtgtgggggtatctttgtggggggtatggggggtgtggggggtgtgtgtgtgtgagtgtggggggtatgtgtgtggggcgtatgtgtatgggggtatgtgtgtgtgagtgtggggggtatgtgtgtggggtgtatgtgtatgggtgtgtgtgtgagagtgtgggggtatgtgtgtagggggtatgtgtgtgggggtgagtgtgtgggtgtgtgtgggtgtgtatagggggtgtgtgggaggtgtgtgtgtgtgtgtgggtatgtgtgtgggggtatgtgtggggggtatgtttgtgggggggtggggggtatgtgtgtggggggatatgtatatgtgggggtgtgtatagggggtgtgtgtgtgggggtatgtgtgcgtgtgtgtgagtgtgggggggtatgtgtggggggtgtgtgtgtgagtgtgtgtgcagccaagcttctgcactgagtaggaatagggcggcttcactaagcaaaggggctgagcaggttggagcacctgcaacccaggagtgcgctgcagaagaggctgagtacacaaaggcttcctcccaggctgaaggtcctgccttcgtgaggtgcttggcagggagagcctgggaactgctgttttttctgggcatctggaaaagccttttcttttcacctatgatagggagttttggtgatgataggttgttttttgtttttctttttttggtgggggtgttgtttttgttttagacagggtctcacccttgcccaggctggagtgcagcggtgcaatcttgattcactgcagcctggacctcctgtgctcaagtgatcctcccacctcagcctcctaagtagtgaggactacaggtgtgcgcccctatgcccagccaattttttatattttttgtagagatgaggtctcgctatgttgcccaggctggtctcaaactcctaggttcaagcagtcctccctccttggcccccacaaagtgctatcaaggcgtgagccagtgacccagcctgttttgcatgtcctaagctatattatcttttgtcttgcctaatctcacagtgggctcaacctcaccctgtcagctgaaagtctcaagagaagagaactgaacagagcctggggtcaaggtgtcttcagcctcccggggacttcacaggagccattcagggccatcagtgggtggggactagaggattctaaggatacccaggtccccacagtcagggcgtgtgacgaggctggcaggggctgctctgcagttctgcttgtaaccccccagcgcctcgccaccgtctcccaggtcccaggcatgagtcagagcaggtgcggtggagaagcagcatcctagctgcaccacgggcgccacctgctgtcacaccctctactctcaacggccagctcccacgtgggcacagctggcctccagacacctcccttcacagccctctgaaggctccctccccctgctctggtggagcccatcctgcagccacttcctgcgacagggtgcgtggaagacacattttgagcaccgtgcctatctgagaatgtctattacactctcatccttgaatgatagctgggctgggtatagaagtctaggctagggccaggcgtggtggctcactcctgtaatcccagcactttgggaggctgaggcaggtggatcacaagagaccaggagtttgagaccagcctggccaacatggtgaaaccctgtctctaataaaaatatgaaacactagccagacatggtggtgcatgccacccagcgactcgggatgctgaggcaggagaatcacttcagcctaggaggtggaggctacagtgaactgagatcacgccactgcactccagcctgggcgacagagcaagactccatctcaaaaaaaaaagaagtctaggctggaagtcactttcctccagcattttgcaggcattgcttcatcgtctgtctgtctccaggggctgcttccacttctcaggccattctgaggcccgtttgaagacgtaacatgtgtccatgtggagaatgttctgtttgccctgttcgcggtgttttccacattgtcgcgtcttggcttggggatgcttgagctggcagtttctgaaagacgagttagagataaaactgaaataggaggcgacatctaggatcgacttcaaaataatcacgtcgggagagggaaaggagacggcagaactggccccacgctgaagaccactgaggccttctcaaaaaaaaaaaaaggggggggcatagtgtagagaggtggtgtgggaaccggagccggcccagaatggtggtggggcacgtcactcactcctgtggcttctgccgccgagtgtggtagaaactatgagagcgggggtggtccgcacactgtgtctgccacaggcccgtaatgagccgtggccggatccaggatgtaacccaacagcagatccaagaagagttcaacatgaaggaaacaggagagccagagatattccccaggttttctggcccaagcacctgggaggtgggcccacctggagcaagggcagatgtggtttgtttgttgtggagctgggtggagtgcgaggcgtccttgggaaactgggtattcacatgcaaaaggaggaagctggatcttcaccaaccaccctaatcaccctaactcgggccaggtgtggtggtacacgtctgtagtcccagcaccctggcagaccaaggtagaggctgcagtgagcagcgatcatgccactgcactccagcctgagccacagaacgagaccttgtctctaaaaaaaaaatagattaactcaaaatggatgaaagacctaaatacaagagctacatccataaaactctgagaagaaacagaggaaaagctccaacacattccgtttgatagtggcttttttgggtatgacaccaaaggtacaggcaacaagataataaatagacaaattgggctttatgaaaatttaaaacttgtacctaaaacagctgaagtccatcgatggagaaatggataagcaaagtgtgatatatacatacagcggaatattacttagctttaaaaaggaaggagattctgactcatgggtgacccttgatgacattatgctgagtgaaatacaccagtcccaaaaaagacagatcctgcccaagtccacttataggagatcctagaggagtcgaaggtataaagacagaaagtggggtggtggcgccaggggctggggagcatggacgggggcactggtgttgaatgggaaccgcttcagttttggacaatgaagggctctggaaatgatagtggcaaaagttgtgcgccatcaatgttccttcacaatcctgagctgtttacttagaaatggtcaagatggccgggcacggtggctcacacctgtaatctcagcactttgggaagctgaggcaggcagattgcttgagctcaggatttcgagatcagcctaggcaaaatagcgagaccctgtctctacaaaaaattagctggacgtggtggtgcacctgtggtcccatctacttgggaggctgaggtgggaggatctcttgagcctaggaggtcgaggctgcagtgagctatgatgtactccagcctgggtgacagagcaagacccatcttaacccccccaccaaaaaaaaaaaagatggtaaatgttgttattgcatgttttaacacaatataaaacacacaagcactgttggccatggttgactctggtagggaatgcactgttcactgcatacttttaggtgctatttaaattttaccatggcatgtattactctttcaatttaaaaaacttttaaaaagtggttaccatggtacattttacattgtgtatcttttactacgatgaaaacaaattggaaaactttgtgaagtgtcactggctatgtacacgaaagctggagcgtgtgagtcgacccctgcaggtggggagggccctgaatcagtgctccaggggcctccctgggtgagaagggctggggagcccataggaaaggtggaaggtcccccaggcagaacccgggagcagcagcagaggtcgctgagcaatggggagggggttgctgagcgatggggagggggacactgagcaatgtggagggggacactgagcgatggggagggggtcgctgagtgatggggagggggtcgctgagcgatggggagggggacaaacgtgcctttgagccccagggcctgttgtcagatgcctcgatgccttgggccccaccctcctgctggagctgtgagcccttcctgctcgagctgttcatctttaacctagggaaattctgactttgtattttcaaagagtcctcctccagcgacctgttctccctggggtgaacaggaggatgcccacacctccccaggctccaagaccctgcccccaccactgtgtgttctggggaaaccccaccaccacccgtgtccagctctggccccttccccggggcacctctgagcctctgggtggttcttcctgggcctctgccctgccccggcccctctgtgcatgcctagtccacctcttcttgctggcataggtgggcactttgcttctttctcttccagggctgcgcacctgccatgccagccgcctccccctgagacccatctcccccgggaacagacccacaaggtgggaggtgatagcacccgccgacggcacacaggccctctgagacccgcagagccgaaagtgcctgaggggctgggcccaggtcctctttgcccgcggcgtgttccaagcctgtggacagttctcacttagtcctgtctcctctgttggtctgttttgctcccgaccgtggttccaggactacgaaggcaacagaggggcgtcacgtgttctgggtgtgccccgacaccccatggggcccctgggacaccagggcagcctggcgcaagagagggtccccgtcatgggatggggcgggtggggctgggtggtgggtacttggggcagggcctgcgggtgctccctagaccaccctcactgggcagtgccttccggagagtgcaggggcgggcccagcagcagcaggaggtgtccaccatgggcttcagatgcagccacaggcttggaggccagagctcataaatgacgaggctctggcctgggccgcggagtctggcccaaggagaagacacaagtcactttctctccctcagcccaattcccagccccccatggagctgggagaacaggggtggcttcttcctcctccacctcggctcccgagtgctgcttctcctgggacttccgacatggctccctcgtccatccccatctggcattgcccttaggatgtgggaggggtgcccgctgccccagacctttgcagacgatgccctggttctctgggtagcacatcagcccataaagcattctccacgctgaccccacacaccccccgcaggaccctcagaccccacgctgaccccacacacccccgcaggaccctcggtctccacgctgaccccacacacccccgcaggaccctcggtctccacgctgaccccacacacccccgcaggaccctcggtctccacgctgaccccacacacccccacaggaccctcggtctccacgctgaccccacacatccccgcaggactctcgggctccacgctgaccccacacacccccgcaggaccctcggtctccacgctgaccccacacacccccgcaggaccctcggtctccacgctgaccccacacacccccgcaggaccctcggtctccacgctgaccccacacatccccgcaggactctcgggctccacgctgaccccacacacccccgcaggaccctcggtctgcacgctgaccccacacacccccgcaggaccctcggtctccacgctgaccccacacacccccgcaggaccctcgggctccacgctgaccccacacacccccgcaggaccctcggtctccacgctgaccccacacacccccgcaggaccctcggtctccacgctgaccccacacacccccgcaggaccctcggtctgcacgctgaccccacacatccccgcaggactctcgggctccacctcctgctcggcccagccgcattccccaaccacggcagggtctccccaagacagagcagccaaacaggcccacagcagggctgggggctgcaagccttgcctgggggcaggggctgggctggcctcacagttttagggaacgccttatggtcccttcctgggaagaggagggagggtgtggcaagtcagaggaggacacatctgccctcctctccccagcccaccctgtacatggggactccggaaaccaccgccaggcacagaatagacctgccgcactcaggcccacccagcccctccttcgataggcccccagccctgctcctgccggcacccgccttgtggacgtgtgtcacctggggctggccgctggaccgaggcccccattcctggcccctaggcgcccctgggtctcgaagggaaacggctcagcccagggccccagcaccaagtgagccccagcccccgttgcagagcaagcccacccggaaagcgctagcccagggaacaatgcccttcgtgtgacagactttcccctctgtgagagaaaatagagttcagtagaatggcaacttcctgcatttgtgcctgtgcctgaaggggtgattcacgcacggacctcccacaaagacagcccccacaccgcgccccagccaacaccgccaggcccagtgtcccagagcctccccgctctgccagccccccggggccgggccagggcccactgcccttccagggagcccctgccttcttcctaggcttcagctccacacccagcagccagaacacacgcatcaacacagctggtgtaaatcacggagggcttcctgaggagccaggcacagggtgcttgggcactgaggggctgtggtgagggcaggctgtgggtgcccaggcagcaagggtggggtgggagtggtggtcatggagcccacagtggctggggagtggggggtgtccctggacatggggaggccagggagggccactgtacaggggccatggctgcaggtgcccagtgcctgcgggtcctggaaagcatgtgctcctgagtgagcccagagcccatgggacatctgacctgccaggggacagtccttcatggtaaaggaaacttgagggcaccccaacatctttcccttctggagaagagaggtggagggcaacatctcagtgggagatctaaagaaggtgcaggaggagtcagcggaggttcctgccaaccgaggcatagctcctctgcaccccgcccccagcttccgggagaatccacccagctccaaatcattgctctgagggcccagccgccgtcagtctctccccagctctgtatacaacctgtgtgtggtccccaagcctgaggagctcctgctaccacgaggcagcctggaacccgcccccagaccactgcccttcctgggaccacttgcctcctggtctctcttgggcagagacccggccaaccaccctggggcctctggtcttcaaggttctcaccccctcccctcttccttccatcccccaagtctccccttaggagtctctagcacacagagactgtgggaccaccctgcccccgggggacacacatgccctcctctgccaccaggtgaagatggctgtgacgaggctgtgtgcagacatcctgacgcaggagccagtagacaatgcccagctgcccagcgctggccccgcatcacactggcatcgtgcccaggcagccccagctctgaggctcctcccacccaccacccagctctcttacctccatccttcccagcacccctgcgtcagtcaggctctccctgctgctgtgcctcctcccctctctatccttcacctgcatttccccagctgaatcgcacctgcatgggatcctggtgtcctcttctcagaggacctgagctcacacaggagactcagattcagggccctgttccatttcctgggctgtgtgccctctggctccttatgccaagggctgcctccccacttctctggttcataggcagcatggcatggctccccagagtgccccggttcgtgccaggcccttcataaacacgtgctgctgcttgtagagtgcccactaagatctggcacctcctttcacctgtgtgaactcccccaggagcctcagaggcagggaagacttgtccaagggacaagcagctgggctgggatggccattggcttgctctcatcgagttcccgggaggagctgtaggtgggaatgctgaaagccatgtgcacgtggcccccaggcccaccgtgcccgtgagctggagggtgggggacctcctgtccacctggggcccactgtgcctgtgagctggagggtgggggacctcctctgcacctggggcccactgtgcctgtaagctggagggtgggggacctcctctccacctggggcccactgtgcctgggagctggagggtggggggcctcctctccacccggggcccgctgtactcatgagctggagggtggggggcctcctccccacctggggcccaccgtgcccgtgagctggagggtggggggcctcctctccaccagggaaggctgcctccgcatctcccacactctcttgctgacttccctggaagctctgtccaaggaagtccagaaggaggagggacaggccatgtttgtccgtcagtggcaacttcaggtgatgatggtggtggcggacatggggacagaaagaggcagtggtgatgacggcagggacgtcagcaagagggggtgaaccactggcccaatctgtggggacacggcagcagtgggacctggctagcaccccccccaaccccacctgccggctgcctcttgcagcaggaaattgatttccggcttgccagactctcctctctacgttcctgcatcccctccaagctgttcgcattaagttctgctgtttgaaatccccgcggtggcttccgtttgctgattgagttggcctgagtcagggccagggctttgctgggaaggcacccagggggtctcggaaaaaggaactgcaggagaccccagggcacatggtgggaagtgagcagcggctgtggccatcctgctccagctggttcagtggcctcgagtgccatggggagctctggtgggcaccggtgggctgtggcactggtgccaactccccctcccaccagctcccagagacccagccccagctacgggtgagcttacaaccgatggccagccaaccagggtgctgtgctgggcgaacctgtggggcctggtgaatgggcagcgtggagcacaggggagagaggacgagggggtggagacggcctcagatggtcaggagcgccgcagggcccccgtgaaggagggatgaaccctggccgcatcactcccctcccaggcctcagcccctcttcccagcccacggtcctgggtgggcgtcttccgcatgggaggccgtgggcgctgggttttcacgaccctgaaacttgagcctgccctcgctctctctgagcctgtcatccagcagggagcagaggaaggctgcagagctgggaggggcaccctctgtctcagggtcttcctcctccttcctccacccgcccccagcgccgcaggatctggaggcgggagccccgccctcacagtgtccccctggaggggacatcccgctcctgcccccgccctgcagaccgcacaccgagccccagcctcactccccagcccccgggagccccgagccaggtctgccgtcgcctctgaccccaggctgggccggcctcctcgtctgggcctcggctcggagggtttcctgcccgcccgctcctagcctggcaggaagcggacacctcagaacaaagggaccggcggacaatggccattgaattgggccggggcgctcgcgcagggacaggccgccagctgcccgcgctgataagaccctccccgcggcgcccggcgcgggggctaatgcccggctcggccttccctccttcgcggcctgggcctcggcaggtgcggccgggactcgggaccgcaggccgggagtgggaggctcagctgcggcctcagggggccgtgcccgccccgctggggactaaagaggagccagcgcccgggaccaatcccaggagcgcaccggggagccaccctagcacctgccccccgaccctgccccgcggtctgacccccccttggatctggccccgcctctacctcccccgacgaactgaaccccctgggatctggccctgccccttgcacctgaccctgcccggagatctgaacccctaggatacggcgggtcccgcagtctgggccctctatgatctgaccccgtccctgcacctgaccccgccctggggtctgggggtccggcccaagccctgggcaggcggggtcggggtggggggcgagagtatgtgggggccagactctacccagctgcctgagagcctggcccttgtgcacgccaaggaagccgcgcttttaagagggcgtgatgtttggtatttccccaaaatgcaccagacgtcatgacactggagagcctcagggcttggctgcgtttccttcgcattgttttggacagaatgacagccagggagggctggccacgtggctgcagcatctcctggctttctgcagggttcggtcacttgctgtccccaggggcagcctgggcctcatgcctgtgtatgcggcaaggggacatggggtggggggggtctgctccaaggaacatcctccccagctgggcctcagggcagggccatcgggagggagaggccacattcctgcccaccccccacccccctggactctgcaggactgtccgacagcctccgagtcctcgagggccatgtttccggaagactctccttgaagactctacctcctcccgaggcctggggcagctctgtgttggcagagactgaacctaggaccagtgaagaggcggctccctgtcccccatccccaggcctgagcacccagggagatcaggagtcagcgctgtgctggctccagagggctcaggggcaccacgttcccactcgaatctgggaaggctttgtgtgggcaggtgcagagctgtcattagggcaagggccgggaggggttggggtgtctcagcgttttcccgcagcagcctggcacctggctgccccaggattagataatcacacaggaggggtgtggcactgggaggggtcaggggctgggggctgaaggaggagcaagaactcaaggtttggggaaactgaggcagcccctctcttctgggcaggatgagatagcccaggcccactttggtcttggcaagccccagacagacgtccagcccatggcacttcttgccatcatctctaccagccacagacccctccctcagcaagccactggccaggacagggatgacacaaggtgagcagagtcaggacaaagagacacttgccagctgcagaggtcccagagcaggttctggcccagccatgggggtgagggtggcaaggaaggcttcttggaggtggcacttgggttgagtttgccaagggaggaggtgacagaggaaaggcgtgacaggcagggacagcggggcatagaccccagtcaggggaaagccgggtgctgacagggagggcaaggagtcccaggggcacaggtggggacagcaggagctgaggccatgctggaccagggacaggagcaaggctctggagtggcaacctggaggcggtggcaagccatggcagggcaggtggatagtggtgactgcttatttgctggggtccccaggagtcaggtcaggtgggggtaccagggagagggtgctggggctgtgaccagagctctagggaagctcccctatgcaggtcctacaggaccaccttggcagcggtggtgctgagcatgatcaccctgggcccctgctggtgggctggggtggtgaccacagtatgccagaaatgctggggtgctgcaggctgccttctggctcaggggctctgagcatcgttgcccaaccagggccccgccatccaaggagccagccccagagtgccctaccatgtgctgtgagcacccccctctcctgggtacccctgaaccctctccgaagcctggtcaagtggatacctgcctgccacaccctcctccacctcactggcctggccctggttgtggccctgctgggaccaccgtctccactccaccctgatccatagcccttctgtagcctccttcctgtgtgagcagaagcttcctgggtctccctgcacccactgggacagatcctgcacgcccccggtgctcagccacgcaggtcatggcgtttgtgcattctgttttctgagccatccagcccaggcggtggacaccggcgtccagccccagctctcaggccacaggaagtgggaggtccagcggcttccattcctgccctcgatcagcccttgctgcttcctgcggccaggcccccgctggcgccgggcggcctggtgagcagtgactcatccagagcccagcacccgaacatcccactcccggctctcagcagaggaccccgtccccacctcaccccaccatctggcctgggctgcaggactgccaccgcccagcacacacctcctcctcagtggccctgcacctgctcccacccaccggctgggggtcctccactataaagagcatgacaccccagcctcaggggactccagccccccactctcagaggcccttgctgtccctggctgtggggctctgcccacctctgccctgctctccctacctctgccctgctctccctagagccaccagccctgccgtcacacaccctctgttgcctgagtcctaggttggaaggcctacctacctctacacctgggaccttctgtagcccatttcagccggccagcccctcctctgggaaggcttatgggctcctgagagccctctcagccccgcctcattgaggctgcctctcctgcctccaccccatggaccttgtctttgagcttggtgtgtccccaaggcagaactcaccctccaaccccatcctattgcgaccctcgcccaactcgcctggagacactgcaccggtcaggatgagaatggaagttgggccggaagttgggccgggcagcagagaaagctccgaggaagctcccctgtgcagggtgccccgaccccaaatccaggtggccaccccatttaagtgacaaaggagctagctgcctcagtggactccttccctccctagaggcctcctctcccatcggcgaggctcctgccctcctcatgacactgtcacacacgcccaatacctgcaagagggctgcacccacacaggcactgagggcccctcaggctgccaccccacacagcccacccagctgtcccgcagcgcctcctgatggccagggcccgaggggcctcccccagcttgcagagcctgcgagcatcctgtgcatgggtatgtacagatgcacctgtcccccagtggccatgtgaccaccacacccctccccttggtgggctgggaaatactgtctctgaatagcaacctccccgggagccaggccgggacacaccagcccaagagcgtgcccagggccctccaaggccaccagcaggctgctgagccctgattttcacctcccaggatcacatcatcccaggctcttccagccccaggccctccacacattacaggcccctaaatttggccccacctgaacctactcctttccgctgtccccctcccctaataacaaatccctgctgagaccttcaccagggagccagtctcatctcctcctccacccacctcccggccccacccagggacacccccatcctctgggcccttctccatcccctccccagagtgctccaaaatggaactaagcatgcgctctgctcacagccccacagcccaccctccagcagctggcaagaccacttctcctctgccggccggccgctgcgcctcacgccctgatttccctgcacaaacttgtgcctatggatcttgttggggagggggtggctcgaagcgcatctcccctacaaggacaggggcgctggcctgtgggcagcacttcccggttccctgcttcatcctcgccgactctgcgcacgcacttggctgtcaggctttctccacgcttgctgagtgaatccatgaacaaatgcatgagaaacacgcattttccagaaccccacgtgcagctggagggaatgctccggtcagggatttgtgggaggggaagtccgaaggggtgaggcctggagggtgggctgtgtggggatggcagccactccccatcctccgggcgccgcgggggcagagcacagagacagaagctcgaacatcgtctccatgctgggtacatgtctcccagcatgtgtgttcctggaccccaggcaggcgaggctgtggcctgcaggtgctgaccctagctcagcctcagcccacagtgccgcctccacctgccaggttctgtggcacctgcagtccggccctgcactgccgcccaggacccccacagcggccaactcagctcaatgggtgggtggtcaaggctggagcagagccatgggggccagcccccgaggtgtgctggcggccgggttaggctggggtcattttcccaggctccaccaaggcgggtacctggcagacaacgttattgtccacagggaggcagcaatgactcagtcgggctggtgcagaggcccccggccgcaaaggaaaggagggtccccacatcgtctggcagagtgggcactgcctcccctgggcaggtgtgactgggccttctgcccggcctcctatcccaatctcagtccagctagggcctcctgggcctctgtggtcccagctttgctgttaagtgggtacatgtaacgctccctccctgcctgtcagcgggcctgagctgcgggcacttccccaatcgaggccccccggactgctcaggagtgccccgaccccagctgtggctcctccctgtccagggtgagctggggtgtcagtcctgggggcatcagtgatggaacagagtcgggttgaggtcagggttgggtcccccagcctagcgcccctgacttcacagttccagccgtgctcattgtgtggggacaatggcttcctgagccaggttcctctccgggcaggaaaaccacacagaacctcctctttgcctccgcccacggcccctttgaagggcctgggccagcctcaggcactgactgcagccttggggcctgcccccggcgccacctcttaccagcctagcccaggccccggtctccccagggacctgccagtcctccagacacgtagtacaggctgcagggacagttactgacggcccaggaagccgccggccagaaccatgcaggcagtgggctcaacacagcatcagagcttggaaggacgcagagtcctgggcccggactccgtacaggctggagacggaggcaaccgacccccctcggtgcctcccaagaggccagggtacatctgcagggtggctgagccctgtgggggcggacagccaagggaccctggagggtgttggccctggagcaggcgcacctaggctggagagggcagagggtcctggcactcaaggcctgagaagggccatctgtcctcacacaagacaggggactcgaagcggggctgcctcagggcgtgtgcatgccctgcttccccagatggtcctgggatgcccctggagatgcagaaattggggaccagtcctgcaggggaaggcaggattgagggctttctagagtcacaggtggcaggtgggtctggcagagctctgcactctgaggcctccagccgtctgttcaccttgctggtgaaggtcttagaccccaggcagaggaggctgggatgttcaggcctggggtgtgtccagggccccactaaggtctctggtgccaggactgggacagggactgggatgctgcaggggcaggtaatctcctgaagcccccaaggctcagggttacttttcctccgagcctgtctccaccgtcttggccaaggggtcctcagaccctgaaagggaaggaccgaggaggaaggcgagaaggccttgctgtgtggggttgggggccaccagccaggcagggctccaagattcaacaaagacctgatacaacaattaagaacataaaggcatcttcgtggcctccggattcaccagatggggtgcaaggtgggcttcatcacccgggaaaaggccaagtgtcccaagaacataaatgtccgcttccagatggtgccgcccgtggccgccagggggcgggccagccgagtctcccggacacactgggcaggccggtcccgcaggagcctggatcccgggtgcccatccctcagcgggtccacgtcagcctgctgtgtctcgctaccacctccaagctccatgggagaaccacagggcggcccccacccaccatcacccagctgtgggggctgggaagggcgtgctccacactcctttgcccgactccctcaaaccaggggagcgggtggcagtccctggtggcagactcagactctagacagtgacaaaagagcccccatttctggccccaggcccagcagctcctcatgcagcagcccctgccccacctggaacaggaccagagagcagcagcaggcctagaagagggcttctgtcagtgtcttggaggacactgggggacagacggtggaaagaggggctgggaggtggagggaggggatgggggggaggtgaagggaggggtgggggatggggagcaggaggcagagggaggggtgggggcatcctcaggggctgcccggcatctgccctcgcagaacctctcattcagtgagagaccctgcaggtgtcccttgctgccccagtaatgctcagcccaggcccaggattcctgacccaccctggctgggctgaccaggggcctgtttggcagaggggcagacgtgggcaacagaaggcacctgggggttgggggagcctgggactgtctgctgtcccctattccaggggcctgggcagtgggggggtcacgctggagtgctcacccagcctggcgctgcctcactccccgaactgccaggaagctcacctcactccccactctgtggccgagggatggagcaggtgccaggtcacacagcactggtgtgggctgggtgaccatcaggtgctggagttaccagacacaagcccccagaccatccctccccgctgcatctgtggggagtggctgcaggggcaggcctggtgactcctgggccctgtcacagtgcccctgtgaggagaaactaccatgagcatccccagccaggtgcggtggctcacacctgcagttccagctactctgggggccgaggcaggaggatcgctggagcccagggatttaaggccagcctgggcaacatagcatgactcaatctcaaaaagaaatttaaaaattagaaagatcacccacaggcccacaagtgtccgagggctcagccaccatgtgggtgtggactgcggccagttgtctgccccaaccgggcccgacaccctgagctggtccagaggctcccggccctcagcatctgtgcatccaggtgtgggtctgggtacacacgctcaagcccgtgcacatggtggtgggatgggtgcgagcagacgtgtgtgcggatgaatgtgtgtacgtgtacacgcgtactgggtgtgcatgaatagcggccatgtaggagggtgtggtgtgcatggaagggcactcacaggtgtgcacaggcacacgtacgtaagggcattatgcatttctctgtggatggtcacatgcctgcacacgtgtgcccctgaggctgccagctccgtcctctctctggctggctgactctagctcagcagccagcagccagcagccagcagcccacgtggccctcagcccctgccctgccctcccctctggcatgcgggcaaaggtgacttggacttggcagagggcaggaaactccaggaaagctctgtggctgcatgagtgggccgaacccgcccactatgccccacctgaaattgggcaggacatgcgcgcttcctgcccactggccctgagcggtatgtgctgagctggggtaggtgggtgaacagaggggcctggctggccttgggtcctggcccttggtcccacaaagttcccagtacacaacaccaaactccacactaggacaggggtccaggatgctccaaggatgcccgggcatacgtgtgcactcatggatgcacgcacactcacatgcagatgtgctccatccccacaaagggccggcccctggctggtgcacgccaagcacagtgggggtacacgagaggcctgcggactgtggaaggctggggaagttggggtatccctggcagagaccacggcggctggctgccagtcacactcccagcctgaagtagatcttaccacatctggggacagccccgggccatgggagaacctccagggctctgcccctccagtgccaacagaggctccccagggcccagctctgcttacccagggtccttggggttccttggtcctgtgcccctcccccgtggggcccgctgctgcctctgcccttgcagagcctcagacgtgtggtgggaggccaggggcggggagaggccatgcaggtgccccctcccaccccagcaatgctccggctttgcagccctgagcctgctgggggacccctccccaaggcaccagaagagaaagaggccgcccaggccagcagccggaaggaccgagccccaagtaaaacatccagccagcctccacgaggacacactgccagggctggggccacagccttctgcagccccgactcccactgccgcccttgaggccctgcccctgctcttggcagctctgggcagatgccagcctgccttgaacactcagcccaggcaggcagctcaggccagtggggaggggagtgtctggccccctctgccacacagggagcagcagctgggctggacctgcctggggcccgactctgaagctgccaatccgcccacctgctggtgcccccaacctcgctccaagccacagggtaaggctctaggcgcccacccagcatgaggcagccagctgcagagggtgctggccacactcgctcctcttcccctgctcctcagcactagacagaggctgctgggtcatccgctgtcagctgtgctggacatgggaactgctccctctggcacttggagtctcctgcaaagcacctgcgctcaggaaggcctggagacaaccagcgcccctgcagggacttgaggaagccaaagtcaggggcacagatgcccggcctgtccctcccctggccagcgtggtccacacccatacggctggaccaaatgagcatgggtcaagattgtgggcaggcatggcagcccctctacagttggggtacagggattgtgggcaggcatggcagcccctctacagttggggtacaggggtgtgggcaggcatggcagcccctctacagttggggtacagggattgtggggaggcatggcagcccctctacagttggggtgcaggggtgtgggcaggcatagcagcccctctacagttggggtacgggattgtgggcaggcatggcagcccctctacagttggggtacgggattgtgggcaggcatggcagcccctctacagttggggtacgggattgtgggcagacatagcagcccctctacagttggggtacagggattgtggggaggcatggcagcccctctacagttggggtgcaggggtgtgggcaggcatagcagcccctctacagttggggtacgggattgtgggcaggcatggcagcccctctacagttggggtacaggggtgtgggcaggcatggcagcccctctacagttggggtacggggtgtgggcagcatggcagcccctctacagttggggtacgggctgtgggcagacatggcagcccctctacagttggggtacagggattgtgggcaggcatggcagcccctctacagttggggtacaagattgtgggcaggcatggcagcccctctacagttggggtacaagattgtgggcaggcatggcagccccctgcagttggggtacaggggtgtggggcgtggcccagcttgttctctgggtcagggagtgaggtcactgggcagacatccctaaggacttggcaaggagcccagaggcggcaaagggtcagatctcgtgccccaccctccaactctggctcaaggggattcctccagggggctctccccaccccagctccatgggctgcaaagaaggagccatccaggcacagaacagctggaccaagacaatggagctcagggccggctgtggtggagcctcgggcctgacccagtcctgagccccacatgccccaccccctcgctctatggagctgtgcagaccacttctcccgggcacccccaaaggtggacacatgctctgacaaagtcctggagcccccaggaccactgagcccccaactggctgttctccagtcctgtcaggactgtaacgtggtatccacggggtggtggcggccaccaaacaccaggttcctaagccagctcgtaacagcctcggatggccctgctctgagcaggcagcaggaggcggcggtggctgctcagggctggggtgtgcatgcctggcaggcccagcccggaaggcagcattcaaggggacagctagcaagctaagaatagtgatgcggggctgagaggctgggctcccccttccccgaggctgcagcatggtctggtcctggcactgggaagggcccaggcagaacctgcccaaggtgctgctggacatgctggcaggccccgtgcagctgcagcgtcacagctggccaagcactgcttcaggcctgtcagcgtccaggctgggagatgtggcccctaagccacctacgggactgagcaatacagacctgaatgcccaaacccgcggttcaggccagcacccaaaagcacctggccactacggctgtctactcccgggccgcagcacctccgcacctcggccacccaagtgtctgtgcagcacaggtccccacggctccaggacccggatgctgtgttccacaccgcaccctctctggggaagagtctttccgccaccagcccagagatgtcccacctcccctccagccattgtggggcttgactctagcacactggtcaccgcctggccccgcttgtgctcctcagccccaaaccccagccatcctctcccgcgccccagcccccgagccccaccccaccctcccccttctgtgataacctcccccgcttccatccccaaagggtggacagccactgcctcccgggcctccctttcccctggccctcacctcccacccacctctccacccctccctctccctccagcctcaggcgggccgttcagccaatatcctcaaccacctgtgggccaagccgctcatgcacaggcagcctggaaaccttctttcctggcctcccgagtggaagtgcccagccagagctgtctgtcctgaaaccccctccaacacccaactggccccaaagcaggtctcccgggatgaggattccttccctcctgcggagctgcagcccacctgtgcctggggccccacagcctggcaaacagcaccaccagagtcagacgctgccccccgccctgcaccccagcacccaggccgagggctggatcgctgcacggcctgcctcgcctgcgcccctcagctgcacgtctggtctcctccccaaataagatctggtggcaggtttcacccatttcgccccccaaatccaccctcttcgatctccaacaagacccccactccatgccacctggctgtcgtctctggcccggccccagtggccatctgctaggccgggagcccctccagctggtcctcagggttcctctaagagcaccttctccaagccccccatcctgcggtcccacggcccacctgcacctccctcggggcccctgggtgccagctgtggcccccaggcccgcccaccctggcccagttgctgcttcctgttaccccagcctcagtgaagcccctgtgggctggtcctgccgtttcactttcttcacagcactcacctcccggtgcccacactgcgctgggggcccaagcggggacttgtccacccggtcccctgtggcacacccatgtccagcccaggctgatgcacacccactcaacagctgctgcagtagttggggggacctaaagaccccacacccctcactcagggcagcccctgggtctcaggggctaatatccacagccaggccgtgcagccagcagaccgacatgacggctggccacagatcgcaacacagaatcagacaagcctcaggcaatttctgttaagtaacaacagatcttcctgctttactaaatctattcttcccccaagccctcgagaagccctggcaggacccaggctggctactgagctctgggcgggggtaggggggtctggcctgctgcgggccaagttggggcaggacatacagcccattccatggggaggatgaggcccctgggggtcagtgaggcacggctctgcctcaaggccaccccctcctaaggacacagggtgaagccccctcggccacatccggggcagccatgccagagctgagacctcctacgagtggtactggggccttcccacgaagaggcctggggaggctctcgggcctccgtctgccctccctcctcgatggggggcctgatccagctctgacagggagcgccactgccctctggctctgtccacggggaactcccagcgccaggacactatgcaggctatgcccgcactgcctacagagctatgctcaggacgggtgggcgccggtctcagctgtcgggcactcagttcacctgccggcagccgcagggctcctgggcccacaactcaagtggccctggagcaggggtctgacccccatgctgctccaggcggtgcaggcagcggggaggggggtctggaggaggcaggggtgggggtgtctgcctcggacgaggcaggtatctggatgcagggccacagctggaggcagaggaccttcaaggagctgctgcctctcaagtgccagatcctcagctcccacggctgcgccggacacctgcagggctctggcttccactctggcagaggctgctggcgccgagtgctgctcaggaggggacggtgcggagggtgggctggagactccagagctggtcctgagtcacagggccagcacactcagccctccacacacttggaccagcagtggggctgccccaagcctgtttccttaatagtagcaacaccacactgccagccttggagggtccttggatgagtcgacggcaggcagcgggacccagccctgcacacacccggcccacatctgatcacacacatgcagacgcttggtccggtttcccttgctgaatagaaacacaatcccaatggtaagttccacatgggacgagggctgtgggacaggtgccacctgtcaccaggagtctcggcgctggggcctgcctgctgcggtcctggaagcccgtctgatgctgaggagacccgcgaggccccctgccaggacatcacctgcctggaggccacacttcagtagccgtcgtcctcatcgccatcacagccatagtctgcagaagagcacagtcatgaagcccagggtctctgtgggacccaggagcccagaccccccaacccgccctgttcctggtgcccccctagaagactcaggctccagccccagccccagccccccgcgccccgccaggagccatcttgggctcctctccacctcccgggactggcatgcacccagagcagggccttgctcctcgtcgagggcacctgagagcagtgtgggctccctcagcctccctccctgggtgtgcaggtccgtggtggtgtgcagatccgggaacctcgtgctgctggctgggcggccctcgtggtgggtacctcaccgtccctagcctctctgaccctggctgcctccaacctcacaatcgacatgaccaatttacaaaatgtcttagttcaaatttctttccagggagaaacagaaatttagtttgaagctaacaggcccaagttcagggatcatgaggggcagtagctgatgcctttatttcccttgaacccctccctgttgtcgggccccacccaccgttgctgcccatcatctgcagggcactgacgcagggctccccgtcctcctcgtcaggctcctcctcgtcagcctcctcgtcggcgtggtatgacacgggcccgctctccaccagcaccgcctggggcctggcaggctcagctccgagggtgggagagcttgggagcaaagcctggaacgaagtggggctctgacacacacagagctgggagccctgtgtatctcaacagacccctcagacccaccagggctggcccaggatgctcagccactcccgccacaccagtggctcccggggttggccagggctcccaggcccactggccccttctggcctcctgggggctgtgccatgagctgtgtcagcatcaagatcccaccctcaggcctctgccagcccctgctcctgtatcctactgggccccaccccagtgctcggggagcatgcagaacacctttccagaccataggcctcggccgaggacactgtggcctcagcccccgggggcttggcctgccctgacccccagaacacagacagaggctctgctccggcccctgccccagcccccgccacctgccagcaccttcaccctcgtttcctgggccagaccagtccccaacaagtgacagtccaggtgaaagacccctgagccctggagggctgggccctgtgacctggcagtgcctgcttcctacatacaggctccctgcaggcaccaggcccacagcaaggctgctcagccttggcccgagcgctgagcagcaggcacacaacggtccccacttcctgcccgctcctgctccggcaaccgggagctcccaccctcgggcctcgattctctggccatgccaggcaagtatggggcagcaggggcaggcgcctctgtcaggcctgctctccctgtggtcacagaccaagcatctgggcccaggaagaagtgggctgcctcccaaggtctccctgccctggctgcgtgggacaacacacctctcccgtggccaccttctttgctggctgcgtagacaccagaggcctcaacctgcaaaaggaagcacagcatggcggcctcagcccaggctcccgaacgcctgcccacttgttcccttttgcccatcttccctttcccagtgttaattgactgtttctctgtccctttggaagcctggttctgcgtccaggttctgtgtgctccatcagtgctcactgcacatcaacacagagctctgacccgttcacattctcaacagcgagcagcactcgacacaaacacagaagctgcagacgccccgctccccagcccactccccttccaacagtgcctgagccctcaaggagctgcctggtgccctacctcactcagggaggaggggagggagggtgaagggacactgtcagacccgagagtgcttccccaaccctcaccaggcccagggcaatccctacatctgctgacaacaccctgcacagggcctgctcgccggcccgccacacacaaaggccaaaggtgccttccacatgccaagtcttcttggagactgctggtccccccagggagacaggggggcccaggggagaggacgcaggcattacccacaacctccagcacggacacacagggctgtcgggcgggcaatgagagggctcagggcctgtggggaaggacgcagcggggcagagcccttccctccagggcacagctgtgtggggaggcggtagggggcctgaggcagggccctgcctggctctgacgtgtcagatgaaccctcgggacactgggaagggaccccatgacaggtggaccttagcagaacatctagacgtggagctctgctcggggtgaagctgatagcaggtgtgagccaggctgaggccccgggctccccatgtggtccctctccagactggagacagtctggacaccagggctcctggtggtgctgtatcctcaggccaggcctccagcctgcttcctggagcctgacagctgctgctccgccctccccactcccatccccaggcccactgtgcagtggagtgggggcctctggggatggcagctggccctgcagcggggcttctcagcaggctgacctcaatgagacaccccactgtggtctctccagaagtggctggcgctccaggaggcaggcctggcagttgggtgggaggcctgatcttggccggtgggactaagtccccaggagattcatgctctggaaggtgaggccagcaggcccccattgagaagggccctgagaccccgctggctcaaggagaggtagtttttttcttttttttttttctgagacggaatcttgctctgtcgccaggctagagtgcagtgacgcgatctcggcccactgcaacctctggaagaggcagtttctttgactttggcagactgtaccttagctagagaggagcagatgctggcgggcaggaatacggggctacagggagagcggtgctgttaggagggtgcgcttcctgcagggacacaccctccctcccccacctggcactgaggacaggctgaaattcaagccacaaggtcctgctgcactgacccaaggtcctgacagacaagtccagcttttccagaaccaggaagcagctgtgccaggcctcaccctggggggccagaaagctccctactcctgcagaacccggctggagagagggtgcgtagtgttcatgagtgcagaaccgcaagggctcctggggtctgcgggctagctgggggcctgtctcaagggcttccccctcttccacgcagtatcctgtgtgaacctgaggcagccaggccacacgggagggcctgagagcgcctggagaacaagctcccacctggcatcacctcggccatggctttggcctgtacgggggtccccagccaggggcctgaggatgtggggcgctgcggcccattgttcacgcaaacccactgttgggctcaggctgctccctctcgcagccgcgccagcacctgctgaccccgcttggctgaagctcggccccagcccagcctggggggatcctggggcctgtaagcaggcaagagggcagctcatctggtgggcccccactttgtcccccttccagatatgggcgctggggcccacagcccacactggcccctctgcctgtccccagagtgggacgctcaggcatgaggacagactgatctgcatgggctagaggaagaccccgagggtcaaagcagcccgagtgaccacagagtgaggaggagacaagctcggagggagcggctgcccacatccctgtgtggctcagctgcccacacccatgcatggcccacccctgcgtggctcagctgcccacacccctgcgtggctcagctgcccacacccctgcatggctcagctgcccacacccctgcgtggctcagctgcccacacccctgagtggcccagctcaggttctgcagttgtctgtcatcaggggaagcatgcatcatgacgcaggaccaggggcaggtggccagagggagatgggctaggcagccaccggcagccaaagagaaagggggtgcagctcaggctggttcccccacagcaaggagggactgccatgcctgggccacccaaggcagcacagctgctgctgaggaacgctgtggtcgctgggctgaggcagtgcctcctcagctgaacccctccttgatggtccctccccaccacccctccccacgtcggagcctcagcctctttccaagtggtccaaatccctttttcctcacccgagtgtgggtgaaaagctgcccccatgggctgcaagggcaaccgggacaagcccttctgtccccaggtagaccccctctcccctgccccgctggaactgcctgagctgcccaggcctgagtgggggtgggagtgtggggggtccccagccctgaggtcttcatgcttccgtcttagaacactaaatattcccgaatcagatcatggccatgttggggggaagactgatgggtttctaaagcaggaagcagtgcacgaacacgcagatgtgtgtgcacacagactcacagatgcacacacactgcacacagttgagagacttaagacacacacacacgccccacgcacacagagaaacacagtgtatacagacacatgcatgcacacacgtgtacatagagacaaagacctgcacaccacaatctgtagacatacaggtacacatgttgcatgcacacacactgcatgcacagagagacacataggcgtgcacacctgcatttgcacacaaaaacttacacacatgcacacacactatgtgcagtcacagatacaggcacacactgtgtgcagacaccagaacacatgcacacacacacgtactgagtgcaccaacgcacacacgtactgtgtgcatacgcactgcatgcacagacacaggcacacacacatgcacacatacactgcaggcacacagacacaggcgcacacacactgcatacacagaaacaggcacacacacactgcatacacagacacaggcacacacacactgcatacacaggcacacacacacatgcacacaaatactgcatgcacacaggcacacacacacatgcacacacacacactgcatacacagacacaggcacatacacatgcacacacactgcacacacacacatgcacacacactgcatacacaggcacacacacatgcacacacactgcatacacagacacaggcacacacacacatgcacacacacgctgcaggcatacagacacaggcacacacacactgcatacgcagacaggcacacacacactgcatacacagacacaggcacacacacacatgcacacacactgcatacacaggcgcacacacacatgcacacacacgctgcaggcatacagacacaggcacacacactgcgtacacagacacaggcacacacacacacatgcacacaaatactgcatgcgcacagacacaggcacacactgcatgcacacagatacaggcatacacgcactgcatgtacatgtatacacacacagagagacacacatgcacacccgggccctgtctgggccagctggtcagatgtgacagagggggctgtgaaccctgtcaccaggcaccagaatcacccaactgggacaggacccccacctccagcgctgacagaggctggctaggcaggcagaggacacggagactaaagcctcagatcggacctgggagtgctcaggcacaggggaaccgagccacagacctgccctgacttcacctctgccccactgacctcctacgcatgccaggagctgtgctaggaatgcacccccagaggaccagtgcatggctgatgtggaggagacagcccatgcggccctcctgaggggctgagacgccggctgagaagcaccagcctgccaggaggtcaggctccctcacagagtagcacctgggcaccccaggggaggggcaggggcagggccacagcacagccaactctcgcggggtgcagtggccagcctagcagctcaaaaggccaaggagaaaccaccgcaaataccgcaaacaacaggaggccctgacggggctgccgagagtcagcactgccccacaggcggaagcagctggagacaacgcaagagatcccaagaagcagtaggaccagcagacacacccagcccggagactcggtggggtggagtgaaggtcggaaccaccaaagggtggacccagaagctaagccgccaaccccatctccactgccagagggacacatggaccagccacaggcccccaagacgcagcaggtgagcccagctgcccatggcctcgtcaggagagcctgcagccgccacccagcggcaagctgtgcacagaggccgacccactccaaggcggccctgcatggagctgcagagcctcgtgaccctgtgcgctgaggccagcacatcccgcctttgacgtccctcagccacgttctccacccacatcctccttcctcagcagtgtgctgctctcacccatcacctcagcagagacggcaatgcagccagggtgcgcagagcaggcacagggcggcagggctggggactcttcttcccgaacccaggctggagaaggcaccgaccccacggattgtcccagcccctccttgggacaaaacagagcctaggctgcaggacccccctgacagctggacccgcccgtccgctcacagcctgccaggccaaggagagttgagacactgtcaaggtgccggagaaggcccaccagtccccagcatgcaggtggcaaatgccactccaggcacttctgtggccccggctggcccccggcagctccaggacccgaagccatgggcctctgcccgccctgggctgctgccctaacccagccactcaggacaggatggtaccttttccccacactggtcacagggtcagccccacttctgctggccggcgtcctccttcgtgacagcttcctggcactggcgctatgctcgggctgtgcatcctccctgtgcggactgcccccgccggcgctgctgaggccccggagcacgctataattgatcttgctggagatcttcttctgctccagcatcttctcgatggcctccctggcggtactggcctgaattggctcccgtcgcttgcaagacttcttgggcttgagggaaacaagcaagaatgcctcccgtgagtcacgcccactgcactccaccatcaggggctccacgtgaggccaggagtgcaggcgggtgaggcctggctcaggccctcagaagggccgctcctgcctcctccccccagaatgtgggccagcctggtgctctctgggcctgcccacgtcaaatcctgccctcccaggtgagtggggcacgtggcctggcatgggtgctggcagggcctccagacagcaacagcagcaaacatgccacaggtgctcagggccctgctgcccctgggtcccacacagggcagggccacatgcacacggcagggcgatgtgctgctgcactgtgagggctgcagcagagatggctactcagtgaagacagacaatccaccccagcaccgctgcccacgtcaaaggccccagctgcccgaagaccctggatctccttctaggagctggagccatagaccacttcagggcaatcagcctgcaccacccctgctgccccccgctgcacgatgaccttcctgcgtggcccagcaaggcctgggacgtgctgctgggtggggtggagtccctgggctcctaactctctgaccacaagctccccgggtcctgctgagcgggtaggccccacatctgccatcccagccacctccagcttcgtctgagggaccccagtctcgcaggcagggaactggctccccgtgttttctcctgctcagtcactcagaggctcaaccactgctgcctgcaccacgaggctgaaggcacattccgccagagagtaagctggcagagcaagtcaccgtgacggccacaaggcagggaggcatgacagtcggactttcccagggcgtcagaagagcaaacccgttaacacaggcagggaccccagcgtccagccccgagtctcgacagtctgccccggtgctgcatccagaaggttaccccaaagctgagcacacgccctccaaggtgaggccgacggctgggcgcctgtggccagcacggggcaggacctagtggttaaggacgtgggtctggggtccagagcacatggcctccggctgcctgccctggggcctagaccctcctgtcacatggggaagggacattccagagacatttgccccccgtaacctggacacccccaagaaggccaggcccagcgtcacaggcgcccaccttgtgttccttgtagatgccgagctccttctctttcgctattcttgcttctttttctaaaagttcagaaagggggccagcgtcactgagggcccacgccccaggcctggggactgtgcgtcctgcgtgtgagtgtgggcgggtggcgcttacccctctgttcccgcaggtactcggcgttctccctcatccacagctcggccttcacgcgggcttccgactcattcaggatgtactgggcgagcacagggaagtggggctggcttttagccttcgcacaccggggcatgctaaggtcgcgctggccagcgggaagtatttccaccgttagaggaaggggaacccggggcagcctctatttagtgcggagcctgggctgaggcctcatcgcgcggggcgagttggggacctgttgctctgtggcctgtcccaaggccaaccacgcaggccacatgtgtgagaccccctagggcagcttgcaagccctgccggcaccaggaccctggccagccagagtgcaggccacaggttcccacaaaggggccaagtgagggtgagagcctcccactcaggtacagatgggccaggctggaggggtctgaggcaccacgtggccatgaaatcagggaagacgacttcctgcctgacagagggcaagtatattgagataaactgcaaagagctggtcccaatggctggaagccctggggtttgggggcgcacagcgcatgtggagtcagtgggtgccctcttgtgtctagagacccctcgaggggctgcccctggtgctatttgtgcgatgtgtgcctgctgcaggctatgtgccgagggccgcaaggaccaggcgcaaagccaggggcctctcgacaggccgcccccgagccgacactggagaagagagtgtgggggggggtcccgggaacagtggccagaaggccaggagcccacttcacccagcggggtgggctctgggcaggggaggtggccaaccccgcccgaccactcagggctccttgggctgcagcgccctcccaagcccagcccctcttgggaaggggtgctgccacgtaccctgtcaatctccaggtcatcaatgccactgaggtccagctcaccgtctcctgaagcatcttctggagggaagcacagcatccgcgtcactcagggccagcactgattataggagcgtggccaccacctgggctggctcaggaccctgggtctgggctaagggctttctagaaccccgtcccctcctctgcactggtgggtcgcgccctgtctgcccacatgaccgcacctctttaaatgcctagctcaggacactaagcgaagccagcagaacactgaactgaagctgcaaaggaaaaccccagcacttctgtgctttttgtaaaaaagcaactttttaagaacaggagacagaggctgtcaggccccaaagaccgagggagggcacggaagctgggcaggaaggaaaggtcaggccacggagtgagatgggggtctgtgctcaggggagccagctccccatcactgagcccataggtctggggatagaaatgagggaatagaaatgattccggagtccaggcctgagggagccctccatgatcatgctcaggacaccccaaaacctgcctgtcacccctgcccagccccacgcagtccaggcagcatctgcacagcctggaattgggacagcctctccttgccacagccccacgccatagctgcctgccccgtgctgccaagtcaactccagcacagggccagactgtctgaggtgctctcctgccatgctgctccagggccgaggccagagacggctcctctcagcactcacaggcagcccttcctcagctccagccagaatggccctttctgctcagggtcactgtgccgctggctgccccagggcctgtgcatgtcccctctgcctgttgctctgtgtgactcgcctgggttccacccacacagcagccccaaccatcaggattgtctctaccccggcccagatatcacttgataaacattcgcctggctcctcacacagaggccaggccctggtgcccgacgggaggcagggcttgagggtgaagcgttgcaggaaggtctaggctctcagccagggaagcctgtcctggcagggatgggggatgggacccacctttctcctagagctcccagccaaatgggcaaggtgagggggggcaagatgggcacggtggcctggcctgggcactatggggcaggggtgcctcgtcattgccacgcccaagctcagcaagtgacgttcccccgaccatgttggacaagcggatgaggggtggagctgccccatgggactcctggacacaacttgtgggctccattctccgtggcccctgtgacctgaaggcggtcccagtgagggtgacgagactcactgcattctggcgtcggcacacacccaattcttcacgccaggaccactgacgcccacacagccccattggggggactggtggtgccaccacccaagcccaccgcccgagaccaccacacctcccgacagaggatggcagcatccggctctccccatgagaggcacacgcctgaaagatctcccgatgacctcagcgtcccccagggccccatcagaactcactggggtcgctgctctgagaggagatgcattcgcggatggagtctgagatgcccaggctggctgcagtggggagggggtccagcagggaccccagggccggaggtctgccgccccactcggggcttcctgctgcttccgagctgccgggggcaccaccaaggagctcccggtataagtctttgttcaggtggctggccgcggcttccagctcctcgtcctctgtgtcctcctcgccacacaagctggacgcggtgtcctcggtggagcctaggtgtacacaatccacctgttaaccaggcagagggccagggtgcccgcttttgtgacaaaaaacaatgctaccaagctgccaggtaacccatagaacggctgtcagtgcacggtgcctggcggtcaggtgccaaagaacgagcctcagcccacacctcgcactgcacgcggaagttagctcaaagcagatcacagacctagggggagagttaaagtacagacatttcagacaaaaacgtaaaagaaaaactttgtgaccttggataaggcaaacatttctaatggttctaaaagcagaatccataaaacactgataaaacggatttccaaaaaattaagaactgccctttgaaagacatcgttaagacaatgaagacagcccacaggcttatctgcaaatctcgtaactgataaaggacttaaatctagaacagatgaagaattcccaaaacttcacaagaaaacacaacccaattaaaaaatggaaaaagatctgaacactccggcgaagacgacatattggtgtaaatgaacatatacaaagacctccagtcctgaaggaaatgcaaatgaaaccaccccaagctcctccttcacaaccatcagaatgtctagccctgaaaagaaaaccaggccgcacttcccagacagggggaacacgctcccttgcacttccacgcatggtgctaaccctttggagacaacctgatcagttctttttttttttttgagacggagtctcgctctgtcgcccaggctggagtgcagtgacgcgatctcggctcactgcaagctccgcctcccgggttcacgccattctcctgcctcagcctcctgagtagctgggactacaggcgcccgccaccacacccggctaattttttgtatttttagaagagacggggtttcactgtgttagccaggatggtcttgatctcctgaccttgtgatctgcccacctcagcctcccaaagtgctgggattacaggcgtgaggctctgcgcctggctgacaacctgatcatttcttaaagacaggcagttcgtggccgcccacttgggctcaggagttccagaccagcctgggcaacacagcaagatcctgtctctatgaagaaatgtaaaaattatctgggtgtggtggtgcccgcctgcagtcccagctacttgggaggctgagatgggagggttgcttgagcccaggaggttgacactgcagtgagctatgatggaactattgcactccactctgggtgacagagtaagaccgtctcaaaaacaacaaaaaaagacatacacacttgcctttcacataacccagcaatttcactcctcagcaattgacccaaaaggaaatcaacgtccacacaaggacttgtacacgagtgttcacgagcgcatctgaaacagcctcaaacgtgcaatgtcctctaacagatgaatggctacacaccctcagcgtgctgaaggactaccgactgccacacaatacaaacgaacaaaccattgatgcgtgactcaacacacaccctcagcgtgctgaaggactaccgactgccacgccacaacacaaatgagcaaaccattgatgcgtgactcaacataattacactgtgaaaaaagccgaagggaaaaacatatactatgtgatcctactcctacggaattctacagaatacaactaatttatcgtgaaaaaagtagctcactggtggcctggggcaggagggggggtggtgaccaagggcctgtggaccccgtgggagccacagatctgtgggtcttcttggttgtcactatggcttcacaggtgtgtgcagacatcaaagttcagaaatcaaagggcacattttaaatatgagcagttttcatacggcaatcacacctcaataaggctgttaaaaatcacccaatggtaaatttaaaagactgagaaaagaactttcacgggaggaatgtgactcctcctccttgagctacgtgttcatttcttgaaaccacttgctgttgccacaagtagctctaaactaacccaataatgccgcacccaatagtttaacgatgtacagccaatcacgaatgaacgttactattgtaagccaatgagaattcccaacagacaactttgtatctatccaatcactgtccctttttgcctttaaaaatccatctgtagctgaggctggctcactcctgtaatcccgcactttggcgggccaaggtggacagatcacttgaggtcaggagttcgagatcagcctggccaacgtggcgaaaccccgtttctacaaaaaatacaaaaattagctgggcgtggtggcgcatgcctgtagtcccaactactcaggagggtgaggcaggagaattgcttcaaactacagggtagaggttgtggtgagctgagattatgcaactgcactccagcctgggtgacagagtgagcctgtctccaaaaaaagaaaaagtccatgtgtaactgctgctcaccagagtgtatattcaaggcaatgggatatgtccaccctggctgcaatcctcaagcttgacccaaataaattatgtagattacttttgcctctgcttcttcctttaaggttggcaaaactcatcttaaaacatcccactctggattttgtgtgtgtgtatactggggacagggtctggctctgctgcccaggctggaatacagtggtgcaatcatagctcactgcacatcgaactcctgggttcaagtgatcctccggcctcagcctcccgaggagctgggactacaggtgcacactcccatgcccagctaatttttttattttttgtagagatggggtctcactatgctgaccaggctggtcttgaactctgctcaagcagtcctcctgtatttgcctcccaaagtgctgcgattacaggcatgaaccaccatgcttgacccactccctagtcttagactgctttcttctgaatgtgttccaatacaagattcctggctagcactgagtcccggaggggtccccatggtgaggaatggctccttgggggaaagcacctgatccccagagagcagctgtcagtggacgatgacctctggacagagcagcctctcagaagcccctccccgggcaagtgggcccaggccgcaggtgccaggagccttgggggctccggctgccacattcccgggacatgcacattccctggactgttggctctgccccaaaagtacttccagagttcgaccaggctgggccaggtctctcaccctgggttcctgcaacagcctccctacctcctgcctctgttctcaggccctcccgtggctcctactaacccccaagtgaaaatacacagtacagaatacaaatcaaaaacaagattctaagccccacaaccaaccaaatggatcccttctcttggccaaggagatttcaaagaaacctgaaaagctagttcagaccatgatgggaagtgggggcggggtcagacacgcctcattatacccgcttataccccctccctttggagttcaggcacagctcatcagcattaacatcaaaacacagatctgatgattgaccagactttgtagcaacagataccaaattccaacctgactctagtacaacatcaatgacaggtagcaggccctgaaagaaataaaaatattttaccccaaaatatctttgacatattttgaaatggccccgcaaagctgtcttttgtaggggaaacttacattctttttttttttgtttgagacggagtctcgctctgtcacccaggctggagtgccgtggtgcgatcttggctcactgctacctccacttcccaggttcaaatgattatcctgcctcagcctcccatggagctgggactacaggtgcgcaccaccacgcccagctaatttttgcatttgtagtagagacagggtttcaccatgttggccaggatggtctccatctcctgacctcgtgatccgcctgcctcagcctcctaaagtgctgggattacaggcgtgagccaccctgcccggtggtaaacttacattctgtagataatccccttccctttccaggtctttttctgatcctgaagagatctgctgagactctagcacattttaaaggtctgaataggggccgggcacagtggactcaccatcttttgccaggctggccaggccccccttggcctttggccggctgttttctagttcaatctcaattgcatcctggtaactggatatttcacctgaagtcataagttaaaagcaaaaagtcagcataaaatcaattttcccaacaaaacagaagcattacatgggaagattggttggttaccttcaacctcctccagtttttttgacaggacttgttcaagctgaaagggaacagggcaagaggcttcgtgaagggaggccctggtgcacagcgcagcctctggggtgccgcgtgggccccagggaccacaggctgctagaacttaggggtacgcagcgatggaggtggagctatgggcctgtgtcccccatgggaagaggtggcacttcccagagtctgtgtgaggggcatcccggagcctcgggctctggctggtcatagcactgaagagcggctatgaggctttgggatggcaccagctctgctacaaccccagtcggggtgtgtggcttccccccaaggctggcaagcccagcacagacagacaccaaagccggcgctacctgcttcatccgcagcttcctctgcccagctgtgtacgagggggggtcgcactcctcctccaggtcgatcttcatgaactcatcaatggtcaactgactggtgggggtgtcttcaaattccgtgagcctaaaatggagccagacatgggaaatggagctggtggctctgaaaccagctgtttaaaactgagctttcgcctgggcgtggctcatgcctgtgatcccagtgctttgggagcccaaggtgggtggattgcttgagtccaagactttgagaccagcctaggcaacacagtgagactctgtctctacccaaaaaaaaaaaaaaaaattagccacgcatggtggtacacacctgtagtttctgctacttgggaggctgaggtcagggagaatcgcttgagcccaggaggttgaggctgtaacgagctgtgatagcgccactggcctccagcctgggcagcagagtgagattttgtctcaaaaaatacataaaaaataaaaggccaggtgctgtggctcatgcctgtaatcccagcatgtgggaggccgaagtggtaggatcacctgaggtcaggagtttgagaccagccaggccaacacggtgaaaccccatctctattaaaaataacaaaaattagctgggcatggtggtgggagcctgtaatctcggctactcgggaggctgaggccggagaatcgcttgaatccaggaggcggagcttgcagtgagccaagatcgtgccactgtactccagcctgggcggcaagagcgaaaatctgtgtcaaaaaaatgaataaataacaataaaaacaaatacctgaactgtgcttgtcggatgttcctccacggggcctggcactcaggccttgcccctcggcgcccaggtcccttctggcggcttctccacccctacccgatcctgcccggacctctgctcactaggagaaaggcccacaggcaccctcatccctcacaagagaaccccaatcctaggcggaagactcagaaggcctgaagagaggaggctgggctagaacctcagcacctggcagtcgggcaggaaggggccctgcaggcctgtgagccatggggctcagttcttacgaacgcctctacacgctacacaaccttcaaacacgtttcatcaaagattttttttacagaatcaatggtcagatgtttaaagtgaaatactttacagctggttttggaaaatgccacaggacacaatctcagctgaaaaacagcagtcctgtgtttaagatttgtgataaatgtcacagcagttacaggtggcagcaactccactgtcacatttaccttgtcaaagtctatgaaacagggctgcggtgcaggcgagctgtgaggaaccccgacaaataccacccagcaaagccggggtgcaaagccccacccctgcctgcctggcttgctacgccactcatttcactgatgcggggacctcttatggcactccggcttctcactgggacaggggtcacctgggctctcaaagtccaggacgggccacagcaaaaaggagacggaccaggcttctgacgtcaaagacagcctcatgcctgtttgtgacttagggcaactttacacatcaccctccgcctcaacttagaaacacggggcgcggtggctcatgcctgtaatcccagcactttgggaggccaagacgggcagatcacgaggtcaggagttcaagaccagcatgaccaacatggtgagaccccatctctactaaaaaattagccaggcgtggtggcacacgcctgtaatcccagctactcaggaggctgaggcaggagaatctcttggacccgggaggcagaggttacagtgagccgagatcacgctattgcactccagcctaagcgacagagcaaggctgttcctcaaaaaaaaaaaaaaaatacagggatcggaggaggaggatgcctccgcaggatagggccggccccagaaggactagcagggaactctctggagggaggcgaggcagcccaccagcacgtccaagccatagtgtgaccggggctgggctaggtcctggccagcagccaggcgggggacggcagggtcccgggaggtggcgcctgctctggcaagcaggcctgagctggactgatgaagcctctgtgtggtccccatgccatgaatgagagcccctcacctcttccgcagcgtggactcacacactttgaccacactgatgacctccttcacagtcctcctgaagtcatgcattctggctgcaaccaggagcgctggaaggcaacgagacgggcctcgtcaaccacggctgggaaccagggcaacatctgtggcggcccaggacaacactgcggatcccggtcacggagatgatggcctgagaagacgtgtctgtgccaggcagtgagaccctcacttggcatggctactcctgaacgacatgaccctctctatcttattgtgggtggcggctgcacccattccattttcaaatcaaggaaaattaaaatgaaggcttccgagagcttcacgtaatccctcaaagcaaacaaactaactctaagatgactgtgcgggaaacacagcttgtgatgggagctggggactctgaggatgcggagccaggctgggcaggaaaggggcgaggccacagctggcagctgacacaggttcaccaaggccacagtgggcccagaacctccagtgcaaacatggagatcatgtgtgcagatggaacggcttctcaggtggactgaatcctgcagcgcagggatgccggtacctggcctgccgggtagagtggactctgtgggcacgagggtaagggcccggatgaggagtgagggccctgccgacctggggctccaattccggagctggggtagttgaccaggccacggccacatccacccaccagcaccaagggcaaagtgagagtctgagtgacagctgcgacctggggggtcacagaggtccaactagaacagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgtgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagccacaacctagcatctcaggagagagaggccacaccactgtccgcgtagtcgcccagctgggggcgggggacagcctgacagccctgtggcaccctcaggagccacaacctagcatctcaggagaaaaaggccacaccactgtccgcgtagtcgcccagctgggggcgggggacagcctggcagccctgtggcaccctcaggagcacaacctagcatctcaggagaaaaaggccacaccactgtccgcgtagtcgcccagctgggggcgggggacagcctggcagccctgtggcaccctcaggagcgacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtcagaagccgggccccacgagaccacgggcagggatgcccatgcagccgcaccccagaagtaggcaacctggggtcaaggccgctctgccctgagagttctgccccttatgccaggacacgcagaggccaacggggcagccaggaggtcctggagggctgaggaccccggtgggccaggccagagtcagccccgggaggctggaggcagctctcagtgctctgcaaacatacggcccagcccaccagcactcaggagtcaggaaagtgtgaggccaggacccagaccagcatcccccaggcaggcagggcccgctgtacctgctccgcagaggcccgaggggcgccggcctgtgtgcatccagtcccgcttcatcctctgtaggagcctcagggcagtcatggacacctcgtggttcttctccccgaattccagcaggtgcgcaaagcgtggaatatacaggcacgggtctgcggcagacacagcacctcagtgcccacctccatgtgccatggcacgtgcacaggcggcccacgcagcccaggggtggggcaacctgcacttgtctttccaggcccccaggccccccaccagttcccctcccctggacaaagcctctctgaccctcagctagggcagccatcgcaccgaacccaggagagccactggccacctgctgccagccagcctgctgcagacacgctagggccaggcagcgtgctcctactgcatggccgccctgctcaggacacagaggggcgcacacccagcagccttccctccagaccatgcagacagcaccacacgcaacaacggtccggggactcttagagcaagacaggcgtgggctgggtacacaagtcgccagccggccggcatcagctgacactcatgggtgagaggagggcccacttctggcatctctaccagcatggcggtgccacgggggctgtgtgtgcacactgaggcctggcgctgtgcacctctgccagcacggcacagtgccacgggggagtgcctggagcaggacaggctgggcgctgcacagcctgggccctgagcgactgcatggacctaagcagcgctcccctatgccgagcatgaggccgggatgtgactccacagggccctgctgtgccccaccaggctcaggtggctatgacttgcatccattcatactcacgacgcagcccccctttccagctgagggtgtccataacacgaaggataaatgcttgaggtgaaagatgtcccatttaccctgatgtgactgttacacactgcatgaacgcatcaagacacctcacatgccccaaaatacacgcacccgctgtgcacccacaactaaagataaaaaccaatgatttgtggtgatttggctgctaaaatagatattatttggagaaaaaaattagataatttaaaacaattgctaagatttttaatgattttcaataagatacaatcatcgcagctagaaataaagagaacgataaaaaatatgctcataggctgggcgcggtggctcacacctctaatcccagcactttgggggccgaggcgggcggatcacctgaggtccgcagttcgagaccggcctgaccaacatggagaaaccccatctttactaaaaatacaaaatttgcagggcgtggtggtgcatgcctctagtcccagctactcaagaggctgaggctggagaattgcttgaaccagggaggtggaggttttggtgagctgagatcgcagcattgcactccagcctgggcaacaagagcgaagttctgactcaaaaaaaaaaaaaaaaaaaaaaaaaaaaagatacgcttatagactgggcaatacagagacgaagtctatacaaaagtttttgaaaaaaatttggccggggccaggtgctgcggcttacgcctgtaatcccaacactttgggagattagggcgggtggatgacctgagctcaggagatcgagaccaccctgggcaacatggtgaaaccccgtctcaactaaaatacaaaaaatgagctgggcgtggtggtgcacgcctgtaatcccacctacttgggaggctgaggcaggagaatcgcttgaacctaggaggcggagattgcagtgagccaagatcatgccactgcactccagcctggatgacagagtgagactctgtctcaaaaaacaaacaaacaaacaaacaaaaaaattagtgggtgtgaggctgggtgtggtggctcacatctgtaatcccagaattttgggaggccaaggcaggtggattgcctgagcttaggagttcgagaccaccctggacaccatagtgaaacccagtctttactaaaatacaaaaaaaaaaaaaaattagccgggtgtggtggcgggcacctatagtcccagatacttgaaaggctgagactacagcattgcttgaagctgggaggtggaggttatagtgagccaagatcatgccactgcactccagcctgggcgacagagcagcaagactctgtctcttaaaaaaaaaaaaataaaaataaaaaattagtgggtgtggtctagtcccagctactgaggaggctgaggcagtaggatcacttgagcccgggaggttgaggctgcagtgagctgtgattgcaccactgtactcaggcctgggcaacagaaaaaaaaaaagagagagaaagaaaaagatgtactaatgtgggtgagactttgatgctcattaattattgaaatagaaaactcatttcaaaaacactggtaaatatatcaacggctgggcacagtggctcacacctgtaatcccagcactttgggaggccgaggagggtggatcacctgacgtcaggaattcaagaccagcctggccaatatagtgaaaccccatctctactaaagatacaaaaattagctgggggtggtggtgtgcgcctgtagtcatcccaggtactaaggaggctgaaacaggagaatttgcttgaacccgggaggtggaggttgcaatgaaccaagactgcgccactgtactccagcctaggcgacagagcgagactccatctcaaacaaacaaacaaaaaattcaagacaagccaggcagagtggctcatacctacattcctagctacttggaaggccgaggtgggaggattgcttgagcccgggagttcgaggtcagcctgggaaacacagcaagaccccatctcttaaaacaaaaatctggggccggatgcagtggctcacacctgtgagtcccagaactttgggaggccaaggcaggaggatcgcttgagcccaggagtttgaaaccagcctaggcaatatagtgagacccccatctttacaaaaaatgaaaaatttagcctagtgtagtgatgcatacctgttgtctcagctacttgggaggctgaggtgggaggattgcttgagtccaggaggtcggggctgcattgagccatgaccttgccactgcattctagcctaggtgactgacaccatgtctcaaaacaaaaaacaaaaaagacaagcaaaaagtgtttttttcaagacaaatctgtcagtgactagggtggaggaggaagtggtgggcagcggcggcacggtgggcaaacgcggagtggcagagcggcacgggacaggcatggcatttcatcatggaaaggaacccatgtcaagcagcctggaatctgcaggcgcacagcgacagaggaagaattaaatgaaggaaaaacactggaaacaaccttcaaaaccacaataataggggattttaacatggttctctgaaatttgacagactgattaggaaaaaaaagactaagggacgacttaagacacatcaccatagactcaatctgacaaggatgttctaaattctgtaccccatggagtcatcatgcttctccagtgtctgtgggacagttatgaaaatgaccaggtatgatagaacaaagaaaccctcaatatatttcaggtaacagcacataggacatgccatttgaccccaagtgcaaaaaaaaaaaaactaaaaatgagcaaaaacaagtagtcccctcacctccaaacgctgttagaaattaaagttcaatccttcaggtaactttattaactcaagcgctttgtgtatttaaggcagcaatgggtcaggcgtggtggctcacacctgtaatcctagcactttgggaggccgaggcaggtggattgcctgagctcagaagtttgaaaccagcccgggcaacacagcgaaaccccgtctctactaaaaaatacaaaaaattagccgggcatggtggcaagtgcctgtaatcccagctactcaggagactgagacaggagaatcacttgaacctgggaggtggaggttgcagtgagctgagatcgtgccactgcactccagcctgagtgacagagcaagactccatctcaaaaaaaataaataaataaataaaggaagcaatgaaattaatgaactaaaataacagaaaactaaaaattaacaaaattaattatttaaagtaggcaaagggactaataagaaaaagaagcaaataaattaccactgtcaagaaaagaattaaaaagtccaacagccagtatggtgctgacataaagacagacctacagaccaacagaacagaacaggacaggacaggacaggacaggacagcacagggccagaaatgacaatgacagacagatgaccttcaacaagggtgacaagaacttcttgcacaatggggaaaggatggtctcttcaatatgcagcgctgggaaaactggatatccacttgcaaataaagatagacccttaccttacatcatacacaaaaactaactcaaaaccgatgcaagacccaaacacagacttgaaactgtaaaacccttagaagaaaacaaagggaaagacttcacgacattggtcttggcaatgatttcttgaacatgacaccaacagcaagggcaacgaaagtaaaaatagacaaatgggatgacctcaaactaaaaagtttctgcacagcaaaggaatctattaacagaaatgatatcctatagaatggaagagactatgtgcaaaccatctatctcataaggggttaacagcctgaatatacaaaaaactccaactcaggaacaaaatcgattaaaaatgggcaaactgcacttttgtaatcccagctctttgggaggctgaggcacaagaatcgcttgaacctggaaggcggatgttgcagtgcaccctcaccaccgcactccagcctgggcaacggagtaagactctgtctcaaaaaaaaaaggcaaagcccttgaacagacgtttctccaaacacgccatgcaaatagccaacaagcacatgagtagatggtcaacatcattatttatcagggacatgcaaatcaaaaccacatgacactacctcatgtccattaggatgaccattatcacaaacaaaaaagaataggctgggcgcggtggctcacacctgtaatcccagcactttgggaggcctaggcaggtagatcacttgaggccaggagtttaagaccagcctggtcaacggagtctcgctctgtcatccaggctggagtgcagtagcatgatctcagctcactgcaacctccgcctccctggttcgagccattctccttccttggcctcccgaatagctgggattacaggtgcccgttaatttttgtatttttagtagagatggggtttcaccatgttggccaggctggtctcaaactcctgacctcaagtgatccgcccaccttggcctcccaaagtgctgggattacaggcgtgagccaccgcgcccaacctacactgtaacatatttaaaaatcaaagtgcaaagggtggtttctttctaaggatgaaaattattattcacatgctccacaccaccatgcagatcaagacgctgactacctctggcggctcagcaattctatcctggcacccccggagacagctgtcgcccaggtcttgtgtgctgctgtaagttattccttctcactgcattccccaaatggacccaccacaacctgctgatcctttctgttgctgatggacatgtaggctgtctccactctggccatttgtatttctcctggaaactgcttatgcccgttacctttttctatggaaacagacggctgggacagaaaccacggccacagcagccagcgtgtctttgccagtggggtcccacactatgaaatcgcagctgtggcctcggtgggtgtgtccttggcgggtgcatccacacactttctctcggaactttccggactctcatgcatatgctacagctttccaaacggcttggccgtgcggagttacgcacccacctgcagcaggtgatctccagctgctctgcattccaccaacactacgtgacaagtctcaagttcagccgcctgggggctcgggcaccccattcctgggagaaatgatgatttgtgcactctgggccattgcatggtgtctgttcacgtcctttgcccgttttttaaaaaactgggttgtcagccttttccttcctgacttgtagttgctcctccatcctggagagtcctttgttgaaaataccgcaaatatcttctgaagaggactctcccagggaacattcactacaactgtaacgaccacagagacacagagctcctgttcactgtttagcccaggactgcggtgacaggtgcacccatgacccgagatgctggctgcgtcctgtggggtttcctgcatatggaagttttaaaagtctaaagcctggcggtccaggaggttgcgtgtgtgtcctcggggaggaaccctcctgacagccaggcctctggagcttcgtctgcacgcgagcttggcatgcaccagctgtgcggcccaggccaggtgacacggcctctgaagtctggtctcctcatcagcaaagccagtgccccatgccacgcacctcccaggattagccccaggccgggaggctagaggccccacaaggagcgagcctgcgactgcgatccacaggcagagccacagaggcagggcgcgccctggggcccaagctccagggctgcaggcccagggccagatcctgacttgcccacccgccggctgtgtgaccttcagcgcgcgactaacctctctgtgcctatttcctcgaggaaaatgccgggaaatagcagcgcctgcccctgtaaagccctcagagcagagtggaccgcgctctctgcaagcgctggctgctggcgtccgtagcaagctaaatcgcgaagcatctgaacgaacgaggaagcccaacgaccatcccacaggccgcggccagaggcagactccggaatgcaaatggccaaacaagcaggtccacctgcgttcctaaccaaaagatcgctaactgaagaacgggcgcaagcacctgcgcatggcactgcgggtctgggggcggccgcctgccagcgccgggagccgccttccacggctacctctgcacagcgcgcggctcgcgccggttgctgggcagaagctcgagcagcttcgaggatgtcgggcctgggggcggggccgcgaggcagcgacgtcgcgcggggcgcggccctgacgcagcgtgacgcaccggcgccgcggcgggtacgggctcgggcgggcgggcgggcgggacggcgccccccgcggccgggcctggccgggctgcgctaggctgggctcgggcagggtcgcaggggcgggggtggcaggggagcgggtggcagccccgcgggtcacagcgccgccgccgcccatgctgctgcccctagcctgcctgcacggccgcgtcgctcagtgcctgacctccttgcttttgcttgcagagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggtgagcccgtgccccgcggcccccgcgcccgcgcgcgcccacgcccccagcccgtgcctctacctttgcaggaacgcgctcatgttcaacaacgagctcatggccgacgtgcacttcgtcgtggggcccccgggggcgaccaggacggtgcccgcccacaaggtgggtagcggcggcccctctcggaacgcgtgccccgtccgccccgtccgccgtgtggctgacacgcagcctgcgggagagccaggctcacggcggcgctttctcctcccagtacgtcttggctgtcggcagctccgtcttctatgccatgttctacggagacctggcggaagtcaaatctgaaattcacattccagacgtggagcccgcagcctttctgatcctcttaaagtaagtccactctactggggagggacgggtgggtccgttttaggcggcctccggaggcttctgaagggaagcacacaggagctgatggactcctctcccaggcccagccccgcgatgggtgcttgggagccagcccctgacgcgggccctgcctcgcctaggtacatgtacagtgatgagatcgatctggaagccgacacggtgctggccactctgtacgctgctaagaagtacatcgtcccagcattggcaaaagcctgtgtcaactttctggagacaagtttggaagccaagaacgcctgcgtcctgctgtcccagagccggctgtttgaggagcccgagctgacgcagcgctgctgggaggtcattgacgcacaggccgagatggccctacggtccgaaggcttctgtgagatagaccggcagacgctggagatcattgtcactcgggaggccctcaacaccaaagaggcggtggtcttcgaggccgtcctgaactgggccgaggcggagtgcaagaggcaggggctgccaatcaccccacgaaacaagaggcatgttctggggcgagccctctatctggtccgaattccaaccatgaccctagaggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcagacggatccagtaacaccttcccggtctggtttgaacacccggtccaggttgaacaagacaccttctacacggccagtgccgtcctggacggcagcgaactcagctactttgggcaggaggggatgacggaagtgcagtgtggaaaggtggccttccagttccagtgctcctcggacagcaccaacgggactggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctcccagtggcacccatgccacctgctttgaggggttggatcttcctgctaccctcttggattctaagtggttccaagcttaacttgagaccttcccttcaaatctaaaattggcaaaaagtcacttaaaatagtggacttctgtaataaaggttgcctaaaataacacccacgtgtcagtaaatgactacagcagttgtacagtggggtattctctttctcatgcaacagaacagctccctcccatcccgaggagaaaacctgtcatgctgaacatgctatgtggttaggagcaaactgcgccccagtgaagcccatctgtcccctgggttgctggctggcttctgggccaccctaggaaacaccaggtgcctggttgtctctatgtcctaatgcatcactagcacctcagagtcctaccctatgaacagactgtcgggggagcattctgctgggcccagcgttctggaccctggggactgtcactagctgtgacactgctgcgggacagcctgttgcaggagtggactatagggtgaaacaggctctcccaccccttgtctctctcctcccactctgcataccctgtaggcagttgttttctggaaaacctgtatgacccccgaaaagagggatggcccctcttggcacctgggagagggcatgggccgagtgtatagcctcagccggtgcccctctgctgctgcagcccgtgttgctcagtcctgttggtgacccagccccacctggtgcttctctacccaaaggacatacgctcctagatgcaaacaggcaaagtaagaaaggggcctctaagcgggccatggaaaccagtcatctgcttggtaaagaaagggtaggtcagaaccatcgggcagtgagtgctgttttgatcctttccttctagacttttccgctaggttagattctgcatgcatgaacactgctgctgcctcgagggagagacaggacttaccctacacctaacacacatcaagaaaggcatacaggagttccacaaactcgcacacaacacagaacaaaagtggcagaaaaaccacaaaagagggctgtggctggaaagcacaaccaggagctgccccactgtccccatctgtccagaggcacctggagccaggtgtgtcccttaaaccttgtccacacaagatgctcccagcacgcagcacttgtttccctgtctacaccttcctgccacctgacaggcactgacaacaggccttctggttttgcagcagaaagcaagccccaggccaggtgcggtctcatgcctgtaatcccagtgctttgggaggcgaaggcacgaggatcacttgaggccaggagtttgaggctgcagtgagctacgattgtgccactgcactccagcctggacaacagcgagactgtgtcttagaaaataaggccccacattactgagctcctagcagctttaagaaacatttcttaccttgaggggtcccatgcttggacaggatttccctccactgttcaaaggacatttggcacgctggtccctacagcagcctgccggacaccccagcatctcacccagatgcctacctatggccggcgcattgatgcagagctctcttgccaagagaagaaacgtctttccaagcacgtacacattcacctgagatggagagatcacaaccagaaacagcattggtatttaaggaaatgtttgctttttttctcttaaaatgcatctcttgtgcagtctttaaagactccgatggcccgtggagcagccaccccacacccgcaagcctggctggcctcccttggctgctggggctcccagggccctgccttcttcctctaagccgctgctttaggccgtgctgccgtctcgccaatgatggcatctgcttagaagaaaacctgactgcaaggttcctcccagggcgtcatcacacggtgcacgcagcatttcattcacaactgcacacccatgaacacaaaaccagttctgtccacatgtgctcccaccagccacacctccagcccagattccgatgggcccaggggtcttggcctcagcccccttgctgggactgagatctgtgttcctcagtgactcccctgccccccacactgttcctaccttaggtccaaatccacacagatcctgtcacccctgcctcggctatctgccatagggcagtggaggtgaggcccagaccgagaagggcaacgccgagggctggcagtgatgggagcaccgctgcttgtcctcagcaaaacaaggactctagcctgtgtgcagaccctgtgcacagccctgccgtgggccgagtacccctaaggagccctgctggctgggggaggacacttcagagcaatgtctgctggcaggtgtggatgaggtgcacagcgggaatagcctggtccctactggagcctgcaagagccctgcccacacttggctgtcttcatcccaggcttgcccctggggcccccgggcctcacaggcttggccagtctgaccctctgccactagcctcccccaaagaattccctcgcctgaccaagcccggctcgtgggcccttagacaagtccccttgtcctggcccgccagtggcacttccaggtgcttgctgactccagggtactgggagacctaagggaccgcacacaaagggtcctgtctgcgctagaggcaagagacagaggcaagagccagaggcagcgcttgtgggggatgcctctgatcagggaccctgcccgctgggagggctgggcccccacagcagctcctcctggtcaccatccaccccagtggggcgcagcttccatcttctccattatatccgagggctccatcacaagggctggtggctcacagagtgtgccttctgaaggaatttcccctcctcacagtttctgggggttccagggatccctggggtctgctcaccaaactggggggcgtgtcagcacatgtagtgtgtgtgtgcatccgcatgcagtgtgcagacatgcatgtgtgtacacacgcatacagtgtgtctaggtgtgactcacgcatgtcatgtatgagtgccccagcccctgtgctgggttcctgccaggcccctgcatcttgatcgtcctgatcccaccatctctctttaagccacagcagaaccatgatctgctgctggcctctgcctgcccacctcaaactccacaccccccaaccttgtgtcccagagacacagggatcaatgagacctgaacactgcaagtgaggaatctccaaagggcctttacatggaaactcacgtttaaaaagccatgtgtgcaaaacgcgtgcagtttttttgttttagtttgtttgtttttgagacggagtcttgctctgtcgcccaggctggagtgcagtggtgcaatctctgctcactgcaagctctgcctcccgggttcacgtcattctcctgcctcagcctcctgagtagtcaggactacaggcgcccaccaccacgcccagctaatttttttgtgtttttagtagagatggagtttcaccgcgttagacaggatggtctcgatctccagacctcctgatctgcccgcctcggcctcccaaagtgctgggattacaggagtgagccaccgcacctggccgcagttttttgtttgttttcttgagacagagtttcactcttgttgcccaggctggagtgcaatggcgcaatcgtgactcactgcaacctccacctcaagggttcaagcgattctcctgtctcaccctcctaagtagctgggattataggcatccgccacaacgctcagctaatttttgtatttttagtagagacggggtttcaccatgttggccaggctggtcttgaactcctgacctcaggtgatctgcctgcctcagcctcccaaagtgcggggattacaggtgtgagccaccgcgcccggcctaaatacatgcagttctttacagagttgctaccatgtatgaggaccatttattggaaattctcttgctaacagtctaactgtggctgctccttgagggcaggtcagggtggggcacagccagctgccccccccatctctcttcctgggcagcaggtggattctgcctgcagactgccctcgtgggtgtctgatgagctgtgtgcccaggccagtgaacaacctgggtctgccctaaggcagggatcaagagggagactccatgagctcgccatgggaccatctgagtccccaggagcctgaccacttccggagcagctgccctggccctggccctcatactcatcttccctgggaagtcgtggggttggaaccagggtcatgtggttttgccctgcactgagcagagagcatctgaaatgtggacttgctggattatcacaattccagcagactatttttagcttgaccacaaaatgtttcagcagtagcttctgagttgccatttataaagacagctgggaggacaaggaccccagatgccacctgacacgggcagaagcctaactgtgggctgctgccaaaggcggaaagcccttgaggaccagaggtggcagcacagcctgtgggtgcccagaacccctgtgggcacctggatctggacagagctccctttgaggagtgaaatctacatgaattctgcactgtggtcacaactgttttcaatatttctgagtcctcagcagcatggtcaccaaggacctgtggtgcagcccccagcaccgtccctgcagagcctcggtgcccccaccctgtatcctgtctgcacaggggtccctggggttggtctttccactctgtcactttgttcagtcatgtggaaagagagatgtaactgaaagtgctttctgtggtacccagaaagtgagtgtctccaaacagactgtaatataagatttttctacaatttaaaatgcatgcaagaggccaggtatggttgttcatgcctgtgaccccagtacttagggaggccttggtgggagggttgcttgagctcaggagttcaagagcagcctgggcaacatagcaagaccccgtctctactaaaaatacaaaatagccgagcatggtggtgggcacctgtggtcccagctacttgggaggctgaggtgggaggattgcttgagcccaggaggcagaggttgcagtaagctgagatcacgccactgcactccagcctgggtgacagagcgagactccatctcataaataaataaataaataaaatgcaaggtcaaaagaaataatctcctataccaaactaggtactcacaaaaaaattttttaattgaaaataatctcctttgtgtaggacaaaagttcactgttcacccaggcctagctaacacccaaccgtgcccagcattggcaggtgccctcctgccatggagacccacactcccacaagtctcggactgtgacccccatgtcatgaaggcccctcatcctacagaccaaaacttcctgactgggcaggcagcacagaccggccactgagatgcgtggaggcacctggggtacaccccggtcacaaccctggtcacaacccccaggtcacaaccccaggtggggaaagatgcaggacggaggctgtctacctggagcaggtcgctgaggtccaggagcatgtctgcagcaggagtcaaggatcctgtcgagtggctgcaagctcaggttactcgcccaccttcaaatgggcaggaccgcaggactgcacctgcagggagctggagtcgcccctccaaatataagctccacctttgatcaggaaggaaaggtggtatggaagcgaggcgcggcacgctcaggcctcaccagaacctcccagccccaggcacaagtgagacttctgtgaacccagtaccaggacaagggactgcaaggaacctggagccgggtcgggggaaccagaaacggtgggggcttccatctgatcctggagaaagcgtgcacccccacacacccgcctgcccagtcaggtgcccaccatatggtggatctgctgcccacacacagcacagaagagacagtggcactcatgctccatcccaagggcacttgctgagcacctatcaggcgtcaggcaggcagtcctcccgagagacagaaaactagacctggggcccccttggtgagtggtgagcctgcaggcgccactgggggctgcgctcgagagacaggtgtggggaccccgcacaggacctgtcttcgctcagatgaacaaacaggaccaagaatgtgtcctaagtgattcaaaactcacatggatacataagttatcaaacacaagtcactggttaatacactctgccagacagctgaagtgcacatctcccatgggcccactgtagcttcgagaagtcactaaggacacctcctggagctggatcaggagtccagagcaggggtccaaaggaagatccccgggaccagagcagcaaagccccaccacgcaagaacctcgcaagcaatcagatggttaggacgccagcccactcatccacgccctgggctggaggcccctgacctctcttgcaactccatgcagaacagcaaggcctcccaccctaagaaggtgccagggctgggtacaggggcattccgacacagagcagaacccccaggacggctgggacgtgagcggtgaggcccgtgaacaaaggtgcatctgaaggcaggcagtcccagagggccgagacaacgggcaggaccgactgcagcacagccaacagcctcacaagaggcactatgagaagaccggcggcaggggtggggccagtgacatcaaaggaaaccaaaggaaagcagtaagaactacctggggaaacgcccgtgacagccaacacacaccaacgggaaaagtgaacgaggccagaaggctacaccctgtgtgactccaagcatacaccttccggaaaaggcaaaactatggagacagcattaggtcagtggccaccaagggctggggaaaggcagggtgggtgggccgagaggagggttccaggacgctgcagctctgcaccactccgcactggtgggttcacatattgcatatttgtgaaaacccatagaaggcacagccccaagagtgaacctcaatgtgaactgtggacttttcttatcaacaacttggcaagacgggctcatcaaccataacaaatggaccagctaacacaagatgttaataacatagggaaattggggattgaagggggtgtatgggaactctgtactttctacacaatttttctgtaaactaagactgctctaagaaataaactctactgggctggacgcggtgactcacgcctgtaatcccagcacttcgggaggccgaggtgggtggatcacaaggtcaggagatcgagaccatcctggctaacatggtgaaaccccgtctctactaaaaatacaaaaaaattagccgggcgtgttggcgggcacctgtagtcccagctacttgggaggctgaggcaggagaatggcgtgaacccagaaggcggagcttgcagtgagccgagatggcgccaccgcactccagcctgggcgacagagcgagactccgtctcaaaaaaaaaaaaagaaatgaactctaaggccaggcgcagtggctcacgcctgtaatcccaacactttgggaggccgaggtgggaggatcacctgaggtcaggagtttgagaccagcctggccaacatggtgaaaccccgtctctactaaaaatacaaaaattacccagggggtggtggcgggcacctgtaatcccagctacttgggaggctgaggtgggagaattgcttgaacccaggaagcagaagttgcagtaagcaaatatcgcaccactgcactccagcctgggcaacagagcgagactcagtctcaaaaaaaagaactctatttaaataagaaaaagaataaaggccaaaataaaaaaaggcaaaacaattcaacagaagcttcatgaagacaaaaaaaaatagccaacaagcacatgaaaaagaactcaactgcattaatcatcagaaatgcaaacaaaactgtgacaatgccacgagcccgcgacgtcactgaatgccggcgaggatgtggggcaagcacagctcacccatgctgctgatggaagcgtgaagtggtacaaccaccttgggaaaaggcctggaagtttcttacaaagctaaacacacacctctgacccacctattccactcctaggtatttacccaagagaaataaaaacagatgtcagccaggtgcagtggctcacacccataatcccagcactttaggaggctgaggccagcagatcaccagagcccaggagttcaagaccggcctgggcaacacagtgagaccctgtttctacaaaaaaatccaaaaattagccgggtatggtgacaaacacttattgtcccagctactcagaaggctaaggcaggaggattgcttgcacccaagaggtcgaggttgcagtgagctgtgattgcaccactgcactgagctggggccacagagtgagactctgtctctaaaaataaaaagaaatatgtccacaaaaaaacttgtagaaaaatgttcatagcagcttcattcagaacagccaaaaacggggagcagtccaggtgtccattaatacaagaatactctggctggtattcacacagcaataccactcaccatacaaaacaccatgggcgcctctcaaaaccatgtccaccggacacggggctcacgcctgtaatcccagcaccttgggaggccaaggcgggcagtcacttgaggccaggagtttgagaccagcctggcctacacagcaaaaccctgtctctactaaaaatacaaaagatgagctggacatggtggcgtgcccctgtagtcccaactacttgagaggctaaggcattagaatcgcttgaacccaggagacagaggttgcagtaagctgagatggaaccatactgcactcagcctgggcgacagagctacattctgtcaccaaaaaaaaaagcatgtgaagtgacagggcacagatcatatgattccatttatagggcattctagaacaggcacaactggtctgtagtggaaggaaatggaaacagcggttgccttttgcggggctgggactgttggaaggggcatgaggtctgtccacagagccctgctctgggctgacgggtgaccgtttgtcagaactctccagatggagcaattagggcctgtgcatctcactttaagccaactttaccttcagaggagaaaaagacccaggaacgatgctcacccccattgagctgatggtctgcctgctgaaggactgtgtgcagtacacagacgtctgcaacttgccttgaaatgtgccaaaaaataagatggtgagggcagcatagctttggggagcggaccacaggtgtgagcgaggggactccacaattcacttcaactttgcaggtgttcgaattttttttttttcccgagatgaagtcttgccctgtcgcccaggctggagtgcaatggtacaatcttggatcactacaacctctgcctaccaggttcaagcgattctcctgcctcagcctcccaagtagcttggactacaggcatgcaccaccatgcctggctaatttttttttgtatttttagtagagatggggtttcaccatgttggccgagctggtctcaaactcctgacctcaggtgatctgctcacctcagcctcccaaagtgctgggattacagacataagccaccaagctccacagaaaattttcttaataaaacaatgggataagtgtgtacatttttaaaaggagcttcaaattaaacatttaacgaagttagaattactgctttccttgaaatgaaaatcacctggcacttgatccgcattcacctggctctatcaggcgctttcagggaagtttccagacgatggaagctcaattatgtgcttcccttgtgaggatatcacattccctctggccaatcccgggagggcctactaatgcctttggggcccagcctacaggtcccccagctaatgagctcccagggctctggaggttctcctgtgtccagcatggctggtacctgtgtcctcccagcagcccctcccttttgctgagcagctgcttctgaccatctgggaatcagaaaaaagtctgcagagaagaggccctgtctgcggcccccagggtgcgaaagcctggattctgccagctggggcctctttctgcctcccttctggcccctgccacgctgtgccgggtggtcttctgctcggtgcagctgagtgccagtcaaaggagagacgcgggagcacaatagagggcaggtgacacaatgccctcaaagggcgccagacattcctgagtgcggcagaggcccacgcgaggctcccatcagcagatgacaaggcccagaaatggtccagtcatgacggtgcagccctgcaccccactgctgtgccatcaaactgtcccggctccaggaaccaaccaggcttccccaccacagctgtggacaacacagcgaggggccactccactgtgaagaggatggggaaactgaggctgcccacaccctggctggctgcacgatgcttgcagggagaaaaactgcagatgggtcctgactcagacacactttccttacatggaaaagtttacagagatttacataaggcagaactaaaacttaaaaaaacaagaaatttctctcaacagcctcacatacaaatgctcttactggatacccaaagagagaagcgagggaaagtgctcttgtatatagagccccacagaaagggctgtgtccacaacagccagcagtgcaggggccggcagggccccaccctgagcggacaccagcattcccggccccatgggactggagagggggactgcggcgcccacacggcgtgaggaccaaggagcgaaacccacaccttctggagaatgatgcccagcactgcaccggcccacggctcactgcccctacccagtgccactccccttctgcaggccccccctgctctgagtgctcctcaccggcagccaacaccacctggcacgggaacacacggcccggccgaagctccgtgtagagcagtagtgcccagccccaacccaccaagggcaaggccctggcagcactcagcatacagcactcagcggccgaccaagcacccacacaggagcccggcaggcagactgggcatcctcaggccccgcacatgcctggacggggctatgacggatcctagcttggaatggggtcactcaccccagagctcggatgccctcagcaccccaagagcaggacccatcaagacccagggcctaggtcatgagcagccctgccctcccgaacttcccagagaccaccctgctcctccgcctggaggtgtggcacagagcaggtgctctgggagtccctgaatgactgatgcggggtaggagacctgctggctgccctttgtccagatacctctgacctccagggaagagccagtgggtcattgctgggccttgcccatcccctgcacagtgactaaatccctgagccactgctggctgccacaccccacggtgggctcctgtgtgcagtacaccctgaataatctagcacctcaccgctgtcatcatgcatggcctctgtgaagttcaagggtacccaggtgccttctcaaagatccctgctctgaagactgagcctcccacagagctgggagcctggctctgtcccagccacactgaggtggtctcacggataatgcagctgctatccaggcagtcacctgacgctcccagcccctggctttcaagcacacacatgcaaccaggcacatggatggccccaggaggagctgagtggcacgagtgtaaggtgcagtgtctcagctcgggcctccttccaattctcgccaattctaataagctgtcatagtctggcagtgccaggccaggattgcctgaggacaggagttcaagaccagcctggacaacatagcaagaccccatctccatttaaaaaaaaaaaaagtggctggacacggtggctcacgcctgtaatcccaacactttgggaggccgaggcgggcagatgacaacgtcaagagtccgagaccagcctggccaatatggtgaaaccctatctctactaaaaatacaagttagccaggcatggtggtgggcacctataatcccagctactcgggaggctgaggcaggagaatcgcttgaacccgggaggcagaggttgcagtgagccgagatggcaccactgcactccagcctgggcaacagagtaagactccatcaaaaaaaaaaaaaaaaaaaaagtaggagcctagtgctcacagtctcgcttggcaagggaagatagagtttacagttcagtggcttccgagccagccagacacgaggggccaagctgccaagagaagaggaagcaacttcaacaagcgagcagggcacagtgcacttagtccctttacggcagctgccgcccctggagccacaggcaccaggctgaggcccgccaagcccagaagtcagctctgaaaggcaaaagagccgagcaggaagttctgcagtcccgaggtgccaggaagggacacctgggtcctgccacgatccttcagccgggaaccaagacggaccagcagcaactggatcagagtgagctacctgcgtgctctctgcttgctcaagaaaagttaaattcccggccgggcgcgatggctcacgcctgtaatcccaacactttggaagggtgagatgggcggaccacgaggtcaggagatcgagaccatcctggctaacacggcgaaaccctgtctctactaaaaatacaaaaaatcagccggatgtggtggcgggcacctatagtcccagctacttgggagactgaggcaggagaatggcatgaacctgggaggcggagcttgcagtgagcagagatggtgccactgcattccagcctgggcaacagagtgagactctgtctcaaaaaaaaaaaaaaagaaaagttaaattccctctggatggaaaagtatccatcatctctgtaatattttagacctaatattccagcgattcaatgaaaaattaccaagcatgacaaaagacaagaccaaaggaacaaaaacaaaaagaaaatcaagataataaaaacagaaccacaaatgattcaactatttggcttatcaatgactttcacctaactatgaagaaatgaagaatcttaccaaagaactggactctaataaaaggagtcttagtgatggctcacatctataatcctagcacgttgggaggccaaggcaggagaatagcttctgcccaggagttcaagaccaggctgggcaacatagcaagacaccattctctacaaaaaataaagagcccaggagttcaagaccagcctgggcaacacagtgagacctcatctctataaaaaattgatggccaggcgcgattgctcacacctataatcccagcactttgggaggccgaggtgggcggatcacgaggtcaggatatcgggaccatcctggctaacacagtgaaacaccgtctctactaaaaatacaaaaaaaaattagccgggcatggtggcgggtgcctgtagtcccagctactcgggaagctgaggcaggagaatggcatgaacccgggaggcagagcatgcagtgagccgagattgtgccactgaactccagcctgggtgacagaatgagactccatctcaaaaaaaaaaaaaaaaaaaaaaaaattgagtgggtgtggtggcgcatacctgtagtcccaactactatggaggctgaggtgagaggattgctcgagcctgggaggtcaaggctgcagtgagctgtgactgcaccactgcactccagcctgggcaacacagcgatattccatctcttaaaaaaaaaattaagaagttagtagatgggttcaacacctgattagacacagcaaaagaaaggatgagcaaaagagagaaaggctaatatatggagtcccagaacaggaagagagagtggagcagaaactttatttgaaaagatactacccaagatgtctccaacgtagacaaaagacatcaagtcataagttctacttatccttttttttgttttttttttgtttgtttgtttttttagagacagggtctcactctgtcgcccaggctggaatgcactgatgcactgatgtcatcacagctcactgcagccttgacccctgggcttaagtgatcctcctgcctcagcctcctgagtagctgggactacaggtgtgcaccaccacacctggctaatttcttttattagcctaggctggtcctaaactcctggcctcaagtgatccacccacctcagcctcccaaagcgctgggattacacccataaactaccacacccagccaagtcacaaatccttgaacttctacaaaaaataatctggataaacacaaagaaaaccacatctaggtacatcagagtcaaactgccaaatccaaacacaaaaatatttcttaaaagcaggtagtgggccgggtgcagtggttcacgcctgtaatcccagcactttgggaggctaaggtgggcagatcacctgatgtcaggagtttgagaccagcctggccaacatggtgaaacccctctctactaaaaatacaaaaattagctgggcatgggccaggcatagtggctcacacctgtaatcccagcagtattgggaggccgaggcggatggatcacgaggtcaggagattgagaccatcctggctaacacagtgaaaccccttctctactaaaaattcaaaaacaaaattagccaggtgtggtggcgggcacctgtattcccagctactcgggaagctgaggcgggagaatggtgtgaacccgcgaggcagagcttgtagtgagctgagatcatgccactgcactccagcctgggcgacagagcaagactccctctcaaaaaaaaaaaaaaaaaaaaattaggtgggcatggtggcatgcacctgtaatcccagctactcgggaggctgaggcaggagaatcacttgaacccagagggcagaggttgcagtgagccgagatggcaccactgcactccagcctgggtgaggcagtgagactctgtctcaaaaaaaaacaaaacaaacaaaaaaccgtgtgatgtaacgaaactcacctagagagaaatttatagcctcgagtgcttatgttagaaaaaacaggccagatacaatagctcacacctgtaatcccaacactttgggagtccaagatgagaagataactggaacccaggagtttgaggccagcctgggcaatacagtgagaccccatctctagtgcacctatggtcccggctactcgggatgctgaggcgagagagtcgcctgagccagggagttggaggttgcaacgagctagggtggtgccacagtggtacagcctgggagaacagagcaagaccctgtttctaaaaaattttaaaaaattaatcagtgttatttacgttaggtaacagattaaggggaaaatgtacatgaaaaaatcataccaataaatacattggtgtttgataaaattcagtatttttcatgacaaaaactcttggaaaattagaaagcaaggtaacatcctcaagctgataaagagtcctatacacaaaagtctaccgcagatacatagagcgaagggcagaaaacacccctcccaggacaggagagagccaggcacatctccctccccaggaccatgctgagtcctcggcatacaaaaggcaggacaaacagatgagaggtgtgtgggttagaaaggaagaaccaaggctgggcggggggttcacacctagaatcccagcactttgggagactgagggaggcagatcacttgagctcagaagtttgagaccagcttggacaatacagcaaaaccccgtcgccacaaaaagtacaaaaattagccaggggtggtggtgtatgcctgtagtccagctacacgggaggctgaggtgggaggatcgcttgagcctgggaggcagaagctgcagtgagccaagactgcgccactgcactccagcctgggtgatcaagtgagatcctgtctcatgaaaaaaatgaaaagaaagaagcagaactggcattatgagcagcagacacagttgtgtgcattaaaggagagactccaaaactcaaacagtaagatcgacaattgaatttggtaggaatgatgtattaataatgtcaacatacaaaactcagctaaacctctgctacgccagcaacaagacaccaccgacaaggggcccacatgggcccacgctgggtgtgccggtgtttccaggtcagcctttcggaagtctgaaatggcaacttttttttttttttgagacggggctcactctattgcctaggctggagtgtagtggtgcgatcatggctcactgcagcctcgacctcctgggttcaagcgatcctcccacctcagcctccccagtaggtgagaccacaggtacacaccaccagctggatttttttttttgttttctttttcttttgtagagacggggtttcaccatgttgcccaagctggtctcaaactcctggactcaagcaatcctcctgcctgggcctcccaaagtgatgggatttacaggcgtgagccactgtgcctgacctgaaatgccaacgtcttcatgcctaatgatgtgtgcaccatttgattccctcatcagccatcctaataccttcttctgaccacttaaactgttataaatgccctgtccttgagaaggcagcagagggagaggagcaggaacaagggggcctggtggcagaaggaggtgctggccagaacaggggggcagagaagtgtgggctctgaaagcccatcccagaccccagaatggaataagctgaatgcacatggcccctgctgacctgaacggacggttctgcagcctgagagaggagctgggtctgaagggagtgtggcggctggcggcagaggccttgctcccacgcgtggccaggcacgccatggaggctgaggctggcaggccatggaagctgggcatgctctttgcagacctacgtggggacaggtgatggcaccatccacagtgctggccccagggctctgacgccctctagggctcaccagcctgtcaccatcccaagatgccctctcacatgcaggcctagggcagcctggctggacaggaacaaatgtcaaagacccacaaaccagctgtgggcaaaagctgcaataacaagtcgagacacacagccaggaaaagcacactggccacaaactacctgctcgacaatggcagaggtgctcattccagctgagtctctgcccggcatgtccaggtcccgtgtctcagccctgctgcccacgcagcctccctgggctgggagccaggagcagactcaggcctagggtcagccgggccttgccagactcagtgggactcagcagcaccccgttcctcctccaggaatccgggactggctgtgtcagccaccaggctacggggccaagagaggaggtgtgtgtgcacagcccccggcactttcggggtgatagtggacacacctgaggatcgggcaacaatgaagggtgggcagaaggaggaataagcttggatgttcttaaatcaagcccttgttccttctgagagaggatttcttgtatccagccctgggctcagggcactggtcccacccatgggctggacgatacgataggaggatcctggggggcctctcctggggtgggggccatgcaccccacaacgtaagctcactgcacaggaccctccacgtcctgctgacggcagggtggaggtggggtggtgggtgctgttgcgccctggctaaaggtggcgagtccagaaggtgacgggagctgtgcaggcagcagggctgggccaagcagccctgtctcggagaagagagcctggctgcacacaccctctcctgggtggattttctgtggaagggaagtgggtggagctattgaggaaactgaggcagcacatgagcccagccagccagctggggctgcaggaggcgaggacagtggccagagccaatgcaggtcagcagggagggagaaggcacaggggcaggagaaaacaaggagggcggtgagagacggagacgtgtccaggatgggtctgggggctctggctggcaggcctagggcacggtgctgcccgcaacctgaagggagggcagagcgggacatgctacacctggcctgacccacttccctctaaagtgccggcaaagcaggggtgggctgggaagtgagggctacagctacccgagaccagcccgaagcatcctctgaggatgctgaagggagccccaccaggccaccagcagccagaggggatagagtgcggcctcccgtgagcacagtcctgttccaagctgtcttgtccttagcagctttataaggtacaagtttgtgccacaaacctgcctgttcacagtgcaccgggcagtgggttttcgtaaatccccagagctgagcaaccaccaccaggatctaattttagaatgcgtgggggacacggggtggcttcctggatgctgccactgtgagcactgtgcgtgagcctcggtggggacacaggtactcttttcccttgggcacacacttagtaggaggatcgctggagcgtgtgggaactttgtggctaaaggtggtcctgccagactcagaggcagccccggcagtgccacaggactgctctccgtcctgcctgtcatcaccccatgaaggcccatgtcccagggcatctgtcccccccacaggaggcccagtgaggcagcagcatggacgtggttccaccccaccttgctgacgctggggtcccagtgccggcctgcaccctaggccctgctccacagcagtccccacacagctcctacaaacacaagggaggcagggccatgggctgaccctgggctctgctcagcttctcgctcaggaccttggtctgcttctaagagagcaggatcggagcaggcctctcagtgggaccccagggtggagccggggcaagcagacagcaggcggggcgggcagggacgcgggcgtgggctctgtctctcgccctgcagtgggctgcctgggcactctgcatcatccctgtccctaaaggcacacgtgtgctttaaacacttttacgcagaaatgacaaatttcaaaatgttgaaaggactttttttttttttttttgagacggagtctcactctgtagcccaggctggagtgcagtggcgcgatctcggctcactgcaagctccgcctcccgggttcccgccattctcctgcctcagcctcccgagtagctgggactacaggagcctgccaccacgcccggctaattttttttgtatttttagtacagacggggtttcatggtgttagacaggatggtctcgatctcctgacctcgtgatccgcccacctaggcctcccaaagtgctgggattacaggcgtgagccaccatgcccagcccaaatttcaaaatgttaaaaggacattttcagggttggatgcagtggctcatgcctataatcccagcactttgggaggccagggcgggtggatcacttgaggccaggagtttgagaccagcctggccaacatggggaaaccccatctctactaaaaatacaaaaaaattagccaggtatggtggtgcacacctgtaatcccagctactcgagaggctaaggcacaagaattgcttgaacctgggaggcagaggttgcagtaagctgagatactaccactgcactccagcctgggtgacagagcaagaccctgtctggaaaaaaaaaaaaaaagtaacattttaatgaaagatcctgatactgagggttgcctggccagaggcaccgtcagcaggctaccagctcgtcatctccaggagccctccctgcaccccactcaaaagagaagcaggccaccaggatcacctggcacccaggacacccctcgagggggaccaaccagaaaaacagaccaagacagaaaagagctcaaggtgagaagatgccacactcaggaagacgggagattataaaaaagattcggaaaagacccagagctcttagagatgaaaaacatgaaagaaatgaaacagcctgctggaagctaaagttcaggtgctgtcccaaagcaaaaagatagccacgtgcaaaaaaggatgagataacacatgggttcagtgtggcaggcagagtaacagagaagaagggagacacatctaacgacgaattcaacagaagctcaggacaggaagctgtcagagagcaaaggcctgatgggctcacactgccgtgagatttctgaacgtggagattagaggcaaggagctgaagccccgcagctgcacagcaagggccaggagccagagggccacagaactgcccagtgagaatgctggaggcaaggcgacggcaggggcgcaggctgggaggcagacatgtggccgggcacgccacgcccaccagacacagggcagggagggggaccaccttcagaggggcgcagctcggaaaaggtccctctcccagggagccattgcaggaggcacctcacaagatgaggagggtgtggaccaggaagcggggagtccccagagagcagggaaaagatgcaggtgcacagcaggtgtggacagcacagcacagagcagaggaggctggaaggctctgggctccctgtcaagaggccgaaggcagctcctgacccatgtgtgtgtctgcagatggcagcagtgggcacaggaccagatgcacagagaccagtgcaagagaacaccagacactggatctccacgcaaggccaagctgcacaccgctgagggtcggcagcctccccgcccaccgcctgcagtcacggtgtccacgcacaaggccaagctgcacaccgctgagggtcggcggcctccccgcccaccgcctgcagtcacggtgtccacgcacaaggccaagctgcacaccgctgagggtcggcggcctccccgcccaccgcctgcagtcacggtgtccacgcacaaggccaagctgcacaccgctgagggtcggcggcctccccgcccaccgcctgcagtcacggtgtccacgcacaaggccaagctgcacaccgctgagggtcgggggcctcctcgcccaccgcctgcggtcacggtgtccacacacaaggccaagctgcacaccgctgagggtcggcggcctccccacccacggcctgcagtcacggtatccacgcacaaggccgagctgcacaccgctgagggtcggcggcctccccacccatcgcccacagtcacggtgtccacagctgcaggcactcggtgtacgcctggctgcagcccactcagcaacagcaccccacctgctcaggccagagggcggcctgaaccacaggggacgtggagacagcacccaaggcgcagtaggtccacaagtggggagaatccagggcatgattctcaggcaccgacagaaccctcgctctgcatgcccaagggctgtgcgaggaaggcaggtgcccagctccccagttcttcgatccagtaaaaggagaccccaaattcagaaagccctggatcaactgaaacagttcttccagtaaggtgtttttctattaaagacaaacaccaagttactgcaactaccaagtcccaatattcgaggggagccaactaagcatcaagatggggccctctgggaggctctcaaaccaaaggatacgcggcgtgccctccgtacggcagaccaggtagaggcaggcagcaatcacgtgggccatcttccggccgcgggtcaggtgcctgctcacggccatcttgaagaagttgaaggcggtgtccaggcagtgctggttcagctgcagctggttccccaggtggtggatgtggcgcctccctaggacacagcacgaggcagctcttagccaaatgttcccacagaacatgaaaagtatcacacggccacagcagcaactttaagaatatagatttgtgcttttccttgtaagtttctgagctcactttttatatgtgggttccaatcactttttatttaaggacactgaaatgtgaattttctgtgatctccatgtgccatgagatcctgttctacctgtttcccttctttaggctctgagtggcgtgtgcggtgtggctgaatgtgcctctctccagggctctgaggtgcggcgtgtctggcaagggcttggtttgggctggctggcaggtgctatgcccctgactgccctgggctacagtgggaatgccccttttcctacagccacatgccccagcgccaccgccttccccaaccgcacagagtctgggtcagcccacccgtcccttctcagcagggcccattctgctcagccctgcgcccgccagcctctcctctaagagccagccacccggcctgagaaaaagccaggctagcgccatcccctgcacctgcccagagggagggccatggtgtagggaaaaggaagagaggtcagactgttactgtgtctatgcagaaagggaagacataagagactccattttgacctgtgccctgaacaactgctttgccctgaggtgttaatctgtaactctgccccagccactttgccccaacctggagctcacagaaacctgtgctgtatggaatcaaggtttcagggatctagggctgtgcaggacgtgccttgttaacaaagtgttcacaggcagtatgcttggtaaaagtcatcgccattctccagtctcgatgaaccaggggcacaatacactgcggaaagctgcagggacctctgccctggaaagccgggtattgtccacggtttctccccatgtgatagtctgaaatatggcctcgtgggatgagaaagacctgaccgtcccccagcccgacacccgtgaagggtctgtgctgaggtggattggtaaaagaggaaggcctcttgcagttgagatacaggaaggcctctgtctcctgcctgcccctgggaactgaatgtctcgatataaaacccgattgtacacttgttcaattctgagataggagaaaaaccgccctatggcgggagattagacacgttggtagcaatactgccttgttattctttactccgctgagatgtttgggcggagagaaacataaatctggcctatgtgcacatccaggcatagtaccttcccttgaacttaattatgacacagattatttggttcacatgttttcttgctgaccttctccccactatcaccctgctctcctgccgcattcttcttgctgagatagtgaaaataataatcaataaaaactgagggaactcagagaccggtgccggtgcaggtccttggtatgctgagtgccggtcccctggccccactgttctttctctatactttgtctctgtgtcatttcttttctcagtctctcgtcccacctgacgagatatacccacaggtgtggaggggcaggccaccccttcaccatggtaagggcatgcccagcagaccggaggccactgcgccctcctaggggctgcgaggtgctggaggtggccaggacggcaacatccgagcacacgcgcctccctggagcaagaccctcccaaagctgcgggccacatgatggcatcaggagggaaatggcaaagctgccctgcaggcaggaggaaccttgggaaacaaatgtcaatgcagagtacaggccaacctcactgccccactctgtctgcagagcacaggctgtgtggggagcacctgggccaacctcactgcccccacttctgtctgcagagcacaggctgtgtggggagcacctgagccaactttactgcccccacttctgtctgcacagtgggcgtcgtgggcaggcagagtccttgctccaggcaattagccccatggggtacccagaggacatgtgtggtgggtcacggctcgatgcagaggaatgctgccgccatggagattccagttcccactgcatcctctggcacccaaacccacagtcctcctgcaaagactacctgaggcggcctccatccccatataaagtcaaaaactgacctcccagatttatttgataagggcacatgagctggagaaagtgagggctgatgttttgctcacgccaaacttcactaatgatgaccagcagccagaggtgggcagctgctgagcctgcatcccaaggaagccggtggccagggtacacagtctggcaggtccaggtcaagcctcacactgccaggcccctggcagtcagcagcatcacatggagcccccagcccggctgtggccctgccaccttgagcacctaaggccacctgcctagagctcatacagctctgaggcctgcagtccagctgagctgacgtggaaggctggtcactgtccccagagctgaggcctgggccaagccaagaccccaaaagaatggacagaaagggcatcgtgccagctgccacctgcacatgtgcagcaccagccagacacaccagcacagaccgtccccgcggcccagcaaggcccagagggaaacagagtcagctgacaggggacccgctgaagctacggctccttacctaccagctctctgctgtatgtttgaaaattctgtaataaaaggtaagagagaggtactctctgaggccacacacttgaggctgggactcgatcccaagccccgaccccacaggcaccagctcgtgttcccagcatgcagggctgctatggtcagaatgtctgactcctaaaattcctatgttgaaatcctatcccctacggggatggtattaagatgcagggcctttgcgggagactaggtcaggaggcagagcactaatgatgagctcagtgcccttaaaaaccggaccccagagaactagcccagctcttctaccacgtgaggccacagtgagaaggagctgagaggcggccctcactagagagctggggaggaggccacagtgagaaggagctgagagggggccctcactagagagctggggaggaggccacagtgagaaggagctgagaggcggccctcactagagagctggggaggaggccacagtgagaaggagctgagagggggccctcactagagagctggggaggaggccacagtgagaaggagccgagaggcggccctcactagagagctggggaggaggccacagtgagaaggagccgagaggcggccctcactagagagctggggaggaggccacagtgagaaggagccgagagggggccctcactagagagctggggaggaggccacagtgagaaggagccgagaggcggccctcactagagagctggggaggaggccacagtgagaaggagccgagaggcggccctcactagagagctggggaggaggccacagtgagaaggagctgagagggggccctcactagagagctggggaggaggccacagtgagaaggagccgagaggcggccctcactagagagctggggaggaggccacagtgagaaggagccgagagggggccctcactagagagctggggaggaggccacagtgagaaggagccgagaggcggccctcactagagagctggggaggaggccacagtgagaaggagccgagagggggccctcactagagagctggggaggaggccacagtgagaaggagctgagaggcggccctcactagagagctggggaggaggccacagtgagaaggagccgagaggcggccctcactagagagctggggaggaggccacagtgagaaggagctgagaggcggccctcactagagagctggggaggaggccacagtgagaaggagccgagaggcggccctcactagagagctggggaggaggccacagtgagaaggagccgagaggcggccctcactagagagctggggaggaggccacagtgagaaggagccgagagggggccctcactagggagctggggaggaggccacagtgagaaggagctgagagggggccctcactagagagctggggaggaggccacagtgagaaggagccgagaggcggccctcactagagagctggggaggaggccacagtgagaaggagccgagaggcggccctcactagagagctggggaggaggccacagtgagaaggagccgagagggggccctcactagggagctggggaggaggccacagtgagaaggagctgagagggggccctcactagagagctggggaggaggccacagtgagaaggagctgagagggggccctcactagagagctggggaggaggccacagtgagaaggagccgagaggcggccctcactagagagctggggaggaggccacagtgagaaggagctgagagggggccctcactagagagctggggaggaggccacagtgagaaggagccgagaggcggccctcactagagagctggggaggaggccacagtgagaaggagctgagagggggccctcactagagagctggggaggaggccacagtgagaaggagctgagaggcggccctcactagagagctggggaggaggccacagtgagaaggagctgagaggcggccctcactagagagctggggaggaggcaactgtctcccccatctccagctcaaactttccagctccaaaagtgtgagaaacacattcctgctgttttgcctttctggtctatggtgttctgttacagcagcccaaaaggactaaaatgggggcttatgatgactgcagtaagttattttttaccatcttctttctcttttttgagatggagtctcgctctgtcacccaggctagagtgcagtggtgcgatctcagctcactgcaacctctgcttcccgggttcaagtgattctcctgcctcagcctcttgagtagctgggactacaggcacatgccactgcacccagctaattttttgtatttttagtacagacagggtttcacactgttggccaggatggtctcgaactcctgaccttgtgatccacccatctccgcctcccaaagtgctgggatacaagcatgagccactgtgcctggccaaatatgttattaataaacagatattcacatagaaaccaactactaattagctagccatagcctgcgagtctccttagacttccttccaacaaatgaattctaaaagtaaactcaggctgtgtgccgtggctcatgcctgtagtaatcccagcacttcgggaggctgaagcaggtagatcacttgagcccagaagttcaagaccagcctgggcaacatagtgagatccaactgctaaaataatcagccaggtgtggtggtgcaagcctgtaggcccagccaaggtaggaggactgcttgagcttggaaggttgaggctgcagtgagccatgatcctgccactgcagtccagcctgggcagcaagagagcgagaccctgtctccaaaaaaaaaaaaaaagatttgaggcatatcaccacttacatgtaaagtataaagcaataaagcttccagaggaaaacacaagagtatcttcagaccttggagtagataagaatttcttgaacaagtcacaaacagccctaaccataaaaactgatatactgggacttcattataattaagaaatttctggcagggtgcagtggctcacacctgtcatcccagcactttgggaggctgaggtgggaggatcactggagcccaggagttgaagaccaacctggccaacatggtgagacccccatctctatttaaaaaaaaaaaagaattggccgtgcgcagtggctcatgccggtaatcccaacactttgggaggccgaggcgggcagatcacgaggtcaagagatcgagaccatcctgaccaacatggtgaaaccccgtctctactaaaaagtacaaatattagccgggcatggtggtgcacacctgtaatcccagctactcgggaggctaaggcaggagaatcgcttgcacccatgaggcagaggctgcagtgagccgagatcgcgccactgcactccagtctggcaaaagagtgagactccatgtcaaagaaaaaaattaaaaatgagtggatgtggtggcatgtacacgtgatcccaactactcgggaggctgaagtgagagggcggctttagtctgggaggttgaggctgcaaggagcatcgactgcaccactgcactccagcccggaccacagagtgagtgagacccagtctcaaaaaaaaaaattcagaagtttctgttcgtcaaaagacaacattaagagagtgagacaagctacagacgtgggaggaggattcgaaacatgtatatccaacaaaggactcgaatccagaatatataaagaactctacaaatctgtaagaaaaagacaactcagtttttaaaaagcacaaaagacgccaataggcacttcacacagaaaggacgtcccaacagccaagaagcatgagcaaaggttgtggccataattactcaccagggaaagcgaattaatgccgcagcgagtgtgctacacacctaccagaaagactacaactggaaaggctgatgatgccacatgtgaacaaggctgcggagccactgggactctcctacactgcttcctggtgggaacatgaactggtacaagcactacagaaaaccctgtggccctatctaatgatgagcacacccagacctcaggacccagacacccattcgcaggtaaactcccaagcggagggggcacctgtgtccaccgaaggaccaggtgcaagaacacgcacagcagcttcctgtgcacagccaagaatggaaacaccctagacgtccatcaacaggaaaaggagataaactgtggtctattcatcccatgaaatactacattgcaataaaagaataaactacttacacgctccaaaacagcacgttctagaacggctccagcccagacactggcaagccagatgcggacgactagagccacaggagctctccttccttgctgctgggagcacaaaatggctcaggtgctttggaaaagggtttggcagtttcttacaaaactcagcatactctcaccacaccacccagcaatcactcagaaaaacctgcacgtgacgtttacagcagcttcactcataatcgcccaagcccagattcccttcagcaagcaggtgaaaggataaatcaactgtggcgcacctaggcggtggaatattactcaccactaaagagaaagaggccacaggctgtgcagagacctggaggacagttaaatgcccatggctgagtgacaggctgcacagagaaaggatgcacagtgtgcaactccagctctacgaccacatgaccaagcgccggtgaaaagatcaatggttgctggaggctggggaaggagggatgaatgggtggagctcaggggatctttaggactctgaaagcactctgtatgaaactgtaacagtggttacccgtcactacgcattcatctaaacccatagaacacgcaccgcccagcgtgagcctgggtgtgtggtggaagctgcgtgatcctgagcccaggtgtgcagatacagcctgaatgatcctgagcccgcgtgcgcaggtggaggctgcatgatcctgagcccgcgtgtgcaggtggaggctgtgtgatcctgagcctgcgtgtgcaggtggaggctgcatgatcctgagcccggctgtgcggtgaaggctgcgtgatcctgagtccgggtgtgcggatacagcccgcgtgaccctgagcccgggtgtgcggatatagcccacgtgaccctgagcctgggtgtgcaggtggaggctgcataatcttgagcccaggtgtgcaggtggaggctgcatgaccctgagcccgggtgtgtggatacagcccacgtgaccctgagcccaggtgtgcggatacagcctgcgtgaccctgagcccaggtgtgtggacagagcctgcgtgaccctgagcccaggtgtgtggacagagcctgcgtgaccctgagcccgggtgtgtggatacagcctgcgtgaccctgagcccaggtgtgtggatacagcctgcgtgaccctgagcccaggtgtgcggatacagcctgcgtgaccctgagcccaggtgtgtggatacagcctgcgtgaccctgagcccgggtgtgtggatacaggctgcgtgatcctgagcccaggtgtgcaggtggaggccgtgtgatcctgagcccgggtgtgtggatacagcctgcgtgatcctgagcccgggtgtgtggatacagcctgcgtgaccctgagcccgggtgtgtggatacagcctgtgtgatcctgagcccgggtgtgtggatacagcctgcgtgatcctgagcccaggtgtgcggatacagcctgtgtgaccctgagcccgggtgtgtggatacaggctgcgtgatcctgagcccaggtgtgaggtggaggccgtgtgatcctgagcccgggtgtgtggatacagcctgcgtgaccctgagcccaggtgtgcggatacagcctgcgtgaccctgagcccgggtgtgtggacagagcctgcgtgatcctgagcccgggtgtgtggacagagcctgcgtgatcctgatgagtcgatgtggggcggctgactgcagctcgtgcaccacagtggaggggggcactgacggggtcaggggaagctgtgtggtgggaggtgctcagagtctacaggaactctctgccgatccattttgctgtgaacctaaaatgctctaaaaattacaagtcttttttttttttttaaattcctttctatatgattcccactgtatgaagcagaaaaccaagtgaagccagtgggcagcaggtgctttctgagctgctgcaggcctgactcatgtggatttgtcaggtggttcatggaaggtcagcacatttcatgcactttactatgcgtgctatactaggaaaaacagaccaagagaacagaaaaagaatttccctgagaaacgcgtcccaaacgaaaggctcatcaggtcaatgaagagagccccacctagcggcatttcagaaccgtcgcttcagaacatcaaagaaatcatcccaaaaggcctgagattttaaaaacagagatcaaaacacactggcattcaacgtctcttgctggtggacccggagcagatgctccccacattccatggggtgcctgtctcaaccccttggcaaccatcccagggggaaggggcaggagtttctctctcccagaccctttctctaaatacagtctcagcgtgtccccagcaaaccaaaggaggggcctgtgacctcgcagggtgcacggaggcaagcagaggagacagagtcctcgcagaacatgactgtcgctgcgggcaggaagggtggcccgtgagtttatttccatctttgcagttttctaagaaaggcaatcaagacttcaccaaaacagtaacagtcggaagctacattcacagatttccaccaaacctggcaggctgggtggcgggcgggagtggaggccgtgggccaagcttgcagcgggaccagggctgatatgaaaacttcaaccaaggcggtatggggagaacaaaggagaataaacaaaatttaaacaaacataacccatgataaatcaatcaatcaaaataaagggttttttaaaagtaagataaatacagccaggtgtagtggctcacacctctaattcaagcactttgggaggccaaggcgggtggatcacctgaggtcaggagttcgagataagcctggccaacatggcaaaaccacgtctctactaaaaatacaaaaattagccgggcgtgatggtgggcacttgtaactccagctactcgggaggctgaggcaggagagtagcttgaacccaggaggcggaggttgcagtgagcccagatcgcgccactgcactccagcctgggtgacagagcgagactccatctcaaaaaacaaacaaacaaacaaaaggtaagataaatacgaaatacaaaataagaggcaggaagagcccaaagcatcagaaatgtgccagttataatgggccaaaatcccctcttgtgtctccagaagtatttgaaaaatacgttaggatctgcctcacagacatgctcccaggacactcgacagcaaggaggtacggcgggcccagccagccaaggcagaggaggacatcactgccacagcagggggcctgactggcagcaaaagggacgactccggcgaaaagtcagcaggaaacaggacaggggctggaccaatggcctccctcagccccacaccccacccaggcaggagcggtgcctggcccggggcaggcgggtgggagagctcactgagtgggcagcagggcatggcccctgatgctgcaggtacccaggctgcagctgcagaacctcaggtgggaacccaggtacaaagatcagcatagggtcccccagaaccacccatccccagtaagactcaagaggggtgggggccccgcagcttcccccacacagtgagtggggtccacggggcctcctgggcctgcaggtcacaaccttcactgacactcacccctaattagggagcatgtatgttccaattttcatttctttcttgaaccaaaggtatttaaaaggcttttgaaaaggtaagatgagccatttctctttctctgttgttggtttccaatcctattgcaatgcacgcgtctgcaccgacactactctttgcaatttgtataggtctgaggcacgaccaactctagtaaagataccgcgagtttttgggaaaatacagactacattctctgtggagaacaaagctcttcacatggagaaaatcttgaagtcagtagaagaaaaaaaggagatagcctagtggcaccacaagcaatgggcagagctgggccccaacccaggcagcctgaggtcaggagggcccctgggcagcgcagccccagcccccacctggaggaactgtaaacgtgtgtgccaggaagccctgaaacagacaaaacaaaaaactgacaaaactgtgggtaggacaggacggatccagtcactgtgccaggtcttcatgcacactctcggtggcagacacagagaaccagccagtggagaggaagagggatgtgctgcgctgcacccgcttcctgcaggaaacgcattcaagcgcccaacacacatgcacgtccacaaaactggccttccacccggccacggctcgaagcatttccgaagactgaaatcacacagagggtgctctctactgcagaagaatcacaccggcagtcaggaagaaaggcgctgactatactcctctactagtaagtccacagcaggacaaggaaaaaagcacaagggaagcgtaaggatccatccactctgctgtgagggatcatcgcaagcccaactacccctgccagcctaggtgtgtcggtgctggccacccgtcggcagcagcagccaggagcagaggcaggtgctcaagagcccggcctcctggagatggcccaggagaaaacagccagggtgacgtgctgtccacaagagatgttctacctgtcccgaccaccttccagcatccacactaaggctgcaggacatggctgcaccgatcacaagaatccctcacgtggtcctcaggttcctgagagtgtactcaatgaaacagtgaagccaaagagatcctagcacaaagtatccctgcctggactgacccacggccaacccacactcaatggtgaagactggatgcttccccaggatcaaggacaagaggatgtctgttcacaccactgctattcaatgtggtaaacaaaaaaaacaaaaacaaaaaacaggcactagactagaaaggaaagataacacgatcttgtaccgaaaatcctaagtgatccgctaaaaaactattcagcataaaaaatgagttcagccaggctgcaagatacaagatcaatacatatcaactgagactaaattcgacaaaagaagtacaaaacttatactctgagaactaataaaattgttgaaacaaattaaagaagacccaaataaatggaaagaaatcctgtattcaggtatcagaagactttacactgtttaggcggcagtgttccccaaaatgaccaacatattaacgcaatccccgtcaaaatcccagctgacttcttggcagaaactgacaagctgatcctaaaattcatattgccactcaagggacttcaaacaggcagcataacacttttgaaagagagcagttagaggactcacagttcctgatttcaaaactgactgcgaagcttcagtgtcctgaacagcgtggaacgggcaccaggactgtcatgcagtcactaagccaaactgaggatccagaaatgagcttttaggtttacggtcaatcgattttcagcaagggcaccaagaggatgccaactggcaaaatacagtgttttcaacacatggtcctgagaaaactgggtctgcacgtgcaggagtgaaggcaggcccttaccttacatcacatgcaaacgctgactcaatatggaccaaaacctactggaaagagaggaaggcgcaaaactccaaaaaatcataagcacaaatcttcacgatttggactggattaggcaacatttgttagttatgataccaaaagcacagccatcaagagactaaataggtaaactggatactatcagaatttaaaactttcatgctccaaaggataccagcgaaaaataaaaagacaaaagaaaatgaaaagaacgcatgaaatggctgaaaatgtcctataaatcacacatccgataaaagacttgtacctaaaacacataaaatcacacatccgataaacgacttgcacctaaaatatataaaatcacacatccgataaaagacttgtacctaaaacacataaagaactttttcaactcaatcataagacaaataacccagcagacatttctccagtttgtggtgaactggcactttgacaaaacgcagtgagaatgtcactacaatatccaactgctataaatgtgttatttctgcctccatctcactgaggccatcaagcaatggctgtggatcctgtgggatccactgggttctccccaaacagccctggcagagtctgcaggacacccaggaggggactcagggcacaattcctcctggaaagcagcctgggctgggcgtgcagggtgacgaggaagtggcaggccatgaggtccatggctgagtcagtgccctccaccctagcaccaccatccccatctctgggacccgccgcacgctcagcagcatccgcggtgggaaataccattctgcagggtctgcgctctcgactccttccccagattcacgtggaagccgccacccagagtcggggttttgccagcacctggaaacacaaaaaaagacagatcagccaaaacttggagatctgcatttacaaccctttcctaacatccacagacacaaagtgagaacaaagcgggggtcagcactcatgggggaagcagcaggtcggccccccgcacctccgtcactgagccaggaaccccagtgggggaagcatctctcactctgcccagccagcagggttgagggtgggccaactgcactttccgcattttctttttttttttgagacggagtctccctctgttgcccaggctggagtgcagtggtcccatctccactcactgcaagctccgcctcctgggttcacgccattctcctgcctcagccttccaagtagctgggactataggtgcccgccaccacgcccggctgggattacaggcactttctgcattttctaaccatgtccctaacacactgcaagtccagagtggacgctgtcaaatggctgccgggcgagaacacagatgtacctccaaacctctgcaagtggtgcacacacagcatgggctggccgtcccccttgccccaggccagcccactcagatatcactcctgcatggtgaccacatgtgaacacatccacctccctgctggactgcaggggacgcaggtaccatcccatgtgccccaaggcactgcaaccagccagtctgcagaaggcccccacgcctcagtccacccacccatggggaggctgcagctgaacctgctggacactctactccgaagctctgccaactgacagcatgcctacgacgtccaccacattctgccctgcagggcttcggggttaagacctggccctggtacctctggaaacatcaggtggacatttggattgttcaccaggttcaccagcccgatcgctgcagcctgatctcccaatgagcatggtggacatgtggattgttcaccaggttcaccaacccaaacgctgcggcctgatcttccaacgagaacagtaaggtgaggccccaggcatgcccaaagatggggagagctggaaagtgccccccgccccgcagcgtcggccctcagtggttggcacaggggccagtgcatttgtgacaaagcacagacacaggactggaggctgctgcaatcgggacgcgcagacaaccttggccacttgggggaaggcaagtgtgtagggcctgtcggaggacactggaaggataggatgcagaagcagaaagccaatcgctggagcctggggccaggccctccagggaaaccatgaggcagggacctcagcgtcatccaggggcagccaccagcacagacaaggcagaacaggcacggcctctggcttcacaatgaatgtaactgaatcccaaacaaatactaacaacactctttaaagactccagtaaaatgattctaaagttcagttggaagcaaaaaggaattagagcagccaagaaaagttttgaagagagcaaggggcagctactgggcccgtccggaaactcagagctgaacagggtcaggtggcactcagcttttcctggtggcagcagaggcaaagcccgggcctccttcaggctgaggcccagagccggcctcctggtgggtaacgtggccacaggggtggccggcagcagcagcagggcaccagcactgagcacaggcctccaacaaaggtggtgccgggacgggggcagtgcctggagactacctaggttgtcacaactgggatctatgtactagttttctgtggctgccataaaaattgccacaaacctagtggctttcaagaagctgtagaaggtccgggcgcggtggctcacgcttgtaatcccggcactttgggaggccgaggtgggtggatcacgaggtcaggagatcgagaccatcttggcgaacatggtgaaactctgtctctactaaaaatacaaaattagccaggcgtggtggcgggtgcctgtgatcccagctactcaggaggctgaggcaggagaatcgcttgaacccaggaggtggaggttgcagtgagcagagatggtgccactgcactccagcctgggtgacagagcaagactccgtctcaaaaaaataaaaataaaaataaaaataaaataaagtaaaaaagaagctggagtggtggccgggcatggtggctcacacctgtggtcccaacactttgggaggccggagcaggaagatcgcccaacccaggagttcaataccagcctgggcaacacggggagacccatttctttctttctttctttcttttttttttttttgaaacagagtttcgctctgtcacccaggctggagtgcagtggcgtgatcttggctcactgcaagctctgcctcctgggttcatgccattctcctgcctcagcctcccgagtagctgggactacaggtgcctgcaaccacgcccggctaattttttgtgtttttagtagagacggggtttcactgtgttagccaggatggggggagacccatttctacaaaaaaaaactgaaaaaaattagctgggtgtggtggcacctgcttgtggtcctactactcaggaggctgaggttggaggatcactagagcccgggaggtcgaggctgcaatgagctgagatcgtgccactgcactccagcctgggtgacagagcaagaccctgtctcaaaaaaaaaaaaaaaaagaagctagaacaggccaggcatagtggctcacatctgtaatcacagcactttgagaggctgaggcaggaagactgcttgagcccaggagttcaagaccagcctggacaacatagcaagatcccatctctacaaaaaaaaaatgagcggggtatggtagggcatgcctgtggtcccagctactcaggtggctgaggcaggcagatcgtttgagtccagaaggtggaggctgcagtgagctgtgatgcacctctgcactccagcctgagcaacacggtgagaacctgtctgaacaaataataaactaaacagaagctggagcaggtcgcagtggtgtctccttgtgggggctggagaggacctggcagggccacagtgaggtgcctgctgatatgagaatccagaagagaggccagggagaaacgcaggactcaggagagacccatcctggaataagggggctttgagcagcactgatgagccaattctaaattctgcagaaatctggcccaggcctccccaggctgagctccaggtgcctgcaactccgaccctccctcagagttctttgttttgtgagcagtgtgtattctttttttttttgagacggagtctcgctctatcgcccaggctggagtgtagtggtgcgatctcggctcactgcaacctccgcctcccggattcaagcaattctcctgcttcagcctcctgagtagctggaactacaggtgcgtgccaccacgcccagctgatttttgtatttttactagagatgaggtttcaccacgttggccaggctggccttgaattcccgacctcaagtgatccacccacctcggcctcccaaagtgctgggattacaggcgtgagccaccacgccccgcctgttttttctaagcgttcgaattaagatcaccattctgtgtagcccctggcatgctggtctccagcacatgctccctcaccaactttcactttagaaaaagaaaaatctcactatattctaattagtgtatataatgcttttaataaataactcatataacactacattagaaaaaggacaatgatcaaagtataaaaagccagctgggtgcagtggctcacgcctataaccccagcactttgggaggccgatgcggttggatcacctgaggttgggagttcgagaccagcctaaccaacaaggagaaaccccgtgtctactaaaaatatgaaattacccaggcatggtggcacatgcctgtaatcccagctactcaggaggctgaagcgggagaatcacttgaacctgggaggcagaggttgtggtgagccgagatcgcgccattgcactccagcctgggcaacaagagcgaaactccatctcaaaaacaaataaataaaaagcccctgaagccccaccttccaagaacaggggacgccgtacagcctccattatagccacgtttccctgcctaggtacagtgggctgcaggcgtgcttctgacagaacagggccacagtgagatgccacgttaaattacagtgatgatttcgattctggttgtgttttacgcaatctcttcactccttgacccatacccatcagcttgcaccacagcacactgcaaagctgcatgcgtcagcagctccacgctccacctgccacctctgccctccctcctccatcactctgtcttgcaccctccagcctcccataccctcctcacaccccaggacctctgtttcctgtccctgtgttgttctccctgtcccccaacaccacagtcaccctccctggggccacgctgctgcacctgctctggaagcgcctcctggcttctgcttgcctcacaccctggtgcgtgcacacttgcaggcacacacacacaggacacatgtggacagtgtgaaacctcagaacactaacccacagggaggatgaaagaggaaagtgccacctctggctgaaactgccaggatgccctctacttctaaaaacatttggtattttccatagcgtgtttctataacaaaaaatatgtgctagttcccgttagctggaactgacatgtggaaggggccaggtcttgtggggcctggccaagactgcccccctgtgtacagcaagggaggacctgcggttccaccagagccagagcagggccagaggccgcaggggcacctctgagctccgacaaagccagcaacaccccataccgccgaacagacagaaaggcgggccaggggccctccatgtcctgaaagacccagcacagcactgtccatttcacaccaggattcttccaacatgagaaagcaataacctttaatattcacgtgctcattcaacttaactgggggcgggctcagtggctcatgacagtaatctcggcattttgggaggccgatgtgggtgggtcacttgaggtcagaagttcaagaccagcctggccaacagggcgaaaccccgtctctactaaaacatacaaaaaaaaaattagccaggcatggtggtgtgctcctgtagtcccagctactcgggaggctgaggcaggagaactgcttgaacccaggagatggaggttgcagtgagccaagactctgtcaaaaaaaaatttttttttaactggagactttctgttgctgctgtgaaacttcctttttttaagagacagggtctggccgggcgtggtggctcacgcctgtaatcccagcaccttcggaggccaaggcgggtggatcacctgaggtcaggagtttgagaccagcctggccaacatggcgaaaccccgtctctactaaaaacacaaaaattagccgggcatggtggcacatgcctgtaataccagctacttgggaggctgaggcaggaaaatcgcttgaacccgggaggcggaggctgcagtgagatgagattgcgccattgcactccagcctgggcaacaagagagacactccatctcaaaaagaaaaaaaaagaagtctcactctgtcacccaggctaaagcgcaggggcaccatcacggctcactgcagcctcaacctctcggactcaaggaatcctcccacctcagcctcccaaataggcgggaccacagacatgcgccaccacgcctagctaatgttttcttattttttgttttctttgtttgtttttttgaagacaagacagagtttcgctcctgtcgcccaggctggagtgtaatggcacgatcttggctcactgcaacctccacctcccgggttcaagcgattctcatgcctcagtctcccaagtagctgggattacaggcgcccaccaccatgcccagctaatttttgtattttggggttttttcttgttttgtttttttagtttttgtagagacagtttcactatgttgcccacgctggtctcaaactcttgacctcaagtgatcctcccaccttggtttcccaaaatcctgggattacaagcatgagctaccaaacctgactggaaacttcttttaaggggagacacctgtaggaggcctggctggctgggcagtaatggatggagaggaattcaggggtcccacaggtgagtgcccaaaggaggctggaccagaccgcagtgcatccctgagagctggggacggggacccgggaacacagagcgtgtgcctactggtggggctggatgcagtagcatcagacatctgggaggagcactgacaaacagggccaagcacggcagcccacaccccttcccaggcgcagacccttcccatgcgcacaccccttcccaggcacagacccttcccaggagcaaccctttcccaggcccacaccccttccccaggcccacatcccctccccaggtccagaccccttcccaagcccaggccccttccccaggccactgcggaggagctggttttgtagtgattacaatttggttacggaaaacaggacgtgtgtcacgctgcaggctaaccagcagcttcctccctcacccagatggcaacgggacagaattcacccgtttcctaagagcaggcaccttcagccacaacttagggttctgggggtcatggagcagaggcagaagcctggagccttccaccctcaggactagagccccgccaggaggccaggcgcatgctcagaaccccaggccgcagggagaggctggccggtcacatccttctctgaggcagagggagcttcccagcaggcgagggcaactccaccacccatgtccccctccagggccagcgccaggtgacatgcagccatgtcacaaattaggtccggctgcatcgtgaccccaaacggaaaacagcagcactcacggacaccccagcttcgaagttctaactgtgaagccactgaaagttgtgattacgggaaacgctccccacccccacaagttctggtgacactgaggtgtgctgctccttgcacaggacgaggagggacccctgcaagcaggagcccaggatgtctggtgtgtgggcgccatcaccatcacctgctggcagagggaagcctcagggcacacacagtgcaggacactgatgtgggctcacagggaagccccgccttgcctcagtggagcagacggcctcctcagggcactgccaacggcccccaactccaccgtctgcctggcccctccagccacgctgagcctcagtcctcacccacccttctctctgcacagtctctgctcgggtgccccgggacgctggagcaccagtgtggtttcccccgtggggcctggcttccaaggtcaggaccctctggggactctcctgaggcctctggtcacctgccctgatgccttagttaaatattccagagtaaactgcgaagctgtatcaggcttagttctcaattaataggcaaaacacctaggaaagacagtggccttgggactagaaaacgacagctcagagagaaagctcagctttcaagatgaagctggaggaaggggcggctggggcctacttgtgtgccagggaaactgagaagccaccaaggtttccagccccctgtgatcaccactgtgacgagggaggaaggatgccaagtgggcacctagagagcctgcctgggagacagaggggctgcccagagcaacagatcccctctctcctccccactctcggcccaggcaccacctgcgccggtccccaggggctaagaacccgccgcctcgcagcacttcccccaggaccaccacagttggttgctgggcctgcgcctccctccagagagtgtgcctgggctcagaggcgtcttggggccacctgacagcgctggctctgagcttgttctgacagcacccgggtgacagacttccagctctgcactgctccacaccaccatcctcccccggcagggcacagtgagggcagtgcgctgtcaccaggcccggatgcacttaacactgtgcctgcccgggaaaccctgcgtctgctgccatgacaacttgctttcattactgttgttatcatcccaacagacatccaagtcttggcaactgtgacacagctgcaaactctgtgcccagcagtcctaggaagatacccagggagtatgagcatggaagacgatggggagggaagagcaggagagaaaactcaatgaagcccaagccagttcttagaaaagatcaaaaacacggatcaacttctagcaagagagacaaagggaaaaaaagacacaaaacaccaacatctgaaaggaaaaaggaggccactgtggaccccgcagatatcaaaaggataagggaatgcttcgaacaactctctgggcaaattcaacaactaggtcaagtggaccaattcctcaacacaagcggctaattcaccccaggtgaaacacagcatcttaaatataactagaacctcagtgatgaaagaagccgaaaccacagtgcagaatcttctgagaaagaaagctttgggaccagatggctacgctggtgaattctaccaaacatttcagaaagaaagaacaccaactctacataatgtcttccagaaaatagaagaggaaacgtttcccaacccattccataaggagcagaaccctgatacccaagacaaggacgttacaggaaaaactacaggccaatatcccacgcaagcatcagcaggaaccctcaacagaacatccggcgctgagcaaagcagctcatgccgctaatcccagcactctgggaggccaaggtgggaggatgccttgaggtcagaagttcgagaccagcctgagcagcaaagcaagaccacatctctacaaaaaaaaaaaaaaaaaaaaaaaaattggcgttggctcacacctgtcatcctagaactttgagaggccaagacgggagaattacttgagcccaggagttccagacgagcctggtcaacatggcaaaaccccatctctacaagaaaaatacaaaaattagctgggtatagtagggcgcacctgtagtaccagcaactcaggaggctgagctgggagggtcactggagcccagggggttacgactgcagtaagccatgaccactgcactccagccagggtgactgagcaagaccctagaccctgtctccccaaccaaaaaaaaatttttttaattagctgggcatggtagtgcatgcccgtagtcctagctactctggagtctcaggtggaaggatctcttgaacccagaagttccaggctgcagtgacctgtgatcacaccactgcactccagtctgggcaacagtgagactttgtcccagaaaaaaaaaaaaaagctgggtgcggtggctcacgcctgtaatcccagaactttcaggggccaaggcaggtgtatcacttgagattagaagttcaagaccagcctcaccaacatggtgaaaccccatctctactacaaatacaaaaaccagccgggtatggtagtgggctcctatgtaatcccagctactcaggaggctgaggcaggagaatcgcttgaacccaggagggggaggttgcagtgagcccagattgcgccactgcactccagcctgggcaacagagcgacactctatctcaaaaaaaaaaaaaaaaaaaaaactcaaggagtgtattaaaaactcttaggggccaggtgtggtggctcacacctgtaatcccagcactttgggaggccaaggcgggtggatcgcctggccaacatggcaaaaccccatctctactaaaaatacaaaaactgcggccgggtgcaacagctcacacctgtaatcccaggactttgggaggccgaggtgggcggatcacgaggtcaggagattgagaccatccatgtaaccccgcctctgctaaaaatacaaaaaattagccgggcgtggtgctgggcgcctgtaatcccagctacttgggaggctcaggcaggagaatggcatgaacctgggaggcagagcttacagtgagccgagattgtgccactggactccagcctgggtgacagagcaagacgccgtctcaaaaaaaaaaacaaaaaacttagctgggtgcggtggcgggtgcctgtgatcccagctacttgggaggctgaggcaggagaatctcttgaacctgggaggcggagattgcagtgagccaagatggtgccactgcactccagcctgggcaacaagagcaagacaccagctcaaaaaaaaagaaaaaaaaaaaaaaacctcttagaacaagtaagtttagcaaagccataggaaacaggacaacacacagaaatcaaccatatttatataaacaagcaatgaagagttgaaaactaaattaaaaaaattccacttataataactcctaatagagcttaggtacacatctaaaaaatgtccagagggccaggcacggcagctcatgcctataattccagcactttgagaggctgaagtggggggggatcacttgaggtcaggagttcgagaccagcctggccaacatggtgaaaccctgtctctactaaaaatacaaaaattagccaggcgtggtggtgggctcctgtaatcacagctacttgggaggctgaggcacgagaatcgcttgaacccaagaggcagaggttgcagtgagccgaggttgcaccactgcactccagcctgagtgacagagcgagactccatctcaaaaaaaaagtccagaagctgtatgctgaaaactacccaacactgacagactatatcaaagaaaatctaaatgaatgcaaacatacactgtgttccatggactacaagattcaacatagaaaaaatgtcagctgggcacagtggctcccacctgtaatcccagcactttgggaggccgaagagggcggatcacgaggtcaggagttcgagaccagcctggccaatgtggtgaaaccccgtctctactaaaaaatatacaaaaattagctgggtgtggtggcgtgtgcctgcagtcccagctactcagaaggctgaggcagcagaatcacttgaactcgggaggcggagggtgcagtgagctcagatcgcgccactgcacttcagcgtgggtgacagggtgagactctgtctcaaaaaaagagaaagaaagaaaaaatgtcagctctccctaaatatatcaagaggtttaatgcaattccaatgaaaaccccaccaggacttttgtacaggttgaacatcccaaatccaaaaatctgagattataaatgctccaaaacggcccggtgcagtggctcacgctggtaaacccagcactttgggaggctgaggcaggtggatcacgaggtcaggagatcgaaaccatcccggctaacacggtgaaaccccgtctctactaaaaatacaaaaaattagccgggcgtggtggcggtcgcctgtagtcccagctacttgggaggctgaggcaggagaatggcgtgaagccaggaggcggagcttgcagtgagccgagatagtgccactgcactccagcatgggcagcaaagcgagactccgtctcaagaaaaaaataaaataaaaaataaatgctccaaaacatgaaactttttgagtatcaacacgatgctcaaaggaaatgctcactggagcatctcagatttcagatttttcgattagggatgcttaaccagtaattataatgcagatattccaaaatcagaaaactctggtatccaaaacacttctggtcccaagcatttcaggtaagaatatgtgacctgcagagatgcacaaacttactctaaaattaaaaagagaaagggaaattaatagccacaacaactttgaaaaggaagaacaaaggttgagggactcacaatatctgatttcaggacaatataacaggtatagtaaaaaagcgtgtgatgctgacaaaggaaaacggcacctgatcaacagggcaggacacaaggcccagagacagacctgcacggacggggcccagtgagcacagccgagggagcaaaggccttcagtctttcaacaaacggtgttgaaacaaggggacctccagataaacaatgagcctcagcctacaaagcacaccttatacaaaacatagatggaccacagatttaggccaggtgcggtggctcgcgcctgtaatcccagcactttgggaggctgaggcaggcggatcacttgaggtcaggtgttcaagaccagcctgacgaacagggtgaaaccctgtctctactaaaaatacaaaaattagccaagtgaggtggcgcacgcctgtaatcccaggtacttgggaggctgaggcacgagaatcacttgaacctgggaggcagaggttgcagtgaaacgagattgtgccactgcactccagcctgggccacagagcaagattctgtctcaaaaaaaaaaaaaaagttaaaacttctgctttgaggccgtgcgcagtggctcacgcctgtaatcccagcactttgggaggccgaggtaggcggatcacgaggtcaggagatcgagaccatcctggctatcacagtgaaaccccgtctccactaaaaaatacaaaaaaaattagccgggcatggtagtgggctcctgtagtcccagctactcgggaggctgaggcaggagaatggcgtgagcctgggaggcagagcttgcagtgagccgagatcgagccactgcactccagcctgggcaacagagcaagactccatctcaaaagaaaaaaaacttctgctttgaaaatcacatatacaacaaagggcttgtaactacaatccacaaagaactcccaaaactcaacaataagaaaacaacccaaataaaaaatgagagtcagggtgtggtggctcacgctgtaatcccagcaattcgggaggccaaggctggagtatcacttgagcccaggagtttgagaccagcctgggcaacatagagaccttgtctctactaaaaataaaataaaataaatgatcacagcatggtggcatgcacctgtagtctcagctactcaggaggttgaggcaggagaattgcctgagcctaggagttcaaggctgcagagagccatgactgggccattgcacaccagcctgggccacagagtgagatcctgtctcgagataaataaaaaaataagacttgagcacacatttcaacaaagaggattcgggcatggcaaataagcaccctaataaggttgaacatcactagccagtagagaaatacagaataccactatgatgagatgccacacacctgttagaacaaccgaaataaaaacatcgacaacaccaagtgctggtgaagatgtggggcaactggtgagaatgcataatggcacagccacatcacaaaacagttcatgacagtttcccatagagttacacatacagctaagttccccagagaaatgaaaacgtatgttcacacagagagctgcaaatgaatccttttagcagctctattcacaaccacctgaaactggccacagtccagctccttccacaggctggggtccatccccagcccgcaatactgcccatcactgaaacgtcccctccgaggcctgcagcagcctgagtggccctagggcatccgcccggtaaccaccaaggccaagggcagcagcaatcggattctaagtaccagacattgctgaaaacaaaactgcaggcacagagagtgacagtgaggggcagcttgaggggccttctgggctccccaggctctcttcaaccctccctgtgctggctgccctggcccacgcgtgtgtcgaggaagtccacgcacgccacgggggtccacaggcgcgcgaagaaggtctacattctcgccaaggggatccacactcgcgcccagacggcgcagaaccgcgcgccccgacagagcgtgcggtaccgaggcgctggtcccggccgcgccgtcaccgcctccagcccgcctaagccgcaccgagaaatccgcgcagcgccagcccgcgggactcaccgtccagggacacgaactggcccacggccgaggagccgccgccgctgctctccacgaactgcacctcggacacgatgatgttgtcctccagcactgagccgcaggcggtgcacaccgcgtccccgcgcgccgcgtccagctcgatgtccgtgccgccgcaaccgcggcacacgcggcccgtcatgccggcgaccgcgcgggcagcgcccggagcctcccaagactctcaagccacccgagcctccggagcagcccgcgccgcccgcccaggcccagccgcccaggcctcgccgctctcgcgaggccccgctccagccgattcgcagccgcagattcgccgcgcgcgcccgggccgcgccgcccgcaacggccgcgcccgcgggatgggacaggcaccgggaccacggcggggacgcgaggactggagccgcgacctccccactgcgagcgagctggcctcccttgcggcgcgccggcgtcggaggggcgacctgcgggggctgggcttcggcggaacccgagcggggcctaccggtgagcgcagccgaggactggcgcttgggggcggggccacggcggtgagcgcagcccgggactggagtttggggcggggcctcgtcggtgggcgacaccggggactagagctaagggtggggcctcgcggtgagtgcagccggggacgggacccaaggctggcgacgggacccaaggctggcgacgcgacctaaggcagtgggcgggcccttggcgatgaacgcagtcggggactaaagctggacgcggggcagaggagggtcctcctcggatagtgagcgcggtctccagcggcgagcgaggcctggggtgaggactcagccggatgcggggctgagggtggggggcggggcctcccgtggagagacggcctgcgaagggaactggagctgtgggcgggggaagggggcggagcctgggtctggacccgaactgtgggcggggcttgaggcgagggggccgagcgtggtgggcggggccttggctcctgagggcgacctgggacccaaccccgggctctgggagtggtgggcggggccagggcagctgcgctggggggcctggccgcagaggtggagacacccgccaggggccaccctgccccgccctccgcatttgcggcgtccgccgctccgctcgcccaggttccagagcctccccgtgcgccccgctattctccgttttctgttcccctaaaattcccactttctagcagtcattcgtggccacctgtggttacccgtgagtcacctcgctgtgccccctgcccagagcgggaaccctggctgcgcacgccctcaaatatctgcaggtgctgttcacaatcgccatagggccggtgacatacccaggaatgagcctaaaaagaaatgcgtaaccaggcgtagtggctcacgcttgtaatcccagcactttgggaggccaaggcaggcggatcacgtaaggtgaggagttcgagaccagcctggccaacatggcgaaaccccgtctccactaaaaatacaaaaaaattagccaggcttggtggtgggcgcctgtaatcccagctactcgcgagtctgagacaggagaaccacttgaacctgagaggtggaggttgcagtgagctgagatcccgccattgcactccagcctgggtgacgggtgacaagagtgaaactctgtctcaaaaaaaaaaaagagaaaaaaggaaatgcggaagaccccaccctcttttttttctttcttttttttttttttttgagacggagtctctgctctgttgcccaggctggagtgcagtggtgagatatcggctcactgcaacctctgcctcctgggtttaagcgattctcctctctcagcctcccgagtagctgggattacaggtatgcaccaccacacctggctaattttgtatttttagtagagacggggtttctccatgttggtcaggccagtcttgaactcccgacctcaggtgatccgcccacttcagcctcccaaagtgctgggattacaggcatgagccaccgtgcatggccctatttcattaatttctgctctcatttttgttagatccttctttccacttaatttggttcaatgtgttccctttttctagtttcttcattttttaaaaattgagatagtgtctcattctgtcacccaaggtggagtgcagtagcataatcaagcctcactgcagactctacctcctgggctcaggtgatcctcccacctcagcctcccgagtagctggaactacaggcatgtgccaccacacccagataatattttttgtagagatgggtttttgcctcatttgcccaggctggtctggaactcctgggctcaagtgagccacccgccttgtcttcccaaagtgctgggattacaggcatgagccactgctccccgccctgtcctcccaaagtgctgggattacaggcatgagccactgctccccgccctttctctagttcttttttttttttgagatagagaacacccaggctggagttcagtggtgccatctcagctcactgcaacttccacctcccaggttcaagtgattctgtcacttcagcctcccaagtagctggaattacaggcatgtgccaccacgcccagctaatttttgtatttttagtagagatggggtttcaccatgttggctaggctggtcccaaactcctgacctcaagtgatccacctgtcttggtctcccaaagtgttgagattctacacgtgagccaatgcacccggcccctttttctagtttttgttttgttttgttttttgaggtggagtctcgctctgtcacccaggctggaatgcagtggtgcgatcttggctcactgtaacctccacctcccgggttcatgccattctcctgcctcagcctcccaagtagctgggactacaggtgcccaccaccatgcctggctaattttttgtatttttagtagagacagggtttcactgtgttagccaggatggtcttgatctcctgacctcgtgatccacctgtctcgccctcccaaagtgctgggactatgggcgtgagccatcgcgcctggccttttcctagttttttaaggtgaaagatgaaatcattgatttaagatctcttttcctttataaataggcattttattgctataattctccctgtaattaccactttagctgaatcctgcacatttcaatgtgctgtgttttcattttcattcagctcaagattgtctccactcttaatttcctcccggatccaagggttattaggaagtgtattgttttgtttctaaatgttggggatttttcaaatatgtattattgatctctatgcaaaatgctctctgtccatgatgacatttcatccttatggcaacactagcttgcagacactgttgtctccattttatggagggagcccttgaggatgtgaggggtgacagccccaaatctcatagccagtaggtaacaaagccagaatccaatctgaggccatgtggccactggatccttgctctcacctgacagactagaggggttatttcgtgtgctccctcaccaaagcctgtgaggtgcctgcaggtgcaaggggcagcatgcctcccaggccacagcggtgcaggacagtcaggcagtacaggacagtcaggctgtacaggacaggattggccagaggagcagagggtggggaagaccacacccacaacggtaagaggtttaaagggtgtggtttcagccaggctcggtggctcaggactgtaatcccagcactttgggaggctgaggagggcagatcacgaggtcaagagatcaagaccgtcctggccaacatggtgaaacccatctttccaaaaaatacaaaaattagcaggtgtgatggtgggcgcctgtagttccagctactcgggaggctgaggcaggagaattgcttgaacctgggaggcgggagttgtggtgaggcgagatggcgtcattgcacttcagcctggacgacaagagtgaaactccatctcacaataaataaaataaaataaaataaaatataaaaaagggtgaggctctactgggcaatggcccaaggtgcgtgctgccagaactaagcctttgctcagatgggctgcagaggaggggtgctatggtctgaatgtgcattgtatcagtctgttttcacactgctgataaagacatacgtgagactgggcgattaacaaacaaaagaggtttattggacctgtagttccacgtggctgcagaggcctcacaatcatggaggaaggcaaggaggagcaagtcacgtcttacgtggatggcagcagggagagagagagcttctgcagggaaactccctcttataaaaccgtcagatctcgtgagacttattcgcaatcacaagaacagcacgggaaagacctgcccccatgattcaattccctcccaccaggtccctccacaatatgtgggaattcaagatgagatctgggtgggtacacagagccaaatcatatcatgtgtgttcccccaaagtccatatgttgacgtccttgccccaaggcgatggttttagagaggtggggcctttgggagatgaggtcatgagggctgcttccctcatgagcgggattaatgccctcagaaaagtggctggctgggcacagtggctcacatctgtgatctcagcactttgggaggctgaggagggaggattgcttgagtccaggagtttgagaccagcctaagcaacatggcaaaaccctgactctacaaaaactacaaaaacttagccggttgtggtagcatgtgtctgtagtcccagctacttgggaggctgaggtaggaggattgcttgagcccagaaagttgaggctgcagtgagctgagatcacaccactccactccagcctgggcgacagattgagaacctgtctcaaagaaaaaagaaacaagaaaaaagaaaaaacgtggctggagggagcttgtctgctgcttcccccatgtgaggatgcaggaagagggcactgtctatgaaccaggaagtggccctcaccagacacggcatctgccagcaccgtcctgtgaaatgaatagtggtttataagccacttggactgtggtggtttgccattgcagtgtgaaccaactgaggcagggagtaacgctccccacgtgatgtgaaggcataaagaatggagccaggttagagggagaatgcggagaactgccctggggaccggttaggtgccccatgctgcaagcgccccaggaagcttggaaacatttaggactgactgacaagctcaaagagtcaagcaagggcggccaaggggcaccagtgccctcagagcacccacactgggcacccagcaccagcttcctgtgcccagggtcctctgtactcctcattcagccctgcaaggcaggaccctcactcgcaccgcgccaaagaggacgctggaaacgtgcagtgatctccgctctggctgtaaacagggagaggctgtgggcttgcccctagacctgactccagcacacagcagcagagcggggcccaggctgggggtgtggggcaggaacattccttcatgggggccccagagagctggaaagtaatgtaggtgttgcactgaaatgagagaattgctttaatctgaactgaacgtgctcgtaacacttagaccaggaaggatttccttttctcagggcctgagaaaaatgacctgaccagcagggttagagttttgaaggacacgcctaggcacctgcaaacttcccctcctggaggctttcttcattcatggtgtcttttgtttttgggtttgttttgttttgttttgttttgttttgtttttgagacacagtcttgctctgtcccccaggctggagtgcagcggcgccatctcgactcagtgcaacctctgcctcccaggttcaagcgattctcctgcctcagcctcccgattagctgggattacaggtgcatgccaccatgcccggctaattttttgtatttttagtagagatggggtttcaccatgttggccaggatggcctcgatctcctgacctcgtgatctgcccacctcaacctcccaaagtgctgggattataggcatgagccaccacacctggcctgttttttgggggttttttttgagactgagtctcgctgtgtcgcccaggctgtagtgcaatggcacgatcttgatgtaccgcaatctctacctcccgggttcaagcaattctcctgcctcagcctcccaagtagctaggattacaggcacctgccactgcgcccagctaatttttgtatttttagtagagtcagggttccatcatgttggccaggctcgtcttgaattcctgacctcaaatgatccatctgccttggcctcccaaagtgctgggattacaggcgtgagccaccgtgccaagccccatcgtgttctcatctgtggtgctttgacatcttggggtctcgtggacctagagagggactcccctcccagggttagctaattcctagagacagctgaccacttgcctctgagtatgccttatttactttattttttctttttttcttttttttttgaggcagggtctcactctgtcacccaggctggagtgcagtggtatgatcatagctcactgtcgtctcaaactgctgggctcaagagatcctttggccccagcctcccaaagtactgagatcccaggcttgagccaccgtgcaggctgagcatacctttgatatgcagagcaaccatcatgagtcccacctgcctcctttcatcaggctcctgcattcctgaacactagccccctgccctaaatcaccccaaggccaggtaccagctagctagataccacccccaagcccagagcccactgaaatgacccagttctaattctgctcagcttgcctcctctgccttgcctggaaaatggcaataaaggctcttgcccaccctttcccttcaccccctccctgtcctgactggccctgggtgcttccccacgtgcccctcctcctgggaactgtgagtaataaactcctctttcaaaggcggttgtctctgtgtctgtcatcttatcacatttgatcaaaataactcctgggtactcaatagccctgtccccccatgcagcagtcagcaggggaaatgagaaagcaagcttctatggccttctcaccttctcacctgctgcctggccttgggcaagtgcttcaatctctctaggtttctacttcctcatctgcataacagggataagaatagcccaccctagcactgcggagtatgatggaggacatgtgtctggtagacagactgctcagaaggcaagtccctgttcctgtctgttctccgcaactcgagtgagacttggtgaggctccagtccaccttccaccacagaagtcaagggccaggccaggacagtggctcacgcctgtcatcccagcactttgggaggcagaggtgggaggatagcttgagcccaggagttcgagaccagcctgggcaacaaagtgagatccctgtctctacaaaaaatttaaaaattagctgtgcgtggtggtgcgtgcctctagttcagctacttgggaggctgaggcaggagaatcgcttgaacccaggtgactgaggctgcagtgagttatgatcacaccacagcactccagcctggaccatagagtgagactctgtcccccccaaaaaaacaattaggccgggcacagtggctcacacctgttatcccagcactttgggaggctgaggtgagaggattgattgagcccaggtgtttgagaccagcctgggaaatatggcaaaacagcatctctaacaaaaatacaaaaattagccaggtgtggtggtacatgcctgtggtcccagctactcgggaggctgaagagggaggattgcctgagcccaggagacagaagttgcagtgagctgagatggcaccattgtactccagcctgggcacgacagaggcagattctgtctttttttttttttttttttgagatggagtcttgctctgtcgtccgggctggagtgcagtggtgcaatcttggctcactgcaacctccgcctcctgggttcaagtgattctcctgcctcagccttctgagtagctgggattacaggtatgagccactgtgcccagctaagttttgcagttttagtagagacagggtttcaccatgttggccaggctggtctggaactcctgacttcatgatccgcctgcctcagccccccaaagtgctgggattacaggcatgagccactgtgcccagccatgactttgtctctaaataaataaataattttttaaaacccttagggacccagcacagtggttcacacttgtaatcccagcactttgagaggctgaggcaggaggatggtttgagtccaggagatctggcctacagtgagccatgatggcaccactgcactccagcctggttgacagagcaagaccctgtcaagaaaacaaaagaaaaaaaaagaaaaagacaaacaaaacctaacaaaaccagaaatccatcctgcacgaagagcactgaggttgagtgttggttgacacgtgttgcggtaattgctgttctgatgtctgtgaatgtccttggctgatttctgtattagggcctgggtgttttcctttcttttctaatatttaagttatgtcctggcttattgtgatgatattctattgtgggaaagaaagaagtgttaaaatttatgcatcaaggtccctcttaatcttggggctcaggataaccacagtcaagaggggagagttttattcctgaatccaggtcatgctgtgttcaactttacaccctgatttgtcacacaatcacatatctgagaatttccccatgttgctaaaactgaggcagcgttccgttttgctggttattccacatcccatggggtggatgtgccagggcaagttttgtcatttcccctggactggacattcctttctgtaggtgttgctgtttgaaatatctcacacacctggacctgtgtccctgttgacatttccagtgtcacctgcaggatgccatgggatacccatgagcccaggcaaatctcccaagacgctgccaagccactctgcagagctgctctgggtcctgccccaggtgctgtgtgagggagctgcgctgcctgcgcccaacccaggaggggagcagcgtgcaggacaccgaggatgtcatcacgaccttaggtctgtattaggtctagattagcctgcattaaggagaaggtggtgatgtgtgtcttttttttttttttttttttttttttttagacggagtctcactctcttgcccaggcaggagtgcagtggcacaatctcggctcactgcaagctccgcctcctggattcaagcaattctcctgtctcagcctcccgactagctgggactacaggcgcccgccaccacacccgactaatttttgtatttttagtagagacggggtttcagtgtattggtcaggctagttttgaactcctgacctggagatccacccgcctcggcctcccaaagtgctgggattacaggtatgagccaccgcacccagccatgtgcatctttttataatttacaattcgtgatagtagtgacaactgtctcacttattcttttgtgaatcttttgtagcttctctaaccattttccactgggaattttttagtggtcttatggacttgtatgatttcctttgatattaagaatgttaccctagtgagccaggcacagtggctcacgcctgtaatcccagcactttgggaggtcgaggcgggcggatcatgaggtcaggagatcaagaccatcctggctaacacggtgaaaccccgtctctaataaaaatacaaaaaattagccaggcgtggtggcaggcgcctgtagtcccccctactcaggaggctgaggcaggagaatggcatgaacccgggaggcagagcttgcagtgagctgagatggcaccactgcactccagcctgggcgacagacagagcgagactctgtctcaaaaaaaaaaaaaaaaaaaaaagaatgttaccctagtgaaacattcagtattcttacaaagatcatcctcaatagtttgttgcgttgggtgagggttccctttgcacgtttggttttttcaggacggggcgcagccccagccagatggcgcccggctctccagccagcggcagctcaccctgctgtggtttgattttccctacacaattaatacatgttcatcatggagaaaataggagataaagataagcaaaaaggagaaaccaaatcaatggaatccccatcacacagagatactttcttaacactttggattaatttgtatcctatcaatatttttctatacctgaaaataggtgttttatatgtataatcactaacatgtaaatacatactgcacatggacatgcattttcacatacatttttgttttcttgagacagagtttcactcttgtcacccaggctggagtgcagtggcacaatcttggctcaatggaacctctgcctgctgggttcaagcgattctcctgcctcagcctcccgagtagctgggattacaggcgcgcaccatcatgccccactaattttttgtatttttagtagagatggggtttcactatgttggccaggatggtcacaaactcctgacctcaggtgatccacccacttcggcctcccaaagtgctaagattacaggcatgagccactgtgcccggcctttttatttttattttttgagatggagcctggctctgtcccccagactggagtgcagtggtgtgatcctggttcactgcaacctccacctcctgggttcaagtgattctcccacctcagcttcccaagtcactgggatcacagatgcgcaccaccatgcccaggtacgtttttgtatttttgttagagatgggactttgccatattgcccaagctggtcttgaactcctgaggtcacgggatctgtgcgctttggcctcccaaagtgctgggattacaggtgtgagcccctgcgactggcctgtttttagctacttttaactcactatttctgccagctgtagaatattctatcaggttctatcatggctcacctaaccctgttctactctacaaccccggggttgattccaggcctcactctcagcagttgagctgctctaagggtgaccgtgggaactgtccacaggtgcggctgcgggtgcagcgatctcagcggtcttagagctcttggccatcccccacatggcttcccagaaaatgcctccaggaggagggccctgctgtaccttttttgtgaccattcctcctcagcctcagtcatggccatgtgctccaaccatgggagtggatgcggcagggcctgtctaggggttcggcagttctgtccctctgccatagcatgggctgggcagggacctggccacgtggggctgcttcctcagcccagctcctggcaggagaaggagtaggggcgctgtgggctggagccgccaactgaccagtgctggccctggaggaggcccctcccccactccccgacttcagcagggcctgctgtgtgtctgtgtcatcttagcccaggctgaggagatgaatgcgtttccaagcagcccatggtcctggcgcccgactggaaaagcctgagccttcaccctaggtggagggacctagcgaagccaggcggacagaggaaaggcctcggcccatcctgtcccatgactgggggttggggcttcgtctttttaataccaatggaatcctagccaagcattcagaaccttgaagctttaacttcttaaataataataactcccacaacctccggggaccccgggcagcacgtggtaggaccagctttcaggttgtcctcctgagaccccagggctctgaaggatcctcttcttggacctcctccccaaccgtgcccagccaccccagtcatccgagaggtttgtctcaaaccaagttcctgctttaaagaaaacgctaccagagaaagcacctgtgctccaaacacgggggtgagggctcacaccatgccagggtcatagcatggggagggatgcctcccagccttcaggggatctcctcctgtgacccacagccctcaagagaaggaccagcacagcatcattttccgacagaggagggcagtgcaaataacaagttctggctaaaaagttactctgatcacccaagggacatctgtgcacttggaaaatacagaagaccacagtcccatcaccaccatcccaccttaaaaacaaacataaacgtggtcgcaggcgtgacacatggtgtgtttcgtgtccctgctttcctgcctggcagaagcattgatgtagacccaccatacgggttcttcgggccactctggtacagactgtgtgggtcatatcccgacccctggcagctgcataacctcacaggccgccatctcctcttttgtcacttgggatgggacagaactgtcacgtcccttaagggctcacaacggtgcctggcacagaggaggggcaccgctcaatggtggcagctggtgccaagccctgctgtgcacggcttagtcaccccgcatctcctcacttgacccccagttgtagtccctgcctgggttagacgctggcatacacaggcaccatgtgtcaggcggcccatccgtctgactgcaactgcacgctcgccaggtccagcagcgccgtacgctcagttctggggtcaatgggtgcctgtctcctgccctcccatcacagacagcctgtcctcctggggtatggctaccccctctctggacatagtcacttctccccctaccctgtctcaaaggtatgagatccaccggccctctgcccgccgagcagctggccaaggtcagacagaccctcatggctctcagtgtaccaccttagaggagccaggggcgcgtgggaaacacagagtcccttgttctctccgaagtgggaccctgactttaagcagtcgcagctgtttgcagttctagatacaggagttacagctggaggctgagctctctcaacggaggaagcagcggcatgagggcctttgcagaaggagctgacggggcactggggtggcaagccccgtgggccaggaaagaaaccagctccaggtcaatttgctcgggctggatttgtttcagtaaaactacttgtagacaagacacagggcgaagagaaaagcaactgtaaactaactgtgaaacaaggaaacagaagagaggccagaaaaccgtttcctaaatctcggcttggcatctggtgctggaccacagccgctgccaaacagatgggggaagcaccctccctgagccccagagcctacacgtcgggccccagcggctctagccattgcctcctctttgcttgggtccccaagttcactgttaaccccagggccaggagccagccttggccccagacatttgttctccattgtcctgagcacaacgctgaaaagcggcgctgaataaggatgctgggacgcaaagagggcgcccggggtcatctggagccctggaggctaagctcggcagcctggcgccccgagtggcttcgagtccccgcgaccgccgccaggcccggccacctccttgccacctccctgcgtcccggggaacccacgcaggggggcgcgagggaggggctcggggacgggcggggcccgcacagccgggccaacccagcgggggtcggcaggagacaaggggcggcgagggcaggggggcggggagactcggggcatggcggggtggaggcgggaaagtgtcgaggccggggaatccgcgcgtggggaggtgggcatcgccagggcgacgatgagctttccttagggggcggcgcctgaagctggccgggacccggtggacccccacgactctcccggcccttgcccgcggctcccggggggcggggcggggcgccccgggcggggtctgtgcgcaggcgcgtgagtgcgcgctctcgcgcaccggcgggcggggacgccccgtgaggcgccgccggaggaagcgcgcgcgcacctcacttccggcgcgcgctgcgccggcggcgattggacccgaggcggcgagctggcgccccgcccagccaatcggcggcgccggcgcgggtcggagggcgccgggcgcgcgcggggcggccgggggcgcgcggggcgcgggcggggcgccgggcggggcggggcggagcggccgcagctcgtcgccgcccgcgggcctgtccgacgccggggcccggcccgtcccctccgccgcccggcagccatgtgaccgcgccgccgccctccgcgcgcccggcccgcccgccgcgcgtccgcggcccggccgcagccccaggccgccgagggagcggcggggccggcgccatggccgagcgaggccgcctcggcctccccggcgcgcccggcgcgctcaacacgcccgtgcccatgaacctgttcgccacctgggaggtggacggctccagccccagctgcgtgcccaggtacgcgccgcccgccgcgctttgttcccgccgggcacctgctgggggtgtcctggccgcggcctctgcgcgccccatccccggcccgggtcccccagcggagcccaggtcgccccccgcgcccccgcccgccggttcgacgcgtgcagccgccgcccccccgcagctccggcaagcgcggccccagccccccaggtcccgagcaccgggggccgcgctcagcttccgaggacccggtgctgctcagacccggcgggaccttggggctcccgggcggcgctcacctggctcgccgcaaccgcacctgcacacctgcctcaatgcggtgccggccggggtgacgagggtgcttcctctctcgggtaccacacgcttcctttcgcgttcggcgacactgtcagacctcggcctgggagcgacccccggcgcacggggcgcgcaggactcggttgtatcctccgtccagcgcgcggtggagatgccctgtcctgcggggcggggtcgtcctcgcgggtacctggttggcgctgtctctcatttagaggcgtcgccaagccagtactgctatttgcgcctcccagttgatcttgccattgcggaagactggctgttctgcacttggtaggggggcgcccggtcgcccagcggtaacgattggacagggtttaccctccggccatagcccagccttccttggacttgcagcttccctgagtctcctgctcagtttgaaacttttgtaatttcttcgtgacttggtagttcctgctcaggaagctcccaggctaaggaggagagagacacgctctccggaaaagttctggttctagaatagacagcaggcgagaagaggaggcggttgggggtagtgagagttctccctggggagatgggagggtgagcggaccttccaggcactggaagtggccagtatgcctggaggggaccccacgtggcattgagttgttccacccctagtcagctgcaggtgggcctctccgtgctttcctgtggctcccacagcctgcatctctgagcgtggtgttggagttgcagagccgctggacagtggggcttgccctcctggagcgcagggttgggacctcggggctttggttttgctgagtggacaggaaggatgcccacccggcacgactcttgcacctggcggggcctcccgaaggacccagtgtccatatgagacctaagggtcagcatttgcccaaggtctggggccgagcactgcagatgtgcctgcttgcctctcttctgggaagtctctggggcctcaaagccaaagccaggagcatctccccaggcctggctgcttctccattccaggtcttggcgattgccccaatgtcaggtcccacagccccacagcccttctcctgtctgcccctctgagtcactgcctcacccacagccccagaaccttcatgcgggctgttggcgctcccctgctccagcactgcagcacatagcctgcccttgctgaacctctgcagcagcttcctggggccctccgaatgagcagcaaagtctttaacccaagggaggtgggggcgtgtggcaggaggggccgggggccttatcagcccccctgtggagctgtgctctattctccaggggtctagaaagcccactctggtgtctgtggggagggtatgggtagggcgggtttcgagaagcctggttaggacaggcgggggtagatgggggcacctgggctgggtagcactaagtgctggggggggtcccgagctctggcctggacagggttgggaggaagggtaggcaggaggacaggatttgttctgttggtgtggagttaatgggcggaggagttaatgggcggaggggcgagtggcgcagctgaccaggtgggcagatgcagtttgttcgtaggacatgctcagcctcataatgagctcctgcccttacctgtcctggaacagggcccctcataggcgggcttgcccctagctttgctttgtgcttgtgccgcctgtccgtgcatcctcggacagtctgctacttagttttgctttgttcctcctgagttcttctgtactcctcacttttgcccagccatgaagcttctgggctgcgtgtgtgctgatgcctttcggcgtgttcactgctgcgtactattcactggcgtgacagtacctcggctttgcttctgtcaagggaccttggcttgtttccagttttttggttaattacaagccccgtgctgctgtggacatcgtgtgccagtcttctgcgtgtgtctttctggatgggcagggcctgtcttaagcatgtaccgccagctaccaggatttatggtgggggtgtgcacgcactcagcgttactgctgggcagttttccagagtggttgtgcctgctccggcccccactgacagggacgagagtccccactgctccacatttgtgccaacactcatttgacttaatttttgccagtctggtgggtgtgaagtggtatcgtggttttaacttgaatttctctgattactaatttaggccatttgtacttccttgtcagtgaaattcctgttcctttgccagtttttttttctctttttttctgcttgagtttcagcagtttctttagagatagtcatcctttctcggctgtgttgaggatgtccccgtccagttatgagcgagtctttgctctctgagcagcctctgggtgcactccccgtgtcagcctggtggagtgtgcacattgactgtttgccaggctggggtgctggtctcgtttcggttctccttctgggaggcagccggagaagtctgcccccgggagcttgaactgggcatgctgggctgttgttggggaggcctgtgctccgggtttccttgcgacgcttttggctcagcactgttacacacggtgctcctaggtggtccacggggtatgcgtcagtgcctgtctgtggcctctgcctcctgggttcccagagtgtcctcctggtgcccatgtccctgagcgcccccacctgctcttcagcaagggctgggctgctttgtaccttgcccttcccacttgattgttttttcggttgatgtttattaatttgtttttatttatgtattttgttgttgttgttgcagagacagggtctccctatgttgcccagactggtcttgaactcctgggctcaagtgatcctctcacctcggcctcccgaagtgctgagattacaggtatgagcccctgggcctggccatctgtttggtttttagagacagagcctcactttgtggcccagactggggtgcagtggcttgatcatggctcattgtaacccctaaaacctgggctcaagcagtcctcccacatcagcttcctgagcagctgggactacaggtgtacaccaccatgtctgtctaatttttttgttttgttttgtttttttgagacagagtctcactctgtcaccaggctggagtgcagtggtgcaatctcggctcactgcaacctccgcctccctgtttcgattttcctgcctcagcctcccaagtagctaggactacaggcgcctgccagcatgcccggctaatttttgtatttttattttatttatttatttatttatttttattttattttattttattttgagatggagtctcgctctgtcacccaggctggagtgcagtggtgctgtctcggctcactgcaagctccgcctcctgggttcacaccattctcctgcctcagcctcccgagtagctgggactacaggcgcccgccaccacgcccggctaattttttttatatttttagtagagatggggtttcaccgtgttagccaggatggtctcaattttctgacctcgtgatccgcccgcctcagcctcccaaagtgttgggattacaggcgtgagccaccacgccctgcctattttatttttttgagaagctctgtcgcccaggctggagtgcagtggcacgatctcagctcactacaacctccacttcccgggttcaagcaattctcctgcctcagcctcctgagtagttgggactacaggcgtgcaccaccacgcccagctaatttctgtatttttagtagagacagggtttcaccatgttggccaggatggtctcgatctcttgacctcgtgatccgcccgccttggcctctgaaagtgctgggattacaggcgtgagccaccacgcccagccagaattatctttttaagtttcacacaaagccacatttggtttataattggaagttctttaactctgtagagcaggttggggagaattgacgtttgtgtggtactgagtcttctcattcatgatcaagctatttacttaggtcttgaatgtattttgagagttttacaagattctgctgtcatgcatatcctttgttacatttattcctagatgcttgtattttagaagtcatagtaaaagtcagctttttattatgtttgttgctaacatatagaaattcagttgatttttcaaagaaatcagtgattttactatttttaacctagtaacttatctatagattattttgtattttcaaaatgtatgttttgtcttttgcaaaagacaaagttgtttcttttcaatcctcatacttttctttctttctcttgcctgactgtgccagttgtcatagtacagtgttgaatatggttggttgcgtggattacccgtgttctgtcttgaccttaaggaaggtttccagtgttttacctttaaggacgatgtttgctgcaactttttgtggatagcctttatgcacttaaaaagtctcatcctattcatgacttgcaaaggctttttaaagaaatcattatgagtggatgttgaatataatcaagtactttcattaagaggattatataatttttatcttttcattactattgtggtaaattacataaattgattttatttcttttcttttctttttgagacagagtctcgctctgttaccaggctggagtgcagtggcgtgatctcagctcactgcaacctctgcctcccaggttcaagcaattcccctgcctcagcctcccaagtagctgggactacaggtgtgcaccaccacgcccagcgaatttttgtatttttagtagagacggggtttcaccgtgttggccaggagggtctcgatctcctgaccttgttatccgtccacctcagcctcccaaagtgctgggattacaggcgtgagccaccatgcctggccgtaaattgattttctaacattaacctattcctggaaaaatactagtttaagcatgttgtattaccctttttaaaaattggtggatatatatttatttatgtatttattttttgagacagggtcttgctcttttgcctaggctggagtgcagtggtgtgaccatggctcaagcaatcctcctgcctcagcctcctgagtagctgagactacaggtgcatgccactggcctggctaattttaaattttttgtagagatggggtctcactatgttgctcaggctggtctccaactcctggcctcaagtgatcctctcaccttggcctctcaaagagctgggactccaggtgtgagcctccctacctgcccacattggtgggtttagatgatagtatcttgtttaggacttctgcatgtgtgtctggggtctatgtgcttcctttcttctgtagtccttagcagattttggcgctaagatttccttgtgaaatgaaatgagtactgcctcttttgctgtatcgtggtatagcttatgtaaaattggaatcatttcttccttgaatgtttgggataattcacttataaaataacctgactggccgggcctggtggttcacacctgtaatcccagcactttgggaggctgaggtgggtggattaccggaggttaggagttcgagaccagcctgggcaacgtagtgaaatcccatctctactaaacatacaaaaattagccaggcgtggtggcacgcacctgtaattccagctactcaggaggctgaagcaggagaatcacttgaacttgggaggcggaggttgcagtgagcccagatggcgccactgcaaaaacatttttttttgaacctgctttctgggtcagtgtgtcaattttaatgcacgttctgtttatacttaaaaggaatgtgtgtttggcagttgatggtgcagtgtttgtctattagatcaagcttggtttactgtggtcttcaagtccgttccctttttttgtctactagaaatgtatgttaaaatcttataatctgagaatagattggtccgggttttctaacagttctgtcagtttctgtttgatactttttttttttccagacaggatctcactctgtcacctaggctggagtgtagtgggacgatcacagctcactgtagccttgaactcccaggcttaatcgatcctcccacctcagcttcccgagtagctgggactacaggtgtgcaccaccacacctggctaaattttgtattttttgtagagactgggtttttccatgttgctcgggctgatcttgaattcttgggctcaagcagtctacctgcctcagcctcccaaagtgctgggattataggcatgaaccactaacgccccgtcacttaatatatttttgaggctatgttattaggtacatacatgtttagaattgtaattctaggtattttgaacttttctcattgtatgactgcttttatatctagtaatgctttttgtctttagtattgactttgatgcaagcattcttttggataatttttgcctgttagctatttttctatcctttttaaaaacctttgtatatccttacatattagatgtgtctttggttattcagcatgtatctagatttcattttcattcactctgaccttttctgacttttttttttttgagacagagtctcgctgtgtcgccaggctggagtacagtcgtgcaatcttggctcactgcaacctctcctcccgggttcaagcgattctcctgcctcagcctcccgagtagctgggactacaggcgcctgccaccacgcccagttaatttttgtatttttagtagagacggggtttcaccatgttggccaggctggtctcgaactctcgacctcgtgatccgcccgccttggcctcccaaagtgctgggattacaggctgagcctctgtgcccggcctttttttatttttattttttattttttgagacggagtctctctcttttgagatggagtcttgctctgttgcccagggtggaatgcagtggcgcaatcttggctcactgcaacctccacctcccaggtcaagtgattcttgtgcctcagcctcccgagtagctggaactacaggtgcgcgccaccgcacccggctcatttttttgtatttttagtagagacggggtttcaccatgttggccagactggtctcgaactcctgacctcaaatgatctgcccgcctcggcctcccaaagtgctgggattacaggcataagccaccacgcccagcctaccctgtacattttaatgtgcatagttaattgtatctttactctcctgctgaactatgcagggaccttagcccactttattctaatccaaccctttcatgtttatatttatatgattttgttactgtgtatcttaattgttttcttgtgaagcccacaagatgttgttactgctttatactgtgatatttgatgagcttcaaaactcaccacttcctttgttgctcattcttcttgcatgtcaggaatcattttccttcttctgttgaatatttgttcttaggatttcctttagtgaggatctgctgataactaccttctctttctgtttgtctgaagatgttttagtttaccctcaccctgagcagggcgtgtgctggttgtacgatgctggggtggtgtgtgctcctcccacaggtccaggcagggcgtccctggctttgacttccagctttgctgtaagaggtcagcggccgtgacaggctggagggagacgtctgggtggctttgtggtcatgtcatcgttgccaacggtcgtctcatggtgggtcctggtgtgggttctcttgtgattgcctgagtcggggttactagacttgctgactttgtggatcgatgattttcatgagtcccgggaagctctcagccactttttcttctgctgttggttctgcgctattctctctctcacctctggagcaacaattggacgtgttgctcttcctgccggatcctccacatccatagatgcactgggtggtgtcagtgggcggcggctggctggggcagtagcctgtctccagcccttccccctgcctctgtccacgtgcaggggcgtctcctcaggacgcatgttgcctactgaccgctgccagcctgcacgagactctcacggcgggaccctgtctgccttgctcggtgctgcccagagcctgcacagtgtagctccttggcggacgttcctgtaatggaaccaggatgtcatgccaaggagtgtggtttcattttgagtggtggggaagtcgctggactatttcaagtgtgtgtatttgggagagcagtgctgctggagtggtggaccacactggaggtggagattgcctcagggtgtgcaggtggagatgggtgggaggtgtcgtgcagggcttgggacagggctttcggaggtggtctgcagtgatccagggaagatgggctgctctgagggaggggctgaggaagctgacctgggcagccagtggcctgtaggctgggcagcactcgagctggggccaaggggcagcaggacggtgcccgtagccctggaggccttggggattcggaggacctggcccatcgccgtggcctgcacggtgcgtgcacaccgctctgtccgcgcaggctgtgccctgctttcaagatgcctggaaacctctggcagctctgtcctgctgtcaacactggagtcacatgtcagtgggtctcctgctggggactggcttttgtgcaggagatggagggcagggggctacagtgcccttggactaaaggatgctttccttggatctgggcactagaaccagccctttccctctctctgcccagcattctcagcatgcgtctcaggaaggtttgatggagtgggcagctgcggtgctgtggcggggtcggggggctgctgcagagagcgggtctgcggtcagtcacagtgacgggggtctctttggaccctgtgacttgtgtgtggtggtggcaggcagtggcgttgccgagacagggtgctcaggtgcaggtgggaaggggtggcaggatggaggttgtacagtgctttccccaggaccagggggcagggtgtggcgtgcttattcctgcctggccgtggagggtctctgtaggacaggctcccgctgagggcagccctgaggcctgtgagctgctggccccgcagggtggctgggcctggctggctcagcagctgctctgagaggcagccctaaaaatagccgagcgctgagaggccgtccctttctgctccgcaggcgcgcgccgatgtgtgctcagctcaggccgacttagcagggttgtgagagtgatgagagcgtggctgctggtcatggtgctggggtcgtcagcagctcctcgagggctccggcctgtggaggccggtggcgccccgtctcaccccacggatggggggcaggctctccaggagccccagggagcactggctactgctgggctgctctcaggcccgggacattcatggccgtagccccaggtcctctgcatggtcaggggccatgctgggtcccctggggtgcagatgccgctcaacagaggagtcaggacccaaaaggggcagaaatgggcaagggaagacactggggaaggggtgggtctgcccttcctgctgggggtgcacacgggcctggggctgagcaacccgctctgggcctggctgttccgctccactgccccaaccagcctttcctcagcaccccctggccaagctgtgggcaccccctgcccccggacacaggcagcacctggccaagtgcagagacactccagctggctcttcgcctgtgtcccagccctgagggcaccgtcgtagggtggtgggacgggggggggctcggacacagtggttgtggaggggtcagtgctgtggctcggggtggggtggggctgggggagggtttgcttcagggtagcggctctcttcaggggttcagcaaggagacagatgggttctaatgacccctgagtcctgagacaaggtggggtgagctggagcaggggaggggacttggaagggccttcagtccccatgcagcccttgcacaacctttcgggccaacatcctgggccttgcttggcagaggagtttgggatccacgggcttgaggcccaggtggtcagctcgctcggtgcaatgctgtgtctcgcatttctgtctctcgactgccccatccagcccgtgtcctaagagcagctggcagcagccgccacgcacaggcagctcagctcagcagccccaggagccaggtgtgtcttgagctgggcagcaaagtggccatgcagtccagcctcccttcagccttccccaggatgcctttcatcttggggagatggccattgtgggggtgaccagcactgtcccttccctggcaggccaggatgtggatccacagcgaggcagacctgcagatgcacatccctcttctcaaatgctgttcttgttctggtgagcacggggaacggcaccaagccaatgctgatgggaagggccctgaccttgggctgctgtcctgcgagcttggcccctctgctgggcccctcctccatgcctttgtttactctccaaccttctgggagtcccacatctgcatcaggacagaggtgaccagggaccagttgacagctaggatgccaccagcatcttttgtttaatttgagtctcatttcccagtgtaattctgtagctgaccttgcaggaggcattgacaatatttctttattgtatggccccagccaggacttccctctttttagatgcaaaataattgggcaagacttttcatgggcattgcatgctgggctcgtgcaggtgtctccagggccgcctcgagaccagcgcccgcctccctggtcctggatacaggtggggcgggggctcccccgcagcagtggagttgagacccgcacctgcttcctggtcctggacacgggtggggcgggggctccgcagcagcagtggagttgaggcttccgtatgagctcgctcctggtcagtttgagggtggacataccagacatcctgcatcttcccagtcgccccaggagcgcctcaggagggtgagtggcaggaggccgatgccctgctagcaggcagtccctcggggccaggccttcctggtgcggtgctgaattgggctgttcgttcctctgagcaccaaggagagggatggcggctcaggcttcaggcagtgcccgccggtgcctctagaaggtgctccgtggtggggcccgggagggtggcccttccacattctcgggctgcctgtgtgccacccaagtgtcaggtcatgaggcccctcggtctggcctagggctctccttcctcccccacctcaagcctggggtgtggcctagccagggaggggagcgggagctctggccgtgaagacccaccctgaggtctgggctctcctggcctgagcgtgctttctgctatgagctccacgttcaccctgcggccaggactctactgttcctcctggtgggagctgctgtggtgccctgggtggcctccagtcaccgccagcctgccccttgcagtcagtcctgctgttccttcggctcctgcagtttccagcttggccctggacttcctgtttttcccacctagctggacgtaaaggttgtcgcgccttggaaagttaagtcactacacccgaatcgacgcactcttggctcgcctggctatggcttcagctggaaacggagctgagcgtggcttatgtttataaatacagcacctatcaggtccagcgtcgctgtctcctgcgggaggtgtcagctttgggcgtgaagaacagctgcaaggccacagggccaaggggtatctcaccagctgggaggccggcgtgcctgacctggccacacagagcgagcctcagaagcgagggggaaggagggcaggccttggggaggggtccaggaaggtcgagaggctgcagtggtggtagcctgaggggatgtgcgcggccaggtcagtgcctgccgctactgcctgctgcgctgactgcctgagcactggggatcgtgggcctgaggggcggggaccttggctcccgtggatagctcctgcaccatcctcttgcttctcagaccctcggcaagtggtgacagggggctggggtggagttgttctcctgccgtggtcctgtcaaatggtgctgggggcggggccaggaatcacagcaggtgtctgccgctagcgctcggagcctgtgctgggggcagggtggtgcatctcatgcctctgccgcttgctcactgtacttgcctggggaggatgtggcaggggcagaggacagctggccaggctcttggactgcacctgactctggtgggctatcgaaggttttggaggtttctttaattagcaacatgatatccagagattgcgactgtggctcgagcggttccctgccagggagcaggaccattgacagccgagccttgactcaccggcccaggccacccgaggggccattgacaactgagccttggctcaccggcccaggccacccgatggaccattgacagccgagccttggctcaccggcccaggccacccgaggggccattgacaactgagccttggctcaccggcccaggccacccgaggggccattgacagccgagccttggctcaccggcccaggccacccgaggtttcactgcggattctatcagaacagtgcctccccccaggattcgtcaaccttcagtggaccaggccctgcagtggttccagttattccctgggaaaatttccagcactgattagggggtgactcttggtcagaggttgagtgtttccctaggtgtggaggtgcacggagaagagaggggtgcagttcttaaaggacacatggcttatgccacaccccctgccccaacccccggagtggccagctttcctttgactggggaggaggcagctgtccagggttgtcctcacctctcctcctggagaatgtggtcccttcagaaaggggacccagtagtgggtgacctggtgcaaaccacccactgcctcctctgggccttcctggggctcttcggctctcaggagaggagggagctcaggctgtggctgctctgtgagttggacacggacgctccagccgctgggcccagcagtgtgaatggccatagagaacaggggcccagaggctgctctcgaggacactggcagcagttgtgctctgggctcgccatccttgaagctggaatattccacaagtgccacgcacttgctggaggtactgcctgggggtagactgtggccaggccctcccagcagcccgagtcttggcgcgtgggctggactcccacactcagcacctttctgctgacctgaacacccagggcacagtggcagcggcgtcattaggatttccaactagctgtttctgttaagagtgaagaggaaaccttgtttgattagactcattgtaaaaaagattccagtgaatctcttgcctgctgtctttgcagttgcctctaagggtcacgaggcagggcggcgtcctctctcagtgccactgtgacctggcagcacctcttttgcatattattgacctagagagagaggtcaattgtaattcggagctgcacagtcggaaaatttgtagcaacagagaattataggcgctctaggcattcgatgaatcttctccaccttgctgtggggttaattcaggggagcagtggggagtgtgctgggagtgagattagagggaggactccctggaggctggccctgcgccctggaggccagcatggccctggtgctggctacatcctctggggctcttcctcatctgtctgcagaggaggcagctgtggagcgagggtgtgtacgggagcaggatgggctgcacagaagcctttccgggggtgcctgtggtttgcaggggcctggctgcagctgccctgtgtgatctctgtccccgtcttctcccggcttccttgggtcctgtgtgcccaacttggcacttcaagatttgctccctggcaactgttgcctttcccagaagagaagtccctggaaccaggaccagcctgctgtcacctgcctgctgctcctgccccaccagaaccatcctgagtccaaactggctgagagtcaagggggtgttcagggcctccaggagctctgggagagtctaggatgctctagatccttgggctcatggggcagtagagtggggggctgtggtcctgggcaccctctggagagaccgctctggtgtcagccaagtggcgggcaccttctgggcttgggggcggggcttctcacgatggctcagggaggtccagacagcccccttgtctaggtgcgcacctggagtcctttcctgcgtgacttgcaaacaggccttgcagggctctagtgtatcagctcccggactgcaggcagcagcaaactctgccgtgtggtactgcttctcatggacaggagaccaccaggctccttccaggagggtgaggtctctgcagcgggagcatccaggcctggaactcgagctgtggtgtggtggtgccagcccaggagccaagcacagccaggagatgaaacccatccctgtggtctgcacgtccatgccagggccgagcccccagctgggatgccctgggagggtgcagggtgggctctggatgcctgctgggggatttcagtgagaaccaggaagggttgagccagagcctccgagaagcctggggtccatgtgtgggaaggaacggggacagggagcctccgagaagcctggggtccgtgtgtgggaaggaacggggacagggagcctccgagaagcctggggtccgtgtgtgggacggaacggggacagggagcctccgagaagcctggggtccgtgtgtgggacggaacggggacagggagcctccgagaagcctggggtccgtgtgtgggacggaatggggacaggagcctccgagaagcctggggtccgtgtgtgggaaggaacggggacaggagcctccaagaagcctggggtccgtgtgtccgtaggaacgggggacaggaggttgtgaagggcgtgtgggttccgggaggctcactatagtgatgtcctgccttagacgaggtcacacaggggaaggttactgtgccgcagagttttctttccgagcactcaatgctcacctcctgggagggagtggggccgcagccagccctgacccagctgggtgtgtggccgctctctggacccccggtcccagggtggcagctagtgcagcctaggccacaccagcatgacccctcgcccctgtctccacggagcaccgtgggactctggcatcagaatcctggggccccacccaacacccacgcatttcctgtcttttctcaggcaatcgccatggtacccagggctggccttgtttcagcttcctgacgagtgccctgtggtcagtcatttctgtcctcgcctttacctcaaatcctgctttttgccttaagtgcgttcccaattccatctctgtgccagctgtgccccatgcagcctctaccggcatctcacgtgatgtcaaccttctgggtccttggggcctagccttgctctggtgaacggctttgttggatgctggggttggcattttttttttttttgagacagagtcatcctgttgcccaggctggagtgcagtggcacaatctcggctcactgcaaccttgcctccagggttcaggtgattctcctgcctcagcctcccgagtagctgggattacaggcatgcaccgtcacacccagctaatttttgtatttttagtagagacggggtttcaccgtgttggccaggctggtctcaaactcctgacctcaggtgatctgcctgcctcggcctcccaaagtgctgggattacaggcatgagccaccgtgcccagcctgggttggcttttaactggcaagtttagtctgtgtttctgtgcgatgatatagttgcatgtattcctgtcattttgatcattttgattgtgtttattacgtatttcctctcctaagttttgttatttcctcctcggaaattaaggaaggatcaagactgattgaatttatttgtatttttgagacaggttctcactctgttgctcaggctagagtgcagtggcatgatcatagctccctgcagcctcaaactctggggctcgagtcatcctcccatttcagcctcctaaagtgctgggattaacaggcacgaaccattgtgcctggcctgagttttatgtattacccactccaggaaatcactgtagtccttttaactgttactgatttgcttaaaatgtgaaaggcctgttgacatttaaggatagtcaacaaccctcccaccctccaaaggaaggagagctgaaatgcaggagaaacagcaatgcctttgatgagtatggctttgctgctactttgctcacctgtggccctgcctttcccaaggatagtttttgttttcctggagcacatccttcagaagctctttcagtctttcagtgcctgaagatggcgtttttgtccccctcatacttggtgatcacagagttcttctaggttgacagttttgtctcctcggtactttgacgattgttttattgtcttctggcctctgttgtggttttgaggagtctgcgatcagcctgctccttgttccttgtgggacacatgtgtgatctgtggttgcttttagcgtttttattttgatttggtgcggatttgttatcaacattgcttttgatcctccttgggacttactgaatatgagcatctctcttcttgttttggaagaatcctcagtcagacattgcatctccttccttgggtggaagctgctcagtcactgtcctgtgccttgccgtggggctgcctgtgcctctgtgcctgcttctccttccatggggagcccctcccagcccctcactggcgctgggaagcacagtggtcctcccctctgtgggctgtgttgagaaatgttgctggctagtcccagacccacaacacggagcacgggggttttgcctggtgcccgtgatatcagtggggagtgagaggagcaggtggccccctcggctgtgttcagggtgtgcctgtgtggccgaccacctccaggactgaggccacacaggaagcagttgggattgtgaaaacccccatgggaagctgtgctgatcctcccctgagcctgtgacagctgagggcacaggcaatggtggggctcggtgcctggggctgagttgggaaggtttggtgtctgacccacttcttcccaagtgggagctccctcctcgggcactgcatggcttctctgcggggcctctgcctggtcctctcgtgggcggtccaagacctggagcccaggaggtggattctgaggtctgagtcccccgcaggacagcagttccatcctctggtccctctcctgcccccaggggccagtaggttacagacaccttcctgaaactccctggaggggagcagccttgattcctaaacaagaagttggtcctaagtgcatcctcttgatgtggggcagagaagaaatctgagacagtctcatgcccccaccgccatcgtccccccacttttttgtgggggtgcccaatctgtgctctgccccctccccaggctccgctcctgtgggctgcgtcgtggtttctcctctctgtgggacgtgtgctgggcccctgggggtggatgcagaccgagcctgggcccatgtagaccaactggcgtgggtgtgagagagagagacgcatacccactcaggcacatacacgtgcacacacacacccatgcacgcgtgtgcacacacaccctggccctgttccctaccagtccccaccccctcctgctgcatgtgctcctggttccctctcttcacctgacagctggagtcatcctcctgcccacagccgtgccctgtgcagagcaggtgctggttctgccctcccctggcctgccccaggcggggacactacactgggaagctgccccgttgcaggcgttcccatggcgccactgctgtgttagctgcctgcagcacaggccggccagtcctggggtgctggacagaccctcctggaagccagtccctggccgtcctgtcctgctgggggcacagtgtctcggcagaaggttctggctgctccctggggtgctggcttgtgtcacctggctttgctgggtcccagtgacatgcagtctggggatgttcctgggacccgttgggcttgcggtggccacttgggaaagctgagcactgaaagtgccaaaacctgggacaccttcttgcaggcccactcttcagcctttgccccgtgggccattggggagggaggaggtgggaggttttggcaaagcagcccaaaggtccacacagacccagggctggcaaccggcccggcctgtcacccttctcactgagggtcacagcctgtggcccatggcagggctgcccaggacaggggcttggccccggaggcctgcagtgtgaggcgtggcccacaggccttcccagagggggttctgggagcctcccccagctgtcacacgcacctgcctgtgcctcacccgggctaaaatagcccctgcacagaaacgcccttgctgggcagggcccattcctgctgggagacacctgtcagggcccttcctgcctggggccatatggagtgtccagcctgggggtggtcgtggggtgtcgggggcctgggcctggatccacgatgccctgtctggtctagagcctggcctggcttccccttggcgtgactgcccacaggcagtggccgccgtctgctcagctgcatcctcctgcgttgggctcatctgtctgccttcccctgacacctcctcctgccagactccagggccaagggagtgggccccggctgcagaggcagtgccagctagctgagtgggtcaggccacagaccccacctgactccagggcagcgtggccaggagagcattggaaggagagagctgttcccaccttgaggctgacgcagaccagacctggctctgtcctgagcagcagaaagtatgtgcagggcttcaccctcttccctctgtctgtgtagagctccacctgaggcccagtgtgtgcgtagagtcccacctgaggcccagtgtctacgtagagctccacctgaggcccaatatgtgcgtagagctccacctgagggccagtgcctacgtagagctccacctgagggccagtatgtgcgtagagctccacctgaggcccagtgtctacatagagctccacctgagggtccagtgtgtgggtagagctccacctgagggccagtgtctgtgtagagctccacctgagggccagtgtgtgcttggtgcccacagctgagttagcccaggctcgtggtcatgctcacaggtgcacgtggccacacaagtcactgagcacagacccagatgggatgcagctcataacgtgcactgcgggggggagctgtggcatcttttcccagagcccctctggtctggcagcctcgggagtgtgtgcatggtatgggaggtgggaacagagctgggaggggctcccctccatggggtggggttcccctccagctgttggtgaggcacactgtacacctgcacacctgtgcctgggactgttgggctggacgtgtaggaacatggaatggcccctgggccttcgggtgactgagacagaagtacaggcccagcaggtctgaggacagggcctcctgatgactggacccagcctggacaatggccggcagctcccagccttgccacaggctgactggaatgcgtggtgtggtggagcccagcactgagggccggacgtgtgtttgcagcattgttctcacagccacctcggaggcttccctgctctggggcagatgccgttgctggagccgtggtgctcccagaggcaccctgggctcagctcagcccccataggccagtgcctggagtggctgtgacgctgtggccggcgcctggcgtggctgtgacgctgtggccggcgcctggcgtggctctgacgctgtggccggcgcctggcgtggctctgacgctgtggccggcgcctggcgtggctctgacgctgtggccggcgcctggcatggctgtgatgtgctgactccggcaccatcagttccttcccctattctggggcaggtggggaccacctcttcaccctccctcatgggcagggctggcctctgctgaggtggcccctcactgggcccaggcatggagacccagtggtcctagccctcggtgtagtctatccatgaggcacctggctgagcctgttcctctcactccacagcagcctccttggccctgaccactggccaacgaggacactgagaaggcaccctgaccttctgtcctcattagcagggagcagccatgtccagataaggctgtacatcagagaaagctgagtgaggctggcaagagctggcagccgccctcggccgcccgggcgagccttgggacgggctgggtggtaagtgctggtgatgcaggagcagagagccccgtggaactctctccatgaggacggcggtgccctggggcccagctacgaggatggctgtgcaggcacctggagcctggggatggcagggcgtgggctgagcatgtggagcaccagcctgtgacattcctctgcccaggggcagcagggcacggagcgtgtgtggccagctgccgccacaggcccccagctcccacgcgggcaggctcgcgaccgcaccaagggggcagctcctggagacaaaagctcctcagttttcccttccaacaaaacacagtcagcaggtttgggaccagctgcctggggtcttaaccatctgtgctctgtgcgcgcccccacccccttgcctgcctggaggaaagtggtggggttgacatgcgcctcgagggccagccgggcgctggtgcatttctcagaaatccgtgaagtgctcccttgtcctgctcgtgttctgtgctgtccttgggagtggcgcggccgcttgccagggctgcagagttggccacgcagcctctccaggaggccttgagccaagcacaggatgcagcccagcagtggtggcaccgtggagtggctgggcggaagagatcctggtccacgctgctgtctggagggcagggtcctcaggtgaccagagtccgtgcaggagcgagtgaggacagggctggggcaggcggcaggatgaggccgcccagagcaactcagtgagtgaatgagtgaaagcacgcacgccccatgctccagcggggccagagtgtgctgttgggtgagtctggccttccttcctggggttgtgggccctacttgtgggaggccactgtggggagggcgtccttgtagaagtgttaatcagagtgaaagccagtccctgtgcactgctgctgggaatgtagcatggtgcagctgttgcggggaacaggacggcagcccctcgggaaatgagacagagttaccgtcagagttactgtgtgagctagcagttgcacttctcagtagaacccgggagcactgacgcagggcctccaggggagatctccaccctgtgttcacagcagccttactcacggtgactgcgtgatggacgcagcctgtatccatcctcggacaaacaagtcagcaccatgtggccctccgcaccacccagcatcactgggccctcggtcagcaccgcgtggccctccacactgtggaatattacttagccctgaaaaggaaggaaatggacacaggctgcaacgtggatggaacttgagtatattgtgctgagtggaataagccagtcacaggaggacatgcactgtatgatcccatttgtgtcaggtccctagagtcattgcattcatagggacggaggtaggatggtgcagcctggtgatgccaggggccggggaaggtgggaatggggagttggggttgaatgggtagtttcagttgcgcaaggtgaagagagttctcgggatggatggcggtgagggctgcacaacagcatccacgcacgtagtgccactgacctgcacactgaaaaatggttcaaacggcaagttttacgttatatttaccacaataaaaaagagaaatagacatcgtcaagctgttctccaaaataaggctgtcaccgtttaccttcctaccagaaaaaaacagttaagtcccaaagccagggggagcaccagtgttaacctcctgggttggggctggctgagcccgtggctatgcctccctgggcttaggtggcaaccctgcgaggagcttgggcctctcgtcttttgggttcctgttcaaaatgggaagtggtctccaaaccccagggcccacctgagccccctgagatgggaacctctccagacctgcccctgagatcctgtcccacccctggacaagggcctctgtgcctctgaacaaaactggggggcctggtgcagagtcctagctcaggcttccagaagtcagtggtttgaaggggtgcccacccttgctccgttgggacatagggacgcaggtgcctgtctcagcccccacatgtgcacccccaggggcagcagcgtcccctccagtctctggtttgcatcatgcacaggagtgggtgggtgggagtttcagtctcccagagagcatactgttgggccatgctgtctctggcctcctcacccatggaggtcctgccccgcccccatctgaggctgggtggccgaggggtctgttctcagactggggcctggcgctggcccggtttcctggaggaggaagcgggggagtgacctgcggaggacttccagcctccccttccgcctgctgtgggctgcatggcgctggggctctgcccagccctggagagtgttggctgctctccttccagctgacatggaaatgccatgcagggcacgcacgtggggcactttctgctgagtcaggtttctctgaccttcctgaaatgtcacttgttctgtaactcacaaaaactggggtgctgggatatggtgccttccttctcccggaagtccctgccgaggggggcggtggtggggcattcccagggggtgtttgtcctttgctgtctttactttcccaccttgttccttgggcctcccctgacctattgaccctgccacagctcgctcaccccaggtccctgggggctgtgcaggattccgggtcctccagggccagtgtgatccttgctgggttctcagagtgaccctggagggaggtcccctgccgaccctcacctcccgttcccaggtcatctgccccagggccaggtgtccatccaccctgactgtgaccatgtgcctgtgacctgcgtgactgacccctgcccttgggtgcccaggcctagcagtgccccatgccactgggtccccaggcatctgccaggaaaggacagctctaaagtggccagggcagcaggggtcctgatgtctgttgaaggcccttggaattccctggcttcattgtgccatctccccgctcttctccctccctcctgcctcctgtcttcctactctctcccctccttccacccacccagctgctctcctctctgagcctggccccacaaccagaggtgctcactcctgccttcaactgactgcaggtatccaggcatctgggctgagggtgcctctgtggctttgttgaccaacccaggctgacttcagaggtgctcttcagcccctgctttgcaagttcctggggacccgtggctgtcactttggccccttgatgtttatggtggttcccgtagctaagtggatgctgccaaagatggaaagtgggggacgctattccactgccactcagagcgagaccaggtgcttcaaaaagactagcagggttgggtgtggtggctcatgcctgtaaccctagcactttgggaggtcaaggtggggggaccacctgaggtcaggagtttgagatcagcctggccaacatgagaaaagcccatctctactgaaaatacaaaaattagccgggtgtggtggtatgcacctgtagtcttagctacttgggaggctgaggcgaaagaatggcttgaacccgggggcagaggttgcagtgagctgagatcatgccattgcactccagcctgggcaacaagagcaaaactctgtctctataaaaaaaaaaaaaaaggaagaaaaagaaaagaccagcagggccaggtgtggtggctcatgcctgcaatcctagcactttgggaggctgaagggagaggatctcctgagcacaggggttcaaggctgcagtgagccgtgattgcaccactacactctagcctaggtgacagagcaagattctgtctctattaaaaaaaaaaaaaaaggaatggagatgacaaagaacaagtcttaattgaatattaacaaaagccagaagctgattggaaaagcttaataaagtagcaaacatgcctggctaatttttgtatttttagtagagaggagtttcaccatgttggccaggctggtttcaaactcctgacctcaggtgatcagccctcctcggcctcccgaagtcctgggattacaggcatgagccaccacatccggccaatttttgtattttttgtagagatggggtttcaccatgttgcccaggctggtcttgagctcctgggctcaggtgatccacctgccttggcctcccaaagggctgcgattccaagtgtgagccaccgcgtctggctaaggagtattttccttagcagatacaaatttatttaaattagctatgctagttaaaacaatatggaattggcagaagtataaacattgactaatggaatgtaccagcagaaacacatgcgatcgtaatgtgcttcagaaatggcctcattcatctgtggggaaaggatatacttctgggtaaatggtttggtgataactgaacattcatgtaggaaataaaatgcaatcacaacacacacaactccaaatggatggataatctcattgtgaaaaagaggaaggaacaaatgggggagtgggatggattaaagcagtggtccccaacctttttgccgccagggaccggttttgtggaagacagtttttccacagacggtgatgggaatggtttccagtgaaactgtcccacctccgatcatcagccatcagattctcataagcagcgtgcagcctggatccctcgcgtgcacagttacaatagggttcttccggagctcaggtgggaatgctcactccctggtgctcatctcctgctgtgcggccagttgctaacaggccaggaacctgtcctgggggttggggacctctggtctacagcacaggtgacttttctgtaccagagctaggaatgaagggctggctgagctggtgcttcctgccacctgtgtagtggtgcaggtgtccatggtccagggctggccaggggcatctcctgtcctggcttggcttctgcccctgggtccgtggtggctgcctgggacctgcccttgcagccagggtgaaaggagtgggcagggcctgctgcctctgctcagggcccctagtggggctgcttgctcagcacccttgccccgtctctggccacgtagccgtcacccagctagcatggggaggctcgctaccaaggggtggggggctggagaacggagcttggagacagctggcagtctcggccacacatagagacacccgctcctgagacctgcagtgcctgcagaggggaagaaacggggctggcggggagagcacacagtgcgtttctgtggtcaggcccctttatttcttcaaatagatcccaagtgtagagaacatgtgctcattcttgttggcaggcctgtgggtttttgtgtctcactctgaacttttcctgtatgcctctcgcttctctctgtcagaaaacaaaacagaagcctctattctctgggattcggattcaagtcggctcttttattcacctatttcgagcagacacaatgaaagaggaaacagataacactgtgggtattcagcaagttgtcttggatgtgaacattgagtttccacttgtcactgtgattttattttatattgagttgtttttaaaatatgctttgcttcactttcgttgctgttgaatctattacagctgcacggtgtcctgaacacagtggcaggctggtgatgaatcgtcttctgtaggttttctggtgtctttgttatgattctctcagggccaagtgtggtgcacctggcctgggcaaacctttaggcctcgctctcagaaccaactgtggataataagcaaataacatgttttgtttatctgcgcagtttctgaatgcaaatgattctttttattccttattttatttatttatgttttagagacagagtcttgccgtgttgcccaggctggagctttttattcttcgtgtttgcacagtggctgtagctatgtgtagtgacagcagagacaggcctgagaggggcagccacgttccccctgggcaggatctgtctgctacgggaccgcaagctgcgactttttccttctaagtgtgcggagaggagcccctgcctagggacggggagccgtagcctgctgtttttgtgacaagcatcttgggcgagggggcactgggctgtgctgcatagatggtgagcactggactcacccccagccccaagtcaaacgaatgtaaggaacgtgagcttctggaaacgagcgtggaagcctgagtggtgaggaagggaaatcttgcagtacctgcacactccccaaatgcctcttgtgggtttgcagtacctgcgcactccccaaatgcctcttgtggatttgtttgtttgtttgtttacaattagttcatccacagcaggatccaagctgctgcctgtgtgtgtgtgtgtgtgtgtgtgtgtgtgtgtgtgtgtgtctatgtgtgagagagagagagacagggtcctctgtcacccaggctgagtgtagtggtgcaatcacagctgactgcagcctccaactcctgggctcaggtgatcctcccacctcagcctcccaagtagctgggactgcaggtgcgccccaccaagcccagctaatttttgtatttttttgtagagacagggtttcgccatgttggccaggctggtctcgaactcctggcctcaagtgatccacccgcctcggcctcccacagtgctgggattacaggcatgattgtgcccagccacagtagagcttcttgtttgcagttggttggtgtgtgtcttgtggctgtctttaataaaacaaaaactttgcaagtatcgtctggtaggccaggcgcagtggctcacgcctgtaatcctagcacttcaggaggccgaggtgggcgggtcacttgaggtcaggagttcaaaaccagcctggccgatatggtgaaaccccatctctagtaaaaatataaaaaattagctgggtgtggtggtgcacgcctgtagtcccagctactcaggaggctgaggcaggtgaattgcttgaacccgggaggcggaggttgcagtgagccaagatcgcaccactgcactccagcctgggtgacagcaggactctgtcttaaaaaaaaaaaaaaaaaaagacagtattgttatggtaaaggttcacccctcacaccttttttcgtatgcagctctgagcttaacatccaccatacaaccaggcacagaacactgggcagtccacccaaaacagtccccagcagccaccctccctactgacctggccttgtgcccccagctctgccttttccagagtgccatagagatggacaaaaatggtgtgtgccctcttgacacgggcgtctctcactcaacacgatgccttccagatccatcctatcacgtatcgatctgttcctagctgttgctgaatagtaccaaaatgtccttgtctttgtgtgaaggacatcggggtttccagtgggtggcagttatgaatagagctgctgtgaatgtgcattagggatctgtgtagggacatatgctttcatttcccttggaccaattccaaggggtaggattgctgggtcctgtatgtttaactttgtaagaaactgccaaactgctttccagtgactctgccatgtggcgttctgcacgttcagagtatatggaagtcccagtggttttgcttcctcgccagcatttggtattagctttttttatttttcatgttttttaagccattctaataggtgtagttggtatctcgtttggttttaatttgcatttccctaataactaataattttgagcatcttttcatgtgcttatttgctatcaatgtatcttttctggtgaaacgtctgttcaaatattttgctcacttttttttttttttgagatggagtcttgctctgtcacccaggctagagtgcagtggcgcgacctcagctcactgcaacctttacctccctggttcaagcaattcccctgcctcagccttccgagtagctgggactacaggcttttctcactttttattaggttgtttgttttcatattgttgagttctgagagttcatatatttatatattctggataaaatttttgtcgaatgtgtgatctgtggccaggtgtggtggctcatgcctataatcccagcactttgggaggctgaggtgggcagatcactcgaggccaggagtttgagaccaggcctggcctacatgtagctgggactacagatgtgtgctgccgtacttggctaatttttatactttttgtagagacagggtctccctgtgtacccaggctggtctcaaactcctgggctcaagtgatccacccacctcagcttcccgaagtgttgggattacaggcatgagccacccttccctgcctcaacttttaatatatggttgaatttgcctggaagtttttttttgttttgttttgtttttggaagatttaattaattaattgatttatttttgagacagagtctcactctgtcccccaggctggcgtgcagtgatacgatctcggctcactacaacctctgcctccccagttcaagtgattctcccacacccggcccagaaaatttaacaattaattcaatttatttaatagttgtaggactataccagctatctatttcatcgtggggagttttagtagtttgtggctttctagggaaatgaaaattggtacattttatcaaagtagtcaaatttttgttcatgaagttgtttatagtatttcccagtagtctgtaaggtctgtagtgctttccttcttttacttctgataatggcaacttttgtctactttcttctttgtttgggtagaggttttatgaattttattgatcttcccaaagaactagcatttggttttattttattgtttatctattttcagtttagttgttcctctttatcattataatttccttccttttgcttacttggggtttaatatgttcttctagtttcttaagatggaaccttagggctgggcgcagtggcccagtaatcccagcactttgggaggccgaggtgggtggatcacctgaggtcaggagttcgagaccagcctggccaacatggtgaaatcgtgtctccaccaaaaatataaaaaattagctgggcgtggtagtgcacacctgtaatcccagctgcttgggaggctgaggcatgagaatcgtttgaacccaggaggtggaggttgcagtgagccgagatcacaccactgcactccagcctgggcaacacagtgtgactccatctcaaaaaagatggaatctggctgggcgcagtggctcaacgcctgtaatcccagcactttgggaggccaaggcaggcggatcacgaggtcgggagattgagaccatcctgcctaacacggtgaaaccccgtctccactaaaaatacaaaaaattagctgggtgtgatgtcgggcgcctgtagtcccagctactcgggaggctgaggcaggacaatagcgtgaacccaggaggcggagcttgcagtgagctgagatcacgccaccgcactccagcctgggcaacagagcgagactccgtcttgagaaaaaaaaaaatggaatctttagattgtgtatttgaatcttttttcttttctgacataagcacttaatgctataaattctcatttcagaacggctttagctgcacctggcagattgacgtgctgcgttttcatttacattccattcagagtgttctctgatttcctttgagacttcctttgatccataggtttttgttttttagtttcccaagcatcccaagaggatttccccgccatctttctgtgatagattgctagtctaacgccattttggtcagagaacgtattctttgtatgatatcagctcttttgtatttgtgaaggatttgtggtgtgacccagcctatggtctatcttggttcatatcacctctcttagtctctctcctctgtctttcttcctcttgcattgtgttgagtaagagagagtctgtgggaatccgggcagccccagtggagtggggtggaaccaggacgagggtccctgctggaggagcgccccctcaggccaggcccttccgcgtttctgccaagtcctaggagactctgacttaatgcctgacttattttgtgatatactgagttatgagaatgactttaaagctcacaggtggcctcagagtgcaccttgtgctcacaaacactgacgggcgacagtggacagtctgactgcagctcggggaatgagttgaaggactctgacagagatgtctgtagtaggcaggcttgtcacactcattgtttaagctccatgcctgtttacctaaaaagctggacttaaatacatcgaacttggaactcagaaaaataaaacatcttctgacctgggtaggtccgtcttccagtgttggaaagcagactcatttccgggttagtcctgtgctgctttttgacctacactgacccgatcttgtttggaacaggccgccctgtgcatgatttggtcccatgcagaatcacacagcccggttggtgactttgatggctgtcaggcactgctcgcgtctgcagccctgtctgcagagagcaccccgtggccctgcatgcacggctcccccacccccgcccacacaacatcccccccaccgcctgcacggctcccccacccacacccgcacaacttcccccccaccccctgcacagttcccccactcccacgcgcacgacttccccccctaccccctgcacggctcccccacccccacccgcacggcatcacccccaccgcctgcacggctcccccacccccacccgcacggcatcacccccaccgcctgcacggctcccccacccccacccgcacaacttcccccccaccccctgcacggctcccccacccccacccccacgcgcatgactttccccccaccccctgcacggctcccccactcccacgcgcatgacttcccccccaccccctgcacggctcccccactcccacgcgcatgacttcccccccaccccctgcacggctcccccacccccacccccacccgcacggcatcaccccctaccccctgcacggctcccccacccccacctgcacagcatccccccaccactgcatggctcccccacctctgcccacacagcttccctacccccgcctgcacggctcccccactgcctgttgtccgctgtccccgttgcacctcccacctgctgccctgctgtcaagtcaggcgcgtcccacccagagtgctctggtgtctgccccttggcttctctcagcagctcagtggagtgtagacagtgtagtagatcatcacctgagcagccaggatgggagtggggtctctgtggtctccattttacaaatgggttgacaggtgctcaggaagccctgtgatgtcctgaggccgcccaggcagtcatacacaggctgtacccatccagtgctcccgttgcctgggggcagggatgtgtgctggaagggcctgggactgccttcccaccgccatgtccacacccaatgcccaggggtggagacggaagcacgtggcggccactgtggcactggtgggtggctgcgttccatggcctgactgtgtctggcgcctgttctggtgttttacattcatactttgagggccaagcaccagcccaggaggtgggtgccacaagtccagacttccccaagggaaagtgtccccagcacagactcagccactcagaacttgttggtcttagagcctgaagccgggcagggcagacagtgccatccctatctggatggtggtgccttcacccttctgctgtcctgagcaagaagaaaaatgagccaagcttcaaagagagctgtgccaaagtttccggaaagcttgccagtgtgggtgttgcaccccacacaccttcaggcatgggtgggtggtgtgggcatcttcactggatggatttggagccctggcgcgtgtacggcagatgccccggggagatggcatgttcacacggggcagcactaggcagagtggagggtagggtctacacccctccactcctcagcaacagagccctggacactgggtgtgtccttcagactgtccctggcgtctccagcactcctgtggcctcaggacggaatgatggaggtgaaatgaacagaaggaaggttgggggaaagcgtatcccagctatgggcagggggtcctggggtgggcaggatttggggcggctgggcctggggctggatagggccgcgggagaggggaggcctgtgctctcacagctgggagctggctcaggactctcagatcttctctttgtggcctgtcatccctcctacctgcctgtccacaggcccacactgagtgagttccatgggagggaggctcaccctcaggggccttcaggagatgggacctctggcccggcagccaacggatgctgaggggtgcccaccatgtgcagggacagctggggtgatgtcttggagccctgtgaggtcctggggccgcccaggcagtcacaccccgccctgcaccccagggtgcaggctcccggggtgacacagtgctgggacggcacagggccgcgtcctgaggagagggcggagccccgaggctgagctgtgccttgcctcacaggttgtgcagcctgactctgaagaagctggtggtcttcaaggagctggagaaggagctgatctccgtggtgatcgctgtcaagatgcaggtgaggccgcttgtgaccccggctgtggctgggtgctgtgtaggctttccatgtgcctgggagacgagtcaggcggtgcgctactgtggggccttgtgccaaaacagcgggcagcccatgccatctccgggagcccggggggctgggaatgacaggatgctcctgggtccagtcctgtcccgcacaagggaggcaggcccggccttctgggatgtggaggtcacatgcatggggccttcccagggcagagctgccctcgagtcacctcacagtgatggacgggccccaagcacctggagccagggcttccctgctgcactcagcacccacttcctgcccactttttgtggggtggagggcgtcggtgggagaggggagcagggcactctgggaggcgagggcctagccagaactcccagcccctggtgccagggcctctctcctgaccctagtgggtcctgtgacctctcgaaggctttgaacaagtagcggttccagaggggtcatgctggtgtcttccccatgcctggcccaggccccgccccctccttggggtagagctgccatgacccttgcagcatggcctttgcccagtggcccagacagggaggtgtccccgccaactgtcagggccacccctgccctttcagggtcatacggttccaggtgtgtggcctgtatagggccaccgccagcgggctctccctagccggcaccactcatgggcaagtctcacccatgtcctcagcatacaggagtgtccttctgtgtggccgtccagcgtgacagggtggggtctcagtggctgttgtgctcctgaccccagcccatcagctcctcgaggatggggccctgcccttggagcccatgtccaaggccccacacaggtccctgcagctggccggattcttgacacctgctgtggctctgacacggggtctccgggtctccccgacctgcagagtagcacctgagcctcggccagtgtggctgaggtcaccagccaagcactgggtcttgagtgcgaggaggcctgaggcttgttgtctgtcccagtcaattgccactatgtgaaacctactgcatcttaaataaacgtctggagaaacccttttcctcgctgaacatgctcgtggattagcagcagcctacatctgcggcgtgtgctggtggccaggttccccgggtggtggggccttgccccaggaacttccaggagcgtgtggctaatagcaggaccccaagaacttccaggagtgcgtggctaatgcaggacccggagaacttccaggagagcgtggctaatagcaggaccccgagaacttccaggagagcgtggctaatgcaggaccccgagaacttccaggagagcgtggctaatagcaggaccccgagaacttccgggagcgcgtggctaatagcaggaccccgagaacttccgggagcgcgtggctaatagcaggaccccaagaacttccaggagtgcgtggctgatagcaggatggaagcgtctctccgcctgtcctgcccatgggtgtggccatgcccagggtgcccagtacctgctgcagtctggctgcgggtcgtccctggggaacagggagctctctgtgggccattgccaccaggccgtgaggctgtgtctggacctcttggcttggggggcaggggtcagggtctcattgggtcttcagagcaatgcagaaaggcatgaaggcaagagtcgacccctcactgacttctgagtctggtgctgttgacctctaacctctggcatggggccccaccccacactgaccctgttccttggccccattccttcctctgcctgtctctggtcctgccccagcctgtgtcttgaccgagagcttggccccagggcccctcagagccccacctctccagcccctctgtgtagcgcatggactggctgcccatgccctccctgcccaccccagctcagcagccacgtggcccttggcctcccttgatcaccccagctcctcatctgcttctcttggggtgtcctctccgcccaggccccctgtgggggaagcagccagcctggccccgcagccccacctgcccctcagccttctctggcgtgcaccttcgcctcactggctggtggcacacactgtccttttcccgacacagctgggtccctgcaggtcctctgaggggggaatgctaagagggacccgacgcagagcacatttgcagggaaacatctctgaagggtcaaggggaggagcagggagagtccagaccacaacgcaggggcagctggggagaggagaggggacaggagggctggccgaggagagccgcgctgcctcttgccacgctgcacgtgaggccccagcacaaggggaggaccagagtccgccatggacgtctcatggagcccgagtacggccatgcgggccgcccgcacctgtcctgaggccccgctgctcccacccgaacctgggctggccccgggctcccgttgtctgtcctggacccccgcccgccctccagccacctggcacctctcatccactgtgtcccgcgcgccggcctccgggaaccttgtgcctgggaccccgcagcggctgcttgtttctcggggcacgaggtccccaagctcatccttgttgggatggtcccatttaaaacagcactgcgataagcacgttcaatccattaggaatctattttgatataaagtttgcggttggggtcctgttgtctttcacgcaaatgactcgttatccatttagcaggtgcgtgtgatgtctcctgctggcctgaagctcactgggtatgaactgtgttttcaggtgctcatgcatttcctgcacctacatctaggcttctactaccctcatttttgtgacagcatctccgtattttaagtattgtatctctgtatgttttactttctgagaggaccagtcaggcctgatcattcttctttttagaaaatgctttaggccaggtgcagtggctcatgcctaatcccagcactgtgggaggccgaggagggtggattgcttgaactcaggagttggagaccagtctgggcaacatgactaatccttgtctcttaacaaaatacaaaaattattgtatatttttttgtggtggtacatgcctgtagtcccaggtgctagggaggctgaggctggaggattgcctgagcctaggaggtcaaggctgtagtgagttgagatcgagccactgccccacagcctgggtgacagagaccctgtctcaaaaaataaaaacaaaaaataaaaaaatgctttaagccaagcatggaggcacatgcctgtaaggctgagctacttaggaggctgaggcaggaggattgcttgagcccgggagctcaagtccagcctgagcaacacagcgagacctgtctctcaaaaccaaaaccagaagaggcttggtgcctccagatttgttctgccagacagacttgggcagcgcagtcaggtgctgctgcacctggccgtggaatctgttttgtgatcgcgttaacttcagcaggagccgctcctggtttctctctcatgtcttagggcagattcctggaggtggaacctgtgggccgaagggtctccatgtttttaaggttcttgggaaagatgccagggcacctctgagaattaccccagcctgtgcctaccacccccagactgcagggctgcaatcctgccagttttagagtgcaggagtcacggtgtctttgcctggtttcctgctgatatgcagtcctttgagctagaacaggtcttgcttaatcacagggctccaaacgaatcctgcggtcccatgagattgtgctgccccccagtggacaagtggagacagacctggccctgaccttctccttgcaggtgagtctttcaccagtggtgacgacaccctcatcactgtcccctggggagacgggcccccctcatcactgtcccctggggagacgggcccccctcatcactgtcccctggggtgatgggcccccctcatcagtgtcccctggggagacgggcacgcctcatcaccgtcccctggggagacgggcacccctcatcaccgtcccctggggcgacgggccccgtcatccctgtcccctggggtgacgggcccccccatcactatcccctggggtgacgggcacccccatcactgtaccctggggagacaggccctccccatcactgttccctggggagacgggcccccccatcactgtcccctggggagacgggcccccccatcagtgtcccctggggagacgggcacgcctcatcactgtcccctggggtgacgggccccctcatcactgtcccctggggagatgggcccccctcatcagtgtcccctggggagacgggcacccctcatcactgtcccctggggtgacgggccccctcatcactgtcccctggggagacgggcacccccatcactgtcccctggggagacgggcacccccatcactgtcccctggggtgacaggccccccccatcactgtcccctggggtgacgggcaccccctcatcactgtcccctggggagacgggcacccccatcactgtcccctggggtgacgggcccccccaatcactgtcccctggggtgatgggcaccccctcatcactgtcccctggggagacgggcacccccatcgctgtcccctggggtgacgggcccccccatcactgtcccctggggtgatgggccccctcgtcactgtcccctggggagacgggcgccctcatcactgtcccctggggtgatggccccccctcatcactgtcccctggggtgacggccccccctcatcactgtcccctggggtgatgggccccctcatcactgtcccctggggtgagagcatttgtctcatcattgccatcagtgtcctgcgttactgcagatcttctgttgattatggtttattcttaaatgattagaagatttgtatttgtttattaggttgagtttttctttgttttttctttgttttttgtttgtttgtttgtttttgagatggagtctctccttgtcacccaggctggtgcagtcttggctcactgcaacctccacctcccgagttcaagcgattctcctgcttcagcctcccgagcagctgggattacaggcatgtgccaccacgcccggctatttttcgtatctttagttgagacggggtttcaccatgtcggccaggctggtctcgaactcctgactgcatgatctgcctgcctcggcctctcaaagtgctgggattacaggcgtgggacaccatgcccagcctagtttttcattccttatctatgataaagagaatataaggccgggtgtggtggctcatgcctgtaatcccagcacttcgggaggccgaggtaggtggcaggagaatcgcttgaacccgggaggtggaggttggttgcagtgagctgagatcatgccatagcactccagcctgggggacagagtgagactccatctcaaaaaaaagagagaatataataacgagggcaaaaaaacacttactgagtcaaggctattttgctcttctatttaaaaagataggggaaactcagagttcacaagcaatcccagctcttcgggaggctgaggcaggaggattgcttgaacccaggaggtggaggtgacagtgagcccggctaatttttgtatttttgtagagatggggttttgccatgttggctagggtggtctcgaactccctacctcaggtgatccgcccagcttggcctcccaaagtgccgggattacaggtgtgagccaccgcgcctggcccaatgctccatggttcagtgggttttgataggcatgctcaggcatgtcagcaccaccgcagttagggtggtgaacagccccattttcccctaagtatttaaactgatttttatttgtgaactctgagtgtctaagagatacctgtgaacatcagcttgctggagccctgctggacagggagcctgtggtgagacgtgcaggcgagttgggtgaacagggggcctcggagggagagccctccccgccctgtgtgcccctcgcggaaaagcgtcctgggtcccaccttgctgattgcctcaggcacatgagccgccacactgtttccgagtgtccacaggcgcgctcggccatcccggacactgcagcacatagtccttgtccacctgccatggctgttagcgtggcgcggagccctcagggcctgagctctggcgactggctcactcttgattgtgttgggtaaaggatgggctctggggaccggcatgccactgggatgaacttgggggcccgtctgtgggtgcccttccgatctcatgggcagcaggttggcctggtcgcaggctgcagggtggctgggccgtcagaggccgtgatgctgcctggggccccggtgcaccctcagctgccactcgcacttgtgcccacagtatcctcacttcttgaagagggaaggcaacaagcttcagatcatgctgcagcgcagaaagcgctacaagaacagaaccatcctgggctacaagacgctggccgcgggctccatcagcatggctgaggtgagtgctccgtctggcgtggcctgcgtcgggctggccacctgggtgccagagcattcgcccgtgggagatggagatgtctctcccgggtccagatgtccagggatcaggtgaaaatgatgagaggagcctgggcggccgggctccgccataagggccaggtgcggccccaggtggtgcttcctctctgaccttcccttgccgcctagcatggctccccgcatgcctgcagccgcgcgcactcccctctaacgagcctgtcctgcccttcagtggaggctgggttttgggtcaggctgctctggagtccttcccatggaggaatcgctgctgtccccacaccacgggtgcgtcctgtgatgggttcgtgtctgcatcctgctcagcacgtgctctggcccaggattggctgagcaggagcaggacaggtgtcagttctgtgaaggggctagcgacaatacccgagcagggcgggggcagcacccagaggtcagaggggtggctggagttccctggaggggaaagaaggggaagtacctcaaaaggaaaagaaacagccaagcagcagcccaccttgctccagagaacccagcgttccaaggaggctgcagtagggcgtgggggcctgggagaagacaccccaggctgaggcctcggactttctcatggaccctttcggggctgcaagattggctctgggagaaggggcagcccagggccccagaccagtttgtctcttttgcttcagaactttccccatcgtggggttgtgttcaggggtccaggggctgcgggcgtgagtggtgcttggggcatgtgaagctgggttgctgcctgcctggggcctgggaaggtcagccagcgcagcccctcattgggagccggagatgccagagccccccagcccctcttcttcccactttgtccccctgctcctggggcttggggctgggacagtgggggtgcccacttgtagctggttcccccacacccccaggcccagcctgcaggcctcctgtctcccaggtcaagcgctaggtcccccagatcctcacacacccccacttacgcatccaggacaagtgccaagtactactctgggctcagccctccctgctaccccaggagatgggagcgtggagggtacaggaagcagcagtggcgtcccgaggcctcgcttctccgtgccgccgcagggcctcagacaagctttgcagtcttcccgattccttcggcaaaccacggacagcacgggtggaccgggcctccaggctgcacttcccagggccctgggacccctctggtggcctggagctgcccatcatcccagcctccctcctgcaggctgagcgatgggtgaacaggtagctcagggatgctctctgggctgtgagagcctcctgggagccaccgcttgcttcctgtggagcaggagggtccaggcactgtggggaggtcatgcaggctctgtttcccattagccatgcaggcgaggtcctgctgatccctgccggtccctgtgtttcccattagccatgcaggcgaggtcctgctgatccctgccggtccctgtgtttcccattagccatgcaggcgaggtcctgctgatccctgccggtccctgtgtttcccattagccatgcaggcgatgtcctgctgatccctgccggtccctgtgtttcccattagccattcaggcgatgtcctgctgatccctgctggtccctgtgtttcccattagccatgcaggcgatgtcctgctgatccctgccggtccctgtgtttcccattagccatgcaggcgatgtcctgctgatccctgctggtccctgtgtagccatgcaggtgatgtcctgctgatccctgccggtccctgtgagctcctgccccaggctgctccgcccacatctctcagtctgcaccccagtgccccaggcggctcctcccagcccctctcagcactggtgcttctgtgtttgacgtccttgccctgaatgctggcctctgctcccaggcccctccctcacctgtcctcccagccttgggctgtcccctcctgatccccggggagaggctggagcaaccttcccccaccccaggtcacaccagccacatcgtctgctgcttgaaatcccatcatctgttcttcactcttggcagaaaagccccacccctggatgtagttccagtgccctgcccctgagcctgtggcccccaccccaaggctccctcgccctgcacctgtggcttccaaagccgaggtcatctgactgctcctcgctctcccctccagcatctcctccaggccctcggggcatccttccaccttccactggcagcctggtcccagaacctagttgggtcctcccatgtgtccccgagcaccagggcggttcatgggctccctgtgtcctgccaccttttggggctggttcccacctgtgagcgttgctggcttgttgagagtatgagcacgggagattgcggaggcgggacagccccgagggcacagacggacacaggtggcagaggtggggggctctcaccagctgggctcaggcagctgtgccatgggggcttgctggctccgagactgcacgcctgagacgggggtgagggcatgggtgctgccatagggactgtcgtgagagtggggtgtcggtgaggctggcgccatgcatttgagagtagtgctcggcggtggggaagggtccttgagggcacagggtggggtgaggcgggctgttgggcggactcgaggccagggctgagagtgtggtgggagaggatgtggggggcacctgcccaggacctccaggctgtggggagaccaggaggcgatggctgtggggacacaggtgtcatctcccttcaaatgggtgcacacgcagggggcaggaggggctgggagcagcctgggcccctgccacaccatagctctgccctcacctggcactcattctgtgtgagctgaggcccagagccctggacttactctgaggctgaggaagtggagtccaaggtggcccagggtaggggccgggcctcatgggtgccaggagctggacgccggcgtggggtggcttaggtctgcaggctgaccagcagttctggctgggaccatcaggagtgaccgcagccccagggcctgctgggcacgcgcctctgcctgccacttctcaggaagcttgagctgactgcaggtggtccctctcagaggcagctccgcagaggcaggtgtgcggtgggggcagacgtggggccttctcctgtggtgtggctctcagaactcaccccagcacccgtagagggagtgtgtaggggtgggcgttcgtgtggccagaccaccctggggctgcagcctgggagacgcaggcatgccagctggtggccattgtctgaggctggggcctgtgggctccccgacaagacaggaaggttgacagacccatgaccaggcgaaggggtgacctgggagtgcggtggtggctgagggagcagccatgcttctttgcacagccggactcctcttgtggcctcgccacaagctgcacatgccactggggccaggtccagcccaaggggacctgtgaggggcgggcggctcatggtgggacacaggaagacctcagggtaaggacagcgcgggagcgtcaccctgaccgtttgcatgctggattccctttagtttctctctatgagtgtctgcacagccacaggctgctgatgacagcccagtcaggtgtgggctgcatatcaatgggtggccccgtgagaatatgatggcactggacacttcctatctcctgatgacatggtagccatcgtaacaccatagcacagttactttattcctgtgtgaactcagtgtggcccaggtgtccagggcctggtcacacacacgtccatccctacacggcggtgcatggcgacctcccaggccttcgcatccacacacacgtccacccctacgcggcggtgcgtggtgacctcccaggccttcgcattactcactcacccaccagcttgtccagagccacctccagccccgcaggctctgccatcgtcagtgccctattcacaggcaccacttaatgtcttttatactttatttttactgtgcttttttttttttgctttttatttttaaatttttttcgtgatgtggtttcacttttatagtgcagtggcgcgatctcagttcactgcaacctccacctcccgggttcaagtgattctccttcctccgcctcccgagtggttgggattacaggtgctcatcaccacacccaactaatttttttatttttagtggagacagggtttcaccctgttgtccaggctggtcttgaactcctgacctcaagtgatctgtctatctgggcctcccaaagtgttggtatttctttcttttttttttttttttttttttgagacagaatctcgctctgtcgcccaggctggagtgcagtgccgcaatctcagctcactgcaacctccacctcccaggttcacgccattctcctgcctcagcctcccgagtagctgggactacaggcgcccgccactacgcctggctaattttctgtatttttagtagagacggggtttcaccgtgttagccaagatggtctcgatctcctgacctcgcgatccgcccaccttggtctcccaaagtgctgggattacaggcgtgagccactgtacccggccaagtgttggtatttcaagcatgagccaccgtgcccagcctactttttctgtgtttaaatgtgtttagacacataaatacttaccatctgtaacaattgcctacagtattcagtacagtaacatgctttacaggtctgtggcctaggagcaggaggctgtctctcatataggctgaccttgaagatattgtgtgttcagttctaggccaccccaataaaaacggatattgaaataaagtgagtcacacaaatttcgtggtttttcagtgcatataaaagttatgtttacactgtactgtagtctgttaagtgtgcaatagcattacgtcaaaaaatatatacatacattaattttaaaatattgctaaagctgggtgcggtggctcatgcctgtaatcccagcactttgggaggccaaggcgggcgtatcacctgaggtcaggtgttcgaaaccagcctggccaatatggtgaaatgtcgtctctactaaaaatacaaaaaaaaattagccgggcgtcgtggctcacacctgtaatcccagctactagggaggggaggcaggagaatcactttaacccgggaggcggaggttgcagtgagccgagatcacgccactgcattctagcctgggtgacagagtaagacttcctctcaaaaaaaaaaaaaaaagaaaagaaaaagctaacaatcatctgagccttcggggagttgtaaccctttggctggtgggggtccttagtgtgggtgggtgctgaccggtcagagtgttggttgctgaaggctagggtgcctgtggcaatttcttaaataaaacaagaaagaagtttcctgcatacttgactcttcttttcgcagaatagttccctgtcgcatgcggtgctgtttggtaccatgttacccaccattatttcagaattggggtcagtcctctcaaaccccgttgctgcgttactaaccgagacggtggactctcccaagtcctgtgttgtcactccgcagtgttcacagcatcctcaccaggagcagattccatcttaagaaaccactttcgttgctcatccatgagaagccacttcttatcagctgaagtttcttcatgagactgcagcaattcagtcagtcctcaggctctgcttctaatcccagtcctcttgctatttccaccacatgtgcacttccttcctgcactgaagccttgagccctcaaagtcatccacgagagagttggaatccacttctcccaaattcctgtcaatgctgatatctcaactttttcccatgaatcacagatgttcttcatggcatcaagaatggtgaatccaggccacgcgcagtggctcacacctgtcatcccagcactttgggaggccaaggtgggcggatcatttgaggtcaggagttctaaaccagcctggccaatatggtgaaacgctgtctctgctaaaaatacaaaaaaagaaaaaaaggctgggcacggtggctcacacctgtaatcccagcactttggcaggccagggcgggtggattacctgaggtcaggagtttgagaccagcctggccaacatggtgaaaccttgtctctactaaaagtacaacaattagccaggtgtggtagaggacacctgtaattccagctactcagtaggctgagacagaagaatcggttgaacctgggaggcggaggttgcagtgagctgagattgcaccagtgcattccagcctgggtgacaagagtgagactccgtctcaaaacaaacaaacaaacaaaaaaattagtgggccgggtgcaatggctcacgccggtaatcccagcactttgggaggccaaggcgggcaggtcacctgaggtcgggagctcgagaccagcctgaccaacatggagaaaccccgtctctactaaaaatacaaaattagctgggtgtggtggcacatgcctgtaattccagctactcaggaggctgaggcaggagaatcgcttgaacccaggaggcggaaattgcaatgagccaagatcacgacattgcactccagcctgggcgccaagagtgagacttcatctcaaacaaacaaacaaaaaaaacgaattagtggagtgtggtggcaggcacctaaagtcccagctactcgggaggctgaggcaggagaattgcttgaacctgggaagtggaggttgtagtgagcgagatcgcaccattgcactccagcctgggcaacaagagttagaatctgtctcaaaaaaaaagaatgggccaggtgtggtggctcacgcctgtcatcccagcactttgggaggccacggtgggcggatcacgaggtcaggagatcaagaccatcctggctaacacagtgaaacaccgtctctactgaaaatataaaaaattagctgggcgtggtggcgggcgcctgtagtcccagctactcgggaggctgaggcaggagaatggtgtgaacctggaggtggagcttgcagtgagccgagatcgcgccactgcactccagcctgggcgacagagcgagactccgtctcaaaaaaaaaaaaaagaaaagaaaaaaaaagaatggtgagtcatttccagggggtttccaatttaccttgcccagatccatcagaggaatcactgtctatggcagctatagccttatgaatgaaatacattttttttaaataataagacttgaggccaggcgcagtggctcacacctgtaatcccagcactttgggaggtcaaggcaggtggatcatctgaggtcaggagttcaagaccagcctgaccaacatgttgaaatgccatctctgctaaaaatataaaaattagccaggcgtggtggcgggcccctgtaatcccagctactcaggaggctgaggcaggagaatcgcttgaacctgggaggcagaggttgtagtgagccaagatcgcgtcattgcactccagcctgggcaacagagcgaaactccaactcaaataataataagacttgaaagttgaaatgactccttgatgcatgggctgcctgatggatgtcgtgtgagcagccatgaaaacaacattcgtctcctgcgagtctccagcagagctcttgggtgaccaggtcatgtcaatgagcagtcatattttgaaaggaaccttttttttcccaagcaataggtctcatagtgggcttaaaacattcagccaattgtgctgtaaacagatgtgctgtcatccaggctttgttgttccattttcagaacacagacagtcgactttgcataattcttaagggccctaggatttcaggaatggtaaatgagcactggcttcaacttaaagtcaccagctgccttcactcctaacaagagaggcagcctgtcctttgaagctttgaggccaggcatcgacttctcctctctagctatgaaagtcctagatggcatcttcttccaatggaaggctgtgtcttctacgttgaaaatctgttgtttagtgttagccaccttcgtcaagatctgaactagaccttctagagaactcgctgcagcttctccgtcagcacttgccgcttcaccttgcatttctgttatggagacggctgctttactaaaacctcatgaaccaacttctgccagctccaaacttcttctgcagcctcctcgcctctctcagccttcacagaggtgaagggagtcagggccttgctccggatgaggctttggcttaaaggagtgttgtctggttcaatcttcatcccggccactcactctctccacaccgtcactgaggctgctctgctgattctccttcctgtgttcgctggagcagcgattttcctttccctcaggagctttctctttgcattcactgcttggtgatttagtataaggggcctcgccctcaccctgtctcggctctgacgtgccttcttcactaaactcagtcatttctaggttctcattgaaagagatgtgcaacccctcctttcacttgaacacttaggggcccgtagagttagtaattggcctaatttccatattattgtgtctcggaagagagaggccacaggagagacagacatgggaatggccggtgggctgagcagtcagacgcacacacctactgattaagttcactgtcttacatgggtgatgttcgtggtgccccagagcagttgtgatagtcacaccgtagctcactgatcacagatcaccatacagatataataatagtgaagaagtttgaaatattgggagaattaccaaaatgtgacacagacaccaagtgaacacgtgctgttggaaaagtggcgctgatagacttgcttgatgcagggttgccaaaagccttcactgtaaaaaacagaagatcagcaaagtgcagcagagcagagtgagggctgcagcccgggtgcgcggtgggcggcggcctgcgggtgtggtgggcgtcccgggtgcgcggtgggcggcggcccgggggtgtggtgggcggtgtcccgggtgcacggtgggcgtcccgggtgcgcggtgggcggtgtcccgggtgcgcggtgggcggtgtcccgggtgcgcggtgggcggcgtcccgggtgcgcggtgggcggcgtcccgggtgcgcggtgggtggcggcccgggtgcgcggtgggcggtggcctgggtgcgcggtgggcggcaccatccaggcttgctgcgatgttggcaagaggacgaggtctcctcaccatgcatgtctcagaacatacctctgtcgttacgtggtgcatgactgtttttgtaaaatttttattgtagtatttgtacaattaagtgtgacatcctgagcaattttcttttctttttttttttttttttttgagacggggtcttactttgccacccaggctggagtgcagtggtgtgatcttggctcactgcagcctcaagcccctgggcccaagcagtcctcccacctcagtcctcaagtagctgggactacaggtgcgcaccaccatgcccagctaattttttatactttttgtagagataagagtttcgccatgttgcccaggctggtctcaaactcctgagctcaagccatccacctgcctcaacctcccaaagtgttaggattacaggcgtgaaccattatgcccggcctcaattttcctagtcactaaaatctatttgaaaatggaagagggaggagcctgtcagggtcaggggtggagggagctgggccctggggccaccctccctggtgaggcagctccagccctttgctgaggattgcagagcatccacagagcatctgctggactaacccgggagggtggtctcagggtcagcaggggcaggagtgggaatggccacagtccaggacagtgacctgccggccagcatcaccccaggggagtgcccagctcaggggtggctggccccttggcaggaggacgcacgccccaaggagcactgtcaggaggagaggaacatgcagcctggagtgtcggggcctgggacttccagggcctgcagatatcaaaatagtgttcacatataggtcgaccacaggctgagtggagcgggggctaatcaacaacccgcccctggcccgctgcgggcccagcagagcattcccactacagccagctccagggatcccggcaaaagcatctttgataagaggccccattccttcctgccctcccacctgaaggaggaagcgagcagggttttcttaggagaaaaagggcccagacccctctgagccccgtggaggttggtatgagcaggtgcagcaccacctgagccccaccttgattcctccgggaccccagcccggcagccccctcccctctgagctcattttactgggatccccagcaagggctcagcatttctgaccgagggcttctgagcttccaggttctcacccctgtgtgacactgagaccctgccacatcagatgccactctgagaaggcgactcagggtgctgggggcctggacaacagcagcctccaagtacgtgaagctgcgtgtgccccggcgagttgtgggcacgagggcgtcagcagtgggtgcgagtgttggcagaagctgccagctgcccttcgtcattttctgaaatgaagatgagggcaaatgtaaacttttaaacatttttttaccttgattaattgaagaattagcagcccaaatcaggaccccacaatcaaaataaatctggtcggctgggcgtggtggctcacgcctgtaatcccagcactttgggaggccgaggcaggcagatcatttgaggtcaggagtttgagaccatcctggccaacatggtgaaactgtttctactaaaaatacaaaacttagctgggcgtgctggcagatgcctgtaatcccaggtacttgggaagctgaggcaggagaatcacttgaacccaggaggcggaggttgcagtgagccaagatcgcaccattgcacaccagcctgggccacagaatgagactccgtctcaaaaaagtaataaataaataaatctggtctataaaatcctaacatctggatgtgaaccgatagccccaaaaggcggcttctagagcacagctggccccaaggctgtgagtgtctgagagttgtcgtcatggcgtgtggttctgaggctggcgtggggcacggcggggctgtgcctgggtacaggtcgtggctgcaggaggggccggggcttgttctgcagctccgtggtttgagtgcctcacaacagaggagctggacctggcctgtgagccaggcctggtgggtgtctcctgctgctggagattccggcctggctgagagtgctgggctcctccttggtcccccacagacactggtccctgggcattggctcctgtgggttgggcagccggcttcacacactgctttgctgctgctgagctcttgggtgggtggagggtggaggcagggttggagcagggggccaggatcttcctgggtggcactgcatggacagcagtcgtgcctgagatcaggagggccgcggacacccctgtctgtccatctcagtccctcgtgactgtgcctggcactggcctctccagcacagcccagtgccctctgcttatggcccgttcgtgaaagctcccacgtgttcctctcgtctgtccgcctggctcctgtgtcctcctctcgtatctgtcccctctccccagtggccacgtttcctgtccactggatgctccctgccctgtggctgccctgctgagggtcccccttgctgtcactgagagagaaagcccttcagaaaccccagcccacacatcagggcaccggggctccttcccgtcgtgctgctttctagaaccgtgcccctggcctgcaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacgggtgagtgtggtgccagcccgctcctgcccctgctgtggggaggccctgccttccagccatggcacatcgggtggcagaaactgtccagcctggcttaaggagttgggggtccggagcacgtgtcagttgctctcctgtctggaagccacagcagaggtgcgcgctgttgtagggtccgggctgccacaggtccctgttctgcccccgtggctgcagctccttggtcaagaggcctgagtcctgagtgtcctcaaaaaggaggtgtggggtcgcactgtgatgcccttgctggtctgggtgcagggcccgccatgggcaggtgccacagctgccgccaccccagtggggtcaccagggcctcccctactcctcaggcgggggagacccagtcggtgcaaatccaggctgaaatgccagctggcaggaggggccgtggaggccggagcagttcatgtggccccctttgccctccctgcccctccccacttcctgccaaccccgacctggaccgttgccagtggacttgggggactcgggggctcggggccacggcacctgtgtctggagcccctctgtcctgcatggatccacctcctcgctgcccccactctgtgtccagggaagcctgggggtggtcactgcctggtttcccgggtggaatctcacggcaccctcccttctgtctgttcattccgcagataactactccgaggaggagtatgagagcttctcctccgagcaggaggccagtgacgacgccgtgcaggggcaggtgacctggggccggggctccgcgccctctcctggctcacaccgggtgtcctggggtctgtggggtcctcaccagctgtcaccagggcctcgtgagggtgggtgagccacgggcctggcccctggttggccgcccatctctcgtctcccgaccccaggggcccgagtttatgctcaggtggctctgagagtcttgggacacaggtgggctctcagtgccgggcctctcccatcgcccacgctgaggctggcagggtcctgccagcactatgcaggctgccgtggcctcagccactgcatatgtctctgcaggacttggacgaggacgactttgacgtggggaagccgaagaagcagcggagatcgattgtaagaacgacgtccatgaccagggttggtggagactgcttctatgaatgctggggaaggcgagggtcggggaggacgctgggagcctgggcgtgggggggacacgggcgtgggaagtgagatctcaccccaggtcacagcagcatgtcccgtggcagaccccctgattgccagtctcctgccgggtgccactgtctcccctgcctcgccacatctcctggctttagccttgtgtggccgctaggctcagtgggccctgagcaaggctgggaggctgcctcgctgccaggctcactccatgtgcagaaactccgggaggccatcctcccttttgtcccgtcaggtgcccacatacacctgagtgggctggttcccccatttttgtttgggatctggcctacctacctccacggtccccaggagcttggcagggctgttcagcattttttccctgaggaaagctcaggcagctctttcctcagaggccgtgtccggcactggcacagagggtccaccgcctggcgcctggacaccccaaggacaggcacggttccagggaggccagcgcaggtgggcggggagctctgtgcctggtgctgacaagggacatgggcacagcccagcccggacaccgccgcctcctctggcagcattcaagggggcgctgtgggcagacggtgccagggacgggcaagctgctcccaaagtggtgaagctgtgtcttgctggcctggagagcagcccccgctgtgcagaacaccagcttgagcctccattccagggcccccttgggcccaactgttgtgaagggagggcgtgggctgcctttgtagggttggtccccgagagggtggctgagggtcccgctcacccagtggctggagccgaggttctgcagtccagggtggcacgaggcacccacggggctcaggctcttggagcacgccccaccccacactcgcccacctgcccaccccacgtgggtgcccagcaccttccttctggggtcggccagggcctttcctgggagggggtgctgagggaagggccccgtgagcctgggaagggctgcagaggcttctggaagaaccatggagtccgcacacgcctccccgggtcccccttggccaggaatggaactgtcagacctcaggcctgttgggaagcctctgggagccacgagcgaatccatcagcgtggctggtgctgaggccttgctgctctcccacggcgggcctgggtgcggcctgggcctgaggaaggggctccagcggcgggtctgcagctctggcggcggctctgactctgcaccgcctgtcttgcagcaacagaacttcaagcagaaagtggtagcgctgctgcggaggttcaaagtgtccgacgaggtgagtgcgccgcgccttctgctcgcggcccccacgcctgcaacagcacctggtcgggaggaggcctctggggtctgtctccgggccacctctggttctgccgctcaccgtctgcacggccccgccagcatcgcacagtctgcgaggcgcagtgacagtggcactgcctcccgggctccaggtcacccgctgggtctctgctgaagtagaagtcgtgaataccctggaagtcggaaagtcattttcagggggatgtaaccattagtttgtgtgtttttttttttataaatagactttagtttttagagcagttttaggtttacagcaaaattgagcagaaagttcagagttcccatggacccctccccacctgacagccccccactattgacatgggccccccctccccacctgacagccccccactactgacattccatggatttttaatgttcatcttttagcttttctctaatctctgaattttctacaatgagcttgtataattttcataccgaaaagaaaaacatggctgggctcagtggctcatgcctgtaatcccagcactttgggaggccaaggcaggcagatcacttgggcccaggagtttgagaccagcctgggcaacatagtgaaaccccatctctacaataaaatacaaaaattagctgtgggtggtggtgtgcacctgtagtcccagctacttgggaggaaacctagtaggccaaggctgcagtgagtggagattgagccactgcacttcagcctgggcaacagagcgagaccctgtctcaaaagaaaaaacttcaaatctcggctcactgcaacctctgcctcccaggttcaacagggtttcaccctgttggccaggctggtcttgaactcctggcctcaagtgatctgcctgcctctgcctcccaaagtggtgggattacaggcgtgagccaccgcgcccagcctttgttgtttctttaacgtcagaagaaaaacgtgcctgggttcaggacctgaagtggagaggtggcgtttaagcgtctcagccttgaagcagggttgtcacccgtcggcctgagagcacactgcctgtagatggcgctgtgtcctaacatactcgggatgcatccagctcagcccctggggcacacactcagcgaggctgtcaggtccatgtgccgaaacaggtgctttgtggcccggtggggcaggcagcatttctgggaacagcgtaacatcaccaactggccgcagaggaagggcagctccgccactgggatggtcatcgggcccctgtgtcttttggtttgcatcttggattggaacattcccaagtgcagctgaagatgggacttagccaagtcggctccctggcctggggcttccttgagccctgctgagcgcctgtgggttcaggggtgggtgttcttggttgaatcttgaccgtggggttctgcactcacctgggcaactgaactgagtcccagaatgcatttcacttacacagattatggttctgagactcacaacccaaactgtgaaaagatgggccaacgtcacagacgctgttcagggagaggacatcgttttcatagggataattgcacagcgttgtgtgaaattcatgcaggtcaacacagtactttaatggagtgatgggatctctttccgtattttccacccatcactccctttcctgaaaagaccagaccatctccgccacagctctgaacctgtgtcttggccactaggagtgccacacctggcactgccccctgcccaggacttcacagcaaccctcagggggcaggagatgcacagtgagacgaggtcaccgcctggattacagccatctgagattgttcatgctgctataacaaaatactttagactgggaaattaataaacaaccaaagtgtatttctcgcagttccggaggctgtgagtccaagatcaaggtgccagtagactcggtgtcttgagggcccgtttcccatagagggcaccttctgtgtgttgtgtggtgagagggcctgacaagctccctcaagcctccctcatcagggccctgagcctattcagcgggcagagctctcgggccctaaccacctgttagaggccccacttcctaattctagcaccttggtggtcaggtttcagtgtaggaattttgggggtacaaacgttcacagcccccaggctgaccacagagcactggcatccaggctgccctgtgcccaggtgccacacagtgggtctggtgaggaggagagcagggctctgcttgggacccatcctgtgaggaggaaccagagtgaagtctgttccttacagccctcagcttcagctcacagcgaaagcgtccgctgagggctgccttctgaatttttcattgtaaaaggtggcacacctggatagtcagttgattttcaacaagggtgccaagttcattggagaaaatatcttttcgcaaaaaaactgaggcttgacaatgcacaccatgtgcagaattcagcttgactggatcatattcctaaatgtaaaagcctaaaatttaaattacctagattctaagccttaaaaaatatgaacttaaatcctgcactaatgccactgaactgtacacctaaaaatagataaaatggtaaatattatgttttatatatttttaacacaataaaaaaagtagaaatttgctttctgaaaggtactgttaaaagaatgaaaagatggccaggtgcggtggctcacgcctgtaatcccagcactttgggaggccgaggcagtacgaggtcaggagatcgagaccatcctggctaacatggtgaaaccccatctctactaaaaatacaaaaaaattagctgggcgtggtggcaggcgactgtagtcccagctacttgggaggcagaggcaggagaatgatgtgaaaccaggaggcagagcttgcagtaagccaagatggggccactgcactccagcctgggtgacagagcgagactccgtctcaaaaaaaaaagaaaaaagccacaggttgacagaaaatatttgcaaataacatacctggtaaagatttgtatccaatagatatattaaaaactttcaaaacccaataagaaaagcaacctgatttttaaaatgagtaagactcatacagtgaaactatgaaacattttttaaagaaagaagatataaataagtggaaagatgtcatatgttcatgaattggaaaacttagtcttgttaaggtggcaataatccctaaattgatgtacaaattcaacaaattcaagtgcgtatcagattcccagctgtgtttttgtagaaattgaccagctaaaatttatgtgtaaatgccagagactcagggcagacagaacagtcttgaagaaagaagacttatacttcccaatttcaaaatgtactacaaaaccacagtagtaatcctgaccatgtggggctggcccagggacaggcatggagatcagtggaatggaggtgatagtccagaagtgaacccttccatttatgggcaagtgatggtcaacaaagatgtcaagatatccatgggggaagaatagtcttcaacaaaggtgctaggaccactggatatccacatgcaaaagaaggaattacagccagctgtggtggcacatgcctgtaaccccagcactctgggaggctgaggcaggcagattgcataagtccacatagtgaaatcgcatctctactaaaaatacaaaaaattggccgggcatggtggtatgcacctgtaatcccagctactcggaaggctgaggtgggagaatcacctgagcccaggaggtggaagctgcagtgagctgagatcatgccattgcactccacctgggcaaccagagtgagaccctgtctcaaaaaaaaaaaaggaatttggacccctacctcacaccatattcaagaattaactaaatggatcagctgggtgcggtggctcacgcctgtaatcccagcactttgggattagtggccgaggcttgaggctcaagtgacccggatcacttgaggtcaggagatcgaaaccagcctggctaacatagtgaaatcccgtctctactaaaaatacaaaaacaattagccaggcatcgtggcgggtgcctgtagtccctgctacctgggaggctgaagtggaagaaacacttgaacctgggaggcagaggttgcagtgagccaacattgcatcattgcactccagcctgggcgacacagcgagactctgtctcaaaaaaaaaaaaaaaaacttgaaatggatcaaatatctccatctgtgagctaagattataaagctcttagaagaaaatgggccaatcttatgaccttgggttaggcaggggtttcttagatgtgacatcaaaagcataagcaacaaaaggtaagtttttctggaccacagcaacattttacagttttgtgcaccaaatagtgccatcaagaaaaccgaacagtagaacagaagaatgttttttgcaaatcatatatgtgataaggggcttgaatccagaacacataaagaatgcttataactgaaaaataaagacacagacagtctagttaaaagctgaactgtccattgctttgagaacgatgcagcctcaggtgccacggagctggggcccgcccactcctgccctgactcgctgctgtccacttgtactgagaagtcgaccaggaagccgcctcgtggccacggcttttaaagacaccgggaggacacctctggagcccgtggagtgattccttgaattagaattaccctgaccagctgcaatgtaaaatccctggaggtgtgtgctggcttatgaggggcacggagaaaaacaatctcaaagtgaaagaaccagttctgatgcctgccaagtctttgagaatcactaagagaaacacaccttgtggtgaaggttctcagacacaggatcacttccagacgagaatccataagcagctcgtggacctgcctggtccatcctggattgtgaggctgattgctctgttggaattgagctgcgagccgcggttgacatcaccattgcagatgcttaagccaagtgttttaataaagtgattatcacttgtcagaaccaggcacagtggctcacacctgtaatcccagcactttgggggctgacgtgggaggatcacttgagcccaggaggtcgaggctgcagtgaactatgattgtgccactgcgctctaccctgggcaacaaagcaagaccctttctcaaagacaaagaacagtgaattgtccaattaaaaaatgggcagggggctgggtgtggtcgctcacacctgtaatcccagaactttgggaggccgaggcgggtggattacaaggtcaagagatcaagaccatcctggctaacacggtgaaaccccatctctactaaaaatacaaaaagtagccgggcgtggtgatgggcgcctgtagtcccagctactcaggaggctgaggccggagaatggcgtgaacccgggaggcggagcttgcagtgagccgagatcgtgccactgcactccagcctgggcaacagacagtgcgagactccatctcaaaaaaaaaaaaaaaaaaaaaatagggatctttctaaatagatttcttcaaagacacacaagtagccaataagtacacgatcatcatgatcattatcactggtcattagggaaatgtaaaccaaaccacaatgagacactacttgatccccactaggatggctggaacaaatgaaatgcaacagggtgaggtgtaacagcaggaacccacaccctgctgggggaatgtaaggtggtgtggcagccacaggaagcagttgccagacacccagcacccctgttcttcagtgttgacttcagggaggtgaacacacacatgcatggacccactcagacgttcacagcagcttcatctgtgatggtcataatgcccgtcagctggtgatctgttagactggggtccacccactcagtggcgcactgcagaaccatcagaggaagtgaataaaggaaagaggtttagttgactcacagttcagcatggctggggaggcctcaggaagctgccaatcatggcagaaggggaagcaggcaccttctttatggggcagcaggtcggagtgggtgcctgcaggggaaatacaagatgcttataaaaccatcagatctcttaagatgtgctcattatcatgagaacagcgtggaggaaaccacccccaggatccagttacctccacttgtcctgcccttggcacgtggggcttatggggattacaattcaaggtgagacttgggtggggacacagtggaacatgaagtgtgccacgctgggtggatgacgccctcctccccccgccaccgagagctgcaggccacatgattccttttgggtagcactcgggaaagggcagaatgtacaggaacagagtgagattcgcagggcctggggctgagggaggggacgcactagaggaaggcaaaggggagcctcctgggtgtggggagcactttctgtcttggttttggtggtggctgcacagtggcccacacccgtcagagctcacctgcctgcacccaggccctccgtgcaccctggcagcccagatgactgcaccagcccaggggaggtggaggaatgccacacgcaccggtacctggggaccgggggtcctcggtgatcatcccgagctccaagacagaagctggactacagccgtgctgagtggaggggtttggtggctgggtgcccgcctcctattgctcctgcagactctggggtctcgggcgcccccagtggggcaatgtgggctgctgcagggaactcacgcgtgcctggcacccgtgcaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggtgagccctacagggcggggcggggaggaacagccatttcagatgccccggccactctgcgaccactctggcagacccatgtccagccctggagacggggtgggcagggccagctgcctcgaagcctgggaaggctctggtggctggaaggaggggtgtgcggctgcctggcaggcccaggctacggctgcactgagccaggcagctttcctttcataggccagggggtgcaagctctgggctggggaggaccgagaggggtcccccagggtgctggctgggctgggtgtggcaccccgttgtaggggatccgtctctgggggatgccctgggaactgcaggggacctccgttcactcaggtggggagtagagctcccatgctgggtgcccctccctgaggaggaggaggcagaggcaggtggggagggggagggcaggtgtctctgtggctggatgggaggaggggctggctggggtggcctggcctgggcaggaggagaggatgcagggcaggcagctctgtgcatgggtctgggtatggaggcctcggtcagctgggggcaggaaggcaagcacaccaggcagaaggcaggtgccagcctctgggcagctgctgaggagccagaggccccagtcagagtcaggaagcttggtagaccttttgctctcacacttttttaacctaaacaacacgaagaaggtggccttgctgcatgttggaggcgcggccccagttagccctgcagccacgcagcggcctcccacctcacctgccccggcctggcagccccagcccaacttgctgctccttcagttgccagcagccaccataacaggtgaccgcggatgtggccaccagaaacagcctctgttcctcctgttctggagattgccatcccgaggctgtggcctcattcttggccagggtctcgctgggctcgggtggaggtattggtggctgccctgactggggctccgaggtcatgcagtgcaggcccagcgtggtggttggtggagttcagctccgtgtggctgcgggatgggggtctggctgccctgccgcctggtggccgttggtcattcttgccttctggcaaccgtcctcgtaccctggcccagggtccctcctccaccttcggaaccagcaaggcccagtgaagtccccctcacactttgggcctccctggccttcctgcctcatctcttctgccttcagccggagaaagttttctgtctttaacggctcacgtgattccataggagacatctttgtggcccagatcctctcccatcttaaactccgtggtgttggctgtatctgcagagccctggccagctagcattcatagtttgaggagaggcgtgtgcgtctcggggctatgatcttgaatgggcacacacagcagcaagtttccacgtgggtttgtcacccagggtggagcagcagacactgctaagtcccgtctgtttttttagggggcgggggagttgtttgtttcttgagataaggccttgctctgtcagccaggctagagtgtagttgtgcagtcgtggctcactgcagcctcaaccacctgggcccaagcggttctcccacctcagcctcctcagtagctgagaccaatggcgtgcgccaccacacccagctaatttttatatttttgtagagacagggtctccctatgtttcccaggctggtctcgaactgagctcaagcgaaccacctgccttggccacccaaagtgctgacactacaggtgtgagccagtgcacctggcctcctgtcaaatttttttcacttgaaaggtcttttaagtcttattgaatctgtaggtctcccttcctcctttttcttcgtacatattatatcaaccagggatgagacattcggcctggatggcctggatcggccagatggtctgcaagggtctggtttgtctggaaaggcatgggtggcctggatcagcctggatcagcctgggtggtctggaaaggcatggatggcctggatctgcctgagtggtccggaaaggcatgggtggcctggatcagcctggatcagcctgggtggtccggaaaggcatggatggtctggataggcctggatggtcgggaagggcctgggtggtccggaaaggcatggatggcctggatctgcctgagtggtctggaaaggcctggatggtctggatttgcctgagtggtctggaaaggcatgggtggcctgcatcagtgtggatagtgtggaaaggcctgggtggtccggaaaggcctggatagtctggataggcctggatggtttggaaggacctggatgggcctgggtggtctgatctgcctggtgggtccggaagggcctgcttcatctgatgtgcccttgttgttttgtcgagcatgttcacctgtttgctgcaggctggctgcagatcccagggctgccctccagcaggattggccagtggagctctccccagagccccttcgtgtttgtggcagccttgcctggagctaaggctgcgagtttcaggggtgtgtgtttcctgcagctgatgtcagggcaggtggaagaaccaggacggggcagccaggttggcccagcgcttagtgttgccagctccagaatcattctgtgccctgtgctgcagctggtgcgagcggggtgtgcgctgacacgggctcttctctggacccagctctgctctgccgttggattctgcagtctgtccctccaggtgtggtgggagaactgcgctttcagtgcaagaagggtcctggaaattaacgtgtcccccacccctgttccctgagccaggccatactttgaaggcctgtcgcactcgagctcgcagacggagattgggagcatccacagcgcccgcagccacaaggagcccccaagcccggtgagtggggccacactgatctcccagagcagaccgtggtctgactgggctgtggtgtggcccaaatctcccagcatgtcctgggcccagggccctgtccagctgtcctggagccactctgcacccactgtccagcacactgccacgcaggtaccccgggcctccctgagtcccagcattcccagtccagaagtcagcgccttggcacctgcagttgagcacaagctgattcccatctcctcccccacaggctgacgtgcccgagaagacgcggtccctgggaggcaggcagccgagcgacagtgtctctgacacggtggccctcgtaagcaggcttgggccgcacccacccgttccacacatcaggcacaccaatgctgcctttaagggtctgacctggaggggcggggcccacatataggtcctcatgtcacacctggtgtgcagaggtggggtcagccctcaggggtggccaggctgccagatggtcagagtatcccaaaattcactccagcttcagggtcagggcgccctggactcaccccaccctcagggtcagggcagctggactccccccacccgcagggtccggatgccctggactccccccaccctcagggtcagggcagctggactccccccaccctcagggtcagggcagctggactcaccccaccctcagggtcagggcccctggactcaccccaccctcagggtctgggttccccagactcaccctaccttcagggtcagggcgcctggactcaccccacccgcagggtcagggcccccggactccccccaccctcaggtggatggcacccaggaacgcctggttcccccctgctgcgttgcatggggtctcctcagttaggaggtcctgggcccagggcaagtcaggtcctgggaggttgggggctggtcaccctgcatggcccggatgggagccctgtgcttggaatttggctcagctaggctccctggtcagcgtatggccgggtccacatgtaggagccacggcctagagaggcctaaaccctcacccgagccagaggccacagggctggagaggccgcagcacgggtgtggtttccacgggaggctccaggcccgtctctgctcagcagggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtgatgggggctgcacggcggggcggggcggtgatgcacctgtcgggggaggggccgtcacgggcatcagtcggggtgggtgcgtgtcagtccatcctgatgagctccctcgggtgtagacagcagattcagggcctcgtccttcttaaaaaggagaagcaaaccccctggcccggcattgggtgtcaagcctgcagccccagattccaccctacctgtttgagggcagggtcaggcgggtctgccctccagcaggtgcccccacatccccctgagtagcccctgcctcagccaaaagacacacatacaccagcttgattcttccaggatttcaatttcatgtttctgtgatatttgggactttttccaaagcagcgagtctgggcactggtttttaccttgtggtggcacgcaggtgcctgtgtccgcgctttggagccaggtcgccctggcagcctcagtgccctgcactggcctgcacctggctctgcccagctcttggcccgggcagggagggtgagctcagtcctcacggtggctccaagcctcctggcctggctcgaagtctcacaggcagagctgtgtggggtcccatcggaggcacggcctcacttgtactcagctgctgctgtggccctcccagggctggtgacctctctgtgcagcccatgttcccactgcccatcagtcagccctgtgctcacccttccctgtccccaccacaatgtgtaggccactgcaggcctgcccctgcctctgcccctgttcctgttcctgctgccacagccacttagcctgtcctggtccccaataggtccgaggggaagcaggctggccgacggggccggagcacatccttgaaggagcggcaggcagcacggccccagaatgagcgggccaacagcctggacaacgagcgctgcccggacgcccggagccagctacaggtgcagctgcaggtgggggtggagggcgtggcacgcccaggaggcagggctcgtggtcaccctggcaccaaccagagcagggcaaaaagagaagcacagggggccaagggtgctgggccacagagcatgcctgggctttggagggctcctgctacacagcagggcgggcgggccatgggttggtttgtcaggaagaccatgtggaccccagggcaagttctagtccttctgctgccctccctggtccagggcagcctcattgcttggctgatttagcccagggcagttctccaagctggccagctctcttcctgccaccgagcctctgtggctgcagggggagcaggggcactgcaggcaccagggctggcgtggtggggatgggcgctgtgcttctcttctgggtgtggacagggctctgtgcctccagatccccaggaagactgtgtatgaccagctcaaccacatcctcatctccgatgaccagcttcccgaaaacatcatccttgtcaacacctcggactggcaggggcaggtagaggggcagtctcttggagtggagggtcagggtgtaggacagaggagagtgggttcctgaagctgccccctacccggcacacctgggtgctggagctgctggctgtggtttgcctggacgtgcctggggtctctggagcccctgagagctttggtgagggtcaggtgctgggggtggcctgggcggctgtgccgaagtcagcgtctgcctgtcttctgccagttcctctccgacgtcctgcagaggcacacgctccccgtggtgtgcacgtgctctcctgcggacgtccaggcggccttcagcaccatcgtctcacggatacagagatagtgagttgggctccaccctgtactcaccacccaagtacccctcggggtccctgcacccccacctctgcccattgctccggggctaggtgcgtcctggacctggggctgtggctggtgtccacagaggctgacccatgcgctcttcgcagcctggcctcccctcagttgtgggcgggagcagcagcctggtgggtgtcctgccacactggagtggtggcctcctggcctgtccttggaagcctgggctgaggccatgactgtgtggtccctcagcctgggcacgtttgggcatgtgggggtcctgggcttgggcagctccagggcagttgtggcatgagcggccacaggcacggagccccctgggctcacactggcatccttggatggaggacggctcccctgaggcgtctgtcccctctccgtcccacctgcctctggattgcagctgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggtgagcaccacgccgtccacctgggcctgggcacagatgccacgggcagtgtggcgtggcatggagtggtgtggcgtggcgtggcgtgttgtgtggcgtggcgtggcgcggtgtgtcgtggtgtggcgcggtgtggcatggcgtggtgtccctgcttgctacacatttgttgtttttaaatgtttgtttgatacagtaacactttgttaattttaattatatgcaagataacttgattgccctaaaacagccatttgggtcaagataaagccatcgccctctgaaggggcctgagctgggtgtctcctccatcagtcgctgtgataactctatgccagtttcgatttccaaagtcagaagtgcaaagcagggctcgttattaatcctctcaaatcgtccaggtcctgtgtcgtcgaactccattacttctttaggtccatacgatgtgtcttaccacgaaacaaacccacccagccttaatctgttgaccagcagcaaggcctggaggcgacacctctcccgtgtggccctcacgatgccgacgtcagagccctgagccagccgaggcctctgcacggtcacatgtgccctgctgggccttcctcagtggcactcagggctctgggacctcagctcagggctggagctccttcagcggggccacaggcatccaccagggaggggcagtggtggctttctctttcggtggcaggaaagtgggcttgtctggaaggcagcagcacaggcctggggtcgggtggcccagcttttgtgccgcggtgggagccttgcagctccgagtcccccgtggtgacaccagccccacccctggcatgcaggctcccaccccgtggccaggtacctaggctccgtggactaccgctacaacaacttcttccaggacctggcctggagagacctgttcaacaagctggaggcccagagtgcgggtgaggcccgggcgcgtccacagcccacgccacggcgggaggaaggggccccggtttccccagatgctgtgcccaggaggccctgcacctgctcaggctcagcctcagggaagaggccatggacagggcctgctggggccttggccaggatgcctcctattcccctgagccttggaatgttggaagctgtggggcctgtctgggaaggggcgggcacagcccttcaggtcttcccacgcttgccctggtactgcctcgagagtagagcaccagggcccctcagctgcaaccagcgagccctgccgcgcttcggggtacgggaggcctgggcggggcaccggggaggcccagcttagccccgcctgcaaccccacctggcaccagcctaaccccccaccgcctcctccccctgcagtacaggacacgccagacattgtgtcacgcatcacgcagtacatcgcaggggccaactgtgcccaccagctccccatcgcagaggccatgctgacctacaagcagaagaggtaacgcggtgggcccaggcaccataccacaggctgccgccagccaccaaccctccgtgggcctccccacccgctgctgggcttggcctggtgggccgcagagccctgcaccgggcttagaccagagcctgggccagctgggcagctctgggcctccctgacagcaggtgcttccccgcaccccagatccctcatagtaagcgccatttccgcacctgtttctgtgcatgttgaaaccccgcgtgataagaagttgacagaatggatagctgtcatggggccagggtggcagtggcccagcccctccagtctgggcacctgttccttccacagcctgggtttctcgggctggggaacgaaggattccctgggcctcgggccctgtgggtgagtgatcagctcgtgtcctcacctgcccagagcaggacggtgctcaggagcccccggccgaaagtcctgcggagacctgtctgtcccgcccggcgcctcctccctgcacatctggcgccactgtcccacaccttccctagactacaggggagagagccgagtgcaaggcgcaaagccagcgctcacgggctctcccacgcaggagccccagtgagatgggagccactgagtgccctcggcggtccctggaggggtcctgagggcgtcgtaacgtgtctgttttctcttttggtggctttctgaaaaggaaaaagcattttcattttgactttaccctaaggtacggctctgtgggtctgcctcccaccctgtctgtccccaggctggtcttcagggcttgtttggcagagtcacgtaggaatcaccccgctgtcctctctccggactgggagtcaggccctgagggccaccagctgcaggctgagagcccgcacgggagaggggaagtggccccaacccgagtcactttttgctgacgtggacccttttcctccatccgatctctgacactgagtcaggagagcagcagatgggccctcctgtccctggccaggcccgtgtgctgggactccaccccagagccctgaagcctgcaggtcggccaggcaggcctttccccggctctgttttgaccctgggttttgatttaagaagtggccaggtttagcccctcctcgttttaaaccaggagcgagtggctggtgtggacaccaggatcacctgggccaggctgtttcccaggcccttcacgtttgtgaagctggcagcagcctagcaggggcacgggtgcacgccctacacacggggacgcccaagcaagtagttaaggagctggcctggtgacacggtggtcagcggctgtgccttgggccccctacacactgcagagcctggctcccagggctccctcgagcacctggggccagcagagaggggtttccagcatcttgtggcttacctggagacggggccaaactaccgagacctccaaatgggggtaaagagttttcattccgaggcagctccaccccctacaacctttcatgttcagagccaagtcccaggcacccccaaagctgccctttcagacagagccaccccttttccttggccaggtgtgtcctgctgcagggtgggggcccctgctggtcctcccatgggctcgttctctaccccgtgtcttctgccctgtgtgaggtcatttgctgtcctaggaaacccccccaaccccctgacctcagtgcagggtagttgggtccctggggcccccttgctggcctaggagctgctcgaagtgggcagcctgggaccacccacagctgtagggctgggcgctgggaagacacaggaagggggctgaacatcctatgtcttgtcctgctaaacaagccttcacaggtgaaagaccagccgtgggggcctcccctgctgacccccagcagcctccgcccttgccccctggctgtggcacgaggagcctgcagcatgttctggccgcccggccgccgcaggccgtggacgcagctgcttgtatctcccaggtcagctcttccaagcagcaagccagggccttagggggccttacacccactcccaccctgcacctcctgcccctgcctccgtgttgcaggggtgacactggctgcctccacgttataagggtgacactggctgcctggggtcctggaaggaacccagcaaaggccataagtgtcttacctgctctctgtacccagaggagggtcagtcgggaggctgagagagtgcaggcggtggcacagcccttgtgacgggggacctgtgcagagccctctccagccaggctcccctgcgagagtccctcgtgaggtgactcctgctggcccgccctcctctgccgagaatggcactcctcctatgagggcaggccaggcctggagggcggcctcgagccccagcctgcccgtgcagcgcatgggtggaaagggctgctcaggcatccggcagcttgcccagggccatgcggagtggcccccaaggcatctgtgccctccgtgcccgcggggcctccccacgccacggtggtatgctccttacactcctgaccacactgcctccacagacatgtgtgtgcctccagggtcaggatgagggtctcagtgtccagccggtgtcacccctgtcatattggcccatgtccagggctgggtgctgtctgcatggcccagaggcgcagcttggctttgagagttccagcaacatccctgtgttgtgacgtctcctgcattcggccctcatctgccacgcactgccccatgggcctcggagcagagcatggatgggaggccagcctgccatggctggctcggtgggggggtctggctcggcagagggcaggtggccctgggaattggagccacccatgccctggggaccagcagccaccacctgtcttctgtgccttcgcgtgcctgggaggacacagatgtcacagatttccaaacactggtctgctcaacaaggatagtgggatgtcaaaggccacgtccaggcactcctgcctgacagctgtggacacagccagggtgctggggggccaggaggccgccctgaggcagaggtgggcctcaacacaggatttgcatcgctttatgttatttgaaatggacaagaagaggggaaagtttcaactcttctccttagaaatggaactaggcctggggcatctttaatgggatgggaggaatctgtaggtggtttcatccagaggcatttgccaggtcttctgcagagggtgggccaggagccgtccaggttggcgtctggggagggtgggtcttgccagccgccgtctcctcacactggcgctgcgaagacagggaaggcacctgctgggaccagccgcagaggctgcctcctgggagtgtgctctggaccggctgccgggcagaggctgttttacttgtgggcacactttgtggggagcactgggatcaagcctctgccctgcagggctcttgaggagatagcgctgctggtcctgggagctggtgctccaggcagacggctgggctgggcctgtggcatcctccgctgggcctgtttcctgcaagggattctctctgaatgaccctgtgctggacgacaacccaagggagggccggggccactgtgcgagcccatgttctgcacctggtgccgggctgtccctgagggccaccctgctggcctggccattctcgtcctgcccccggcgctccaggggcaacaggtgctcctctgcactgtgtgtgcacagtctccgcctgtaagacagccacttgccggcatcagactctgcagtttggggaaatgagacagaagaaacagctgagggagctgcccagagagaaggcaccagttgctgatgcggtctggctgaggaagctgggcggggaggcacctctgtccctacgtgcaggccacggggggccttgaggccaggggagaggaggaaagaggagagccagacccagcccaccactcaggataggccctgccctctggatctttcctggggcccagaaggagatgccctcacctcaccctagctgccggcggggcctcatgctgtgctggccccttgtcttgtgggagagctccctgggcccaagcccaggctgcagtgggcacagtcagcaggagcctgtgcgagctggaccacaggacagccctgcttgagctgcacacgtcggaggggaagacagacgggtcccctcagcggccccgcggctcctgtcctccacccttggcatcttcgtgtggacgggctgtgaccagacttccaggagaggctgctgttacctgccagatgttgtatggggccaagtccaggcaaaacctccactgcccgctgagtacatcagctcacgcggggcacggcctggggtgtgctgggcctgcctgcaggctgtgcgtggggtgttctggtagaacatggaggcccactgcagccaaagcctggcctcttatgtgggcatggacgttacccagatagtctggagaaaacttctgcaccctggctttggtgctgctgattaccagagagggcccaggctcttcctgggagtcccagggcactggcagctgccctaaccccagcagagcaggggtgcccagcttggtggggaagtggaaatgcaagccggacagggctgagctggctgtgtgggcgtcgggcacctaggatggcagagtgaatccctccgtggagctgtgccctctggcctgtcctcctgaccatgggtgcacagagacccctttgtccttccagcatgtcagcatgtcagaaggggcccaggcgttggtcctgggggccaggccagggctggcagtggttggagatgggtggggccgggacacacagggcagggctgtccggcagggccatccggcagggccgcggccccagggctgcgccaggttctcaggccaagagggagctgtgcccaccaggcggggctgtgccctgaggagagcttaactgtctgtttccttgctcttagccctgacgaagagtcctcccaaaagttcattccctttgtcggggtgagtactggccagctttatgtgatgggaaaccgcacacctgccaacttgtcgtttacagtcagaacgtttggggattgactcgatatattccagaaccttcccacagatacgagctggggatttgccttcccatctggcctgtctcaaagctcgcttccttccctgctggagtggggtgtggggccagaggttgttagttccccttagctctgccttgggggctgataaatggaagcagagacaggtcggtggggcgaggcctcagaacacccaggaggcttggccccacgtctcaggagaggagagactgcctgcccgggttggggagggcgcctctgtcctttaggagcccaaggccccgggagcttcccagtgctcacttgggctgcagcctgcagtgtgtgggtttcacttcctgccctgcccagggttagggctgcttctgccagccaggccatctccctgccagccctgggtctccacagcctgtttcctgccatcttttcgctctgttgtgtggcctccctcccgccaggtgtctgctgtgagacagacccacagggcctggcagacaggttgcccaggcagcggaagggtctctgggcctcggtttccccactggtggaacagaggcctttttgtgcaccgtgcagtggttgggtctgctgagggctctggggcgatggctggccctctgggagggtggaattcgtcttgaacagcggctgcccaaagagctttctccggtgacaagagtacactgtgctcgggcacacaggccttcccatgcaaccaaggccctgcggtgtcactgggattcacggtagatctacgtagccgcctgtggctcgtggctgccaggtccggggcctatccccgtcggcccgccaaggtccctctcaccagcgtcctgtttttactgcacacatagtttgcagctgccctgagggccgactttagagagagcagtccctcctgctgaggccacgcaccctgagcactgtctgtccccacatggctgctctgagctcagctctgctccacagatggggagagaagggcaggagggagctggcaccacctggccgctccagcatcatgggagtggtggccacggtggggaggcgggagccccactgggagggcgctgggctagctgaattgcacggctttcaccagccagtgcctgttgttttctaggttgtgaaggttggaattgtggagccatcctcggccacatcaggtaaccccgtcccaccctgaggccttgtgagtggcccgtgggtgggctgcaggagcacggtcattcgagtcctgcagaccagatcaacctttcagggcctgagagccgccacgtcccagtcttgctgtggtgcttctgtcctgcggggggttcatcctccaaggactgctgtcacaaagccccacatcaaggctggcagggttgtcttccaaaaaccgaggagaatccgagaccctcccgtctctcacaggccactggggactcccaccctgcccacccccaggagctgcctggcctggccacatcctggtccggagggcctggtggcacccgggcagagcagcaggtgggctcagcctgccctgtgactcctccccaaaggcgactcggacgacgcggccccctcgggctctggcacgctctcctccaccccgccgtccgcatctcctgcggccaaggaggcctcacccaccccgccctcctccccgtcggtgagcggaggcctgtcctcccccaggtaaaggtgcctcacggctcagcacgtttcacttacccgccccaccacatgctgcctgattcagtcatcctcccctatgtcacatccacctcccagggcacctggcctgtcagccacgaaggcggaggggctctgcaggacggctgggtcctctctggccacctcctgccacagatctggtgtttgggggcaggacctctgggggacagaaactcctgcacagtgaataaacatgggcgttgtgctgggctgtctctcagctctgtacacagttggggcttttaaaaaacaagctgagggcagaaggtgcaagagacgtgagtctctagacggtcctcatgggatgagcttcgatagctgtgctgaggccccgctagcccgcccgggtctctccggagcagacctcactcaagtggaactaagccatggggggttgtgggccctgaggccaggcgtggtgctggtgctgcgtgcagggctcacaccagcagatacccccccgacccccctgcctctgtgtttccagccgccggctccttccaggctgcgcctgagggagctggttcgcacgggccctcacgactccaaggggcagcttggagagcaggtggacaggcctcccaggccgaggctctcctgtcgccagggtccctgtaatttaagcaggacccttgtgggggtgactgggcatgtgaacagctccacagagcatgctccaagcacccggccctcctctgctggcaagttggcacaggtgctggctgtcacctcctggcctgtcacagggacagtgatgtccccatcactaggcccaaagatgcaggtgtgaatgcctccctctgcctttcccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaagggtgaggtggggcaggctataaggccacacggcgcagaagggcggctctgtgggagagggcggctcgcagtcaacagggatgacagcccccgggctggcctcgggcagcccacatgcgcaggcaggggcgggtggggtgagggagcctgaatcctgagggcagtgagggtcaggtgcttctgaccagagcctcaggcggaggccagctgggtgggcaggagagcagctgtcctcagtcaccgtggaaggcaggtttcctaggtgagcagtgccatgaccagctgagcccccagtgcctcccccacacgtacccctggccctggccccagccccgaaggagcagcaagatgacagcagggcctcttttctcctcccagtgatgtttctgcccaagaaagcgaaggacaaggacgtggagtctaagagccagtgcattgagggcatcagccggctcatctgcactgccaggcagcagcagaacatgctgcggggtgagcaccaccggccccggggtctgtagagtgggacgtaggtgagagcacagcaaggctgctttggagcccagcctaggagctgcgggtgtctcgctgtgacacgcacattccacgattcaaggtgcaagcacattcgatgaagccctcagtgaggctgacaaccttccaaatgctgagaaagaattttttttcaaccctttttgctttttaaaaataatgacttgtttcgtttttcttgtttgttttttgttttggtttttttttttttgagacagagttttgctcttgttacccaggctggagtgcaatggtgtgatctcagctcactgcaacttccatctctcaggttcaagcgattctcctgcctgagcctcccaagtagctgggattacaggcgcgtgccaccacgcccggctaattttttgtatttttagtagagatggggttttaccgtgttggccaggctggtctcaaactcctgacctcaggtgatctgcctgcctcggcctcccaaagtgctgggattatgggcgcgagccaccgcacctggcctaaaaataatggcttgtagtttaaaagtgttggctgagcgcagaggctgaggcaggagaatggcgtgaacccgggtggcggagcttgcagtgagccgagattgcgccactgcactccagcctgggtgacagagcaagactccgcctcaaaaaaaaaaaaaaaaaaaggggttttggagaagatactctgcaagtaactgtttcagaaacggagctctgggaggctttcctctttttgagcacgggtcagatgacctccaggtcgacgtggccctgtctccccacaggggtctctgttttaagggggctcccactgtcttcttcccacacctgtgcaggtggaagtggatgtggacgagcagcgcctggcggaaggtggtggggtctgctccttccacctgcaggcagccctgggggaaatgctgccctccccaccccccagggctctgagtgtggagggcaggggcaggaatggcgtccctcaggagccagcatggccctggagcccccgagtccctgaggaaagtgttgatgccctccagcatggggctccttctcatcctgtacgcccggctgccacccagcctggtgggccaggcaggcaggtggatagggtgggcaggccgggcaggggggcaggcggtcaggcagccctctcccacagtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagcagcagatatttttaatgcttttcaatacatgttctaatgtagctgccaaacatgttgctcttctgaagtccccctggggctgggcagagccagcagagcctgcccccacttccccagcccctgccccaccccgcctcacaccttccccactctcaggctgttcttgaaacaccatgaggcttctgcgtgtagtccctgccccaaacttagcaagcacaggggcctccacagcccaggtggccccagaaaatgttccagagcccagcttggtacatagtgagatgctgctggggttggcctgaggtgggggccacttcctccaccccagtgggtatgtctgaggtcagccatggggatatctgggttgagattcaggttttggtgaatatggggcaggcgtccagatgtgtttgtgtcacctgctgcaacgctgtagccaatgaagattccagcgggatggcctgaccagcggggccggcactttggagccgtgggtgcagccaggtaccccgtgcagggcctgggaggctctccaggccacagtcctcagagcgtgttgggtcccatgttgtgtgtgggttccatgccctccacacagcaggagagggcttccctgaccacacctgccccctcagtcctgcttctccccagtaagcctgcactgtggggtctccataggaggagctggggaagctggggccctcccaggggtcctgatcgaccctgggggctcttggcctggtttcgtaagatggagcactgcaaaaggccatgctcagaaagcaaacgcagggcagggtgggcctcgagccggggctggaggggtctccacccttgctggcctgagagatggcccacatttcttacttgtgaccgccctgctcttcctggccgccccccccaggtggctgaacagggtgattttgttgtggtgaggggccaggatgtggcctggtgtgcagcctcagctccctgggttcaggcctcagaggtagcctgtgtgcaggaggcagagccccagcccctcccagccagagcccctccacaccagggactcctccttcacctgggaccaggagcctggggcacaccccagggtgggggagagggtaggaaggtctcccattgaatcctggcttcaggctctgccccgagaagtgtctgcggtgagggtgtgagccccgggctgatggcctctgaccccggcaacaggtgggaccctgactgactcgttcagctgcccccaagctgggctgcagagcatctgtttttctgctctccagtttcttttctttttttttttttttttttttgagatggagtcttgctctgttgcccaggctggagtgcagtggcatgatctcagctcactgcagcctccgtctcccaggttcaagcagttctcctgcctcagcctcccgagtagctgggattacaggcgtgtgccaccacacctggctattttttttgtatttttagtagagatggggttttgccatgttggccaggctggtcttgaactcctgacctcaagtgatccacccgcctcggcctcccaaagtgctgggattacaggcgtgagtcaccgcgtcctgcctgctcttcctgtttctttcccaagggtcacactcagtagggagatgaaggtggaaacatccttgctgtggctttctggcctcagagcaggttttagaggaaggggccacaggctgcctagtgcatcctggctgtgggcagcccctttcctggagccctcctgcctaccccgtacctcccatctggctgcacagctccatccttagccacgcaaggggagaacatgggcagagtctccatccagcagctgggggttctggtggcactccctgtgcccctgctgctgctgggctgtgggtctgccctgcacccaggagccccacggtccatcccccacaccatgcccagcaccagggaggttgggcagacaagacctgggccatgccagccctctgtgcctcggttttcccactggttacacaggatggtcgcattttccctgcctacctcacagagctgttctgagggtgcatggaggagcactctgtcccaccaaggacaactagaaaccaaagccatctgacagccagtgcggtaagggcgggggatgtgtgtgtgaggtgtgcacaccccccgagaacctggccctggactggcctcacaggacaggaggcagccccttgtagagctagggctcagccccatcagtctcaaaggttaagccaccagtcaccaccgaggcacccctcaggcctggtggccactgtccactattacgtagacagaccccaccctcacccaggccagctgtgggccagtcccgccctgcaatctggtctgctgccttcctcttccatgttggtccccttggccactgtctctgggcatgcaagccagtgtcctggttcagtgcctcggccagagctggggcaggagaggggcctctgggtgagagctgggggtgtctctgcagggtactggcagccttgccacactgtcctcattcccagatggaaagacctgagtgcctctcgccttcctccgggaatgaattcctcatgaaaatgaccaggccacttcttccgagggccaggccgccccctccccgagacctgtcctgccgtccgcgggtgtgtggcctgtaggggactgagagctgggcttgctgggcacctctggaatctgaccctgtgggccaaagaagcaccactgtagtttctgcagacccccatgcggttcattgtgcattgtttggtttctaggatgtatgtgttgctagttttttttaatgaaaccctggattaatgtaaatagctttttggggaacggattctaatgtcacgtatgtgaccgtgtggactatttcaaggtgctgatgcaacactaataaacctggaggggccggcccccgcctgcagtgtgattctctcggccgtccaccccttgggagcacgcggcggagcagcgcctccctcccgcccgcgcgccccgtcctgggtcgccccgccccagccctgcggccccgcgcgcgcggaggtggcccggggctcagcggcatcgcgccgcttgaagggcgcagggccgaaaggggctctggccgacaaaccccaagttcaggtctgtgcttcgggagaccccggaggccgacgcccggaagggcccgtggggcggtagcggccatagacccggatatgcgccggggacccccagaccgcgcccatcccccacccgccgcaacggagcccagaacgcaggcgcggcgcagaccggaagcggaaccggtgggggcggggcttgccgtagcggacgttctggagcgaggcgccggccccttgggccccctcaagccgcggtgtactccagcggccccctgtggcctctccatccgcggcgggtctgtccctccttctgtctccgggtgcccacgtaccccccacctccgaccgccgttcccgtgtaccccgcccccccgccgaaccccagagtgcccacggcctccagcgtgtgtcctgagccttcttcccccgtccctccgcggaccccggccgcgcagaccccgcctccccaccggagagggcgggcacgtaagggctccgggctgggcctggggcgaggcctgggccgcgtggaggggaggtctcagggtcggaagcggggctgtggcaagagctctgggcctttccttcgccccgggcgtagcaaggccgggccctgagagcgtgcccgcagtgctggctgagggctgatgcccctggaacgtttgagaaggctggcagaggcgtggagtccgtgcagcaggctgccgaaggctttccaggctcccggggtggggtcggcaggggcagagaggacagttcgggaggctggtgtggagaagagctgcggcgggagctgggggatccactccacccagaggggtcagtgatgcctgacctttggctggaaggtgaccctagcagaccgcgatactgccaccatctgcccccagggactcaggtattggtgggcacgtgggtggccttgtgggccccgccccacctccccctgctcctacccccagatctcagaggtgtggacaagcagcctactagggctagagatggacagcaggaaactgtccccccgggggaagaagctggagtcgcacctctcccaagagcacaggcggcccccactgggcctgatagcagcctggggccagcccagtatccagagcagcgttcagcagggactgcagactcaggactgggtaagcggaaggaaaccctggccgaggctactctcctgtccccagcccgcctgaggccgctgtctctgaaaactccaggctggtcgtgatgagcagcctcaggggagggctgagtggggactgatgagaaacagatggctggactcaggaggctctcttccccatggccctggacgagcaccaaggtggacctgcacccttcttgcttccagaaccgtgggccgctgggctctgtagagaggtcttccaaggccaggaaggaggcaaggcaacacacttcccttagctctccccagtgcctcccaccccaggctgaaggtggcaagaagcgggagggaaagcaaggtccccagggggggtggtgtcctcccaaccaggtggggcagctgtcaggagaaggatttgtcactgaaagttgaccaaaacaaaatagtgggagaggctctgctgtgattccccaaactggaagcatctcctggtctctctactgctggacagtgagctacaggcttgtgtcaggcccagtagtgagaatggtgggatatagctgttcagccttaggacgttctctgagggcagaggaagccagaaccccactcgtgtggttccacttttggaaggttcaaagccaggctgagagatggctctaggctgtggcgagatgggtgcaggggctcctgggcactggcaatgctttggcagctggcgctggtcatgcggccagttcagtgtggggagctcattgagccatgcacacaggcgtgtctgcgtgtgttcccagggctgcccgctgaggcccctttgtaccctctcagtcatgtccttcaggcccaaatgctttcaaaacccctatgatggtgtcaggtgctggggagtggggtgaccaaaccagcagatgcagtggcttttgggaggcgaacatctcatgacaggcaatccggactataaatacacataggtcacctgtctagtgagggccgctcaggaggagggccagggggtgtgaggcttctgtcctgcacagggctggggacagggcactatgtctgaaggggtagggatgtggatgcaggaggagtgtgtattggacccatatccagcaaggacacagggacccagtggctcttgggcaggggcagccaggctgtatttgtagttccaagagatggactggtggctatgggtaatggtggttgaggacaaggctgggaggcagaagagtgggctgaaggcctccaagggcaggcgagcagtgggagaattaggttgttggccaagggtggaaagaggtatgggtgcatctctgctgacgggcaggtttttagtttggggacagggaatcttccctaaaaaatgtgggtgcccagatgactttataggtgggcactcccaaacaagaaattagtcatcctcattgatgaagcttcacctgcccagagccacttctgatatggacctggtatcacccaataccagtgccagaagagaacagagggagaaaaggaaaaagagaaaatgatgtgccagtctacctgtgggcatagattgaaaaatcctgagtaagtactagaccaaatccaggagcacctgaaatgcagaatttcatagccgtaaggatgggtcctgcacacttccgcctgccaggagagcaggcacatgtctcttcacagctctgtcccagtgcttaggacagtgtctggcacatagtaggtgctcaatgaatgtatatggaataaatgaagttgtatgtaaataaaagaagattgtaacccaaggacaaaggaattttgaaatctgtaaataaagttcagtaacaacaggtggaaaatcacatgattatctcaatagatgttgaaaagtaatactaataaattccagtatctttccttaagaacaaaagaagtcgcagccataaaaaaggatgagttcatgtcctttgtagggacatggatgaagctggaaaccatcattctcagcaaactatcgcaaggacaaaaaaccagatgctgcatgttctcactcataggtgggaattgaacaatgacaacacttggacacaggaaggggaacatcacacaccggggactcttgtggggtggggggaggggggagggatagcattaggagatacacctaatgctaaatgacgagttaatgggtgcagcacaccaacatggcacatggatacatatgtaacaaacctgcatgttgtgcacatgtaccctagaacttaaaagtataatttaaaaaaaaccgaagtatagaaacctgtaggttctggataagatgggaagagatggacatctccatagcctgacggaggggagctctcaagagcttgcagtggccaccaatggaagtatttcagatgcaagcagatggatgcatggtaccactatgacgtcagaaaaatcgccaggtgcggtggctcatgcctgtaatcccaacaattcaggaggccgaggcaggcggatcacctgaggtcgagagttggagaccatcctggcaaatgggatgaaaccccgtctctattaaaaatacaaaaactagctgggcatggtggtgggtgcctataatcccagctacttgggaggctgaggcaggagaattgcttgaacctgggagttggaggatgcagtgagccgagattccgccaccacactccagcctgggcgacagagggagactgtctcaaaaaagtaaataaacagtattctggaaaccgaagcccttatagtaaatcaagaaaatgagatgtgtaaatatctgaaaagatgacaatcactatttgcatctaatatgttacctacttggaaaatccaatttaagaaacatgagtacagataaaagagggagtttggatatgtgatcaccattcacaacttttcaacacagtaaaaagcagaaaatggaatggaagcaaaggatactattcaacttagcaacaggaactatgaagttcttagaaataaacctgttattggccgggtgtggtggctcacgcctgtaatcccagcactttgggaggctggggcgggcagatcacaaggtctggagatcaagaccatcctggctaacacggtgaaaccccgtctctactaaaaaatacaaaaaaattagccgggcgtggtggcgggcgcctgtagtcccagctactcgggaggctgaggcaggagaatggcgtgaacccgggaggcggagcttgcagtgagacgagattgcgctactgcactccagcctgggcgacagagcgagactccgtctcaaaaaaaaaaaaaaaaaaagagaaacctgttgttcaattccttcatgaagaacactttacaatgttactgaatagcatgtagagctcctgatggagatggttatcatattggatgggcagatttcatatgtgtgtttttgagacagggtcttgctctgtcaccaggctggagtacagtggtatgatcacagtgttactggaaaagggatctccatctggaccccaagagagggtttttggatctcatgcaggaaggagtttgaggcgagctgcagagtgcagtgagaagagatcatttattgaaagccgctccactgcagagcagggcatcctcaacaagcaagcagaggaacagacctactttgtttttagtttttcttatatcgaggtcttatctatgtaaagaccaagctgtgcctacgtgtgggtgggctgacagcataacaatttattattctattgattaaaaggaaactattttacattttagtgtgcaagtacattaaagcatcactataattatcttgaaagcatatattattgtgggtgttgggacatctgaacttccttttctatgagtttgtccttgtaggcattaccaagctgcttccttagctgtaaacatcttaggtccgtggttgtgacctgtaaggaatgtgctctattagtctcaaggtggagttgaacataaaatgatgttatcctggctctcctagactcctgcttctctaatcacagctcactacagcctggacctcctggactccagctatcctcccacctcagcctcccaagtagctgggaccacagtggcatgccaccatgcctagctaattttaaaaaaatttttgcagagatggggtcttactgtgttgcctggtgtggtcttgaactgggctcatgtgatcctccagctttggggtcccaaagtgttaggattataggcatgagccattgcgcccagccagatttaacgttttaaacatgccaagcttcccaaaaacaattcagtgttttttaaaaaaacagacttcatgaatcttgaaaatttcattttaaatgtacatagtgattctggaaatgtattactagtttactttttaaaaaaaattacagacagggtctcactatgttacctaggctggtctctaactcctggccttcctaagagctgggatcacaggcatgagccaccatacccagcctttggcaatgtattggttatccattgctgcatgacaaatttccccagagcttagcaacttaaaacagtaagtatttttatcttagtttccgtaggtcagaaatttgggagctgcttagctggtggctttggtttgagatctctcaggagcttatagttgagatagcagtcaacacttcagtcatctcaaagcttgaggaaggctggagactgcttccacggcagctcactcacatgactggcgagtccatgataggggctggcaggaggctcagctccttaccacgtggatctccccataggacagcttcagtatcctcagtatgggggctggcttcccccagagtgagtgagtggagagagtgagctgaaagctgcaatgacttccatgacttaaccttggaagtcacactcctctctttctacagtatccgttttggatacactggtcatcctatttagtgtgagaggggacgacacaggggcatggataccaggaggtgaggatcattggatgccatcttggaggacagctctcacaggcagtcatttagtctatacgctttaagaaattatgtactgagaagcataatagtgaaattgtagaatgccagcgacaaaaacctcagaagcaatttgagtgggaagacagaaccttcaaagcagccacgggagctcgtcacagtagagcagtagcatgcctgtgctcaggggaagccatgctcagcctggaatagcaggcccagcaaaaatggattatacaaagggctaagtaaagtttttaaatgataaaaaagagaatttgcccccagcacactctcacctcagttctgaagaaatgatctcaaagcatcatgaaagtgatgaaaggtctgaaatggataaagcatgagaggaagtaggaagtgtctgagtaaactgaaactgacagtcactggatgtcactcatgcacagaaaagcaaggatacaatcaatatatgtacctgcaatggcataaatgtcaagatggtgcctgtgagtggaactaaagtgttctcagttcctctgagaagaggaggggggtgggccatggtggctcacacctgtaatcccagcactttgggaggcctaggtgggaggattgcttgagctcagcctggcaacatggcaaaaccccatctctataaaaaaatcacaaaaagttagccaggcatggtggcatgtacctgtagtgccagctacgtggaggctgaggcaggaggatcacttgtgtctgtgaggcggaaactgcagtgagctgagattgcaccaccacactccagcctgggcaacagagccagaccttgactcaaaaaaaaaaaaagatcgagttgcttgtcatctttggagttagatgagtttgcctgccctcacatattacagcagaagaacagaaggagatacgatggcagatagaatcgccggtacgtcatttaattcagtcaatgaaaacggactaagtgttccagttaaaagacagacattgtcagagtgggttgaaaacaaccaaattcagcggtagggttgtgaacgtgtgcagcggtaagcacaggaatattccaaccgcagggtgaagatggacaccaaacggccgtgcatcagttcacattgcatttttctgtcaaacagcaaacttacctcggatttgggaatgtggttgtgtggacgcctgttgcgtgcagccgtgagcgtgagtctcatagacctgttcctgagtgaaagaggcaaaaaggtgacaaaattattcatgccatgtggctttgttcagagttcaaaagcatgcagaagtaaacaagatattgccaatattcattaaagtataatttgaaaaaataaagatgttttaaaatgtttacttggaaaaggaaccatacaacaattttggaaaataagagcaaggcctggcttgtccgcaccagctccaacaactaaaactgtgtggccctgtggcagaaggtggcaaagacaccactgcctggacaagtaacccggaaaccaacctgtgcataaatgtggggatttaatttatgttgagcatggcatttcagagtagtgagaaacagacctttcaataagtggtattggggtgattggctgtatagttagaagacggtagagtgcgggtccgtctctcaaaaaaatgcacacacaaaaaacattaaacccaaaccatgtgagcactgagagagtatatgagagaatatttgggatctggaagtgataagtgcctttcgtaggccaaacacaaaatccttgaaggaaaagcctgacaaatctaactacagagtttttaaacatttctgtgcaatcaaagacacaaaaatgttaaacgacagcctggaagaaaatacttgtaatatttataacattcaaatgtttaccaaccagaatctatgaagagatgcttgaaagcaatgaggaaactatttttaaaactggatagaaaagtgggccaggcacagtggttcactgctgtaaatcccagcacttcaggaggccaaggcaggaggatcacttaaggccaggagttcaagaccagtctggacagcatagtgaaaccctatctctgcaaaaaataaaaattagcccgggtggcgtgccactgtaggctcccagctgctcgggaggcagaacaagaccctgtatctttaaaaaaaaggaggaaaaaaatgaattaagtctacgtacttgcagttcctaaaaaaaaaaaaaaggaactaaatgaaacagtgaaaaagttggcaaaaattataaaggtggatctatgtggagttggtgaggatgtaaggaaagagtaagtctgttttattggtttttcaaagagcccattgtgatcattattcaccatttttaaattttaatttagtcattaatctttcctaatttcatctttaagctttcagaccatttcttttgctgttctttttgtatcttttcaaataatttgcacggtcatggtttggggacctttttctaaagatgtatttaaagctccagcttctcgcagcacagctttgaccatacctcacgttttggtgtgtcctgatttcatcgttcgtttctcagccaccatgtctggctaatttcttaattttttttttttttttttgagacagtctcactctgtcacccaggctggagtgcagtggcgtgatcttggctcactgcagcctccacctcttgggttcaagcaattctcctgtctcagcctcctgagtagctgggattacaggtgcacaccaccatgcctggctaatcttttatattttagtaggcatggggtttcatcatgttgctcaggctggtctcgaactcctgagctcaggccattcacccaccttggcttcccaaagtgctgggattacaggcatgagccaccatgcccggccagtttcttaaatttttttagagatgggatctcactttgttgtctaggctagagtgcagcgtgtggcaccatgacggctcactgcagccttgaactcctagcctcaagtgatcctcccatctcagcctcccgaatagctgggactgtaggtacacgtcaccatgcccagctaattattttttgtagagatgaggtctccctatgttgcccaggctggtctcgaacttctctgctgaggtcaagccatcctgcctaggcctcccaaagtgttgggattacagacgagagccactgcactctgccattgtttctttctaaataaattggtatttcagtctttattttctttttcactcaggacttaattagaagggtgttttggaatgtccatatcaacaggagtgttttgttatccttttgctattaatttctaattgtgtcactttgtagttgcagaaccctgtgttatgggggtctgtctgcatgggggtccatctgtgttatgggggtctgtctgcatgggggtccatctgtgttatgggggtctgtctgcatgggggtctgtctgtgttatggggctctatctgcattggggtctattttgtttgtggccaattcatgtgcatgttgagcttgtttgggaagaacatggattctctatgagttaaagagttctgtgcatgttctcctgtgtctgttggattactcattacttaaatcttattttttttaaattttaaattacttttgttaaaacatatatatttagaacagcagtccccaaagccactctcagcccttgcagacgtcccaccgcatgctgaggtgagaagtgcacttttgccggtgcgctgcctccttttctttctttctttcttccttttttttttttttgaaacggagtctcactctatcaccaggctggagtgcagtggcgtgatcttggctcactgcaacctccgcctccggggttcaagtggttctcctgcctcagcctcccaagtagctgggactacaggcacccaccaccacacccagctaatttttgtgttttgtttgtttgttttttgtttttgagacagagtctcgctccatcacccagactggagtgcaatggcatgatcttggctcactgcaacctctgcctcctgggttcaagcaattctcctgccttagcttcccaagtagttgggattacaggtgcgtgccaccatgctgggctaatttttgtatttttagtagaaacagggtttcgccatgctgaccaggctggtctcaaactcctgacctctggtgatctgcccgcctcggcctcccaaaatgctgggattacaggcgtgagccaccgtgcccggccgcactgcctccttttcattcctctgtcttgcattctgtccatgccccaccgcagagacgaagggtgtagcgccccttccccatcctcccaccagcattctgtctactcagcagaaacccaattccactgttagctttacagtgaccatgtggcatcgtgaccgtgggatggccgtgttgcctttgtgctgttttccctggaggaaatcattgtgttcccccctcctccccctccccctcctcctgctcctcctcctcctcctccctcttctacgaactgattattctttcctaaaccttccaacaaatctaggactctcctctcacagacccctgtacattgggtcgtctggagctgtgttttctccttggcagtggccttcctggagccctggactgccagcaaccagcccagctggcagggccactgagtagccttccccactccctctcccctccccctacaatccgcctgcctcctgtctacaggaccccttgtttcctgggccccagcttgttctccttggtttatcctttgttttggtggagtacatctagcagcttcctccaaaagggttcagaggatgtgaaagtttttgagactctaaagatatgaaaatatctttattctgcctgtatgcttgaatgacaccttggttgggtgagatactaggtgggaaataattttctttcaggattttaaggctttgtccatcaccttctagcttgcagcgctgctgtgtggtggtgccctagactattaagacttcttcttcttctttttttttttttttttgagacagagtcttgcactgtcacccaggctggagtgcagtggtgcaatcctagctcactgtggccttgaactcctggggagttcaaggggatggagcgatcctccctcctcagcctcctgaagtgcttggattatagctactgtgcccagccaggattttcttacattttctgtttctttctcccttcctttctttctttcattcattctttctttcgttctttttctctctttctccttccttccttctttttctttctctctctcttttttttttttccagagtcttactctgtcacccaggctggagtgcagtggcaaaatcacagttcactgcagcctcagcctcctgggctcaagcaatctctgcctcagcctccccagtagcaaggactacaggcatgtgccactgaacttggctaattttttaatttttcttttgtagagatggggtctcacaggctggtttagaattcctggcctcaagcgatcctcctgccttgggctcccaaactgctgggattgcagatgtgaaccatggcgcctagcctccttaccttttttgtttgtttgtttgagacggagttttgctcttgttgcccaggctgaagtacaatggtgtgatctcggctcagtgcaacctccacctcccggattcaagcgattctcctgcctcagcctcttgagtagctgggattacaggcatgtgccaccacgcctggctaattttgtatttttagtagagatggggtttttccacgttggtcaggctagtctcgaactcctgacctcaggtgatctactcgcctcggcctcccaaaatgctgggattacaggcatgagccaccacacccggccagcctttttactttttaaggcttaataatattccattttctggatctgccacattttctttatccattgatccattgtggaaacctggattccttccacattttcgctattgtgaataatgaccactgctgtgttggagtgcgcacatctgtttgccttcctgccttcaactcttttgggtacataccccaaagcggaattgctggatcccatgcaattctgattttaatgttttgaggaatgagaattcacttcgggtttgcatgaatcccactcttagcatggcactgccttctctcccctctccccttccccctggtgagggaggtggaggatggtgaacctcaggctgagcagagtctggaggaaccgtctcctgcagcccacgtgggaagttccttcttgggggatagaggtcgtgctggggacctcacctgcttctggcctttccctgtggccctcccacagcttctccagctggtggtccctgccctccagtctcctgtaccctgccaggggccctcctccactggcgctggtcttttgtctatggattcatgatctttattttctcccgaactctctttatgatcatttcagaggggtctggggagaagggcagtctggagctggccttagtcctgcctttcctgaggcacgcatcagtgctcgagctccgggggttctcctgccggtcaagccgggggccggccgtgaggactaagcggtccacaggcagccctgctgtacatgaagcggggcaggtactgggttgggcggtgtcctggcacagatgactgtgcaaagccacagagggccacactgcctgaggccccgcgccgggagctggcgctggagcagcgggaggctgagcagacggcgctttagaaagcgcccgggggcgagctctgagggtcggcgggtgctgggtgggagcggcgaaggggagctggcgccgaggccctcgccgacccgctgccctgtcccccaggtgtgcgagccgccggaacgcaggcgcccgggccgccgctggagcgtcagcatcgacgagcgccggcggctggccacgctgggcggccgggagaggccgggcgccgccgggacccagctgcactgcagggtgcgcggggggcgggtcctccccgccccgtccccgccccgccccgcccctccgcctcgcctccctcgactcagtcccactgggccctttaccccggcgctcccgggccccgccgttgtccccttcccgcccctcgaggctccctgaccaccctcgcccgcaggacgtcgtgcagatggtagcccagctggtgtcggaggacgtggacaaggacgtgctccttccccacccgctgaggtccaccgagtccaccaacgccttccaggccttcctggcgcgcagtgcgcctttctggcataatgcgactttcgaggcctcgaggtcacccccttcctaagagccccattcagcccattgtctgtcttccagtgcctttccttgggggcccacggtgggggcagcctctgcgccttctttgtgccccaccagggggtcaccacccacccatgttaggaaaacaggccaggcaggacctggctccggacagcctgcagctgctgaggccttggagaccgggctaggggctatgggaggccatctaggggaggggaacactgccccgggtcagtctgagagggccctggcaaggcctgggtagcaggagcttgccctcggggccgctgggaggaggcctggggtacctgggcctgcctgaggtgcactggtgtcctgggaagccccagtggcaggcgctgcctggagactcagctccttggctggcctggtctggggaactgggtatctgcctgcaccaggctgtgagatgggccaggcagagttctccagggggcggggtctcacattgggtcctgcctctgaagacccagaagggcacacgggaccccaggggtgctgtggtggggagcagcaagcccagggacccaatgcagtgcccagcacagagggaggctgtctggaggcagagatgcctcctggcctctggacagcgatgctggtggtggacgagggccaagagggtatcctgcgcagggggtctgagcaactgtgaggagctggctgccgcaggggcctgtgggacatggtccactgggtgactgcctcgtttccaggctgcagggccctcggaagggtgctgagccggggtaacgtgtcccagctgcattttggggacactaagttgcagggggactggattgggaggcggggcaggagagctgtgagcatgggttcccagcccggggtgggtgggggtggggaaagggccctgaactctgtgactgactgttaggggcctgactgggcttctgtggaggtggctaggtggaggaggctttggggcaagcggaggtgatcactcctgggctccaggtgagggcaggagctggacctgtgcggtggcctggaccaccagatacactacatgctggctgtgctgcccacctggcctgtaaccctccccttcccgctgctgagaagccacctgactgcactgccagccacctgctgccctgacacaggatccctggcccgagttgaatcctctgcacctgcctgtctccccttcttactgtaagactcagtgaagttccctcctccttcaggaagccttccaagattacacagccaggtgctccccttctctcccaagtcctctgaatgtcatttggtgcaccctagggatcctctgcatttctcaggagccctagggtaggtggatggagggcagatcctccaggggctagggcaggtgtccttaagggtgtggggagttttgggcagggcactgtccttaagggtgtggggagttttgggtcatgacccaccccctctgaggcccctgatgatgatgtggggaatgggatcctatgggcccagctgcatgccaggcaggcatccccaggtgtaaacagggcagagcggagctgacaggtaagcagttgccatgggggtgatgagctgggcagtcctctgttgctgagtggctttaaagaaccactcgttgttctgtgacttgggggttggctgggctcatcctgccagctctcctgctctcgtttgagtgtctcctgaggctgcagtcagagcgtggtggtccaggatgctggtgatgctgggatggttgccctctctgctccatgaggtctccctacagagcacctcccccatggtggcagcagagacaaaaccctggcctccttcaggctgaggcccagagccagtctcctggtgggtaaggtggccacagggccagctggcagcagggtattggcactgagaggcacaggcctctccaacagaggtggtgccgggacaggggcagtgcctggagaccgcttaggttgtcacaactgggatttgtgtactagttttctgtagctgccataaaaattgccacaaattcagtaggtttggtttctttttcttttttctttttttggtggttggggcggagcggggggcaggcttgctatgttgcccaggctggtcttgaactattggactcaagtgatcccccgactttggcctcctgggtagctgggactgcaggtgcatcccaccacacccggcctttatttttttttttgtaagtttttatagagaaacagtcttggtatgttgctcaggctggtcttgaactccttgacccaagcaatcctcttgcctcggcctcctgagtagctggggttacatgagtgttccactggtgcctggctttgagtgttttaaaacaacacaaatgtattagctaagttttgtagaagttcaaaatgggtatctttgggctcagaatgaggggttggcagagttctgttccttctggaggtgccaggggagaccctgtttccctttttctagcctcaagaagccacctgcattccttggctggtagttgtggcctccttcggagcggccgagcccctctctgccctgcccttctctgcccacctctccattgcctccctcctgcaccctgaaacacacttgtggctacgctgggcccacccggaagatccagggtcgcctgcctgctttcgggtgaactggttagcccccttcctaacctgccacttaacccagttaacccagcctgctccaaggttctggggatttgtacacaagtatctgtgagaggggcattctgccttccacaggggctgccggcacctggtgggcagaggcggcggcgctgtgctgctcaggatcccgcaatgcatgggcagccccaaaccatgagggcccggcaggaaacccgggggcagaggagggtgcgtgcggcgggagcgcatgtgaagcccaccttgcaaggggaggggcgcgctcttcgcgggacggcagagggagggtctctgaggcgcgtggaatcaaggggacagaagaagcagtctcgggagtgggaaggatcctgggaggggagtgggaaggatcctgggaggggagtgggaaggatcctgggaggggagtgggaaggatcctgggaggggagtgggaaggatcctgggaggggagtggggatcccccgaagtctcgcagcagtagtgtggtgcttaggccgtcgccccggccgccactgcgcctccccacccgcaggcctccgcagcgccacgggcggccgcgcggggtagcgtttgggggctcccggggacgcggtctccggcgcgcaggtccgcccagggttggccgcgtggtcccccgggcttcccacgcccgattcgaattgtgactccggctggctccggaccgagccgaggacgctccggcaccacagcaggagccgcgcgggcgggggcgcggggcgcggaacggggcgcggggcgcctgggagatgtagttcgcggccttccccggcgcaccagacaatgcccgacgcggccccgctggagaaacgccttccttggctttgcagaaacaccgcttgctattaatacagcaacgaatacagctttaaaaacgcgcccagtgtcctccctggaataacagctgttaacattacctaaaggttatcccagatatttctaaatgtatatggggagataaaaggatgtaatggaaatacagaaatacgtgtcgagttgctacttatagacttttaaatatttaaagaaaaaaattgctaaaagcagatgaatgcttcttcacctcaagtttaaaagtctccttacgatggccgggcgccgtggctcaggcctgtaatcccggcactttgggaagccaaggcaggcagatcgcttgagctcaggagttggagaacagcctgggcaacaaagggaagctccatccatactgaagatacaaaaatcagccgggcgtggtggtgctctcctgtagtcccagctacttgggaggctgaggtgggaggatcgcttgagctcaggaagtcgaggctgcagtgagccgagataggcccactgcacttgagcctgggtgacagagtgagaccctgtctccaaaaaaaaaaaaaaaaaagtcttctacgattatttttagaaattacaaaaacatcaagagatgagtgtgtttggtttacagcagcaaagcacggttcggctgaggcggcaccggctgacttctgcctgtgaatggtgaggaactggcactgacatttccatatcccctggcagggcatttcttaccagaagatcaaggctcaccgccagtatttgacccactgaaagtctttgttttgatttacatctttactggctggacttaagatcagtttttgttgttgttgttagacagggtcttgctctgccacccacgccgcagtgcagaggtgctatctcggctcactgcgaactatgcctctcaggcctaagctatcctcctgcctcagcctctcaagtagcagggactacaggcatgcaccaccacgccccgctaatttttatatttttcagtagagatgggttttcactatgttgcccaggctggtctcaaactcctgggttcaagtgacctgcccaaagtgctggaacttcagagccagagccctggttttatacactttattatgttcccctccctgctagattgcaaaccctctgagggcaaaggtgctgtttccttaccctccaaggcctagagtggcctgtagcttgaagtagatgtttaacaaataatcaatgagtaaattattgtgttaatcactttgtcttgctctgaaattatctcaagcctttcatctccaagtaacttgatattctgccctttgctgtttatgacttgatccagccacggtgcgattttggtgcttccggtttgcttggctcttaactcttcctcccatcctgctgttttgtcgtcaagcatttgaattcctgattgttgaattcatgctgctatgaagctctgaaagaagtcctgtggagtcctcttctgtttctttggttgcgttttcttatttatttatttatttatttatttattttttatttttgtttctttgagacggagtctcactgtgccgcccccaggctggagtgcagtggtgtggtctcggctcctgggttcatgcaattctcctgcctcagcctccggagtagctgggactacaggcacgcgctaccacacccagttaatttttttgtatttttagtagagatgaggtttcactatgttgaccaggctggtctcgaactcctgacctcaggtgatcctcctgccttggcctcccaaagtgctgggattacaggcgtgagccaccacgctcagcccagttgtgttttcttccatactgggtttctcaccggcccctcacaccctcgatgacttgtttttctgttgttgaatgacatggatgtggtcacgtgccacctctcagcaatgctcccacctcagcctccggggatatgccactacttctgtagtgctttctgacgtgaaagctctttcctgaatgtctattcgctctgctactaagtggatggagtggatggattttttttttttttttttttttggagacggagtctcgctctgtcgcccaggctggagtgcagtggcatgatctcggctcactgcaagctccgcttcctgggttcacgccattcttctgcctcagcctccggagtagctgggactacaggcgcccgccaccacgcccagctaattttttctatttttagtagagacggggtttcaccgtgttagccaggatggtctcgacctcctgctcgtgatcctcccgcctcagcctcccaaagtgctgggattacaggcgtgagccaccgcacccagctggattcttcttaattctttgtttttattgtttgactcacctgaggtctttggactttgcctctgagctggcttaagggcaatccaccttgttcactggtctggagtggggaggcagagtatgggtcggctggaggagtggggctctgtgctctcttttgagagtttactaaacgtcactctgcatggtgaggggtgtgtcctctccgctggggaggcctggcttgaatttcagattgcctccctgggacaccagaccctgtgctgtgctccctcagaaggacagccttgactgtctccactccagcagtcagttctctccactcccactgggagaaggagcaaaggctggtgtcttcaggaggctcctctccaggctggggccagggaagagtgtgcatgtcactgtcaggatgtgtcccagtggtgtggctgggttctcagggtgaagctcgtccatttctgggatggcagcggaagcaggcactacacacgcagcttcagggggctctccccatgcttcctagctgcctggcactttctggtgtttctggctaactttctggccatgccaggagttggtggaaggagatctcaggctgcagctttgctttcctgctgaggagacagaggtaggctggggctgtaggacaggggaggccagcagccccaccttccttctggagagacgctgcctgtctgtcattgcccctctcctgcacctggccgctggctggctgctcttccctcccaatcaccagcaagccagctcctgttccctgcagcccagcccgcaggatgtgtcctgggacccatagccctctctccccagagacagcaccgccctgcagctcgggttcctggccctgtgctaaccctggtggggctttccttactggtctgctctgcagccatgacattgtggccaccgctctccttgggacccccacctggctttcctcccagcacatgctgtttcctacccacctggatggtgtcctgtgtgctggattccccatgctgtgtccccagcatcctgaccatgtctgtcccgcctgcctagatcttgcaccgtggccacggggctccctcctgatagccctgaacgctccgctccatgtcctacagagagggatgtcccaagtagatgtcagctccctccagcatctgagcaggcaggacagagacccacggtgctgctcacatcagcagcctggaaccccgagacagctccttttgctcacctcccccaacactgatgttgcacctgtctccaagccactctgggaccatctgtttctctccatctgggaagcccccttcgcacctcatgctcttcctggctggggcgtctgggtcactcactggactctcctctccttagacctgtgcacaagcacacacgggaaggcatcctgacaggtggtgggaagagaaggcagctgcctcactgcggaaagagcacggccgctcctggactccagccctgttggggctggcggggtcagcaggcgctgggttccagcctcaggtggggtctttggaggtggcctctgggcacaggcacctcctctgcggccttctcaccaggtcacggttcagggaggctttgccggctacggagcctgcccacaccaaggcgcgcacgaccacctgtccagagatgccacgcgggctgggcggcgaaggccaaggacacgccctgcctggtgtcgggggcaaaggttaggcctggaagggaggtgtggggtggggaccccgaggccagggctgggccgctgagcttcagggcccttggggggctcagggaggaatgccggaggaccccagcatcaggaggaacccctggagagctacggcaggactcacctgtggggcacagggagggatcaccagggaaatggcccttgtggaggatctcccctctacccccagggcaccaggggaggatctaccagggggttctggtggaagggcccacccgggaagcggcgcgcggggaggactcgggggcgccgagaggaactgtccgggaaggggcgcgcgggccgcgggcggcgcggggtcggtaacggcccgtgcggtgggcggcggcgcccgaggcccctccccgccgcccgcggccgctcctcctcttcctctcccgcccgcgccgcggccctcccgtccctgcgcggcctcggcggcctcggcggcggcggcggcggcggcggcggcagcagcgcggcccctttaaacgcctgcggcgccccccgcccccgccatcgcgcctccattttcccggccgcccgcgccgagcgccgcgcccgccccgggcccctccgccgccgccggcccggacatggccgccaacatgtacagggtcggaggtaaggccgcaccgcctttatgcccggccccgacccgcccgcagcccccacccgccgccgctgccgcctcccccgcccctctgccccgcaggccccgcgccccccgcccgccctcgcggcccccggctccttcccgaaccgccccccgccgtgctcaccccaacccaaaatggccccgcgggtcggccccatcgggggcgggcggggctcggcggcccgggggtggggggcggcccacctgttggggccgagggggcggccgcgggggtggcgggggggcgcggggcctgcgggacatccgggggtccggggccgggagcccccagcgggagcacgtggccttgggaggcgccggctgccggtctgggagcaggagttttggggctgtggggtctcccccggcccgcggccctgtgctgggactccggtgcatcccctctggggatggggagccccggtgaggggccacgttcctccctagagccctcctgcagcctggccccggggcttcccccagcagggatccctcagggggtcttcagcagggagcgagcatcccgagcacgcctctaagtccccccaaacttttccctgcctctcgctcacctcagcccattcgggaggcgctttgcaagggttggggagaggccggagggcctcctgggcaggggcttcctccgtgggcccagcctcctgttgctcgggccccccgggcctgcagctttgagccttgccctccttcgtgtgcctgggactccgtggggtctttcacaggaaggtggggggtcgtgtgcattccatcattccatcagcgcctccctccccaggactctgagacccctccctgcctgtgaccctctcgggcaggtgctcattacctttcccacctgcagcctgcgctgctggagggagctggggtcactcccgctctggcttgatccccatgcccctgaccccgagtgcccagaacactctgtgtctctcgagcgtggcttctgctgccttggacgccgtgtggtctggccggccagtcctgtgaccttggggacggtgggagccccctacatcccgtctgtgagatgggcggtcagtccgcatcagcagctctgggcctcccctgtcctctcagaggggcggtgggcctgtaccccatccagcggcagcccctcccacagcctcatacagctttgccaggtccctgtgtggacccaggtgcgctgagcccaccccacgctcagggagcagcctgggtgcggggtccctcgagggaggggcctgttccttcctgttctttctccccacctggagaccccccttccagcctgacatgagggcccagtttctcaccctggcagagaggatgcctgctgcctgggctccagccgggcccactgcgcatggttttgggattggtcccaagaagagctctccctgcccccacccatgttgggggtggggagtggtggcagctttgggctctagggctggggacaccccgaccccaactcatgccttcctagtggctgcattgctcggccttcaggcctgcctgcctgtgatcttggcgccagcctggctgccccccctccaaccttcccatgcctcggtttccccatggtgtgggtgaggacctcgtctctcagccgtccttttgtgccctgtggcagctgtgctgtggctgatgaaagccaggaccctgccttgtcccatcccggaggtgcagctcccctgggccccacacaggcttgggaggagcccttcgtggggctgcgccgccctccccgaaccctctgtccccctgtgcccgcaggcccgtcccagggcctcactgacccacgcactccagtgctgtgagggtgggtggcctggactcctaggctgtggcggaggggccccaccatgcctggcagagatgctgctggtctcttttcctgtgatgaggagcatgggaggttgggtgctgtctgctggcagcacagccacgcgtgggatccagactgcttctgcgtgtgcagtccgtggtcactgtggccgggtgtgctcggagctgtcaggccccccacgtgcccgccccgaggacttcctctccctgcaggtgagactgtaggcctccccctctctactctgactgtccctataggagaagcggcatttatccctggcttctggaccggaaccctgggttccggcaggaccccggcagagccctgtggtcgcagtgggctgggcattgcaggttggcttcctgtcttggtgctcgctcggggaggtgggcgtctggattcttgagcccccagacaagaaagaggaaggtgtgcagtgtctcctgagcagcctttgtccgtctgtcgccggctgcctggcacgggctccatctgggtggccagtcctggcctgtgggagatgccggcagggacccagcctgggaaggggcttgctcctgtgcccccccaccccagggaccttgtgtgtagaggcaccaaatttagttaagaaaagtacaggacgcccaggcaaatttgagtttcagataaacagaaatttattagtgtaagtatgtcccaaatatggcatgggacatacttgtcccagaagattcttatctgacattcacagttatctgggcaacccgtattttagctggcaggctactccgaggccctgccaggttgggctaggcagggtgaaggtgtggtggcagtatttttgtgccagctgagctgggtgaagtggtgagcagggagggaacagggcctgtttcttccccatggagtgccctggccacggacagaggccttctgtctgtgcctgtgagggcagcggatggcctgggcaagggtggcggggtcagggttccctgacctctgcttctcaagggttgtccatcccgagggctggggaaggcttgaaacctgctgtgggatgagagggccccagggcaacggcgggatgtttcttctctgggttgaacatgaagatgttagatagcatccaaaacaggacagcaggaatcggtgcctgccagccgcctgcagcttgctcatgtggggcttctgcttttcagtggacaggccattaccattttgccttgggtgtttctgtttttcattgcaagaggttaacaccccatcttttggattttttttgtttaattttttttttttttttttttttgagatggagtcttgctctgtggcccaagctggagtgcagaggcgcgatttcggctcactgcaacctccgcctccccggcccaagcgatttcctgcctcagcctcccaagtagctgggactagccaggcgccaccaggcctggttaagttttacatttttagtagagacggcgtttctccatgttggtcaggctggtctggaactcctgacctcaagtgatccacccgcttcggcctccgaaagtgctgggattacaggcgtgagctcatgcccggcctttttgttttaattttaataaaagttgaggctgggtgacagagtgagactccgtatcaaaaaaaaaaaattttaatgtagtttgaaaggatgccagaaagcccctgcccctgcagggccgcgggctctgccccggtctctggcgcagcctgggcggaagcaccctgtccgtgctgctggtcttcactgggcttggcatgtgccatcatctgcgctctggcgcgctgttagaaatgttgcttttgtatttttattctagtgtttttttgaagtttaaactttattgctctatatacttgccagtggggaaaaaagtaaacttaaaaaaaatgtcagatttgtagagggctgcagccagcgccgccctaccctggagtgctgagtgcaccgtgtccctaggcacttgctgctccatgggccgacttttggggtcccacccatcttttccaagaaggcagggaagagccctggagacacggccgtcctgtgagcaccaggagcgggagtggtagaagtggcaggggcccaggtgtgatgtcctggaggggatggcatggggctgtcccacttggcctgtgaggatcggcctcagcactgcgccattggcagccctggctcactctccaggcaggatgggccactgagcttctcctgcctcagccactgagcactcctggcttgctccacctttgtttttttgagacggagtctcgctctgtcccccaggctggagtgcagtagcgcaatctgggctcactgcaagtccgcctcccgggttcacaccattctcctgcctcagcctcccaagtagctgggactacaggcgcccgccaccatgcctggctaatgttttgtaatttttttttttttgtagagacggggtttcactgtgttagccagtatggtctcgatctcctgaccttgtgacccacccgcctcagcctctcaaagtattgggattacaggcgtgagccactgcgtctggcttttttttttgtttttgagacagtctcactctgtcacccaggctggagtgcagtggcacaatcgcggctcactgcaacctccgcctcctgggttctagtgatttgcctgcctcagccccctgagtagctgggattacaggtgtgcaccaccacacctggctagtttttgtgtttttagtagagacagggtttcaccatctaggccaggctggtctcgaactcctgacctcaagtgatccacccgcctcggcctcccaaagtgctgggattacaggcgtgagccacggtgcctggccccatattgttctgagtggagaatttgatcgttaagctctcagaataataaaaaagtagctgtcagtgagagatgttggaatatatggtccaatgaagcacatccctcgcgcccgacccgccctggcagtgccgttcccgcccgtgtgtgtgggttctgggtgtcaaaactgctgcagtggccctgcaggcatcctacctagaggtgggtccccagctgcgcatctggacgctggtcagcaggtgaggctgggatgccagaggaggtgccgtgtgcctggccaggtacccgggaggcggcttgggggagcactggctgcagggcctccttcctcctcctgctgaacttggagtgctcttgccagattatgggctgagtcctgctagggagggtggccccccttccccaggaggagcccaccctgagacctggttggggggcagcttagaccctaccttagactccagcaggctgtcttgggagcatgtaattatgttttttttgagacagggtctcctgttgcccaggctggagtgcagtggcaccatcacagctactgcagcctccaccccacaggctcaggcgatcctcccatctcagcttcctgagtagctgagaccacaggtgcacaccaccatacccagctaattttaagattttttatagaggcggagtctcactatgttgcccaggctggtctcgaactcccgtcctcaagcgatcctcttgccttgggctcccaaagtgccgctgggtttgcaaggctgtgaactaccatgcccggcagagcatttaatattctccaaatgtctttcctcgtgtgctacctgggctcactgctttctggggctctcgtgttgctggtgtctccacccccacccccaccccagctggcctgctccattcctgtcccggtgggctcatgtctgagtgtgcggactgggggatcttggtggcgatggagccaagcccagggaggctggggccaccctcatagtgcaaggccacccagcacctcgcccctataccccacccgccccaccaatgtgcccccggcacccccgagcccaggccccaaggcttgcttctatgggctttgcaccaccctctaggctgctcccgcctgggccatgcagcgcacctgaggggtctgaggtgaccgctcctcagagccgcccggcagcctccctggggcgggcctcagcactgcagccccgtgatccggcctggcgtgggctttgctgctttctctgcccggtggcctgaggagctcgagtgcccgcctgcccccagagccctttcacggtcagggcctgagctctgtgggtgccattaggaggagggtctgcagatctgtgcggttgggggacccctggggcatggaggggaccacgcgtcccttcccgtccgtgccctgccaggctgtcctcacagcagcgtcgtcacaggggaggaaaccagggcagcggcagcggctcctggtaccaagcataccttaaaaatgagcccatggatgttgcagtgagccgagatcacgccactgcactccagcctgggtgacagagcgagacttcgtctcacaaaaaaaaaaaaaaaaaaaaagagcctcaaggcctgtgcagttggtcagcggtggagtcaggtatggggcacacctgattctgccctggctcatcccctgccttcagaggacagcaagggcgcagcgcacgtgggggctggccctgaggtgtggcgttctctgggctgggctagggcagttctgagggaggggcgtgttctgtcccattcctccaggagacacagtgcctgggccatctggccacttgcatgagggaacgtctgtctgcatcccctgggggccgctgtccccatcccttgactgccggatgcacctcggatgctggggctctggtctccgatccttcttggactttgtggggacagcaacggaggaggatgaccccaaggatgggccgggcgcgaggcttgcagcagtgcccaggttttgcagataaaaatacaggacacccctgcagcatttgggacgttgtcacatggagacccggctcctggagcaggggtgctgggggctttcctgaccactgttgctgtttctcttgactctgttcccaaaagggaaaagacaaagttcctctctgtgctccctggtctcctgtctctgaccatggcagacctggctgtgggtgagctcaggagagtgggctgtgccctggagggtcccggacaggcagggaccacgggcaccgccctgccgcacagctcttgttgctcaatgatcttgggggttgtgtctgttctcccccaattcttctgtggccccatcccctatttgttaaaacttacgtgtaaccccaaaattcacacttatgtcactttcccagtcatttgcgggcacgcacaggctgctaaaagcccaagttgcgtggtgcttgggtgcctgctggggtgagcgaggcaccctgccctctgccactgctcccatgttggaagcaaattgtcctttctccatctactgagggccatgcttcttgcatttgggggctcttggtgattttgctttttagatgcccctgggggaggtgccgcagtgctgttgagtgtccctggacacaggcaggctgggatgggtcccatggagagaacgtgtgttggacaggctctgccccacgtgagttcagtgtcggagaacaataataattataaagttctttgacagaaacgtaaaataaggctgttgcgtattgattggttgctgaaaatgttgtgaccagaggctcgtaggaacctgaccctgtatttcctgtaggaacagaggtacggtgttcagtattagtggtgactttatggaacgtaattactgcaaacaatgagaattgactctgggtgcgtgtatatttttttaacttaaagtaaggtttaggccgggcatggtggctcacacctgtaatcccaacactttgggaggctgaggtgggcagatcacttgagctcaggagtttgagaccaacctgaccacacagcaaaaccccatctctactaaaaatacaaaaaaagccaggcgtggtggtgcgtgcctgtaatcctagctacttgggaggccgaggcatgagaatcacttgcgtgcaggacgcagaggttgcagtgagtggagatcgcaccactgtaccccagcctgggcaacagagtgagactctctcaaaaaaaaaaaaaaaaaaagttaggtttattgagatacacgtttcacatggcaaacccacttatgtgtaggggcctgtggttttccactcatgcacagctgtgtggtcgctgcagctcttccacacctgacatgcttctcttgtgaccttctgtagtcagccccctcttctcccccagctcccagcaacactgacctattttctgttcctgccgttttgccttgtccagaatgtggtagaagtggaattgcacagcatgtgggcttttgagtctggcgtctttctttttttttgagataaggtctcagtctgtcacccaggttggagtgcagtggtacagccatgactcactgcagcctccacctcccaggctcaagtgatccttccacctcagcctcctgaacagccgggaccacaggtgtgcaccaccacacccagctaagtttttcgttatgttgtctaggctggtctcgaactcctgggctcaagcgatcctcccacttcggactcccatagtgctgaggtaacaggagtgagccaccatgcccagccttatagtaattcttgaaatcaagtagtaggaatccttgaactttgttcctcattttcaaaattgtttagcctgttctggttacttggctttcccttacagagtttagaattggcttgttaatttctacagaaaccaaaaagaagtgtttcttttttttttttctttttttgagacaacatcttgctctgttgcccaggctggagtgcagtggtatgatcttggctcactgtatgtagcctcagtctcttgggctcaagtgatcctccccacttcagcctcccgagtagctaggactacaggcatacgccaccatgcctggctagttttatttatttttgtagagatggggtctcactatgttgcccacactagtctcaaacccctggcctcaagtgatcctcctgccttgactcccaaaatgctgggattacaggcatgagccattgtgcccagcctcaccttgcacttttatgtggtagaaatggcttctttccttgaacttcatgggccaacttctgctagcttcagatttttcttctgcagcctcctcacctccctcagccttcgtagaactgaagggagttagggcctcgctcaggctggggctctggcttcggggaatgtgtccgctttgatttcccatcccggcacttcagctttctctctatcagtactaaggccgttcagctgtcttatcaggcttgtgttcactggagcagcactttttgttttttggagatgaagtcttgctctgtcgcccaggctggagtgcggtggcacgatctcggctcgctgcaacctccgcctcccgggttcaagcgattctcctgcctcagcctcccaagtggctgggactacaggcacccaccaccacacccggctaatttttttttttttttttgagacagagtctccctctgtcacccaggctggagtgcagtggcacgatctcggctcactgcaagctccgcctcccaggttcacgccattctcttgcctcagcctcccgagtagctgggactacaggtgcccgccactatgcccggctaattttttgtatttttttagtagagacggggtttcaccatgttagccaggatggcctcaatctcctgaccttgtgatccacctgcctcagcctcccgaagtgctgggattacagacgtgagccactgcgcccggcctttttttttttttttttttttggtgaccaagtctcgctctgtcattcaggctggagtgcagtggtgcgatcttggctcactgccacctccagctctcgggttcaagtgattctcccacctcagcctcccgagtagctgggattacaggcacacaccaccatgcctggctaatttttttatttttagtagagatggggtttcaccatgttggccaggctggtctcaaactcctgacctcaagtgatccacctgctttggcctcccaaagtgctgggaatacaggtgtgagccactgcgcccgacccacttttagtttctttcaggaacttttcctctgcattcacaactgggctacctgcttggcgctgaagaccaggctttccgttagggtatcttggctttcgacaggccttcctaactaagcttagtcatttatttccagcttttgttttaaagtgagagatgtgtgaccctcaactcttcccttcactggactacttagaggccatggcagggttgctagttggcccaatttcagtattgttgtgtctcagggaatagagaggccccaggagagggagagaaatggaggaatggccagttcctggggcagtcggaacacacacatttatcaattaagttcttagttggggtatggctcatgatgcccaaaacaattacaatagtagcatcgaggagcaatgaccacagatcgccatcacagatagaatcatggttaaaaagttggaaatgttgagagaattaccaaaacgtgacagcaacacgtagtgagcacctgctgttggaaaaatggcaccgatggacttgacttgatgcacgttgccacaaaccttcaatttgtaagaaacacaatacctgcaaagcatcatcaagctaagcatgatgcccgtgtagatgtttgggaaataattggcatctaaaccaatcttgggtcctctcgtacagggattggcaaactggcccgctgcctgtttttgatgactcacgagctaagaatgggttttacattttttaattgttgagaaaaaaatcaaaggcagaaaacttcatgacacatgaagattatatgaaattcacatttcagtgctcagaaataaagtgttatgggaacacggccgcactaatgggagggattccagttattatgtggctgctttgagctaccgtggtggggttgaatatttgtgatagggacaggaaaaacttaactttttcccagtctcacacgttcaacacagaacacttcacctctggtccctggaatgtgtgtggggtttctccctaccagcagccagtcggttatccagtgatttaacccaattttgacactgcttacctggagagaatattaggttctgcagctgaagggctgagtcccacaagactgtcctcacttctcctgcctcagcctcccgagtagctgggattacaggcgcccaccaccacgcacagttaatttttgtatttttagtagagaccaggtttcaccatattggccaggctggtctcaaactcctgacctcaggtgatccacccaccttggcctcccaaactgctgggatttacaggcatgagccactgtgcccagcctacaagctggttattaacaagaccaataaactgaaatctatagccagactgacaaagaaatagaagccacaagtaaccaacatcaggaacaacagatgggacatcactacagatcctactgacacgagaaatgtgtggcacagaaaagggcttggttggacaaatttacaagggttgttaaacatacaaagtgccaaaagcctatagttattcattctattacttgttggcaggtaaatattttgtggaaagtatttgtttatttttatttttactttttgaggtggagtctcgccctgttgcccaggcagcagtgcagtggcgcagtctcggctcactacaacctctgcctcccgggcccgagtgattctcctgcttcagcctcccaagtagctgggactaaaggcatgcaccaccacacctggctattttttgtatctttagtagagatggggtttcaccatgttgggcaggctggtctcaaactcctgacctcaggtgatccgcccacctcagcctcccaaagtgctgggattacaggcgtgaggcactacacccggcctgtggaaagtatttgagtctgtcatgccttattgaaccagtagtgtcaacagtgaacttcatttgaccttgtggacttgatgtcatcagttctgtgaattaaaaaaaaaccttttttaaagagatagagtcttgctttattgcccaggctagagagcagtggcacagtcctggcccactgcagcctcaatttcctgggctcaggtgtgagcccctgtgcctggcctaaagctgaacatcttgacttgctgtcctgtgcagcagcttgatgagttggcagtggtgaagttctattgcttttttatttttattttttatttatttatttatttttgagacggagtcttgctctgtcacccaggctggagtgcagtggcgtgatctcggctcaccgcaacctctgcctcctgggttcaagcaattatcctgcctcagcctcccaagtagctgggattacaggcacatgccaccatgcccggctaatttttgtatttttagtggagatgaggtttcaccatgttggccaggctggtctcaaactcctgacctcatgatccacctgcctcggcctcccaaagtgctgggattacaggcgtgagccaccgtgtctggcctgctttttgaaaaagcgccgaaattggaaaatttcagaatgagaagaaccactgttgactgccatcatcaatacaccagatgacttgggaaactagtttttgctgcatgatgttctctacgttctttatgaattcatcttaaagttacgaggcacaaccacatttatttgcaaaatttatactgtgatgaagtcactttggcaacagctcatgtttaaatcacaaactgctttgtacagttttcttattgtcaagaggtaaaatgagaggcaaagtctgcattgccacacagatttgcagtgagctgcttttctgggctcacactgtggttacagcagagtgtctgcgacttccatgcgagtgcaagggaaacgtcgacatttcaaaatccactcagctgtgtgttagggagctcccgcctgagcttcagtcgaaagcgattggactgtagcgtaaccccgtgctgtaatataggggccccaagaccaccctcgggttcagtaattcactaggactcatggaatacagcagagcatttctgccaggggtacggttgattacagcaaaaggacgcagactcaaatcagcaaagggaagcggcacaggggccgggctcaggagagaccaggggtgggcttccggcgtctctcccagcagagacgtgggcggtgtgtaggtctagcagtggtctgtgatgacaggcctggcgtatttccaagcagggacgctcccgtgagccttggtggtccaggtgtttttagaggttggtcaggtgggcctggctgagcaccggtgtggctgccctcggtccctccgtctcagcccctccagaggtcaggctgatgccacaaggcaccgcggtacgtcactgtcagggtagcctctctgaggtggcctgaggccctgggtgagcagacgctgttggcaggcaggatgctccaagagctccgaggtgacctcctaggagcaggtcaagggtcagacctctctggaaggaagaatgcgggcaatccaagcctgctgagctggccctttccaggaaagggagtagcgaggctgctcacttagagccacgcacctggggctgacagtgtgcctggcagtacctgtgtggaaagacagttacagaggaaacacatgaactcactataagccagcactaatggatgcacctttgttgttgattttggtgataaagaacattaaatttgaacccagtgaagcaatatgtcatctcccaaaacaagtcctctcatgagtgcatctgtattatagaaagctgcactcagctttttaaaaaaatttttttagatggggtcttgctctgtcaccaggctggagtgcagtggcacaatctcggctcactgcaagctccgcctcccaggttcaagcgattcccctgcctcagcctcccacgtagctgggactacaggtgcgtgccaccacacctggctaattttttgtatttcagtagagacaggctttcaccatgttggccaggatggtctcgatctcctgaagtgatctgcccgcctcctgaagtgctggcattacaggtgtgagccactgcgcctggcccagttattttgatttcatcagtatgaaatgtgtagaaattgttacattagtccctatgtaatatccttggtgtggcctcttggcctgcacagcctggagtattgactatctggacctttataggaagctcaccaacatgtattttaacccttgacaccttatctgttaccatttatttagatctttgctgatttttctcaccagtgttttgtacttttcagcatgtagatctttgcacagatcttttgatctttaaacatctatagatcttttgtaaaatttatattgtaagtatttaatttttcttggtgctcttgtgaatagtacttttacaattttgatttccatttgttagtagtacgtagaaagaggactttttttttttttttttttttgagacagagtttcactcttgttacccaggctggagtgcagtgaatggcgtgatctcagctcaccgcaacctccgcctcccgggttcaagcgattgtcctgcctcagcctcctgagtagctgggattacgggcatacaccaccacacccagctattttttttgtatttttagtggagatggggtagctccatattggtcaggctggtcttgaactcccaacctcaggtgatccgcccgcctcagcctcccaaagtgctgggattacaggcgtgagccaccatgcccagcccaaaagaggacttatttttatatattgacctgtgaccttgcaaaactcttactcagcagtttcaatagctttttttgtagactctggggatttctatatagaaagtcacatcatctgcgtatagaaagttttatttcttcatatccagtctgtgtgcctttcattgatttttcttcccattgtactggctgggacttcctcgatggtcagcagtagtggtgagagtagctatacccttggcacatccctgatctcagcagaagcagcccttttctcaccactgaggatgatgctagctgtaggttttttgtaaatgtattaccaggctgaggaagtaccctttagttccttgtttgctcagagtttaatagcgtatgtgttggattttttcagattatattcttgcatctacggagatggtcatagggcttttcttacttattctgtgaatatgatgagctacactggtttttgaatgtttttaaaaatttaagttatatttagagatggcatctcactctgtcacccaggcttgagtgcagtggtaccatcatggctcactgcagccccaaactcctgggcttaagcgatccttctgccttagcccccaagcagctgggactacaggcacatgctaccacacctgcataattaaaaataatttttttttagagatggggtcctgtgatgttgcctaagctggtctcaaactcctggactgaagcaatcctcctgatttcttgtgtgtctttggttttggtatcagggcaatggcgttctcactgtcagctggggagtgttccctccttttctgttttctggaagagttgtgtagaattggtgttaatttttccttaaatgtttgatagacttcaccaatgaagccatctgggcgcagagttcttgttgttgtatttccgtagtatggatagggttacctgtttcttcttgaatgagctttggtgtttatatctttcaagcaattggttcatttcatttaagttgtcaagttctgtggcataaagtcctccataatactccttacaccccttctcgtgtcagtaggatccgtagtgatgtcccatctgtcgttcctgatgttggttacttgtggcttctctctttgtttctttgtcagtctggctatagatttcagtttattgatcttgttaataaccagcttgtaggctgggcatggtggctcatgcctgtaatctcagcactttgggagactgaggcaggtggatcacctgaggtcaggagtttgagaccagcctggccaacatggtgaaaccccgtctctactaaaaatacaaaaattaactgggcgtggtggtaggctcctgtaatcccagctactcgggaggttgaggcagaagaatcacttgaacccgggaggcggaggttgcagtgagctgagatcgctccattgcactccatccagcctgggcaacaagagcgaaacttcatctcaaacaagcaaacactcagcttttggttcctctgatattttcccctctactatttttgtttcatgttatttttactctatcatttcctgccttcttgctttatttgtccgtttattaaggcataatttacattcagtacaattccttttacgtgtacagttccgtgaattttggaagtccatagtcatgttgttgtaccacagtcatgatacagaatagttcccaaattcccaaattctcacgtcttccacatcttggttttcctgcgccagcagcttgtaggtggccccactgcacgcagccgtcgtgcctgccacctcccccgagagggccttccggtgctgcagaccccgagctgccagggggcttcactcctggcccctgccgaggagtcttccatcaagtggatggaccccagcttgtttgtctttcctcacttaagggacatttttcccccattttttggcaagtttgatgcattgttttgaatttaatttatttggtttcttggagtaaaaagttagaccgttgatttgagaccttttttaaaaaaaagtttgagatatctacatgtgatgaaacccaccaattttgagtgtgtgattcagtgaattctagcgttttcacagcgttgcacaagcgtggacacatcctgcattcagaacactcctgtagccgtgacacagacccacaggccccctgtcacttctgcaggcttttctgcagggaacgctcactgctgtgcgtgtcccccgggcaccgtggctgtgtcccctctgggctctccatgctcctagcccgttgtcctgtggagctctatgtgggcgtagcctcatctgatcagctggtttgctcaggcagcacggggggctcaggagctgcatgcacaggtgtgactttgcacatgggtgcccaaacaggtgcgtcctcccaggtgtgcacccacagatgtgtcctcacgggcgtgtgcctgcaggtgtgtcctcacgggtgtgtcctcatgggcatgtgcctgcaggtgcgtcctcatgggcgtgtgcctgcaggtgcgtcctcatgggagtgtcctcatgggtgtgtggctgcaggtgcgtcctcaggggtgtgtcctcatgggagtgtcctcatgggcgtgtgactgcaggtgcatcctcaggggtgtgtcctcacgggcatgagcctgcaggtgcgtcctcatgggtgtgtcctcacgggcacgagcctgcaggtgcgtcctcactggcgtgtcctcaggggcatgagcctgcaggtgtgtgccagcagcaggagggagatgctctccaggcccctccacagggtcctcgcggcacgggtttggcctccgtgtggacagatgggctgggcttctttggtgctggtcttgctgtattttgctgaatcccaggcctgtgcgggcctctgggctgattccagctgagacaggcctcctgctcagtcccccctgcggagctgatgcagggtgggctggcgagggtgctcgtggtgctggttcgtgaggacatggcctcagtgcctcccaagctgagcccctgcggtggccccaggaggcctggagcatcggggtgtcagcaccaccagcctggacttccctgggccttccagggtaagcctctgggctccggaaggttccgtggctctctgtctgtggagctggtgagaaggctggagggccagatggtttcatcgctgagggaagcgctgtactcacctgatggccgatcttggggcactcccagtgcctgctgcctgttgctgtccctgagctctggtgagctctggtattcctgtcattcctggagcaactctgtcctgtttttgagcctgcctgggcccaggaagccccaactgtgttctctgtgtagtcactgctgttggttttggagggaaagatgggggccgctgtgggcagggctggtggctggtggtggccacgtggctctgggggtgtagcatccaggctggctgctgccagtgggaaggtgtcctggggctcccggcagggtctgggcagtgctggagctgggctttgcctgggaagctgccgcctggcccccacagcttccccaagaagggcctgagcccttgggggcagctggcgtctgtgaggatccgggatgggggctgtctgctcctgctgggaacggcccctccagatgcatctccctgtccctgacccagcctgtcagtccattttggttgcagccacccctccctgatggtgtgggggcttcgcttcctctgtttattcctcgcctgagggagcagaggtgaggggatgacactgccccgcctgagccccgagtccctgggccacgggaggtgggactgggtctggcctttggtgccacaggtggcactctctctgttgctgtttgcagactacgtctactttgagaactcctccagcaacccatacctgatccggagaatcgaggagctcaacaaggtactggggggccctggtgttgctgcaggggggtagtgggtgggggctacgccagctcctgccctgtgggtggccagtgtgggtggccccctttcggggctgatcttggactggccactgcacaggcccttcagtgactccgtccactgtcacctgcaccgtggctcctccttggagatactgagtgaggggcctggtggcctcatgcaggacccagcgcagctgccctgagctgcctgcccactctacacttggtctgtgggtgctgggtcccctgaagatgccagtgtcccctggggagcccgagcggaatggtgtgattctgaaaccaaccaaaggctgcagaaagccatactcggtgcccctgccctgcccgaaccctggcagccagccctgcagggctgtgagctctgcccccacccctgaggtgtctgcatggctggaagcaccctccctggtcactcaggcagccctgcagggctgtgagctctgcccccaaccctgaggtgtctgcgtggctggaagcgccctccctggtcactcaggcagcccttgctcccacctggtttgtgtctgccatgagtccttggcagttgcttgctgtttggtcgggggacgtggttgtgcccatgcattgagcctggcagcaccagatccttcctggggggtggtgacacatgggcccctcagccccagccactcctggcctccactgcctcggcacagcctccgtcccatcagctcgggagacagagccgtagatggccatggaggtgtagggcgcccgcacaccctgggagccttctcgctgtcctcaggggtggtgggtgggtcccccagcgtcccttctcctcctcctggttggagactttctaagggtgttgagggagggcaggttgtccccaccagtggacacatggttccagcagagagtggggtggggtgctgggtgcttcacagacctctctgtgcctgcctgcagggctcctgagcccccgatcccctggagccagtggcccgatggctgccttctcctaggagccctgcccactcggcaggcctggggcactcgggcccttggtgttccatctggatgctgcaggctcacctgggagaagctgccttcctggacctcaggcttggtggcagcggtgacgtggggttcttgggatcagagggggcagcggggggaaggttagcgcgccacctctgacgtagccatgctgggctccgggcttccctggctgcgcttgtcgagggccattccctgcggtatctgccaccacctggggccgaggagcatggggtgcgacatctgctcccccgcagcttcctgggaggtctgagggccaggcctgtttgttggaggcacaggcaatgacctgggtgtcttctgagtctgcctcactgcccctgctgggcagggcctgcccgcctgcagagcaaggccacttgggtactgccggaatggggcgccactcctgtggctgagcctcctgagtgcggggcagcactttacgcatcccagcatgtggactgtagggaaacaggtgcagagggaggttcctcagctgacgctgaaccatggctgggggaggtcctgtgtccctcctggtctgtgtagtggaggggcggccggcagatggcactgctggccccacacagccagctggcaggcaacccggggcgggaggctgcagtgcctccgtgggcgcctggccgagtgccactgctgggaggtgccactgtcaggaaggttccctcgtgctgcttccggcttccatgtgcagacagtagattgcaggcgtgtgcaggcagggggctggcttccagcccttgggcgatgttcagttacacatgtagcattgcacacgctcagaggcgtccccttcgtcctaggactccctcctcctcagggccagggccacatggcgtgggcacttgcctgtctctgggcgggacaccagcctgtgaggggcacgactactctcttggactgttcaggcagggcagccgagccagacgctcaccatgtggaaaagaacccgcaggcctgcgacagagtgcggccagtgccctccacgccaaggagctccaggcggggcttccaggtgggcgcagctggttgagtacagacctcccctctgttccctggactgaacgccccctcaaataacaagaaagtggtgctggggctctgcacccacagggcaaggaaggtgggagaggcggtgccactgggaggtatgggcacagcttggaaggcagccaggcagactgggcaacctgagaggccctggccctggcctgggtcaggatggggagaacaggaaccatggtgacatgtggctggcagcgcggaaggcctgtctggggggtcaggtggtcccacagagcccttccctgggctggagcagtggactcagaggacccagatttggggcaccagacccaggccagcacagttcgtgcgggggctggaagtggggatcgcctggctcatggcctgtcccctggtgggcccccccgcccctcttgcctccttggctcccaggaccctagcggccagacttctaaagcccacagacccagctgctggcatcggggacccagcagaatgcccgctaccccagcacccatgggtgcagcccatgcagcgagctgcccagcaccggggaggctcccagggatgaaaagccgcaaggcgtatggggcggggcgggggggcttttaacaggaaggtcagccagcacatgtaaaaattgaactcagaggctggacgcaggggctcacgcctggaatcccagcactttgagaggccgaggcgggcggatcacaagatcaggagatcgagaccatcctggctaatacggtgaaactccgtctctactaaaaatacaaaaaattagccgggcgtggtggcgggcgcctgtgatcccagctactcgggaggctgaggcaggagaatggcgtgaacccgggaggtggagcttgcagtgagccgagatcccgccactacactccagcctgggcgacagagcgagactctgtctcaaaaaaataaaaaagtaaaaaaggaactcagaggaagggccagtgcagggaacagaaggaaactaaagcaaaacaaagcccgtgaatgttctctgagaaatggatgggatccatcctgggatgtggtcagatgagaggaaagctcttgacacttgggttaggagaagtagcaaatgaaatgaaaggatcaggtgataaagttgaggataccgcacagaagatggggcaaaaacacaaagaaactaggagagaaaaaaatcagacatcagtccattggtccaacgtccagttaatagcagagaaggagcgagcaaagcaataaagaggggccccttcaaggtgtatttaaaattttagaacacgggagaagaaatgtgtttagagaaaaagtgggtcacacacgaagcaccggagtcaaaacccactttgcctttcggcagccgcgttcaggtgtggaggctccacgcccagccaagctccatctcccggaaggcagatgagtgaggtttcctgactgaggccttggagtgcactcctccgcgcctttccaacacgagggaggcgcaggttcctcccgcccaggaagatgcggcccctggtgcaggcagcaagcagggtggaccccagctctgggaggggcctcgcaggcgccctgatatgagccctttctctttgggagctctgctgccgagcactttagggaagaatctgtgatgattccatgaaaaactaggcaagtggagaaaaaagacgattgttaatctcaggaagcaaaggtgttcgaaggaagagaagaaagaatggcctagtgtggcctcaccgcctttacctgtgtgtgcaggagcgtctcagaacagaccccgagtgtgactgagtccgctgtgtgcaggaacacaacacaacagaacagaccccgagtgtgactgagtccgctgtgtgcaggaacacagcagaacacaacagaccccgagtgtgactgagtccgctgtgtgcaggaacacaacacaacagaacagaccccgagtgtgactgagtccactgtgtgcaggaacacagcagaacagaccttgagcgtcatggaatgcacacagtgatcctggagggtggggtgcatgtgtggcaatgggaggcctggcctgaggcgctgagctggtgggaacctgaatgcggaagagcctggccccacggtcccagctgcccgggtggggtggctgcggtcatgtgttcttgcagggttcatggctcgctgagacattggatggtctgtgtgtgtcactgtgatcagatgtggatgtaaccccactgcggtggagcctgtcagggacacaggagccaacaaagcgagaacccggcggccagggtagggacagctcgacctgcaggagggtcaggccacattggatcatgacttgaagcagagcatggtggtccctgggttcacaccaccatagtgagcagatacagatgcgaaggggagaggagatgcacgtcccaaacagaggaattccaccctcgagaacgcccggctcccggcaggctgtgcagagcaactgagcacttttctctttattctttcttttttgttgttgcttttttgaaacaaggtcttgctcttttgctcagaccagagtgcagtggcacgatctcaactcattgcagccttgacctcccaggcccaagtgatcctctcacctcagcctcccaagtagctgggactacaggcgcacaccactgcatctggttaatttttaaaacacattttatagagatgaggtttcaccatgttgcccaggctggtcttgaactcctgggagtgagccactgcccccaacccatttataacattaaaccaaattatctttaagaaaagtggccaggtgccttggcttactcctgtaatcctagcactctgggaggccaaggcgggcagattgctggagtccaggagttcaagattagcctgagcaatgtggtgaaaccccgtctctacaaaaaatttaaaaattagccaggttggctgggtgcggtggctcatgcctgtaatcccagcactttgggaggctgaggcgggtgggtcacgaggtcaggagatagagaccatcctggccaacatggtaaaaccccgtctctactaaaaatacaaaaatgagccggtgtggtggtgggtgcctatagttccagctactcaggaggctgaggcaggagaatcgcttgaacccgggaggtggaggttgcagtgagctgagatcgcaccactgccctccagcctgggcgacagagtgagactccatctaaaaaggccgggtgcggtggctcacgcctgtaaccccagcactttgagagaccaagacgggcggatcacgaggtcaggagatcgaggccatcctggctaacacggtgaaacccagtctctactaaaaaatacaaaaaaattagccgggcgtggtggtgggcgcctgtagtcccagctactcgggaggctgaggcaggagaatggcgtgaacccaggaggcggagcttgcagtgagccgagattgcaccactgcactccagcctgggcgacagagcaagactctgtctcaaaaaaaaagccaggcatggtgtaattggactgtggtcctgggagatggaggctgcagtgacctgacatcacactgctgcattctagtctgggcaacagagtgagaccctatctcaaaaaattaaaaagttaggtgaggctgggtgctgtttacacctgtaatcccagcactttgtggggctgaggcaggcagattgcttgaggtcaggggttccagaccagcctggccaacatggcaaaaccctgtctctactgaaaatacaaaaattagctggtcgtggtggctcacgcttgtaatctcagctacctgggaggctgaggcaggagaatcacttgaacccaggaggcagaggttgcagtgagccaagatcacaacactgcactccagcctgggcgacagagtgagaccccatcttaaaaaaaaaaaaaaaaagagttataaatagtattccattaggcacttgcactgtgattagaattacagcacaattcttgcagtagcaaagatgttataaaaactcgttcagaaaacatacgtgcttctctggtggcgttttacagccgtcttgacttggagacgtttgtcagccaggccaggtgggagggctggtcccatgcggggggtccaggctgcgtccgccgctagggccgtggctgctgtgcaggtcaccccagaggggctgggatagctgggcgtggcctcccaggagctgactgaggtcctacccagtgtggcgggggccttttcctccttgggaccctgctgttctcaggtggtacactggggtctggaagggagggagaatggagacacaggttgaggttgggtgcacacgcccgccttctcccctgggatagacgccacgggcgtccagagctgcaggatttgctccatttgtgaagtgccctcctggagtcccgaggggtggtgtggttacacctgcagtccctggacggcagggtccggccttggagcccctcctgggagctgtgcagcccgggtttggtcgcgtttctcagacgcccctgccttgctgttacagacggccaatgggaacgtggaggccaaagtggtgtgcttctaccggaggcgggacatctccagcaccctcatcgccctggccgacaagcacgcaagtgagtccggccttccctggggtgcccgcctggcgggagggtcggctggggagggctggcggggtccttcttccctagggcccatcggcatcctggcctcgtggggccaccctctgcccaactcactctggcgtctctttttctcccttccacagtgggcgggggtgtcctggctccgtttcctcgggggctgggtgaatgaagtcctcgcacgccccccggagtggtctgtctctcactggcatcctctgcaagcttgtcatggtgtggctgggtgtgggcatcattgatcgaggcttctttttcccttctatgatgacttctggagactttccaggctggtgggaccctgctgcctgcacttgccaatgtctctctctttttaattttgcggagaggcttctgttgggattctgagtagtgttttcaggaaagcagtcctctccttattctttacgattcaaacccaagtttagtaacctggctgggaggggctgctgtggccagcacagcgtgtgggaggaagccactggctgcatgggaatgccctcagccttggggacccagcttctcccccgggaacaggtgctcgcaggtggtggagtctcctgtgccgggggatgttgacttcagagccaggagccagaggcacccccacgccctccacatgctactgacacagggcctgccgagctgggccccacctgcaccagacacagtgtggtaccccactgaggcccttcatgtgtcggtgggggcaggcatgaggggcatttttggcttccactctgacacatcacctggggtgggatctgagcccaggctgaggctgtggtctgtagggtgacatttcccagtaggtgaggcatgtgactgcccgggtacccgtgtcgctggggtgggccaaggtcccacctgtaacctcccacgacccctaatggggtgaggtccagggactgtgggtttgcggtgggtcgggtgggaggaccctcgcatcttctgccccgtcccagcgctgtgggtgaggggcaggaagtcagcccaggcaacctccccctgctctgggaggggcttagggacaggacagaccatcctgccaccgatgccttgttcctgagcctttgctgggagtcggccagggcaggcgcttgtggaaggaaggtgtcccttaaccccactgccttgcccaccggacagctgggacctttcctcagcaaccagtggatgcggacgtgagctgccctgggtcagtgcagctgggccgggcccccgagcctgggtccactctggacactgggctgtggggcctgtggctggcccaaagggagctgccagttgaccatgggctttctctggctttgtgaggaactggacctcctagctctctgctcagaggaggggagcgttcaaggtggggcatggtgatccttgacctctgaccccaaagcctgtgtactccactgctgcactcggcgggctccaggcaccaaggaggagagctggggatgttgaaggtccacaggctacacattctggaggggtgtttggtgtggcccttggccctgcaggtgctgggtgccagtcagcagcacggctggcggttcttagtgttggaggctggcctatgtcgactctgcagggctggcccgctggagaagcagtggtggggagcggcctggctcgctggagaagcagtggtggggagcgggctggcccgctggagaagcagtgcccaggctgagcggccgcagtgtggccctgccagtctgtgtggcctggggagtcaggcgccaccgttgagttgggcatgtttatggctggcccagggtggatcctgtctctgtcctctggcacctgggggcacagtgtccctgctccagagagcctgtatcagtggtttagtggtttttgagggtactgtggcccccttggctgaggttctgctctcagacgccccagaggatggccttttgctggaagagccccagaaggggactccagacataacgtgattagaggtatcagagggcaggttttccagaagggcctcgttggggctgataggactgggtggagagcagtgtcccagctcgagcactggcccccccaggtacacagcacagcccctttggacggtgctccctggaaagctgcgtggcggcccctctgcagggcgttcctatgaactgagagcccagctgcagggagcaggcgtcatgggtgatgggtctgccgctggtccagggactcagagcgcggccccactcttgcctggcggctgggccttgcggtgattctgcagggcccacaccccccggggttgtgtcaatctccgtttctcctgcttctctgtgagctcatggcagccagggtgaggcccccagctgatcccagggacaggtgtgaggacactctgggaggcctctggctctcccacgtcactgcctccacccagcccctgctggggcgtccagcccacagtgcaggcctcagggtggagggtagacacccgccaggctgcactgtggcccctgtggcagagaagccctccccccggcagggctgtgagcatgaagcctttctcaggacagaatgacagggagaggggaacgtccctcctcagaggagggcgtgggggccctggagaccacagccaagagtgggagtgagggcacagcctgggcctcacgcttaggggtgtatccagggtctgagggagggttcagagtgtgaggggtgcagggtacactagccagccccacctcctgcctgggtgtttctgcctgttgagggtcttctgaggagctgtaggcccacctcgcccgcatctccgacaggctgcaccacagagccctgttctgctgaccgggacgctggtgaaatgggagtttcggagccgctgtgggctcctgtccaggctgggtcagtgctcggatggggcctggcatagggcgggcgtgaacaaaagccagcctctggtctggggctggtgtgtgggcctctgggccctggtgatgtctgagttcagggtgcagtttgctcgtgggtccccagaagtgggagcgagtgagatgtgttggcctgggatgagaggactggggctgtcctggtcggccctgccctgttctatggaccgggaggaggtgaggctcagccgccagacaccccaggcttttgaggcccagatagggccggcccagaacaggcccagcatggctgctcccagcctcagtcttagctgttggcgcctgggagggcccagaggagccaggacttcctgcaggcaccacaagggggccgcagagagcgagcagcccggctggctgtggtcccatctggggaccttgggctcagagagccggcagggcgctgagcgggatgagtggcccactggcggccggtgctgagcgtgcgaggggcggtggggagcaccactgcacgcccccattttgggtgttataagaaccctacttgggttcctagcacagggcaggaatccccatgctgctggccggtgcccggccccggtctcatctggacagcctgttctgggaagccccagtggagtgggggcaggggtggcctctggacaggggccctccacagccaggcttgtctgggctcttcccaaagaggcttggcactgggtggatgggcagccagagtggggggacgtcgaggcccagatgatcttcaaccgggtggtcttcacgccccaccgggaggcctgcggcccccgttctgccctgccccctggcggcacagccctcggtccgggccctgggcagggagcaggccgccaccctgtgctgaccgtgctgccgggtgctgtctgtctgttatatagccctgtcagtctgctataaggccggaccgggggcggacaacggcgaggaaggtaagagccggcctccgcaaggagggcgtcctcctgtctgtgtccctgggctgggggcggcagcgccgctgagggacagagtttgggcgggccgcctgcatgcctgtgccctgcgcccggccggcccggctgaggaggggccctcccttgtgtccggcccacggcccaggcttggtgcggccccggcctgagggtgacctgctggtgtgggaggtctgtggtgggctgtatggggctgtctggccacgagatggggacggacagagggcggctgcccctcgccctcctggcctgggctcttggcagccgccgactcccccgctcctcttgctcttgcctgctgcttctggggctggcccggaccttgttctccctcctccttccatcttcatgccctggggagtctgggcctttagggtgcctggacttaaagggcacgtgggcaccagagtgtctgcaggggtacctgccaaggagccgccgggccgccatagggtggggcagtgggacagtgtccggcagcaggaggaggcacgcctcccaggactgggcctcctgcgtgctggcgccaggtggggctggtggggtgggccttggtctggcagtgtgcgtctgccgcggtgctgacaggggctccttgtccttcaggggaaatagaagaggaaatggagaacccggaaatggtggacctgcccgagaaactaaagcaccagctgcggcatcgggagctgttcctctcccggcagctggagtctctgcccgccacgcacatcaggtagcccccagcagctcccgccctgggcccctcgggctgccctcgcctttccagcctgcccgtccttctcttccaggggcaagtgcagcgtcaccctgctcaacgagaccgagtcgctcaagtcctacctggagcgggaggtgaggcccagcccggcctggtctgccgcagccagtcccgggccactgtttcctctacctatgacctctgctggcctgggcggcggagacgattttccctcctccctctaggcccaggctgttctggggggaagcggggattgcgtcctgactgtcacttccaggtgtcctggtgtgtggccgcccccaccctacgcgtccagagttgtgggccaggagcttggagctctttcctcttgccactgccacccagacagccagcgaggggaggtccccctggggagggtgtggctgaggcaggtgggggcaggggccacctgagtcttcgcaggagtcttggctggtctctcctgggcggtgggcagagtcctggtaggcccaccttgggggtcactgtgattatacggtgttaccaggtgattcttatctgggggtcacctgtgattatacggtgttaacctgccgtatagcatcccccaaggcgtgacaaccaaaaaatgtgtcccgacaatgccatacatccctggggagcagtgtcgcctgacggagagcggtggcactgaggctgctgtgagatccagcgaacgggagggttgggttttctgaggccacgtgggggcaaaagcgtctggagtgtgttggttccctggagtgcctgtcacagttgcggggcacacctgccaaggggcaggcgcatctccaggcctagggcttggcctcccacgggctctgctgccacctggctggagtcttgtgacctgaacacccccagcgtgtccagtcagctcagatgcaggttgctggatgcggcccccaccctgcccatcccaggggggctcatctctgtcgtggccatcggcgctctggcatgggctctgaaggatccaggatggccacggtgtgtcccaagctcagccctgcactacctctgtggccccggtccccattcccaccacacagcctggaaacaggcgtgaagggcgacagtggctcagctagggctgtggtcgtgccttagctcagagtcatgagcaggcagagaagagcaggcagggcttggcctggggtcgtaacacatgcgtggagcatgggcagggctcgaaccctctcaggctgccagaccagcttcccagaaggctgagccacaacatgctgggcgggagcagaggctgtgggggtcgctgtgaaggcttccactcaggaatgaggagtgcccttattgacagagccacacagagagggtgagactgcagaaatgtatctgtgggcacagaaaatgtttgttagcaaaaaaggcccgtgaggaagcagcaggtgcagtgacaagcctgtctgcactgtgtccgcccagaaacggccgggtccatgcttgccggggacaaaacaggctgctcaggcaccctgaaaccctcctgctgcacgatgcagcccttcccccctttttctttttctttttttgttttttttttttttttttttttttgagacagagtttcgctcttgttgcccaggctggagtacagtggcgcgatctcagctcactgcaacctccgcctcccgggttcaagcgattctcctgtctcagcctcccgagtagctgggattacagacgtgtgtcaccatgtccggctaattttttgtatttttagtagaaatggggtttcaccatgttagccgggctggtctcaaactcctgacctcaggtgatcatcccgcctctgcctcccgaactgttgggattacaggcatgagccactgcgcccagccacttccctcttctttcttacctggggtttctgaacagccccaatatgggaatttaatgtaacaggctcagggtgagtacacttagcacctggcagaagcttgtgccactggcccctgggcgatcgtgcccctgcctcgcctcaaataaccctcactgatgaagtcctgataaacacaggctcatgtcacagataagcaagagtgcagaaacagcacacagcagtcacagacacacccaggccctgaccagtggcgcagtccggcaccaaatagaaaccacttgtgtttattaatttaaagaaacaggccgggtacagtggctcatgcctgtaatcccagcactttgggaggccaaggccgggggaatcacttgagctcaggagttcaagagcagcctgggcatcatagtgagacctcacctctacaaaagtaaaaaacattagccaggcgtggtggtgcacacttactgttgtcccagctactcaggaggctgaggtgggaggattgcttgagtcaagaggcggaggcttcactgaagcaagatcgcaccactgtactctatcttgggtgatagagcaagaccctatctccaaaaaaaataaaagatccaggcagagtaggagctgaggctgaggctggcagctggcctctggatagtcgtgtcagttcaagaggacgaaggccctgaagcatggctcgtggtcacacatggagcaggtgtcatgctggactttaaaggtagctcttgaaagaaaacacgcagagtagctttcagaataggagagacagggaaagcgggtaagggctggaaaagacgacccacaggaatcaggaggatgacctggaaacgggagggtgattggacgccaggcacacatgcagaagaaagtgcagccctggctgaggccaggtgctcaggctgggactccagggtcaggcccggacaggcctgcttcaaaaatcatcagaaccagcccagtgcaggacacacaatgccggacagcaaaaggttggcaaaggccatgtcctggaaatgccatcccagaggcagcctgggggccctggtgtgaggttgcctgagatggaatgctggcgggaagggccgcgcctgctgcgcgggtggcggccggcggtgctgagcctggaatgctccgtagcgctccagcggtggccgctcctccaaggttgtgcccagaactcctgatttctgttgctcttaaacaccttggataagttacatcttcacattgctgctgctgatagggatggctttgtagccgggcatagcacacgcctgtagtctcaactacttggaggctgaggtgggaggatcacttgaacccaggaggcggaggccacagtgagctgtgattgcactgctgcactccagcctgggcgacggagcgagaccatgtttcgaaaaaggaaaataagtctgctgggcgcagtggctgacgccagtaattccagcactttgggaggccgaggcgggtggatcacctgagctcaggagtttgagaacagcctggccaacatggtgaaactctgtctctactgaaaatacaaaatattagctaggtgtggtggtgggcacctgtaatcccagctacttggaaggctgaggcaggagaattgcttgaacccgggaaacggaggttgcagtgagccgagatcacgccattgcactccaacctgggcgacaagagcgaaactctgcctcaaaaaaataaaaaggcaaataagtcatggtttttgggctgtagccgtatccaccctgccttggtaaaggcttgtggagcctggccccacccctgcagctgctcattggccctgcctctgctgaccctcggcatgtctcctccgtgcagtgtcatggggcaggtgcatcccccagtgaccctcgaggccccgctgtaggctcctcccaggcatggccgggagctgtgggggctcctgcgccctccctccctcctgcgcccatgtcgccccacaagagctctgggcaagaccctcccagcagcccggccgtgctgacgcctctctgaccctcccagcagcctgactgtgctgacgcctctctgtctcctgtggtgttttccaggatttcttcttctattctctagtctacgacccacagcagaagaccctgctggcagataaaggagagattcgagtaggaaaccggtaccaggcagacatcaccgacttgttaaaagaaggtagggtgggccgccctgggcatggagccctctgtcctgtcctgtcctgccgggtgacacactgggtgagaggaggctgggacatggccgtgtcagtgattcatgtgtgactgggggcggcaggtgtaggcctgggctctgtccacatgggtgatgcgtgtaggctggtgtcccggagccttcccccacccactcctggtggtgttggggttctggggaagcctcagaccctcaggcaggacgtggtgatcagctgtccttgcacagtgacacctggtttccttctggcagttgtttttctttttcttttttttcagacggagtctcgctctgttgcccaggctggagtgcagtggggtgatctcggctcactgcaacctccgcctcccaggttcaagcgattctcctgcctcagcctcccgagtagctgggattacaggcgcccgccatcacgcccggctaatttttttatttttagtagagacggggtttcaccgtgttggccacgttggtcttgaactcttgacctcaggcctcccaaggtgctgggattacaggcgtgagccaccgagtctggccttggcagttatttttcattactttttcttttttttggacaaggtctggctctgtcgcccaggctggaatgcagtggtgcaatcacagctcactgcagcctcgacctcccaggctcagatgatcctcccacctcagcctcctcagtagctggaactacaggggcaccaccacacccccctagtttttttgtatttttattagagacagggtttcgccatgttgcccaggttggtctcaaacccctgaactcaagtgatctacctgcttcgacctcccaaactgctgggattacatgtgtgagccactgcacctggcctcattttttaaagttctttttgcctccagaaattttcttctgtgtgaatctgcccacgtttcttgtcttgcctgtgggtgccccacccttgaggcctgctggggccgtggagctccgacgcagtgctcaccccggatgctggcagcctcctccctccaccgggtgcttcggtagccctggtgggaggtcctggggctcactgtccccttctcagccctgtccctcatctccccgctgggcaaggccgcgaggctgccctcgagacgcagggctctgcccccgagggtgggcggggactcgcctccctgcttgcagttgtgatcaaggcgtttcgtgcttgtcctgttttggtttgttttgagagcgggtcttgctgtgtcgcccaggctggacttgaagtcctaggccccagcgatcctcaagcctcagcctcccgagtagctggtgctgtttcgtgttcttcttgattgtccgtaaggtgctggtgcgtctcacaggtggctgggtgtgccacctcctccaggcagctgtgggctccagcattgggctcgtgggcctgctacattgcaagcatctgtgctctgggaggtgcttggcagtgggggaagacccccacatctctccaggcagacagggcacattgagggctgggcctggggaggaggcctctgtgctgaggcctgtgggtcggagcctggggaggccgctgtgctggagcccggcctgtgggtctaagtgtggggaagtcactgtgctgaggcctgtgggtctgagtgtggagaggccgctgtgctgaggcctgtgggtctgagtgtggagaggccactgtgctggggcccggcctgtgggtctgagcatggggaggccgctgtgctgggtctgggcctgtggcctccagggtgccctgctatcatgccagggtctcccagcctggggctgtcttgcctttctggcctggccaaaggtgaaggcctggcagccgcacccaggtggaaaggcagagtccgtggctgggagacaggtgagaacacagatcacatgagggccagagagtgaggagctgtctcaggtcagaggccctcagctggcgcatctgtaccttcagcctggggccagtgggcctgtcaggagaatgggccttgaggtgcccccatcttaccatgcacacctggagagacctggcggagctctgcagggtctggggcgatgggactaagggtccacaaggccgagccagccgcaggagccggcctcctctccccacgctgccttccccgctgccctgccgttccttggcttttgggccgctggtgcaaggaccagggatcccaccagctggtgtggggccgggacgtggcgtccagagctttccccacctccgagaggctgtgtccctcttgagtgatggaaaattgcacactagttgtgcacctgcctttagtgagtttgaaatgtcaaagggagtgcgaccatcatgaccagcagtgcgcatacacggaggcaccatggcttgtgtgggtcacaccaaggctcagcttcttggccgtcagggagctaggccccagcttccccagggtacccctgagccaggtgaggagtccacaccaggctgaagaccccccagcccgccttgctggttcacacagccccagtccctggctgaccccgtcctctgagtctggccaggcattgtttcctagaggccgcatggcctgaccctccctggacacatggcccaggatgtccggcccttggggcagggtctgggagccagtgccccttagcgagggatagcattttcttggggactttctagtctcaagagctctctccatgctggacctgcagccgggcgccccagtggagggcagccccgcactccgtggtccttggtctggaacctcggtgctgcccagggctggaggggagctgcttgcagagtctgagcctggcaccctgcactgagctatggaggcggctgagaggtggacagaggacaattgtggagctctttctccaagtcctcccccaggagtcaggctcagccatgctcagacacacattctcctgagggtgtctcccaacaccacggtcttgttttttggcgagtaaaaggctgtttcgtcagaaaccctcctggccctggccgactgcaggcgtcaggtggcctcttcaccagccttgagttctccatcgtcccagctcccagaagacaggaaacaactggtgactccagaggcacgcccactccctggcccccggctctggctgtgccaggcttagccgcagctgccccagaaccccctggggtggaagaggggccaggagggagcctgtgcccccagaaggtccctggaggtggtctgcctgctgctgtgacgtggcagggccctcttgcaacagcatgtgaacccaagtatctcaaaataaaaagcttgggccgggcacggtggctcacgcctatgatcccaacactttgggaggctaaggcggatggatcacctgaggtcaagagttcgagaccagcctgggcaacatggtgaaaccccgtgtctactgaaaatacaaaaattagctgggcatggtgtcggtgcctgtggtcccagctactcaggaggctgaggcaggagaatcgcttgaacctgggaggcggaggttgtagtgagccaagatcgtaccactgtattccagcctgggcgacagagtgagactccgtctcaaaaaataataataataataataataatataaataaataaataaaaaggcttgatttaaatttacaaaccaaccttcccatctcttgtggccacagttcttggagccctgcattctgggtgggctgggaggccccttgcgtgtgcaccccagccccgggttgagaggccactgtgtgcctgtgtgtgcaacagcctccgtccagccttgcaccctggcctcacctatggggccctgcagcccttccccctccccgtcccagcagctccccgcacccggggaggagaggcgcggcccggcgcgccgtgggaccccgtctcagaaaggccacacttcctccctgtaggcgaggaggatggccgagaccagtccaggttggagacccaggtgtgggaggcgcacaacccactcacagacaagcagatcgaccagttcctggtggtggcccggtgagtcctgctcctgggcaaggccagcaggggtggtgcctggagcttctgttctcccttccctgtggtgggtgttggggacgtgacagtcttggatcccatatcccaacaagaagcccatgcgctgcagccctgagacccccggtagcagttcccagagaggctcgggagtgctgggtccaggcccttcattaaatagaagggcggcccttctggggggcaggcctgtgtgcctgcccatgtgtccctaatggggctttcccaggatgggccagaggtgctttcccactcctgggccactgggagcaagtgggctgggcctggtcatggagcagagcagctgcagcccgggcagacccctggggcagggcgaaggccgaggcccaggagaggaccatgcaccttccctgccagcagcctgggaggtggagaaaaccccaaaagaagccccaaggcggctgccaatctatcgggatgccctcagttagacgcacacgggttctggggtgggtgccgggccctactccgcagcctggggcccaggacacgaggagtcctcgccacctgcgggctgctccctgcgatgctcatgcagtctgtccctggtccctggcgcctggggagctgtgtgcctggggggagtccgcgctgcccgtggcccctggtccctggtccctggggagctgtgtgcctggggggagtccgtgctgcccatggcccctggtccctggcacctggggagctgtgtgcctggggggagtccgcgctgcccgtggcccctggtccctggtccctagggagctgtgtgcctggggggagtccgtgctgcccatggcccctggtccctggcgcctggggagctgtgtgcctgggggcagtccgtgctgcccatggcccctggtccctggtccctggggagctgtgtgcctggggggagtccgtgctgcccgtggcccctggtccctggtccctggggagctgtgtgcctggggggagtccgtgctgcccatggcccctggtccctggcgcctggggagctgtgtgcctggggggagtccgtgctgcccatggcccctggtccctggtccctggggagctgtgtgcctggggggagtccgtgctgcccgtggcccctggtccctggcgcctggggagctgtgtgcctgggggcagtccgtgctgcccatggcccctggtccctggcacctggggagctgtgtgcctggggggagtccgcgctgcccgtggcccctggtccctggtccctggggagctgtgtgcctggggggagtccgtgctgcccatggcccctggtccctggcgcctggggagctgtgtgcctgggggcagtccgtgctgcccatggcccctggtccctggtccctggggagctgtgtgcctggggggagtccgtgctgcccgtggcccctggtccctggtccctggggagctgtgtgcctggggggagtccgtgctgcccatggcccctggtccctggcgcctggggagctgtgtgcctggggggagtccgtgctgcccgtggcccctggtccctggcgcctggggagctgtgtgcctgggggaagtccgtgctgcccatggcccctggtccctggcacctggggagctgtgtgcctgggggaagtccgtgctgcccatggcccctggtccctggcacctggggagcggtgtgcgtgggggaagtccgtgctgcccatggcccctggtccctggcacctggggagctgtgtgcctgggggaagtccgtgctgcccatggcccctggtccctggcacctggggagtggtgtgcctgggggaagtccgtgctgcccatggcccctggtccctggcacctggggagtggtgtgccttgggggagtccgtgctgcccgtggccgctggtccctggcgcctggggagcggtgtgcctgtggggagtccctgcttggccgacactgtggtcagcgcatctcctttccccagctctgtgggcaccttcgcacgggccctggactgcagcagctccgtccgacagcccagcctgcacatgagcgccgcagctgcctcccgagacatcaccctggtaagtgggcccagggcgggacaggtgagacctggggtggcccatggcccagagtggctgcgcccttcttcctaccagggcccagcacctgccccaggtattcaggacccctgcagaggtgctgtcccacctggactggcctttcctatccaccccaaactcggccagactgtgctgagggtgcagggagggttgtgctgctgggcctgcagtaggggatccttgaggtactgagggagggggtaccgtgccacaggtgcaggaaaagccaccttggcccgggtgaccctgctgtctcctgccgcagttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttgtgagtaccgtgggtggcgatgggggagtggctggccatgcccatctccaggtaggctgcgggggtgtgggctccacatcccactctgccctgagggagcctgtcctgcaccctgattccctgtgcggagctgcatgagttctgtctcagctgcgctcggccgccatagtccttcctgtcacactggttcagcagacaggcatgggggcgctggtggggcctgggcatagagagccatgctcctgccaccattgcgtgatgaggataagggttggcccaggtgacggaggccagggtatcctcacggagactttcccttccttgctgccccctccagccccaggcttggttttgctttgtttttgactaagctgaacctcttgactcctcatgtccttgttttctgtctcacgtgagtttagcccagcagcaggcctagagagtcttcatggcgtggggtctcccttccctgtacctccacctcaggacccccaccctccaaccgtcagccctcctaaaatacttctaaattaatctgttagaagagcatccctatgtgggggtggtggggcccccaaccatcagccctggggaggtggagactgtggcagggcagggaggagccccaaaggggccgggacacagcggggtggctagtatctgatgaaagcaccatccgggcagcagcgcacaggccagcgcagcagaggctggagacgcatctggaattcggaagaaacaaacatggggttgggtagggtgcctagacctgaagaggaggagggacagcagccagctgtgaggctcctgaggacgcatctgctgggggcaggagtgcagctttgtgtgggggcctctggccaaggggagagcttggccgggcgggaggagtccctgactgtccctggggccagcggcctctccaaggcggatacggatctctccaggcttaaaaacaaaccaagatgagcagaacatgttcagacaagaggacgagggctagaaacaaaattcaccaactaggctcagaccagggcggaatttgagggagaccctgctgcacatggttccagcggaggagaccccagtgctgagcccacgtgatgcctagcgaggcagcgctcaggggactgcggctgcggggccatgcccaggcacggtctcggggggctgcggctgcggggccctgtccaggtgcggggatgggaggctgcagcttcggggctgtgtcgagggagcaggccccgctctccttcctgccagatgcagtggaccagactgaggaactatctgaacccttatttaataagacaggtttcttaaatccatgccacagcccgggcgcagtggctcatgcctgtaatcctagcactttgggaggccgaggcaggaggatcatgaggtcaggagatcaagaccatcctggccaacatggtgaaacgccatgtctactaaaaatacaaaaattagtcgggcatggtggcaggctcctgtagtcccagctactcgggagacagaggcaggagaatcacttgaacccccgggggtggaagttgctgtgagccgagatcgcaccactgcactccagcctgggcgacagtgcgagactctgtctcaaaaacaaaaatggctgagatggccgggcatggtggcttatgcctataatcccatttgggaggccgaagtgggtggaccacttgaggtcaggagttcgagaccggcctggccaacatggtgaaaccacgtctgtactaaaaatacaaaaattagccgggtgtgttgagaggtgcctgtagtcccagctactcaggagacagaggcaggagaattgcttgaacccgggaggcagaggttgcagcgagccgagattgtactactgcactccagcctgggtgacagagcgagactccgtctcaaaaacaaacaaaaaaaaggctgagatggaggctgggttgtcagtgccacctcggcaagatctcgaccttgaccttgtgccagctcctcttcccctggcgtcactgtgttttggcatctggcggggggacctgcttcatcagctgccctctgcacctgcctgccagcaggggcctggcctccgtgcaccaagcacacctcgccctctggcctcccgccccctctgtggccttctggccgcagccctgcccctgcctgcatggtgtgcctgcctcctgccccttcctgcttgtgtgacacgcctcctcccacccagctcccgtggaagtcgctgaccagcatcattgagtactactacatgtggaagaccaccgacagatacgtgcagcaggtgagcccgcccgccactcagtgcccggggtgtgccgcctccccgtcctgcgccccatcctctcccagcaggtgggcgtgcactgctgcagcaggaggggaaggaagactcctgagtccctggcccggctgtcctctccgtggtgctctcctctccgtagcctccagcctgtctgcactgcagccccaacctgggcctagcctgctgacctctgaccttctcttttgttttaagaaacgcttgaaagcagctgaagctgagagcaagttaaagcaagtttatattcccaactagtaagtgtgccctcacagccgtcgtcctcgtggccccgggggccagggagggtgggcacagggtgctggggccaggcgggtcccaaggaaactcaagctcagaggctgggaaagttggggcagcccccgggagggcggcccagggctggggggttctggctgcagacgcagtggccatgtctctgtcgtcctggcctcctggtcagtaagggggcattgggattccagcccacaccgccagggttcagtccctgagctgggctccatgctagggggagcacgggggcctggagaacggctcagacctcagcagtggctcccaggaactgaaaggggagaaaggaagatccctgccgaggccgaggggtgcgaggacgtggttctggacaaggggtggtcagccgcggtgcctgctgggcacatgggccctcgaggtttgtgctcctgcaactcctctcgtctctcctttccctctttaagtaacaagccaaatccgaaccaaatcagcgtcaacaacgtcaaggccggtgtggtgaacggcacgggggcgccgggccagagccctggggctggccgggcctgcgagagctgttacagtaagtgccctggatggccgggggcacaccgcacgcccgcctgtgggccgtggtgcctgcgttggccctgagggctccagcatggcccagcctgcaaggggcccactgacgatgggggctgcgtcccaggggtgtggttgggagagcctcggggaacgtgtgggggtgcctggcgggtgggggcggccggcgtgggggtggcggggaatactctgacatcgctggttctgcttaagaatccgtctatttccaactttgttgtccgtagccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatggtaaggggggggacacccgccctgcctgccatgagcctgtcggccacgcgggtcctcggcccccggtcatggcgctgtgttggggcggttgcgcccccttccgcagagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgtgagtcaccccaacgccccgcttactctgttcctgcgggtggtggggagagagcagcaaccttggggcccagcctgtagccccactgggagttctgatctcagggagccccacgtcctcctcggtgctgacatggccgagcccagtgagggctcccaggtcaaggcgcaggcagggtcccgtgctcccctgggggtgccccacccctcacaccgtgtggtaccccgcaggcacggcgcggctgcccgaagcctcccagagcccgctggtgctgaagcaggcggtacgcaagccgctggaagccgtgcttcggtatcttggtgagcagccaggcgtgctggggggctcccaatgctgcctgcaggcagcttctcacccaagctcatgcactggtgctcccagccttctctagctgggagctcctggacagccccccagggcctggaactgtccttttggggtactctgcaccgtgccaggctcaggcagacccactgggacccaggctgctccctgctcctggggtcgtgatggggcccagtgcggagtagcggccgccctgtcttctgcggggccagcctcctcaaggcacacccgggggcttccctgccagtctcgctaccctgttccctgtgttctgatcgtccctggggcctgagggtctggggtttaggtggtgcacacccctgcctgtaataccattaaggcagcgtcgtacctgctgcctgcagggagtatacttcctgagccacgcccactccacaggggcagcactcaggcctctgcacgccctcggcagggggaggagcagcctcaggcggcagggggttcctttgcctttgagcatctgaggacacccgagaacctcagccggctaccctggcccagctggaagcagcttggtggctgggccagacatttgtggtggcggtggggggcctcctccatttgctgggctcgagtgggcttgtgcatctgccctcccgacacagggtgactgtcctgagaaggacattccagagtcatgagccaagtgtgctctgagattcaagtggctttggcattgctccctgtttggggttgtggcccctgtcctgtgggaagaggtggctggtgtcagggctggtcctcagcagctgtgtccctggccaggctggctggatggttggttcgctgtctgacgagcagccagccctccaccagcagctccgggggcctggacgtgggggctgtttaataggcgtgctgtgctcacgggcctgtgtatggatcctgttgtcccggggctgaggggcctggcccccgccaggtggtctccctgctctctggaagccctggggtgcgggactggcccgggcacacgccttgccgagggcttctgggcttctggttctgtggtgacctccccacttccagcccagtcaggatggggcctcgggtgggggccgcatggggcttagttcctgggggtatcccggaaccatgagggctggagcctgggcctgcctgcccctcccctgctgggcagaggcaactcgttctgcctgtgtcattcccggcagagacccacccccgcccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggtgagtggcccccccgcccggtgagtgtggccctccccgcccggtgagtccggcccgtccccgcccgggcacccgccgtgcgtgctgacgctgtcttctctccctctctcccaccccggcgctgccaggcaacatgaagaagcgcctcttgatgcccagtaggggtaaggcctggagccgcgggcgggcgctgcgccggccccgcccgtgatgcctgtgctgtgctgctctgtgtccccgcggcgggcggcccagggcccatgcttggggcagtccacgtgagccaggccacagcccagttccccacattcctcccgacatcactggtcccttggtgaagaccccccgagcccaggcatctggccctcggccccctggccccgcctcctgtcagtggactgtcctggcacgtgtggccctggcgcccctgcctgcgctgtctgccatcgcgctgtgactgcccgcatgctgccagcctcagctcgtggggccgcccgtgctgtgcctgcaatccttccgtgcgcctgccaggcgggacagtggggagggtggtcgggggtgtctgtgtgggccgtgggcaactgagcttgtacacatgggtgccttctgtcggaggactggctcaggtgctctgtgccggttgcttggagcaggggctgcgggaccccaggccccttggggaagagcagataggaccaagcctagcatgaggaggccaggtgtgtggggcccgggtgtgcaagtgctgggcctgccagtgtggatgtgcctggagccccttcgccaggcggctttcactgacggtgctggccagggcagcagggccggtttggcgacctggaggtggatatgggtagtggctgcccagcccagccaaccctgtccccttggggcattctctcgaggctgctgggtgtcctggcaggcacgtcctgtggggtcagcacgccggctgcagcgcagggtgggcctgagatcgggtgccgggccccccatctccacctgtctggacacgcacccctggcctgtccttgcagcttcctcccgacatcccttggcggtgtctgtgtctcggccccagccccagccctcctttcctggggcaccctcccagccatctggtattggggctgcccccattgcctagtcctgggcccagggccagcccactctgggctggctttacttgtctgttcctaatggcagggcgtcccaggaacagccccataagagctggtagaaacaggagggagtccttgtcagcaggcatcttcgagctttttgttttgttttgtaaaaagcggttaaccagcaagttacataaaagcttatttgttcccactgaattttccacacctcacacgtgagtcccagccatgcagtgcttgtgagggagcatcaccccttgccgcctggctgggcggggccctgggctcagaggggtcagccacagaggaagcgcctgtcctgacgtgtagcggccaggacctgggcgctggagaggggccagctgggtgaagacggctcccgggggcactggcgcacacgaggtggggtctctgtccagcctgggtaggcatgagctgagctcgagtgagggccctgcctgcccacagcacggggccccagcgctctaacccggccatttgcccgtgcagcctgttgcgctgtccccacctgcggggcctgcagatggctgcgtgtggctcactaacctaaagcatgtgtttcttccctctgctgtccaccgctctggtaggcacttacctgggtaagtagtttttgtgctactggccagccctgggcgctgggccttggcttgtggcaggtgccctgaggtatggctgttcctgcttgggagcgccgcagatcaggcacctgggcccccacctgaccctgcccggcagagctaagcaaactggcagggaaaggctgacccagggctccagggccccagttggcccccaggggagtgccccaagttaggaggcaactgcaggtggggaggggctggacaggctgcttctgttccttaagggatgggcctcagctaagcagcgtttctggagctggcaggttgctccgatgcccctgggccctggcacctgactgagttgagtatgacatcctgtcctctctgagctggtcctgctgggagccgagccatcctgggaccagctcccacatgcacacgcccacacctacacacagggcagtggggaagggcagtgagtgggggagggcagcggcggtcctgggcccagctgggggtgaccaggagcatggaccccgcttcttggcccaactcccgcagtgccccttgggctcctcaccctgcactgtgggaagtcagaggcctctggcaccccatccccaagcacatgccagggtggctggggcccagccagggcagtgggtggtgacctgtttctggccggggctggcggctctctcagagccttaggaaaaagcccggcctcctggtggggcagtgccggccacagcgtggctgccctgcagaggggcttgtgccgctgctggactgacagccttgcgaggctttgcttgtctcggcacggcaggcaagtgggtggacagccccggcccctgtgcagggaggtgactgtcgggtccaaggctcctggcctcctgcctggagcccaagccaatgtgtctcttgctggccagagagctgtggggccaccaggcggcccaggacccggggatgcgaggccccacgtcccccaggcccatcctgggtgtgggctgtggcttggttggcagatggccccggcccattgtcccaaggtggctgaggccgtggtgggcggtgggagtgcaggacgcgctctctcggggcctcatttctctcctccatttctcatcaggtctggcaaaccacggacaggccaggcacatggtaagaggaacaacccatgatggggtacggtgcgctcacccatgagctctctggggtgttgggaagaggcctggccagccctgccaggtgccacgtggaagcttccaggaggcctggcaagaccagaggggctgcagcatgtgggggccatggcccctgtgccaggcccagcggtgtgcggccgaccagccctcagggctgccctgggccaggctgggggtccgtgtaactcactggggtggtggggggttggccaggcacagcacctcccagcgggagccctgcaggttgaggtggagctggcccttggctggctgcccaggaagtgcaccccctctgcagggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggtggggccttcccagggcaggcgggagggctccgcacagcgtcccggccctcaccaccacctctgcccacaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaccggtccttccctgtgtcttttgttcccagtccctctccctgactcaggccctgggccccccacccccatcgggcggccctaggctgtggctctgccgtggagctggaggcccctggaggccacctcagccaggacagccaccccagcctctgggctctgttgctctcccacctgcccacagaccttcccctgctggggcctggcgcggtgccctctgccctccccagggggcagcaagcggttgcagggcccaacccccttccccagcagagctgtgctgaaaccgtctgtgcgtctgtgtctgcggcagcggtgggccggggactgcctcccggcaggcagagctggccctgccgaagaccctgtggcttcccaccagggcagccagtgcagctgggccagcgaggccttggagtgctccagccagaggcccaacctcctggccatgtagagcctggccccagccgcctgagggtttctgcccagagctctggcccccaagcaggtgtgcagtctccacagtgagaatctgcttagatttctgcaagcacattctcagaaatcctgcttggcccatcctccggccggggacaggacttgcaggccgggggacaggtacaggccgggccaccagaaggaggggtccggtggatagcctggctccagaccacccccctggccgtgctacctcagccggccaggaggggtccgcccaggcctcgctcagggagagtagctcctctgtctctccccagagctgtgcctttgctcccccagcccacccaggcgccctgtcatgtggaaatctcagccacggaattaaaatagaaaccacttctgctgtctcccaggagacaaagataagggggcgtcctggcctccgtgggagcctgtgctggggcccagcagtgacaggactaggtgtcagggactcggctgcagtgcacgtcccacccaccctccctgggctgtggcgcccccccacccaaccccagcccccaccagccaactctaatctgcagccagcatccgagtgaccccacagcctgaggacttgcctgtagtgcgtcatcagacggctgggaaatcaggcccctgacctcatgaaggacacagctccctctgaggccttttccaaccctgggggtctggagctcagtgaagaccccagctcccttgtctcccttccccaggcctcgggcttgcctcccagtgctggctgcagggttctggcctcagcagctcttccaccccccagggcctgtccttttctggagtcaacatgtgggctgtgaggtgtcctaggtcctgggctctatcccaagggcagggaggccctgaggagatgtggggccctttcccaccccagacaccctccccggccagacacccaggctgcagtgccctcacagggccaagctctggccaccggtgctgggtggggcctgggctgcttgtgggtctaaacctgggcttagaagtgagtgggtaccggctggggggagcattggccttggtgcccaggccatgaaggggtctcccagctttgctatgtcctcgttaggcccttccctgctgatgagacagcagcctgctttctgcaccagcaaccccacaggggccgcggctccccagggccaggggcatctcagggtggcaaggccatcatgctgtcatgcctggagacctgtcctgccagctccgctccaccctgctagggtcctctgtccaccactcagcccagcctggcttccctgcagtggagctgagtagcaggggcctgctatctgccagtgtcacaggatggcggaagggaccagaccactgcagcccaggggtgtgacccagccccatgcccagccatcagccctgccagctcccttcacacccgccgtgtcctgtgcccccctctccactcgggcccgtcccactgtgtcactgcccctgcctgtgacccaccgcagcctcagaggtggagaccaaggccactgctctgcacccattgatcctgacccctgcctgccaggcccagaatagccccgtcgcattagggagcttctggccgctgcccagggactgcggctggggtgagggcagtgcagcagctggcacactccttgtcccaccccaccctccgtgtgtctccagggcacctggccagtgccgaatgccattcctttgctgccaccctgggaggggcctgcctctacccccatccactcttctggcagggctggggaccttggggcaggtggtctccctccagaagagccctgtgttcagccagccctgtcctccagagcaagccccacaggtagcaagccccacaggtagcaaagtcagggagggtaatggcttagccccaggctcccaagctgggcagaacagggcagggagctggagagggtttggcagtgggcccatgaatccagcctgggcaaggccctgctgtgagggacccctagggacccctgggcctgccagggaggaagggctgcccagaaaaggtactgactgatgcctcctcaccatcttctgccttggctggcacaggtcccaagtgcagagggggagctggtcaggctggtcagtcgggcgggggggcggggggcatgtttctggcctgctgtcaccatggaaatggcagtggctgcagggtgtgtgtgcaagggaggagggtgctgccacagagagcccagccaggaccaccatgaaagccaggagcaccgagggcctctggttggctcacaaacatgcctggtgcaccaggcagagggaacaggtaggtctccgtgtccagcccacagcctccaagacacagggggaagggtgtccagagtcagctgcccccatagggcctgatcactgggcttctgggatctgcctgtctcccaggccgacgctcagctggggccagaaggctcagagaagggcccatggggacagagcaccaggaagcccgtgggtgcggaggttccccacctggggccaggctctacggggctctagggcggaggcactgtggtgaggcgtggtcaggcacgccctggttgggaggaggccagagtgggggtgtgggggtgcggtgactggcatgacccctcaatctcccgcctgacccctcgaggtcaggccctgggcccccaggcacgcagctggtcctgggcggtgcgggagaagggactggagtgtcagccccagcccggggcacagagggcacgcccactccttcccctccttcccttcctaactcctcaccgcctccccggccgccccctgggtggaagtgcttggggtggacgccttaagcgcggatccctcggcgctggtgcccgccgccccttccctgcctgggaggcagacgcagacctccccacaccccctaccagcagcttctcgagctgtttctggaggtggcggcgccttccttcctgagccctgccctccacccaaggagccttcagcaccacagacagtgttggggcggggcgcgggcgggggcggagcgggacatggagacccggacagggctgggggccgtgcccgccgggaatctgactccgctcccgcggcgcggctgttgctatggaaaccgagcaacaaagggaagcgggacaggcgccgcgcgcggcggggtgggggtggggttctcccggagcctgcgaccccttcccgcggcggagcgcagcctgggcgcccagggccgggagtgttggacccctaggcccaagtcactagggctccccgagagccgagggccaggctccccgcaccctgcccgccgccccggggacggcccggccaggcggccccgacgtcgccatggaaacagccggggcgcgggcggcgccgcggtcgcccgggcgggcccctgtagacgccacctccggcgcgaggggcccgggggcgccaggcctggcccggctgccccgcacccgccacccccggcaggtgcgccccgcccccgcggcgcccccaggcggcccccagcccgggggacgggttatcgaggccccgccccggccgcggagccaatgggcgcgcggacagccgggcaggcggggctgggcgcgggcggcggcggcccggaggagaacgggcggagggcgcgggccgaccgggcgcaccgaccatggcctccaaatgccccaagtgcgacaagaccgtgtacttcggtgagtgcgtgcccgctcccggcccgctcggtgcatcccgccgcccttcgcggccagtcccgcgccgcagagccgcggcgtaactcggggtgcgcccggccccggccccggaccgaggatgcgcgtcccggaggctggctggccgcgctgcccaagcggctaaagccaaagggtggggctgcgcgaaagcgggggcggtcacgcccgaaccccgaagcggcttgtgggggcggggcagggaccacccgggcggggcttgtggtgccccgggatgaggccagtgtttgggggagcgctcggggatccgcggacgcatcccggttcctcggacggcgccgggcggggcggggcagggcgtggctgtacgccccgggtgcgtcccgcgcgctcccgtgggcctgggccctttctcctggaccccctacacccgcttcccccgggaacaagtggccgggaacagtgacccccagctcccactccgggctccgctgagctgggctgggccaggtttggactctgtcgggattcagtccaagcgggggcgaccttggcctctgcctcctgcttgtcccgacgcattcccttggcgccagttcccccaggagtttcacacgggggtagggtgggggcgggtgtgacacgcgagttcccgcgaacgtgagagggaccttgtgctcaagcagcccaggtgtccaggatccctgcctcctcaaggtcagaacagccctggacaggatgcaggtggtggcgggaagagggatgtctcgcaaggcggccctcggtctagcccctccggcaggcgcgctccccccgtctgggcttactcactctctgggcctgggtgcgcccttcctacccccttcctcctggctgattcgctgcccagctttctccagggtggtaaggtccctgcccacctacccaccagctgctgcacgaaggggggcagacttagtgaagcagagaggagggccgggaccaacagggcgcctgccctggtcgccccatacccagaatgcggccaggctgcagggaaggccgccactgggcttccccggctcacaggctggagggggttgaggggaggttgtattttgcccgtcccagaggggagggaccggatttggcctggagtgcttctggcgtggctgggagccgaggggcttccggctgcctctcctggagcccgctcagccctcagtctctgtcccagcgagggctgtctctgtaaggcttagggtgggagacggtccccagggcccttctgcagtccaactgcccatgactttaccccaggccgggccaggccagcctggggctctccagggtctcggccaacagtcctgtggacagcccggaaaggcctgcctgcctggcccgcccagcctctcagcggaaaacaaaggcgcttcagacccggctggcttctgtcctgcctgggaggcactgtgagggcgagggtccagaatcctgcccaccctcacaccaggctgcccccgcagctcatacctgagtagaacccaggctgggatgtcggagcacattgaggaggccaccccagagcccatgcagccagggtgggcagctggttttcttctgagccattagacccaatcgattctgtgttcccaactcggacccgtaatgtgtggccattgacccacccagtgggtctgagggccagttccctgcccccacttggcccacgtcccagagctggccagagcacagtgctggcagccctgggctgcagctgccacggccgatagccaccgagacttccttgctgctgctgggacacgcctgcccaccgtgcagccagcccctgcctgccctggtgtgtcccagcttccttgagtggagtggttctggtcagagggctctaagctggtgcagccttgtggttgggctggtgtcctggaggctggccctggccatgcccagagggttgtaccagggccacggagagccagtattcacagccctctacctagtaggccacctgggggatcccatctcactgccaggagcagcacccttgggcctctcagagtgggcttcgccctagccagatgcccctccccgatatctgccagacaaagggggctgggccacttgctgagaaagggagctgggagagccactggtcctcggccacctgaggggcttggccagattctgccgggcagggtgggcccagcctgcatgctccctccccccagggcctgcagcttgtccccttcccttcagaattccggctctgctgggcccttcctgcccctccccacctcttcctgcctggctccctagggaggcccctgcttccatccactgggaagcagtccagtagccccagtgtgggggtgggaggcagtggcagagggtcccggaccctcagcagctgccctcagatcttccatgccagtggcagccaggggcattacggcggggggagagctcagggtttaggacgaggaatccacagacagatgagggtcccgcctggaggacccacggggacggggcctggccttcccatgagggagctggaggttctggggctgcacctttgactcagcagcggggtgctgccagccccatcagggcccagttggtggggatcaggggcgtgtcagtgcgaggcaggtgtgagagggagagcagcatgtgttgaagcaggtgcactgcagaggcaggtgtgtgagtgtaagagaagtgtttgagggaatgacaggtgggggagatgcatatgtgtggggggaggcaggtgtgtggggggaagcgggtgtgtgtctgaggaagcgggtgtgtgtggggggaagcgggtgtgtggaggcgggcgtgtgggggaggcgggtgtgtgtgtgagaggaaggtgtgtgggaggaggcagatttgtggggggaggcgggcgtgtgggggaggcgggtgtgaggcgggtgtccgggaggcaggtgttggagcgcgggcaggtgttggagcgcgggcaggtgttggagcgcgggcaggtgttggagcgcgggcaggtgttggagcgcgggcaggctcgagcacaggccccttcaccgcaggcactgaggggactaacagggcagccccgggccccttctcaaaggcggctctagcggggttccagggctgggggcgctgagacccagagggagaacagggcctgggggcgacgggctcctccgggtctcagaaggaggggcagggcccgccaggtggaaggaaggcgcctgggagacctcctgaaagtggggacccccggagcgcgtgggggtggtggctgccaggtgggggcggagggggtgcggggcgcgccccggccctgacccccctgccgcccctcccgctcagccgagaaggtgagctccctggggaaggactggcacaagttctgcctcaagtgcgagcgctgcagcaagacgctgacgcccgggggccacgccgaggtgagccccactgcgcggcgcgggcgggggcgggggtcgcgactcccgccaccctcaggcagggtcctgacccgcgcccctctgcgcagcatgacgggaagccgttctgccacaagccgtgctacgccaccctgttcggacccaaaggtgagctccggctgccctcggcctgccctgggacctgctgggaggggcgtggcgctggcgctggggagggctgggggtcccggccgccgtggatccccgcccagagtccctgccaccctggaaagcctagtgccccccagtccccagcgggccgttttctgagatgcccggtggccgcggcccccaccccacgtacccccgccccacgtacccccacccgcaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagaggtgggctgggcgcgggctggggctgggggttgtgggcacgcgcgggctggggctgggggttgtgggcacccccggccccgccccgccctgactcgtgcgccccacagcctccagtgtcaccactttcaccggggagcccaacacgtgcccgcgctgcagcaagaaggtgtacttcggtgagtgcgcgcccgggccccggacccccgcccccgcccccgccccggggctcggcctcactcctccccctttccagctgagaaggtgacgtctctgggcaaggattggcaccggccctgcctgcgctgcgagcgctgcgggaagacactgacccccggcgggcacgcggaggtgaggggagtgcaacggggcttgggggccgggcaggggcgcggggtcggggggatgagggtgagaggcgcgcctagaggggatggggggtggtgcttctgggagctgcgctgccctctcccccacggcgagccggcctgcacgttctggaagcctccaggtgatgggtcgggggagtctgtggactcctccctcagcacccaccttctgccccagcacgacggccagccctactgccacaagccctgctatggaatcctcttcggacccaagggtgagtgtagccagggtggtccacgatgtcttccctgccctccccttccctccactgttcccccgacccaccccagcggcctccctccacaggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaggattgtctctgcttgtgggatggatgcaaatcccagaccagggtccctttctccggtccatgcgtgctcccagccaacacccctgggcctggctgctagtgggggtgggctcttctcctgggggtcatagtgggaggtggggccctgggatgtttctgagcaggagggagggatgggggcggggagcgtggtctccggtttgggtggtggtgcccacccagatggggaggcagtaagaacgccaggctgtggggaggtaaggaaggtgggaggcattccggggccagggtcctggccagggtcaggtgagggtggggtccatggaggacagagccttggagaaaagttgaacctagaaccctgaaaataccaacagcaggcctgagaacccggagctgcctgggtgtgtggaccctggcaagcgcaggaggggtccgccctgagagcagagtgtggctgaggagggaagggggccggggaccagaggaggggtcctgggcagagaatggggaagccggcgaaggtcgggtgggacagaggtctctggcagccccagactggactgggatgcgcaggagggtttgggggctctggtcagagcaaggactggagaggctcagcgtggctgtttccagcttttgtccatagggtgatggacaggcttttgtggacaggcctgccttgggtgtggcccagggacagaatccctgcccaagtgttctggtgaaggttttagtgatgaccgactcgcccctggcgtcttcatggtccaggctctgccctttcagccaggggcgctggcggctccaaggagctctcccctcccccgcgccccgcctttgctgtgcgccactcctcgggtgcccactagagggcgcactgtcccattctggcagcacagagcagaaacgtggagaccttccccagtggctgagccctgtcctggcgccatctggacttcccaccttggtttatgctcctctgctcctggcaccacaccgaagttgccttggcccttccttcagtgaggggcactcagacctggccacctccaggcccctgtccccagtgctacagggtggccggggctttacgcctcttccctgctcccagccgttggcacagctccctgcctggccaccctccagcccatgggctcagacggagctgagcctggatgctgagcccattgtcccgagagcagccatccatgtcctggcggggcctgggctggctccggggtccagccgtaccacagctgccctccagccaggcacccagtgcggtctcctcccacctggaattcagccaaaacccccggggcctgacgttgcggaagggacggccagtccccaaccccaggcagaggggaggatcaggcaggttccagacccctgctcacaggagaggctgggatggttccccttctcatcccctcctgccaggcccaggcttccttgtgtgtgttggggggttgtttcgggagaactgagaatttccggagtgcccgtctccgcccttgctgcgggctcccagggttgcatgggaaattcctgctttcagcttggcggggcggggggcgggggggggactggagggctcagctggacccccctcccttgggagcctccagtggaaactatgtcgtgaggagagtggtgggtggtgtgcccttctctaaaacctgggcggcggtgggggatttgtgtgccagaagaccttccagggtcggttgcggggatgatgtgggtaaggggtctcctccagagatcagcccctgaccccgccagggacagcagcacccccgaccccaggtctggctggggcaggaccatttcctgcggggccggtttgaggatgacgcctgcctgccgtgtttgtttccaagtcattgtcatggaaaccggggcggttgttgctactgtttgtctggactgcgtcgctaggcggtgttgctggggttggctgggtgcccacggcactaacagggctcgcttggtgtctccagctccaggaagctatgccctcccagccgcctgccagccaggtgctcccttgggtgcccacagacccagatatcccctaaaagggaggggaatctggaatgggctcttctgcctttgggcgtgcctgcttctctgtccctgccttgggggctgctctgccctcaaccttcactctcttctacttggacctatgcctggccagtgaggcggctctgaaatgctatctgctccatccctccccttcagaacccctgggaaccaagtccagggatccacaaggccctggtgccccatggggctaagctcacaccccggcgctctgttgaaccgagctgtgccgctccccgtctgtacccccactgtccagtcttcccgtgtctcctggccaggtccctccaaggtatcccccactccaacctgggctggtggggccctcactggtgcccccagccaggcatctttgtggggccagctcagcctgcagctacccctgtctccacttcttctggcccctgcccgggacccccagcacccttcctccaggccctgcccagccagtgaccgcagcatcggccctgggtacccctgctcccagggtcttccctaattcctggaccccttcggactccacacagctgggactagcgcccctgaccctgaccctccacaggacttggtggggcacacctccctcccggccctgggtccagcttattgggggccggcggtagcctgagaggtggatgtgaggaaatcacccagtgccgtgggcccctagctctggaccgtggagggctgggcacaggcaagggcaggctggaggaccaggacggccaggtatgggcagcacttttcccagcgcctgatgggcttccggtggggatgtggggtccagctgccaggcggggaggctggaattccagcctctggaattcctgggctatggctgtaggatgctgggtactaggcccagcctcaagagaggggagggaggtcaggggcaccccatctggccagtctgtggaagccaggcaggggtgcagccccgctgggggcagggctggctgagggagcccccttcttccctctttccacaccttgccacgtctgctctgggagaggaggaactgcgcagccttcccacctgctcggggctggaggtgaggcctggaggacaggaggtgcctgtctggtaagcctgtcccatgccagccccatgccaggtctgcccagggcaggaatggccactgagcccagcacggccaaccggggccagaccacaggccagacagggggtcccgggagacaagcagctgaaaatagaccctgggaacttgggagtgtctgagactcagctgggccgagagggaggggcagggaggtgggccctggggaggcctgagctgggcgtggccggctccgcgctgtcctggcatgcatgttggcagtgcagggcacctggttgcagagcatccaggacaggcctggctggcctgcagccccgggagggcacctcacacctgcccacactctcagcctgggcatggggcaaggggaggtggtggggagggctccaaggacaaggaggggcatctcaaggcaagtccccaagctgagtctgcagaggaaggggctgtgggcccagaggagcaaaatgttcctagaggggtggacggtgggattcctcagggacagtggggcccagccctgcctcctgggttaccctggttcctggagcccaggcctggctgcaggctgccgcaccccagcccctgtgggcttcagccagagggccagcaggagcaggccagggcgcagggatgtgtgcagagggcgggctgagcagacagaggcggcctccaagatgcacccggaacactgcagcagcccccgccacccccgggtctagggccctcttgctgtccaggtgcagggtggaatgttctgggcatagaggcagcctggggcgagcagctgcggagctccgagtccctgccccgaccactctgtcctctgtttgttcctgaaacaaatgccaccagcaccctgcagagtgggctgagaggtacaggggctggggtttccagccagcccagtgggcctgagtcaggctggccccatggacgaggtcagtgccctgtcctaggtgcatccccggccaggtgagagctgacaaagcctgaggcctagtgactgggctggggctggtcgggggcagtgtgtcccggaagccggcaggaccctgacctgctcagatggaggtgggcgttgggggtgggatggcctgaacacggagtgtgggtggagaaaggagctggaagctggggtcctgcagctgatgaggggtccccacccccagagcacagggtagatggggagcacaggagaaagggggtctgaggggcatgtcagtctgtggctgaagtttaggaagggttccagggatcgtgtgtatgtgactgtgtgtgtgtctctgtgttatgtctgtgtcagtgagggtgtgcgtgtgtatctgtgcatgtgtctgtgtgtatctgtgagtgtgggtgtctgagttgagtggaaaaactgctgtgagccaacacagaaggcgtggccccacggcgagggcatcctgccccccaccccacccgtgaccatggtgacaggaagcaacagcagggaaggccaggaatggactcatcaccctggttttcaaggaggggctcctccatgggcagggtgggttggagtccagagtgtgggggaagggaccatccctgggggcgggtagaggggaggacaaggactgggtcattgtccctatctgccctggctaatgtccgtacatgagctgcaaggtaccgggccaggagctgggatgggctggggaggaggcttgacagaaatatgggcggacaactgcgagagggaccacacacatgctcgcggggaccccagagacccctgatggacacacccatacgggtatgtccacgggcaccaggcacacacgtgtgcatcaggcacttgccctgcacctctgcacccggagcacgtcatcctggtgggggtgtggacagcggtgctgggcaccctggggcttgggggcagcgcacgccccagggaaagtgcagtgacagagcccccggcctccccaatactgtccgggctcccctggcctctcccccttcttggtgcctctgcctctccctctgcttgtctgcaggtttgtcccacgatgccccacactcagtggagatggcaggtgggcccagacctcagagtgggtttcaaggctcatgggctggagagtgggggttccaagtttgcaggacaggagcgcacccctactctggaaaccttatctctgaggtctcagaatgggggatgaggagggctccaatgggcccctgtggaatgtcctatcagaccccaggacttagccccagtcgggggacagaactgtggccttagaggggcgccaggaggagggcaagcaggatgtggccttgggctgggtgtgctggtgtggggctctctggagtgtggcctctgtgccagacgcctgtgccttggccgtcctacagccctgctgcccctgccctctccccaagctggggactggtggcagacagggcagggcaggcggcttctcttcctctaagtgcaggcctcgaggtgccgacaggggtgcggtaggattcagggaaagtgaggttgggatcacaggtgcagttagggctcagggcccgacagcggtaggccagcggctcctggggcccaggaggatggtctccagcgcccccagcggggacagggccagcacaggcccagtggagatcgaggggagataaggacgctggttaacatggctgacaggagggatggtgggtggggaggaagggcagcaccgcccttgtgctgtgggagctcccagggagctccatgcagcatggaggtgaagggcctgcagagagagggctcccctgctcagtgacaggagagggggctgacagtgacctgggctcccttcctgaggctggccagtcagctagagggctgaccccaaagcccgaggccagcgcagcccccttggccctcctgaatctggggggcgggtgaggcgggacagactccgcctggcaccgggaccatcctccgcctcaactttgcagcgtacttggaccgctctggccgccctgggcgctacccgcagagataagggcccctccctgcgcccggtccgggcatctccgagccggcctgggggtggctgaactctcttttgccggccgaaaccccagcccccgcagcccccgcagccgatcggtcctcaagctacagctcccctctctgggagtccccgcttttgaattccccggggatgttcccgctgcggtccgatggacctcccagagcagcggaggtcaggggagctagcagaggcggggacgtcccttgggagtgaggggactgacaggggcggcctcgtaaccctgcgtgggatggaaggtcagagtgggttcctcggtggggggcaacagcgggggctctccggcaattgtccccgaccctccgtcctggggagggcaggatcagcgcgcgggctgctttgcatctctttgcattttagtgatgtttggtccagtcctggcccgggcagatctggggttcgggcgggtgccggtggggtagggctgggggtgggagcggcgtttcctgctgcgggtgagccttttgcctcggaactggacccgggagacatcacagcgctgggctaggggcgcggcttgaactcgcctaaagagctgcgccctctcagtaagtccccatggccccctgcccccccgcgctccgtcctcagtcaggcccgggtcctgcctgaaggcgggggtggaccagatgatctttcttgggccctgggcctagattcgaggtccccagggtccaagtcctgggttcagagggcggggcgcgaggggcggggtctccaaggggcggggtcccggggtccctgaaaggcgcggaccaggccggatccacccagtctcgcgcctgcagcccgtgccgccccagccgctgccgcctgcaccggacccggagccgtcatgcccaagtgtcccaagtgcaacaaggaggtgtacttcggtgagcgcgcccacaccggccccgcgaggaggcgccgccgacggggcgacgaggctggggaccgctcaggaggaccgggggcgctgggtccctggggcggcgccccagcctgaaaacgcctcagcctggcccgccgcctgccccgggatgagggtggaggcccctgcgtccgagggccctggcgatctctgcctgctagtggtcttgctgtgctcggcgggctacctctggctctgagcctccccgtctctgggtcctacggtctctgccgtttcctctcaggcgcgccctgagtgggggacccgcagggctggaaggaacgcggggctggggccgcgccccccagcgctaagtggaaacagacgcggaaaccgacgcccggggcgcgatcccgggcgcccgcctccctgccccgcgcccgcgcgccccgaggggagggaggaagtgggaagtcacccctgtccccgccgagaagggctgtcgcaggctccacccttgccaccgcagaggcccggggctgaaagcaggcagccaggcccaggccctgctgacctaagccgcgacccctgaccctcggcctcgccctctagccccacccagccttcaggagcaagattcccggccgcacccgaaagtgccccggggaccagcgaccccgcgctttgtttagttgtattggctctggggattggagatgttcccctcatggagggtgctgagaccttagggtgggctgccaggctgggcggatgcgggctaagtgcacagggccttgggcagagctggctgcaagaggcgggtacgccagtggtgggtaggcgccgcgtcctgcagcgtctcaccggggcctgtctgtgcctctgcagccgagagggtgacctctctgggcaaggactggcatcggccctgcctgaagtgcgagaaatgtgggaagacgctgacctctgggggccacgctgaggtaggtgggacccaccctggtggcaggggccaggggtgatggcaccccctcacggcccttctctttgcagcacgaaggcaaaccctactgcaaccacccctgctacgcagccatgtttgggcctaaaggtatgctcccgtcatccccaccccaccccaccccacagcctcctccaccccagcctgttgactttttccaccttctctgcaggctttgggcggggcggagccgagagccacactttcaagtaaaccaggtaggtaggaccccaccccctatcctgcctcctggttccaccctcgggatggggatgccccctcccagggaggcctgaccactcgtgggccccaaaggaggccgtggacgctgcactcacgtctgtgcctgtctctctctgcacaggtggtggagaccccatccttggctgcttgcagggccactgtccaggcaaatgccaggccttgtccccagatgcccagggctcccttgttgcccctaatgctctcagtaaacctgaacacttggaaaacctgtgtgtgtacatgcgcgtgtgtgctggggagtgccaagggagctgcagtggggtcctggcagcaggctctgccaccggcgcctgctcttctgctgcccattgccctccccagggggccgttccagggtctcataggcgagggctccctgtgcagggtgagtccaggccaccctagacagcccgcacccagccctggcactctgagtccgcctcgacaactcccagatcctcagaagtgcctctgagccctcctggccttctgggagtggggaaggggggctttgcaggccaccagccaaaggctcagcaggccgagaggcctgggggcgggcgaggctggcctcgggtcagagggtgaatcagctcatgctggctccctttctgagaggctctgggggagttatgggaactcctggccttcctcctttccaccccccaaccctgtcctcattccccacccctccaggccaggcccagcttctgcaagggcctgatgaggctgctctgcccctgacccaggcaccactgccccatgtgcgtcctcatctgccatctaccctgtgcccagggacttacccagtggcccggcgtccagtggggaacttgagtaccggccgtgcacaggggctggggggccttctggaaactcccttgtcaactcagccagccgctgctgactggccaccttcagagaccctcttccccacactggctacttagataccggccttggcagaaggccacccctccggacacccactggtttaaaagagcccaggggtctggccctgccttagggctgtggtgggtgtgctgcaggctcagctcgacaggtgctgtgggggcagtctagggtggcccgcagggtggggtgtgtgggggtgattgggggattcctggaattccaagagctgggagccacagcacttttgatgggatgggggcagggggtgctgaggtgaggctggtttctggctggacggtggtgggtggagctgagggaactgagatctttgagacagcgacacctggtgcagagaaaaatccgcaagctcgggggttgggagagcgctgaacaaggccgcagagctgctccgccatctcccccacgcctcctgccaagttctgtggcgccgcggttccccacctcctgctcccatccccctggctcccgccgccctgtagctcggcaggtgcagtaggcgctccgaggaggaggccccttagcttcaagaaacccgcgtgggcggggtgaggagcgcagtcctcctactggcgccgtgaaggagatcgcgatgcgccggagggaaggaggctgcgggcggggaaggacggagggcgtgcggggagggagaggaggggcttgctggggggggggccccgaggcggggccgggagggccgcctggaagaggaggtcgggggcgaaggaggccgagaagaaaggtggggccgggacccctcgggctgcgcctctcgtgggcgtgtccagccagggctgggggtccagggaggactgagtttccctctcccgccgtcctcgcagccccgggaggtgcaggggcatcgcgggaacagccccggtgacacgctgcccggggtcttcacgaatgcccggaggcgccgctggccagaagccagcccgaccttccatccccgcagacagccccacgttcctcccggcccgcgtctttcggggccgcccgtgcaggcgggcccggctcagcggcgcccgggcagcagctgcttccatgcgccggcttcctccggggctgctccgtggcggcggcagagggaagcgctgccgcgggcgggcgaggatcgggagcgcctgaggaggctgccgcgggctccggctgcgcgttcggggcgggggagctgcccgggacttcgcgccaggggccaggggccggccgcgctggggtctgcgctgtgcggcgcggcgggctctgggcgcctcctggcggcccagcctggaaggcggcgcgatggggcgaggctcgtccgctccgactgcgtaagcggccccacagggcgccttccggagtctgcgcgctcccgcccggcggttgctaggttgccaaggggcgtgaggcgctgatgggtggggtctgagcgaggcggggtgtcgggtgtcgtgacgattgagcctgcaagggcggactctgcggtgttctccatatcaacagccctgccaggagcccggaagtgggtccgcacgagacagaatagactacactcaaactccaggggaaccgttcattgggcttggacacgaaggcgggaccctgccgacgcagtgattggatgcatgtccggccagcgcggtgattgggtacaggtctcgggagcgcggtgattgggtacaggtctcggccagcgcggtgattgggcgcaggtcccagccggcgcggtgattgggcgctggacccggcccgtgccatgattgggctcaggttccagccggagcggtaactgggcgcaggtcccagccgccgcactaaacccggcccgtgcggtgattggacgcaggccccgggccgcggcggaggcgggcgatccgaaagaggctggtgctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcggtgacgctctcgcggagggcaggcgggccgggtggggtcccgggccctcgcagggagttgggccggctccgctgaccgcccgctttttattttccgcagacctccgcgctctggcagctcctcttccgtgtgctctcgccactccctgcgggcaacgccttggcatcgctcgccctgggtaagccccgctcctggccccgcccacccggtagcactggccccgcctactcctgtaaagccccgccttccccagtaagccccgccccggcaggctctagcccccacccaacactgaccccgcttgctcctcaaaactccgccttccccggtaagccacgccccctgatgggccctagctccacccccttgggtagcactggcttctgctcctacaaagccctggggacgtccctgttggcccctggtctcctcatcctggtctgagttctagctctcccactatcatctcttctgaactaggccttgagcttctgctcaagtgacctgtgggggtctctggagggatccaggtggtgtcacctccaggtgggtggtccccctaaggtggtggtcttctgtcctagaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccaggtgcgtgtgggtgagggtgagctgagccagccctggtctcaactcctggggccagagcaagggcaggcctgggtcagccccctctgtctgctttgctcctcagggcagtcccatgaagggttacccagctgcccagctgaaagcacggaggctccctgtgcagggagcacccgttgtttttggctgtgcctccactaccgtctccatcctggccttttctggggggcagggtggggtgggagcagggcctgacccttgcccctctccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaaggtagagctggcacagggcttccactcaggggctgtgtcccgtgctgcaggccgccagctgccagtccctgcagcccgtcccgtgaggcctggcacaggcttttggctggatgtgggccttcctgccctggcttacccaaagcctgagcccgtggttcccggtggtccttgtagggggcagggctgggcagggagcccagtggggtgggcaatggtgggcagaaacgggtgtcagagagctcacagaatttgcctttctgttcccaaaagttaccagtggacttccagctctgtgaacagtgggatggggtctgtgccatgaaagccactccctcctgggcactggagggggaggaagacagctcctgttgccaccacatcctggtgggggctgacttgcggggtggacagctcctgtggggtcctgaaggtggcaggggctggctcaggggcacaggtacccagtggtgtgtccactgtgaggccagcgctgacaggtgggtctgtggcagcggcgggctcccaccagcgcgggactccttggagacccccccatcccacccttgcagagggtctgttgctcagctggcctttccagggacctctcaccccgtcgggcctggccttggcaccagctgctccgcttacttatgtgcctacctgtgaccctctgtgccaccttccagcctcccttttttggggagccttccccatttccctagatccaagcagtcgttcatgtccccactgtgagcctggctgaactgctgtgcctgtccagaggctgttcctcccccgatgctgctggggaagccagggcaccccactccaatcttgctgctgcttggaagctgggcggggtggggaggccatcagtgaaattgcctggcgcccccttgcaggagaccccagcggtgctgatggttgttctgcacccagcccagccccgccaacctcaggcaaggagtggctttctctgagccctctttcctcatctgggaggtgggctctgatggccgacctccctggactcatggagactcagcgttgggggaggtgcttgactgccactcagcctggggtctgcactacctgttttagatccacctgtacacacgcggctgccacagcgaccagagccttagccatctgtctgtcactgaagcagagatgctcagggacccagagggaggccagcaggtgagggcgggcaagctgctgcgggggggtgggggtgggctggggggcacagcagggggactgcccagggtgggaggggcctgggggcggggcagctcttgggcctccagcggtgggtgtctctgcatgtctgccactgatcattgccagcctgggtgacagacagcttctctgggcctctcctagcctcatgggccactcacccttcccttccacaaatcaagacgtggcacgggtgggggcccaggacgcaggagcctgggctgggcaggcagctggctaagggcaggctgttggaataaaggaacacagatctcaggtgtgagctggtggtgttggcatctcaagcaggtctcacttggtgtgtcagggggcacctaggggtgtggggggccagcccacactgggtgaagggttgggcacagggctgactgtgggaggggacaactgcccttcagaacccaaggccaggcccacatggggtgtgctggaccgagcctcccaagctggagccagctccataggccctggagacttgcagtcccgttctgcttgctacacccggaccacccgggggcacggcgctttctaggcaggcctgcccccggcgaccggggctctgtggtcccaggcagatcctgagccctggatagcatagacctggaggaaaacctgcctctgagccccaggtggctgtgtgaccttggggagacagcatcctcctctgactggggctgctggagcactgacccaagtgttagggttgacctagccccaggcatcttccccagggatggccgcttcctcgcaccctgctgctggccttccatcctcatccttctttctgggggtctgcccgcccgtcatcactggcttcttcctcttggctggcttggtttcaggggatagggcagggctggctgccactcttttaatttattttatttatttatttgagacagagtctcgctgtgtcgcccaggctggcatgcagtggcacagtcttggctcactgcaacctccgtctcctgggttcaagcgattttcctatctcaacctcctgagtagctgggactacaggcacctgtcaccacgtccggctaatttttttgtatttttagtagagacggggttttgccacgttggccaggctggtctcgaactcctgacctctggtgatccacctgcctcgacctcccagagtgctgggattacaggcgtgagccaaccacttgggctgggctctgtactgtcctgagtgacgggctggcactgtcctgctccaggtgcatatggccgggcaggagggcagaggctcagggctggtgtgacctcttcttccagacccagtcccccttctctgcctcttccctctccaatcccagagacttggcccctgtacctcatcccaggcctgcccagggggacctaggggtcagaggcggatggcctggctcctggcccctagtcttgtgtctgctggggcttcctgctcgtagcaagggcctgtgggttccagctctgcagcccaagcctgggggattgcatgcctcactcatgggcttacagggcccaacccctgacgcctgcctggcccctggtgccagctggacctgtgtccctggctgaagccgggctggcgcccacccagtcagcctgcactggcgttggcagtgctgaggcagcatccgggcgtcctggtctgcccttgtccctacctgccttgtagaggcggctcagcgaagcccaggcttctggcccctgggacccctgggttggggcagaggagaggctgccctggccccaggctgctcctgcccagtgcctctgtgggaccaccctctgtggtgggctgggggggcctggaagtgaggccccgccctctccccgaagctgtgtgcggcactggccaggtggactggggccatggctggcttccttccaaggtttctggagcgggagctgcccaaaacctggacctggcctacccaaagtgcctgcactccttctgcactcctgggatgggtcccagaaccttctggaatgatctgtggctggtatgtgagcagccaggtctgctgccgggtgactgggcagcacccttggatcctggtggggcctcagcctgcagcctgctctccccttttagggcggtaagtcggggaggctggcagggaagtggagaccgcaggacttgggggtgggtgggagggggtggcgagggggtgtgtttgctcctcctctcctgcctgctcccacccctggcccttaccttcttgggaactgtggtgattgccttctgtcaggtgtgttgaagcggccgtacccatggtggaggcctttgctcttcttgtggcgtgctggggtgggcaggtgggctgcagccccggcaccagcctgctccagctcccacaccgcccacagacctccctgtcctcatattctctgaccgcaggcctgcctgcctctgctctgctccgccccagaggggctgggttggacctggtgttcaaggccattcctatctgccccccagcccactgctggagccccaggcccctgcagcctgctccacactctgggttcccgggggaagcaggggtagagtggggcaggattcaggtgtagagggcctgtccccagcaggggtccccttgccccgggcccagggtcactggtacagatagcccatgagcgaacctgggaggccttccgtgtgtgggcagagcagctgctgtgtcctggccattctccagccgcctgtctgtgggcactgtgggcaggtacctttgtgcagggccatggggcaggcagggcggggtctcctggccctgcctgacccttcacttgggaatgtcaagtgtggctcagctctgccttctctgccacctgggtcactaggcagactcctcactgccttagggggtccctgaagttacaggggatgggttttccctcccccagagcctggcttgctccttcgtttggggcctccccgtccgcctgcagtccccggatacagcccgcattcagtgagggctgtggggcagaggtctaggcttgagaggcacctggacctgtccctgaccttgttggactggcagtggggctggtgtgggggacagcggatgtcctcagagccggggggcagctcttgcctggcaggcagggcctggccgtgcactggttgggggctgccctgcactgcagaaaggacaggtgggctgtggcgtccgcaccacaccagggtgccctgctcatcgctctggccagagaacctgggcgcaggcaggggagggctgcaggggcggggcgtgagctaggcgttgggccgggtgtcggcgctgggtccagctgtccatccgactgtctgtccatggggtcccgtgtgaggttctaggccagctgccgtttgccttccagctgctgcggactctggagcgtgagaaccagcgcctggaggctgtcctggcgtggcggcgctctgagctggtcttctggcggtggatggtgaggaagcccgcgcatccctctcccggcatcccttcccacagcagcccccaggtggggcattcgggatcttcctgttttccagacaggaagaggggcttttagggaggccacagacctagtgtaggctctttctaggacttccactcgccttctggggaggctcactgctgcccccgccctcagctccatggccttctagagtgtggcctttgtgcctccctggacgtcacagttgctgagatggtggcatccagcccgctgtgggacctgggggactaccactgccctctttgccctctgtccctctgtccccttggcttggtgcacgctgtctcacttgggtctctgtaggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggtgagtgccagcctcgctctgggcaccagcccagccccaccttcgggggatggctgacctgagggcactttggacttgctgaatcctacagttgcatttgtcaagcatggcaggggacacacttagaggcacgtaccctgagggagcgggagggcacctggtgaggagccgcagctgctgcgagacagcccccgcccctcctgcgggaggtctgttgtctgattctttgcatgagggagggaagcccgtgctgtgtgggccctgctgctcccatgcgtccgccacacatgcatcacacggtagtagtcactcctccacacctgcctgggacccgtctaacctcctggtggccacctgggcctccaccctagactcagagctgcccgcttaacctgcgcaggttcatggctgtgaacacggggctgtgttggctccatctattttctttttctgaagagttttaacttaaattgcaggcatgattttccccttaaaattttcagtaagcctctctgaagagcatgggcgtttcccgcatgcctgcagcgcctgcacctgagtctgggctcagggaatgctcagggagcctgaggccagtgtcctggggggacagagccattgccattgtgtcccacgcaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgccgctggccctccccctgccaccctgtcgggtttccctgtttgggggtgggagcgtggaggagcccctgggcagtggtggccagtgtagggctggccaggtgctggaggacatgcataccccagcactggtgagtggcaggaccacggggaggtggcacaggcctccctggagcgggattatctcggccccgccccccttcatttgggctcccgctgtgggcctggccctgggctgtgagcacagctgcccccacctccggccaaggctgtgcctggtgggtgcgccggatgggagcccggggctctgctccttcccgggaggtggtgctccgggtggggaggcacagcatggacagaggggctttgttccagaggctgctcagcaagctcagctcatccctgacaaagagccatctgtgtccgggggacgtgcctcagcctggcggaaggagggtcggcctcatggcaccccccccgccccccaccagcagacacaggtggccctgaggcctccagccctgcctgccttgccgggctcccctctcttctggggctgtcggactctgacctgaggtgggcagacgatggggcttgtggggccacctccaggctcctgccggccctgccccgaggccacgtccattccccctgccagaacatgctctcactggggcatgtgcctgagtgacagcacacacctggggctccagctccagtctcagcctgtctgggcctccttggtcccaggggtggacacgcctagaccgcctgccttcccattccggtgcatgggacccaggagcaccggcaagacctggccgtggccagcaaggcctccctttcaggagcacctctctgaccctctcatgcagctgggcctcctgtgggccaccaggatttgtgcaaatgctccctggcctgcgccaccctccggcccctccgccagctcctcctaagggctcctgccacctccacctgctggttccagctctgttccaggccctcagacctcaaccctcctccacctgcagcctctgaaagtcccccgtgctctcagcaaccctcgactgccggacagggctcttcttgggctgggagcaagtccacttgaagccctgctttttataaactgccacagaaccaggactctcacgggcctgggggacttgatttttacgagcacaaaagcaggcttattgtcatggagttgtcacctctcgatgtgatgcgtgaattcagggcagtccaagtcctgggtgcgcgtgtgcccccatgatgctggcggtggagagggcctgagaggccagggcctgcgggagggaagccggcagggtgccctagtgctgcccgtcatgatggagcagggatgggaccctggccttcagctctagttgttatcacacatgcagtggctcgagtcgcctgaagtcacgccctcttgttctgtgggtcgggggttgccagtccacagggttaaagctggatgggcaggcagggctgtgtggcccccagctcagagcaggcatggaggtcctcacaacactgcctctctgacactctcctgcctccctcccctgccttcaggagcccgagtcatcctcaagacccccatcccctctgtccccatagacttcctgtcttaaggccagctgcagcttttcccttctgtcttgcgacctgccccagacccacggaacagcctggaggcccacggtgtcggcctggctggggcagtagggccctgcaccctggacgagccagcatctgtgtaaggacagtgcagtttgcttcccaggaagacagaggcgaagatggcctcacaggaaacagcagaggtcacctggcgcgtgagaccaagtgcgcttactggaaggtgcaataaacttcaacaaaactagaaatttttttttttttaagacagagtcttgctcttgtcacccaggctggagtacagtggcgcagtttcggctcactgcaacctccgcctcccgggttcaagcgattctcctgcctcagccttctgagtagctgggattacagcagtgcgccaccatgcccggccaatttttgtatttttagtagagatggggtttcatcgtattggtcaggctggtcttgaactcctgacctcaggtgatccacccgcctcggcctcccaaagtgctgggattacaggcatgaaccactgtgcccggccaaaactaatgtttattaagaggtggtgcagctggatgcagtggctcatgcctgtaatcccagcgctttgggaggcctggatgggaggattgcatgagcctgggagatcaagaccagcctgggcaacatagggaggccccaccactacaaaaaataaaaaaagcagctgggtgtagtggcatgtgcctgtagtcccagctacatagaagggaggccgagacaggaggatcgcttgagcctggagaccaaggctatgaggccaagtgagctatgatcttgttactgcactccagcctgggcaacagagtgagaccctatatgaaaaagaaaaaacgattaatgagatggaagtgcagtgtctcatacgcttgcctattctgttccggctggctcagccttcctggcctctgcttccctttctgcactacttcagggctccttcacctggtcctggctgaccctgccttgagggatgaggctggttgggactccggccaggtcaggatcacaacctctggggcctgtggtggtcgcacctccccctggagcccagggaatgtgtcctacggcctctgaagtcccgccttggttggacaggagggtttctcttttttttttttttttttttgagacaagatgttgctctgtcactcagtggcacagtcagctcactgcagcctccatcttccaggatcaagtcatcctcccacctcagcctcctgagtggctgggactgcagccttgatcttccgggatcaagtcatcctcccacctcagcctcctgagtggctgggactgcagcctcgatcttccgggatcaactaatcctcccatctcagcctcctgagtggctgagactacaggcgcgtgccaccatgcccagctaatttttgtattttcatttttagtagacgcagggtttcaccatgccgcccaggctggtcccaaactcctgggctcaagtgatctgcctgcctctacctcccaaagtgccgggattacaggcgtaggccaccgctcctggcaggagagaagtgtttctgagtggttcctgtttatctcatggggaccctgaccgctcagtccacactgcccttgtctaccccatggccttgggtgtggttgtggctggtggctctgaagtcctgcgcctgggctcagcctccagctgtctgtccctgcgtgtgagcctgcattggctctgcagccatccctgtcctcagagtggtcggagggtgtcctgcccggcctctcgctgccctgcctggctgtgctgggctggtccctcagtcattctacctgaagtcacgtggtgcccaatatgtgccattctgaggggccccatggccatgtcccagagggaagagcaaacaccatagaggaaagtgctcacagctggaggacatgggtgcccgccggggctcagccccaaggggggcacaagctgagagtaggcagggcccaggcttctgcccccatccgctggtggggaggttctgtggctcagaggaggtgggtttggaggacagctggactaggtgggttctggcccactggggcacaggattggccgctgtcttggttgcgggtgtgatgtagggagctgtggtggctgggcccatggtggtttgagaactgggcaggctggggtgggcactgctgcttggtagcccggctctgacctgctcacaatcttggcatcttagtgggtgtcaggtgggcagttggctgcgtgaacctggaatttggggctggagaatggaatgtgagaatgcagggtgtgggtgggctcagccggggtgggaggcagggcagggcagggcagggccccagggtgcggtgggcccggggctggtgaggggcccggggctggtgaggggcctggggctggtgaggggcctgggtctgaggcctgagcctgggcctgcacagtggtaggaagcacaggcagggcagaggggatggctggcaagtgggggtgcggtcaagttgggggtcttggtggccaagtaaagacagtgcttccggacggaggggcttatcacctgtgctgctgagggacagggccgggggctgaagatcacgcttggagtgggggctacacacctgacagagggggatgaggggggccacggaggaggacaccagggctgtgctctcaccaggtctccagggtcttgccataaactgcagcgaagacataggatgctggctgcagaggtttgggctgcagcctcctaaatgtggggcctgtatctttttaaaatgagcctaggatttgttgtaatcagggagggtaacacacagacgcaggaatgaccgtcttgtaggaagaaagttcttttatccacagagagtgggggctgctccacgcagctgggtggtcggggcacaggaatgggcaagacgtcagcatcaaaactacagaaaaagacgcgcttagtgaggtggtacaacagctaccacgacctcagctaataaaaaaatgtgggccttgaagtgggggacccatggcttgtcacgctggtgggaggcaccgggcttggggaggcactgggctggagggggcgccgggctggtgggggcgccaggctggagaggacacccagctggcgggggtgccgggctggtgggggatgttgggcgggcagagccctgggctggtgggggcgctgggccggttggggtatcggaggggaccgccaggctggaggggggggcgccaggctggagggggcactgggctggtggggtgctggggtggaggagctctgggctggtgggggcgcctggctagaggggacgctgggctggtgatgccccgggctggtggagccctgggaggtgggggtgcctggctggaggggatgccaggctggtggggccctggcatgaagctggcattgtgatcagagtgtgctccagtgacttggaaagcagacacaccactgccagccctgtagtttcagggaagagggaggaaaaggcctggatgttactggcgagggccgtgtgcacctggccccacgtcgcccctaggagatgggctggggcgaggccttgccggcatgagagcagaaccaaagggcagtagagagggagggagttcggggccttgcctgtgggaaaaacctgctgctcctgagcccagagtacaggaagttcaagagccgtttagccacgaagtcctattaatttaacatccctccgttaactgaagggccaggaccttgctgtgaacgtcctcctagggcgtggctgtcgacagtgagggacagaactgctagatgagcagctaggtgggaggctgcggggcactggcgagatgcctacttttttttttgtttttttttgagacagagtctcgctctgtcgcccaggctggagtgcagtggcgtgatctcggctcactgcaacctccacctcctgggttcaaaggattctcctgcctcagcctcttgagtagctgggactacagatgcgtgccaccatgcccggctgctttttgtatttttaacagagacgggatttcaccgtgttagccaggctggtctcaatctcctgacctcgtgatccgcccgcctcgacctcccaaagtgctgggattacgggcgtgagccactgtgcctggccccactgctggtttttgatagaatcaagttgctaaagagacgtgagcctggctgcagaaggcctgggccccaggactgcaccagcaggaagagactttgggaaaagccagcccaggagggcggacaccctaacgcttatcccgaaggagagggaccagcaggcccatcccgggaagtaaagccagcaccctgggcccgtggacgaggggtcttagctgagagcgcaacgcgtgtgggccagggtctcctccgaggacggcctcactggtgccctttatggatggggccttctactgagcggccctgccaggcgtcacccttgtacccgggggccaggtgggcaggcggctcttgtccggcatgtaatggagaaactgcagcccttgcagatcctggagtgtgcaggaactagtggaatgtggcagccactgccagcccctccctccagtcacttcttggggtctgtttgtgacagcagctggcattgtcctaactcagggattcctgcactttctcagttcatggcactcttagtgtcccagtgattctttacagcaccccttgggcgaaagaaaaacccaacagttctgtttgttagggccaaatgccttagtatttatgtcctaacaacttagtagcagttttggggaaaaaaaagtcatataaattgaaaaaaaaacccttaacttaaatattaaaagaattgtaattacttacttatagcatgtctgggtctgttaaggtctgcatgtttttgcaaaccttaattagattggacatcatcatctggatttctgatccacattaatttttgcctggtatttgcttttgctcacagcaactgctgtgaaaccagctttgcaaagagacaccaacgcaaggaaggtgcaacccactgctgaaactctgggctcttttttttgagacggagtctttttttgagacagagtcttgctcagtcgcccaggctggactgcagtggcgcaatcttggctcactgcaagctctgcctcccgggttcacaccattctcctgcctcagcctcccgagtagctgggactacaggcgcccgccaccacgcccggctaattttttttttgtatttttagtaaagtcagggtttcaccatgttagccagggtggtctcgatctcgtgacctcatgatccgcccgcctcggcctcctaaagtgctgggattacaggcatgagccactgcgcctggctgagacggagtccttgctcttgtcccccaagctggagtgcagtggcgcgatctcagctcactgcaacctctacctcccgggttcaaaggattctcttgcctcagcctcccaagtagctgggactacaggcgtgggccaccatgcccggctaatttttgtgtgtgtgtgattttagtagagacggggtttcaccatgttggccaggctggtgtcgaactcctgaccttaggtgatctgcctgcctcggcctctcaaagtgctgggattacaggcgtgagccactgcgcccggcctgggctctcttgaatttttcatgaggtaacggatgtgttgtgtatccctgcatttccctcagaaccttaaaatactttgtagtggccccgaaaacttttgatggcaccctggggtgactcagtttgggaactctcgtcctaactttcctgtgatttcttttttttgagacagagtctcactctgttgcccaggctgaactgcaatggcacgatcttggctcactgcaacctccgacttctgggttcaagtgattctcctgcctcagcctccccagtagctgggattacaggcacccgccatcatgcctggctaatttttgtatttttgtagagatggggtttcaccatgttggccaggctgacctcaagtgatccacccgcctctgcctcccaaaatgttgggattacaagcatgagccaccgcacctggcttcataatttctttccacttagtgttgttgtgttttttgtttgtttgtttgtttttttgagacggagtctcgctctgtcacccaggctggagtgcagtgtcgcgatctcggctcactgtgagctccaactgccggggtcacgccattctcctgcctcaggctcccgagtagctgggactacaggcgcccaccaccacgcccggctaattttttgtatttttagtagagacggggtttcaccgtgttagccaggatggaatgttgttgtgttttaagctccatcctctaaggtgcgcctgcagcgactcactgcttccaactcccgcacacgtccagtggggagcatttaggcaactacccacccactctccacagacaggtacctggctgccccccgctccctgccacacaaaagacgcagctctcaggtgggcccaagggatcaggccacagaaaaggagggcttgtggtccttcccttggtcggggacgtgccgtgactccccgagtggcctttctggcccgtactcctgtctggctcctacctcctgggtcccggccctccctccctcagcgttttctagcgtttgcgggtttgccagcagagcgtcaggtggtctctgcgtctaatttccatctctctgagtattgaccgtgagcatctttcacacacttgcttcgtttctgggtttcctcttctgtgagctgcctggtcataccctttgatcgtttttcttttgggacctgctgtcttttacaaattgagtggcaggaactccttgaaaattcaagatagggatctctcagtggttttacacactataaatagcttctcccattctgtcgtctggttaaagatttgcctatggttacccagaaaattttaactttgctataatcaaattcgtctttttttttttttgactcttggtttcaccttagcattttgtgaaaacgagcttccctctcccagtcctccttctcccagtttccttctgtcacttctccctgtagcacttaggtcttccgttcgtccacagcccacctccgcaggtgctctcatgtcgaaaccagtttttctccatagggtgagccgcttcccaagaccatctcctgggagctctgccctcctcacagtccacgctgtcgctgtcatccacatcggctcctgtccgtgcaggggtcttgccccgacctcccttctgatccagcaggctgttcctcaccaataccacatggcgtgattaccctgcatgtcatcagggttcaagcagagtagccgagccggtgggggctgtgatacataggaagggtggggtgcgtgtgaggctggcatgggggaggctgcgattgtcggggtttacctttgccgtcttgctgacgcacactcagcagccctggtgacagtgggcgtccttgttctcagtctcagagggcaggtgtctaaagtttgtccatgaagtatgacacttgctgggtgctttggccacataacttttttttttattttattttgagataaggtctcctgttgcctaggctggagtgcagtggcccaatcacagcccactgcagcctctgcctcccaggctcaagggatcttcccaactcagcctcctgagtagctgggactacaggtgtgcaccacctcacccagctaatttttgtatttttttgtagagactggggaggcgggtctcaccacgttgcccaggctggtctcgaactcctgggctcaactggtcctcttgcctcggcgtcccaaagtgctgggattgtaggcatgagccactgtgcccagccaatgagttttgactctcttttttttccacgtgaaaagggtccgagtaccacttgtggaaaagaccctgctctcctgccaccctgtgtgccgcttggtaccgccctggtgtccatcttcgtcttgggtcttccttctttccctttgggaagcccacatggtgttcatgactccagccgtctctcgggctccatgtagggcagggagggtgtgttgtccactctcgcctatgtcgggagccctgggactcttctcgacgcctcatatttcatagacattgtagaatccgtttgtcgaatattaggcaaagaactattgggattttacttgggatgacgtggaatccatagatcagtttgagaactgatgtctttagaatgttaatgctggctcttctgccttacaaacacacttctccgtgggttaggtgttcattaatgttttatagtttcctggatataggtattatacttcttttgttagatttgtttctcagtatttggtctttttgaaatattgtaagatatatatatatatcttatatatagatatctcatatatatacacacacacacacccacacccatttcatatttacatttcattttctaactctgttgaaaattgtagaaacccgaaactgatttctgcattttgacctggtttagcgagtcttgctaaactcacttattaatactaaaaaatttatctctggatttttttttttttttatgagacagggtctcactccgtcacccaggctggagtgcagtggtgtgatctcagctgactgtaacctctgcctccgcttcccaggttcaagcgattctcatgcctcagcctcctgagaagctgggactataggcacccaccaccacgcccagctaatttttgtaaattttgtattttttgctagagatggggtttcaccatgttgtccaggttggtctcaaactcttgacctcaagtgatctgcccgcctcggcctcccaaagagccaccgtgcccagcctagattttaaaagacttttctaagtacacaattatatcacttgcaaaaactaatcgtaggttaggctgggcatagtggctcatgcctgtaatcccagcactttgggaagccaaggtgggaggatcacttgaggccaggagtttgagaccagcccagacaacactgttacacaccgtatctacaaaaaatttaaaaattaacaggatgtggtggtgtgcacctgtattcccagctactctggaggctgaggcaggaggattgtcagagcctgtaaggttgagactgcagtgagccatgatcatgccactgcactccaccttgcacagagcaagaccctctctttaaaaacaaacaaaaaagaccagtcacgatggctcacacctgtaatcccagcactttgcgaggctgaggcaggtggctcacgtgaggtcaggagtttgagaccagcctggccaacatggtgaaactccatctctactaaaaatacaaaaaaaaaaaaaaattagctgggtgtggtggcgggtgcctgtaatctcacctactagggaggctgaggcaggagaatcactggaacccgggaggcagaggttgcagtgagccaagatcgcgccactgtactccagtctgggcaacagtgcgagactctgtctcaaaaaaccaaaccaaaccaaaacaaaacaaaacagacaaacaaactaatgatagtttcattttaaacatctccaaatctttttttttttttttttttttgagacagagtcttgctctgttgcccaggctggagtgcagtggcgtgatctcggcttactgcaacctccgcctcccaggttcaaaccattctcctgcctcagcctcctgagcagctgggactacaggcacgctccaccacacccacctaatttttgtatttttaaaagacacggggtttctctgtgttagccaggatggtctcgatctcctgacctcgtgatctgcccgcctcgacctcccaaagtgttgggattacaggcgtgagccaccatgcccagcttaaaatcccccattcttatttctttttcttgcttcctgaaagaagcaccctgttttcctggtgtttctagtaggggctgagcagcccaggcggctgcagcgtctctgtctgcttctggctggaagagagtgttctagttctgcactacgaagattgctgtttgcaaagcagattcctgtagatgtacttaattagattaaggagagctcccttccattctccgtctactgagagctgttttaggaagtcatgaacagctattgaatctactaaatgccttttttgcacctactgatatggtcatttttttctttaatctgttaatgtgaagacttacatttattgattttagaaaaccttttattaaaaaatcatttcaaataaaaaaattacagtagtggctgggcgccgtggctcacgcctgtaatctcagcagtttgggaggccgaggcaggtggatcatctgaggtcaggagttcgagaccagcctgaccaacatggtgaaaccctgcctcttctaaaaatacaaaaattagctgaacatggtgaatccctgcctcttctaaaaatacaaaaattagctggacatggtggtgggtgcctgtaatcccatttactcgggagctggaggctgaggcaagagaattgcttcaacctgggaggcgaagattgcagtgagccaagattgcaccactgcactctgggtctgggcgacagagtgacaccctgtcacaaaaacaaacaaacaaaacaaaaagaaaaaacaaacaacaaaaatactacagtggtaccatagctcctatatgtcttcacacagattcctcaattgttaacatttcacctgaccattctctacacacacacacacacacacacacacacacacacacgcgtgtgatggacgtatgggaatggagctgtgtcagcctcagggcattcgctcaggagggtgtggctctctgggccctgctgcgggtgccacccacctctctcccttagtcagagtggcaaccgctcgctcctccaccgtgaggttaatgtgaaatgtgttgctaactacggcataattcctgagtattgtatgagggtgatgctccaatgcgatgtcagtgtcctggtccaattcccacgggcgccctccgcggggcgccccgagactcccacccgaccgggtgtcctggtcctaatcccatgctcaccctctgaggggcaccctgagactctggcccaactaggtgaggactgtgatgtggctgaagggcggagtccacttcccttctggatgcctcagtgagcctgctgccagctgcagctttccctccctctgcttattcacatcagcttggacttgtgtgtgcctattttactcagagggttatgatgcattattctcattatttatgtgatgctcacatagtcccggaggcagccagtgcagccctacagctgggtctggtgactttgtagtgtgtcctgccattctatctttaaagattttttggagacagggtctcactctgtcacccaggctggagtgaagtggtgcaatcatggctcactgcagcctcgacctccctgggctcaagcgatcctcccacctcagcctctcgagtagctgagactacaggtgtgtgccaccatgcccagctaatttttttctattttttttggagatgggggggaggtctcgttatgttgcccaggctgggctccagtaatcccaaaatgttgggattacaggcatgagccaccacacctggccatgtctctgtcttataaggacagttgtcattggatatagggtccactcgataatgcaggatgatctcctgctctcgagatccttaatcacatctgccaagactcttattccaaataagggtgcattcccgggctctgggggttaggatgtggacgcgtatttaggggtcaccttcagccaagggccagcagtctgtctgctgtgtccaaggcacagctttccagctggctttttcctcgtgttgcccaagccctccccttttcctttctttggggctgagctttcaatagcacacctagcatgggcagaggaggcattcggaatggaacaataaatagggagattgaggatgagggagcgagactctgactgtaagtggtggttacacatcaggaaagtggggatttaggaataagccctgtggactggcatgaacttgtggttaaatcattgacggcctgggagagggatgggtgtggaaacacaggtgtgcgcatgcctgcaaagacagcctgagcggcggcagccgggcagcagtgagcacgtccagcacccagggtcagctggtctcaaactcctgacctcaagtgttccccctgcctcggcctcccaaagtgctgggattacaggcgtgagccaccgtgcctggcctgttctcttattttcaacctttctgtatatgtattgtaaatgtaagttgcagaaacagaatatatttgtcttatgatggactcttctaattgatttataatcactaatctatttgggtttaaatctaccatcttactaggaacctccacataacccataacctcacacaactatcaactcctagccatctaataggtgtgcacgggaacctcatcactgtttaaatctgcatggaactcctcatgtgccgatttgcatccatgtatcctgtttggtgaaatgtctgttcaagtcctttgccgatttttagattattgtatttactgcagattttttttttattttttatttttagagacagggttttgttctgtctcccagggtggaatgcagtggcatcaacatagctcactgcagcctcgaactcctggcctcaagtgatcctcctgactcggccttccaaagcactgagattacaggcatgagccactgtgcttggccttattgccgatgttaagagttaaaaaaatatgtaggctgggcatggtggttcacaccgtaatcccagcacttcggaaggctaaggcgggcagatcacgaggtcaggagtttgagaccagcttggccaacatggagaaatcccatctctacaaaagatacaaaaaattagccaggcgtggtggcgtgcttctgtaatcccagctactcgtgaagcagaggcaggagaattgcttgaactggggaggtggaggttgctgtgagccaagattgcgccgttgcactctctcctgggtgacagggtgagactctgtctctaaaaaaaaaaaaaaaaaaaagtaaaaaactaacaggtgctggtgaagttgtggagaaaaaggaacacttatatactgttggtgggagtgtaaattagttcaaccattgtggaaaacaatgtggtgattcctccaagacctaaaaacagaactcccattctatccagaaaatcccgttactagatatatacccaaaggaatataaattgtaatatcataaagacacatgcaccgctattcacgatagcaaactcatagaatcaacctgaatgcccatcaatgatagactggatggaaaatgtgatacatatacactatggaatactatgaagccataaaaaagaatgagatcatgtcctttgcaggaacgtggatggagctgagggccattatccttagcaagctaatgcaggaacagaaacccaaattcatgttctcacctgtaagtgggagctaaatgatgagaacatatggacacatagaggggaacaactgacactggcctattggagggtggagagttggaggagggagaggatcaggtaaaataactaatgagtacaaaggcttagtacctgggtgatgaaataatctgtacaacaaccccctatgacacaagttaacctatataacaaacctgcacatgtactcctgaacataaaataaaagttaaatatataaatatgtacattagatgttaatatacattacacattatatatatatatattctgcaaacaagtcttttgtttgatacatgatttataagttgatatggtttggcagtgtccccacccaaatctcatcttgaattgtagttcccataatccccacctgttgtgggagggacccagtgtgaggtaactgaatcatgggggtggttacccccatgctactcttctcttggtagtgagtgagttctcacgagatctgatggttttacaaagggcttttcaccctttgttcagcacttttttctcctgatgccatgtgaagaaggacgtgttgcttccccttccgccatgattctaagtctcctgacgcctccccaggcatgtggaactgtgagtcaattaaacctttttcttttataaattacccagtcttggttacttctttttttttttttttgagatggagtttcgctcttattgcccaggctggagtgcaatggcatgatcttggctcaccgcaatctctgcctccctggttcaagtgattcctctgcctcagtctcctgagtagctgggattacaggcccctgccaccatgcccagcttatttttgtattttttagtagagacagggtctcaccatgttggccaggctggtcttgaactcctgacctcgggtgattcacccacttcagcctcccaaagtcctggggattacaggcgtgagccactgcacctgggctcagtcttgggtatttcttcatagcagcatgagtacggactaatacacaaatactttctcccagtatataatttgtcttttcatcctcttaacagtgacttttacatagaaaaaaaggtttaaattttgatgaaatccaatttatcaatttatcttttatggattgagcttttgttgttgtgtctaagaatatttttagccttggcccaggttgtgaaaattttttctgtttttttcttctaaaggttttgtagctttacacttgacatttagacctgtgatcatcttgagttaatttttgcataaggaatgaaggtctaggttgaggatcctttcttttttcccacacacgtgtctaatttggtgaaaatactatctttccaatgtcgaatcacttttgcactttagttaaaaattaattaccactttcgaaaagctaggaatagaagggaacttccttaatctgatgaaagagatctgctaggccccacagctaacattctccttaatggtaaaaggcaggatgctcttcccctgggatcaaaaacaagacaaggatatctactgtcaccacttttattcaacattgtactggaggctctagtcaaggcaatttggcaagataaagaaataaaagacatctagatcagaaaggaagaagtaaaacttctctgtctggggatgatataatactatatataggaaatcctcagaaatgaactaaaaatattagcactaataaagaaattcagcaaggttgcagaatcttgtgatcgatgtgcagaaaatccacttatttctatgcactagccacaagcaactgaaataaagtaaaaaaatccatttatagcagagtcgaaaagaattaaacgcttagaaataaattttacaaaagaagtgtaaaacgttggcaacgcgtggtgtatttttctatgcaaaaaaaaaaaaaaacaaacaaaaaaccagactgtaaaacacgtgttttgaagacgacaaaacattgttgaaagaaattaaagaagaccgaactaaagtaaatgtaaagacatcctatgttaatcacaaactgacctgcagactcagtgcaatccctagtatcaaaaccgcacacggcttctttgtttgttgttgcagaaattgacaagctgattctgaaattcatagggaaatgcaagggatccagggcggactaaacagtcttttgttttgttttgttttgagatggagtctggctctgtcacccaggctggagtgcagtggcgagatctcagctcacctcaacctctgcctcctgggttcaagctattctcatgcctcagcctcccaagtagctgggattacaggacccaccaccacactcaactcatttttctatttttagtagagatggggtttcaccatgttggccaggctggtctcgaactcctggcctcaagtgatccacccgcctcggcctcccaaagtgctgagattacaggcgtgagctaccacgcctggccccaaaacagtcttgaagaaaacagttggagtatccacacttcccaatgtcaacacttattacaaagccgcagaaatcaagataatgaggggctcacagaaggacagacttacagattactggaacagagtggagaatccagaaataaacctttacgtttttatggccagtcaatttttgaaaaggatgtcaagaccattaaatgggaaagaatcgtctttttaacaaatggtgctgggagcactggatatgcctaagcaggaagctagaccctgtgtctgtgccccagggctgccctaacaaagcactgcaaacgggacagcgtcaaccacaggaattccttctcccacgctctggaagctagaagcccaagatcaaggtgtctgcaggactggtgttgctgaaactgacccaatagtcctacagactgttctttttgaaaacacagaaatggacccttctggtcttaaagcttgaaacttttgttttatctgaatttcttcctcagcaaaggaccttcaggcctctcagaaaagtatcaaagaactgaaactacccagaccaaggcacagatgctggacccctcattcatcatgattgcttccttgcctgacatggtttggctgtgtcctcacccaaatctcaacttgaattgtatctcccagaattcccacgtgttgtgggagggaaccagggggagataattgaatcatgggggccagtctttcccgtgctattctcttgatagtgaataagtctcatgagatctgatggtttattaggggtttctgcttttgcttctctctcattttctcttgccgctgccatgtaagaagtgcctctcacctcctgccatgattctgagaactccccagccatgtggaactgtaagtccaatgaaatctttttttgttcccagtttggggtagatctttatcagcagcatgaaaacgagtaatacattgcacctctctagttcttgttttcttacacgttgttacatttcttcccctgctatataaacccctggttttagtgagtcaggagatggatttgggactgagctcccatctcctctgctcagcacccaattaaagccttcttccttggccatacttggcatctcagtgattggctttctttgcagcaagcagcaggacctggaatgaaaccctggtgtttcagtaaccttgccagcaactctcagcttgcagctgcctccctccaacctctgtccctgtcctcatacagtcttctttcctctctccttataaggacacagacattggatgtaggcccaccctaatccagtgtgatctcaacttaactagatgatacctacaaagatcctatttccaaataaggtcacgttggcaggtatcagggtaggactgaaacatatctttctgggagccatgatttagcccatagcagatcccttccttaaaacagacataaaatgtaactaaaaatgcatcatacacctaaatgtaaaacctaaaactataacacttctagaagaaaacagaggagaaaatctttgtgaccttggattatgcaaaagcttcttaggacacagaaaagcacaagcaacaaaataaaagatagataaatcgggtttaattaaaattagaggtttctggccgggcacagtggctcgtgcctgtaatcccagcactttgggagactgaggtgggcagatcacgaagtcaggagttcgagaccagactcgccaacatggtgaagccatatctctactaaaaataggaaaagttagccgagtgtggtggtgtgcacctgtaatcccagctattcgggaagctgaggcaggataattgcttgaacttgggaagtggaggttgcagtgagctgagatcacaccactgtactccagcctgggcaataaagcgagactgtctcaaaaaaaaaaaaaagtttctgtgctttgggactccataaaaaacgttgggtgggtaaggatcacgcctgtaataccagcactttgcgaggtcaaggtgggaggatcaattgagcccacgcgttcaaggccagcctgggaaacgagagtagcaagaccatgtctctacaaaaaattaaaaaattagccagccatggtggtgcgcacctgtagttccagctactcaggaggttgaggtgggaaggtcacttgagcctgggagatcaaggccctggtgagctgtcattgtgccactgcactccagcctgagcgacagagagagaccctgtctcaaaaaaaaagttgaggctgggcgtggtggctcacgcctgtaatcccagcactttcgggggctttggcacatggatcactttggggggcttaggcacatggatcgtctgaggtcaggagtttgagaccagcctggccaacatggtgaaactccgtctctactaaaattacaaaaattagctgggcgtggtggcacgtgactgtaattccagctactcaggaggccgaggcaggagaatcacttgaatacaggaggcggaggttgcagtaagccgagatctcaccactgcactccagcctgggtgacagagcaagactctgtctcaaaaaaaaaaaaaaaaaagaaaagaaaacaaaatggccaagcacagtggctcatgcctgtaatcctagcactttgggaggctgaggtgggcagattgcttgagctcaggcgttcaagaccagcctgggcaacatggtgaaaccccatctctactaaaaacacaaaaaattagctgggtgtggtggcgtgtgactgtattcccagctacttgggaggctgaggcacgagaattgcttgaacctcggaagcagaggttgtagtgagctgagattgtgctacagcactccagcctgggtgacagagcacgactctgtctcaaaaaaaaaaaaaaaaaaaaaaagttgaaaagacaactcagaaaatgggagaaagtatttgcaaatcacatatctgataagagaattgtatccagaatatataaggaactcttagagtggaacagtaaaaggataaataacccaatggaaaaacgtgcgaaggatttgaacagacatttctccaaaggagatatgcaaatggccactaaacacacgaccagtgcctggtgtccttagccatcagggacatgcaaatcagaggcacagtgaggcaacatttcacacctgccacgatggctatgattaaacatgttgataataacaagtgctggcaagggtgtgaagaaattggaatcctcacatattgctgatggaaacgtaaaatgatctgaaaaagagtcgacgcttccccaaaatgttaaacacagagttaccgtatgacccggccattccacccctcgacggacacctaagagaaataaacacaggtccacataagagtttgtactgaagtgttcatagccacatccataatggccaaaaggtggaaacaaagccaaaagatgtccatcaactgataaagagataataagagcatggaatattatttggcaataaaaaggaaggaagtagtgatgcatgctgcaacatgaatgcgccttgaacacatttagcaaaataagccagtcacagatgaccgcatatggtatggtcccatttatatgaaacgtccagaaaaggcaaatctgtggagacagaaagtagattattggttgccaggggctgggaaaactggggagaaattgggtgtgaaaggggggcgaatgctactggctctgggtgggtgtgaaaggggggcgaatgctactggctctgggtgggtgtgaaaggggggcgaatgctactggctctgggtgggtgtgaaagggggcgaatgctactggctctgggtgggtgtgaaaggggggcgaatgctactggctctgggtgggtgtgaaagggggcgaatgctactggctctgggtgggtgtgaaaggggggcgaatgctactggctctgggtgggtgtgaaagggggcgaatgctactggctctgggtgggtgtgaaagggggcgaatgctactggctctgggtgggtgtgaaaggggggcgaatgctactggctctgggtgggtgtgaaaggggggcgaatgctactgggtctgggtgggtgtgaaagggggcgaatgctactgggtctgggtgggtgtgaaaggggggcgaatgctactgggtctgggtgggtgtgaaaggggggcgaatgctactgggtctgggtgggtgtgaaagggggcgaatgctactggctctgggtgggtgtgaaagggggcgaatgctactgggtctgggtgggtgtgaaagggggcgaatgctactggctctgggtgggtgtgaaaggggggcgaatgctactggctctgggtgggtgtgaaaggggggcgaatgctactggctctgggtgggtgtgaaaggggggcgaatgctactggctctgggtgggtgtgaaaggggggcgaatgctactggctctggggatgatgaaaatcttttaaaattgattatgacatgtgtaaaattttccttccttccttcctcccttcctctctctttcctttccttcctctttctttctttctttctttctttctttctttctttctttctttctttctttctttctttctctctctccctctctctccctccctccctccctctccctctccctctctctccctccctccctccctgcctccctctctctctctctctctgtctctctccttcttatcttgctctgtcacccaggctggagtgcagtggtgccatctcggctcactacaacctccgcctcctgggttcaagctaggctccttctgcctcagcctcccaagcagctgggattacaagtgtgcgccaccacgcccagctaatttttgtattttagtagagacgaggtttcaccatgctggccaggctgatctcgaactcctgacctcaagtcatctgccctccttggactcccaaagtgctgggatcacaggcgtgagccactgtgcccagactgtacacttttgcttttggagacagagtctcactctgttgccccagctcccacggctcactgtagcctcaacctcccaggttcaagcgatcctcccacctcagccccccaaatagctgtgactacaggcatgcgccaccatgcccacctaccctttgtgttttttgtagagacgaggtattgctatgttacctaggttggcatcgaactcttgggatcaagcagttctcctgcctggcctcccaaagcgctgggattacaggagtgagccactgtgcctggctgaattgtacactttatttatttatttatttattttgagacagagtcttgctctgttgcccaggctggcgtgcagtggcatgatctcggctcactgcaacctccgtctcctgggttcaagcgattctcttgccttagcctcccaagtagctgggactacaggcgtgggtcatcacgcctggctaatttttgtgtgtgtgtgtgtgtgtgtttttagtagaggtgaggtttcaccgtgttggccaggctggtcttgaactcctgacctcaggtgatcacctgcctcggcctcccaaggtgctgggattacaagtgtgagccactgcgcctggcctgaattgtaccctttaaatggatgaattttatggtatttgaattatatttcaataaatctgttaaagaatcaatggccatgcttgtgtgggtgcacttgttccattgatctgtcggctgaccctctgccaattcagcctgtctcaattgctttagctttatggtgagttaacatccattagtgatggctgggcacggtggctcacacctgtaatcccagcactttgggaggctgaggtgggtggatcacgaggtcaggagatcgagatcatcttggctaacacagtgaaactccgtctctactaaaaatacaaaaaattagccgggcgtggtggcggccgcctgtagtcccagctactcgggaggctgaggcaggagaatggcatgaacccaggaggcagagcttccagtgagccaagatcatgccactgcactccagcctgggctacagagcgagactcagtctcaaaaaaaaaaaaaacccaaaaaaacaaaaacaacaacaacaaaaacatccattcgtgagaaccctccaactttttcccttctttttcagaattattttggcaactagttgcttttcatttctatatacatttcagaacaaggttttctatacctataaaatttccgacaggaattttaattgaaattgcattaaatccgtagtcgttttggagagaattggtatcttaactatatttgttctaattcaggaacacagcatgcctctcacatatttaggccttctttgatttcttttatcagcatttggtagttttcagtatacaaatcctgtaccagtcttgttagattaataccaaacgaataaatttactgggggaccattttaaatagcattgcttttaaaaattttggttttcaattgttcattgctaatatatagaaacaggactgagttctgtgttttcatcctgcaaccttgcaaaactcacttattagtattctgacttttttgttggtaaaattcttgggattttcgacatagacttttatgttatttatggatagggacatctttatttcttcctttctaatctgtatgccttttatttttctggttttattgcatgggttaggactgccagtacactgtggaacaggagtgaatagagtggacatctttaccttgttcctgatcttagggctcagcatttagtccttcattattaagtatcacattagatgcagaggttttttttttttttttttttcttttttggacagggtcttcctctgttgcccacactggagtgcagtggtgcgatcttagttcactgcaacctctgcctcccaagttcaagcgattctcatgcctcagcctcctgagtagctgggattacaggtgtgtgtcactgtaccctgctaatgtgtgtgtgtgtgtgtgtgtgttttaagtagagatggtgtttcgccatgttgcccaggctggcatagaactcctgagctcaggtgatctgcctgccttggcctcccaaagtgctgggattacaggcgtgagccaccacatccggccagattgttttgtattttttgtagagacagggtttcaccatgtttcccaggctggtcttgaactcaagctcaagcaatccgcccactttggcctcccaaaatgctggtattagaggcatgagccacagtgcctggcctaattttttttttaattaaaaataacagatatggaatctctccatgttgcccgggctggtcttgaactcctggcctcccaaaatgttgagattgcaggggtgagccaccatgcctggcctgttgtttttgttgttgctttttgtagattccttttatgagattaagcatgttccctttgctttctagtttgctgagagtgtttatcagggatgagtgttgaattccgtcaaatactttctttgaattgattgagatgatcacatggttttcttcttgagactaatatggtggatcacatcgatttattttcacatgttgaaccagccttgcctttctgggatagcctccatttggttggggtatttgtgtgtgtgtgtttttaatgctgcttgattctatttgctgataattagttgagggtttttgtgtcatgttggcattggcggctgttgattgtcttttctcttgcaggttggatttcctgattcttcacatgcagagtaattttagattgtctcctgcacatttagacattatgttatgagactggtcttatttaaatcccattgagaatgttggcattttgttttatcatgcaatcaacctagttggtttcaggccacaagttcaaataggctcctgtgggtcctgccttccatgtcggttttgttttcaaagcctttgcagtgggactcagatctgtccttcgtatgcactgcccagtggccagtgtgggacgtgggcagtgggctgtccttttgttcagttctcagcctttgggatgtgaatgagggtttagacttgtacatcatgtatggcttgcacaacttcctggggttgctttttttttttttttttttttgagacagagtctcactctgttgcccaggctggagtgcagtggcaagatctcggctcactgcaacctccatctcccggactcaagcaattctcctgcttcagcctcccgagtagctgggattacaggtgtgtgccaccacgcccggctaatttttatatttttagtagagatgggggtttcaccatgttggccaggctggtctcgaactcccgacctcaggtaatccgcccacatcggcctcccaaagtgctggaattacaggtgtgagccaccacgcccagcccatggattgctttctactgcttctccctgcccaccatctctccagcgacaggggaccacatctcctggggctggaaaggaaggctcttctgcctcagcgttttaggtgcttgtaaaccctatgccttggtcatggctttggtgggatacctaggggctggggcatcagagaatggagaagagtaaaaaaacaaccactaccaaaaaaccccatcctcccaaaccctaacatccccccgggcattctcctgcaccctgggagcattaggcgacctttttctttcctccccttgtgccaggactagagaacttctggagctctctgtcctcttctggctttcaggccgtgttgagtccaggcccggggatacgggaagagaatctggaagttcactaccagttgggtggtgcctcaaattctggtctttccaccaaatctggtgtccctttacctctctgaccctcagtctcctcctatgtcagagggaagtcacagcagttctgggaaggagggcaggcaggcagaaggtgccctcgggttcttctctggctcacacgggatggacaggatgtggggggaggggcttagtgccacctcagtgacaaaatgaagcccaagtccccaaaccctagcttgcctcctggacgggctggagaagaaggtgggggccgctcatcattcctttcctctgccctgagaagaaacctgggaaggctgggtttctccccaaagaggacagagggtggcgcggagggccccggcggccaggccagccccgcgcctacatccctgtcagctcctgggccggtgggcgcctgtccggctgagtggggtcgctctagggggcggcagcggagtttcagggcgcggggggcactgggcgggaccctgggattctgggcggtgggtgaggagggtggagacgggactccgcgcctgggggtgcgcgagggcgccccgctccccagagccaccagtcctgcgcgccgccgcgcggtgctgtcgccgtggcaaccggcgctgcggagggggcggggcaccggcacccccgcgctcccaggtccccaggtccggcggggctcgcgggccgaggggcgcggggcggggcctctgggtcgggggcggtgccgcgcgggcgggggaggggcgcggcgggaggagccggcgcggccccggcagtggcggcagaggctgggcgggcgggcccgggagcggcgcagcatctgcgggcggcggggtaggcgcgggcgcgggcgggactggctgggtgcgcggctgcgtccgcggagggggcggcgggcctgggcgaccctgcacctctgggccgtggggactgtggggtggggcgggggccgatgcggcaggggtgaggcctggggccggcggggtgacggggacccggccctgcgtggggaagcctcggggggacaagcagagacgcagcctgctgggagcggcccaagctctgcaccggcccgcggcgggagcacagcagccccctcccgcccctcctcccgggggctccgaggggtggttatggggcgagggtccttgcggggcccgggcagtgaagggcctggaggccccagagtctgtgccaggtctgagccgcggggcgtggggggaggaggggcctcggccggggcccaggagacccaggacaggtgggcctggggccaggtccctacggagaggtggccgggccgggctctggcttgccggggtaggggctccgctaggggctggagtccgtcccttcgccagcgcagagcccctcggcccgcatctgccaagtgactgaggatcgagcgacagcgtagtggggcggaggggctggaggcacggccggaaagggtgagcggcgccgtggctcccccgctatttatttggccccgccacgcgcggagagggaggaaattctcaggctgcggctgcagctaggggaggcccaggtgggcctggaatgggcccagagagggcttcctgggtcagacgtgtagatccagtggacgtgaaaaccgggtgagtgtcccggtgggacccagagcgcggggaggcttggaggcaggggcatgggctgaggaccctcaaggcaccctcctcgcgacctgtcagagctccgaggggtgggggtgtcctgtgtgtggctgtggggatcctgggcggcgggtgctgggtgggggcaggggtgggagtgcagagttcaacgctttcccggatcggtggggcctgcggtgtcaccagggcagtccgagcgcccgactgtcacggggacattaaattttatgcctttgtctagacacggcagtaaacggagccccaggcctggggctgtggagggggtgaggggctggctgggagtaagcctgtcagtgactttggggtgggtgcgggtgtgcgggcctccattgtcacccaggtgtgcacaggcccaggtgcggggactccgacagcacggccatgaggaccagtgccaggtgtgtgacagaggtgcaggggcctgtggaagcccgacgggccttggtggacgggcttcccgagattcgagggcagccacaggcatcgccctggcgcagaggagcaaagcagggtggctctgccggggcagagggtgggggacaacacctcgccaaggcaatgcggagccatggggagcagggcaggcagtggccacgcgcccaggatggtggacaggaggggagaccgagcctgcccgtgcagggaggaggggcgtgggggctgccgggcaggggcggggaggctcggagaggcttgtgggacggatgcatcgggacctgggtggctctcggtccgggatcagaaagcctgggagggccgaggcctccttgggtactccaagagcggaggggcaggcccgcctccctgcccagtgcggcggcggggagagggtattcccggaactccgcggaaacggcctgaggccagcagcgcgggcgtggggtccgggccgccggagccaggagggagggcggcgcgggcccagcagtgacaaacccccccgggctccgggaacgagctcggcgggcagaaaacgcgtccgttccgtttccttcctggcggcgggaacgaggcccgggtgctctggcgaggcagcagcgccctctggaggcctcgctgtggttcgcggccgccggttcgcgcatgggcgcaggcgtgcgcgatgcctcggggccccggcgcggagaccgcgcctggtgggaagcacgcggggtgcggggggcggggggtgttgggggaggccgctccagcccgcaccctgatcttgtctcctccggtctccccaggtttcgagctcgccgggccgtgtcgcgccatgcccgctggctgagcgccgcagggcctcgtcccgccaggcgtgggggccgcgcgcgcccaggccggggcccggcggccgaccatggtgctgccgcccccggaccggcgccacgtgtgcctgaccacgctggtgatcatgggcagcatggccgtcatggacgcgtacctggtggagcagaaccagggcccgcgcaagatcggcgtgtgcatcatcgtgctggtgggcgacgtgtgcttcctgctggtgctgcgctacgtggccgtgtgggtgggcgccgaggtgcgcacggccaagcgcggctacgccatgatcctgtggttcctttacatcttcgtgctggagatcaagctctacttcatcttccagaactacaaggcggcgcggcgcggcgcggcggaccccgtggcgcgcaaggcgctgacgctgctgctgtctgtgtgtgtgcccggcctgttcctgctgctcgtggcgctggaccgcatggagtacgtgcgcaccttccgcaagcgcgaggacctgcgcggccgcctgttttgggtggcgctggacctgctggacctgctggacatgcaggccagcctgtgggagccgccgcgctccgggctgccgctgtgggccgagggcctcaccttcttctactgctacatgctgctgctggtgctgccgtgcgtggcgctcagcgaggtcagcatgcagggcgagcacatagcgccgcagaagatgatgctgtacccggtgctcagcctcgccaccgtcaatgtggtggccgtgctggcgcgcgccgccaacatggcgctgttccgggacagccgtgtctcggccatcttcgtcggcaaaaacgtggtggcgctcgccaccaaggcctgcaccttcctggagtaccgccgccaggtgcgcgacttcccgccgcctgcgctatcactggagctgcagccgccacccccgcagcgcaactcggtgccgccgccgccgccgccgctgcacggcccgcctgggcgcccccacatgtcctcgcccacgcgtgaccccctggacacgtgacagggcccgcgcggcccccgacacgcccctggggcgcagagacaccgggttggcttggggcgcgcggtttgcatgggatggggtgggggcgggctcccctagggacaggtgcctcgagtgcccgtgcctggggtcccgcggccgcttcttcatctcaggaatctctcggaccgcggatcctcagcccccgctccaccagcccgccccagcgcgtgggtctgtttgggaggcctgggccggagcagagcagaggtgatccggcccctgcctgctgggccgcccgggttggaagggagggcagtgtgggcggagatctgctccttcggtgggggcctctggctcagatttggggccaaggaggcctctgtcattttaaagactcgtgtttacagttttgtatccaaggccgcactgctttgcctgttcctgtgtccctgtgtttaccagccaggctgggaggcggggagccaggaggggtgtgtggagggcgggggagatggtggcgtccaagtgccggatgctggtgaggctgggccgctccacttcctccggggctctcaggagctcctgggggccactgccgctctgtcccagggacagctcctccactccagcttcggtgttcccaattatcttcctgggataccttgacccccatcttcccccagcaccgtaggtgtcctggcccctgctcccctcaacctcaggcatgacagtgtctcccacatccctggtttccttctcccccaccgtggaacctaccttccctgtgggctcctccagcccaggacagccacagccagatggaatcagggtgttcccaagttgatgtggcagccccaggtcgcagccccaggagcagcacggagcctggccccaccttaccatcctggccttgccccagcacgggagctggcagcccctggcacaggcagcacccgccctgaagcccatctgcaaggggtctctcacctgccttccacctgggaccctgtacctgtgatgtggccctgggtatccacctggcctgggaaggtccgtagcatctggggaggggccctttatgaggctgctaaaagaattgtttgaggatgcccgctccatgagcgggtgatggtcacacacatctcatgtggcacagttcactgcctgggccttcgcttcccgcatttccacggcccaaaggtggcaaggtttagccagccagggctaaaaccatcgaggggagtggagctggctgctcaagtggggtcctccccaagtgcatttcccaacaactgcagcagttaagggcgtggctggtggcagccccagccgcaccccgaccccacacagtcctcataccccagctccaggccacctggggtctggcctttgaaagtcgcctgccttccaggcagctggcctcgggaccactgtcctcagggtcccgggcagggggactacctcgctgtccaggtcagacgtggccggcgctctgcccacctctaaaaccgtgccttggccccggcctccgatcatatccccagcagcccctccaagcgccgagcgccgtgggtgggcacggggcgctggcctgggtaggaggtcagaggcgccctgctctgggctgtgcccaggccactaatgatcgtgttgggaagtggaaggtctgcaggatcaagggggctggggggccggggaggggcggtgatgagcagccgtggaaaggccccaggcctggcatggagagagaagaggggctgtgggagttgcgtgggccagtgggaggacctgggccttcttgggagggagtggtctggagtggggggtagtgggtgaggggcgagcttcattctgcctgtctgggctggagcctgtttcctcccctggctgaagccagtgccggccccatcctgccttaagggtctcctgggtgaagacgagcccacaatcatcttggctctggcacctgcagcaaatcccatgggaacagacaggcagcgtggccatgggtgaatggagctgaggggctctgggctcctgacatcctgctctgacccttcctgaaagcccatggtctcttccatgctggctgcagtctgggaggcgttgggcccagcttggcctgtgaaagctgaaagcccacaccccctagtcagaggctggtttagctactcccctagtttagctactcttggggcagtgaaggccctggggctcgaagacctccccaggcaaccttaccctgcacacaccccactcctcctggcctgttcaggggtggtccctggtctccgtgctccttggcacaggccagtgccctctacctctgccaccacatccctggcagtggaggtccaagtcctggctgtcccccctctcaccagtggggccagggatcctggctctacccgctatgacttggttcaatggcccatcgcctctgcaactgactctgagggcattggagcagacatcaagccccaccctgcccaggcccatgcctggcacctggtttccacgacgaggcgcagctgtggctccgactgtggcagggctgggaagcagggggcctttgtcaggctcacggcctgaggtttctggcctctgtgatctcccctgggaacaggacggggaccgggccgcactccagcctgcccttcgtgagtttcctgaggtgtcctgcaatggccagattcgacggagaagccagtcagctcccttgtcccctcactgattcctggtgagtacgtgagtcctgatgcgtgtccactacccgctggccctgtgctggggcctggtgcccaacccaggcagagacgtctggggacagccacactttggggagttagggcctgggaggagcagggaggcctcctcagatgggcttgggttggacttgggagctggcctcgagggaggcccgcaggtgcagcagcctggaggcagagagctgggtgtgtcagtgcctgagagggccgtggtgggcagctcaccagcaaagggagcagaaagggcccgggggagaagtgggcagctcagagggaagaggcggggctgggatgctgagcagggtgtggacggagatgcagctgggtgcaccagtgtggtttggctgggaagggaggcgtgtgtgtgggggagagaaattgggcagtggaggtcctgtcctgagaaaggggctgtctgcaggcactctgctccctctcgtggcctagtctgcctctacaccagcagagacctccctgccctgcggccaccaggaatccatgcagcgtgcatgccccaccatagctccaccgccaccaggaattcaggtgctgctgaagctgcatcaagaaagccccagcccagtcgcctcccctagatgaatgagagtgagctcttttctaattgtgaaggacatggcagattgtagctgtgaagacactgtcaggtcactctgtggaagtttgaggtgagcccttccagggtcacctggccatggaggacccaggctcagcccatctttcttcaccatctgggggggttggtgatggagccacaacagcagcgagcatcacattgtctcaaaatgtcatccgcgtgagggaaggagggacggctcctccttgggtgcctccctctccttgggaggaaaacccttctcagaagcccccagaatgtgtctgctgaggtcctgtggtccagagcttgttccaggacaatgtgtacacttccgctggcaggggacatgggtgtcatgactggctgcctgcccacaggtgagcccgtggtatcatggatgccccagaagacacgagactcgtgggtctgagacaaagggccctgtttctcagcatgagcttcagctgtggctcctcttgcctacaatcccgtgggggcgacgggagtgcctggcgatgcagcacacacagctggcaggagcccaccctccctctgccattacccaggaggccgcagtgtgacatcaaaaatactctgcaacttggcccaggttcacattctgcaaaagctgtgagcttgcaaattgcctttgatcctataagagccatcatggtgatcaatttctttctacacaacgccagcacatatttaaccccccacacggagcaacgtccagtttaacccgcacagcagcaacccagcctccagctctgtctcaccaagcacgtgtcaacaattctcttcctaggtgattccagcagcacagcctggcagctcctgagcccttgggaagttctgcagctcggcttacccagggctgccctggccaaagccccagccactctcctttactgcagagagcgggaccgtgtcccccttcatccccctagaacggtagggctgggagctgcgtcagacctgcctccacgtgcctgtgggaagagacgtcggagtctgatcgcagacacaagaagatcagtcacccaaaaagataaaatatactcgaacttccgacccttcatcttcctttcagaacacactcacattttctataggaaaacagcctcataataataaaaactcaatttagcgaaagtgaactcacttatcttaagcaataagaaagccaaacattattggattcgttttatgcagtaaaataacggagatgcactaagtggcaacccccgagggaaaagccatcagagtcactgccagcgcagaatggtggcagaggctgcaaagccacattcccaccctggctgaaacatgggtggcttcatttgttgcaaaaacaaggtaactgccatttaaccagggaaagatgaagggaaaaaacaccccccaatcagaggctgtcagggagggcctctgtcctcggggcttgacctgcaggcaggccccagcagcagggctagggccgcactgggcgtgaggaccaagcgtgcagagggtcaagaggtgggtgaggagagggtagaaaaggcagtgggcaggtggggggaacaccagagggaggcagacgggggcaggaggaggaaggggcctgggtgccagagggaggtcaagacagggggaggtgggcaggagtgttgccagacacacggcagcccccggcccatgcccacccccgccaccctgcattggcacgaggtcccagatttccctgggacagtgccgcctctcctcactccgtggctgatgtggaatggactccgtcctctgagggctggggcagctgccaaggaaggggcgctaacatcacactgtcccccgagaaaggaaacccatggtgaccgctgtgctttgaacatttgcgtcccctccaaaacttatgtggaaacataatccccaatgcaacaggctgtccattttgtgtggctataataataccacaggctgggaactaatttacaaagaaaagacatttatttctcacagttctggaggctggaagtccaagattgaggtgccagctctggcgagggcctttgtgctgcatcggctcaccgtggaaggtgcaggggcaggaaagggtgagagagagagggcccagcttgctgtcgtaaccacccacagtgcagatagtaaacacgccccaagataatggcgttaacccctccacgagggtggaacccgcctggcctcatcacctcttaacggccccaccttttttttttttttttgagacggagtctcgctctgtcacccaggctggagtgcagtggcgcgatcttggctcactggaagctccgcctcccaggttcacgcattctcctgcctcagcctcccgagtagctgggactacaggtgcccgccaccacgcccggctaatttttttttttttgtatttttaatagagatggggttttcaccgtgttagccaggatggtctcgatctcctgacctcgtgatccactcgcctcggcctcccaaagtgctgggattacagacatgagccaccacgcctggcctgagatggagtcttgctctgtcgccaggctggagtgcagtggcgcgatcttgactcactgcaatctctgcctcccgggttcaagcaattctcctgcctcagcctcccaagtagctgggattacaggcgcctgccatcacctggctaattttttgtattttttttagtagagacagggttttgccatgttggccaggctggtcctgagctcctgacctcaagtgatctgcccgccttggcctcccaaagtgctgggattacaggtgtgagccaccgcgcccagctccccacctcttaatattgccatagtggcaattacatttccatatgaattttggaggggacactcaagccatagcccaggctcggatgatggtggtgtttgtcaacgtacacattcatttccctcctgggtgagtctgggcagtggtccaggctgccaggacacagatccctcctactcgtggcccctgggtcctgggtgtggatcttgctctcacaggtcaggctgcaccatcagggctcggcggcagcacagccagggtggaggaggttgacgaggcatgcttttggggtctctttgggatggggctcaggagctggcatgaggcacctgcccacactctgctgcccagaacttagacatgccagtgccctgagctgccagggagccaggaatagggacctgcctttgggtgccgcatgcccaggtgaggaagaaggggagccctcctgtgttgctgcaccttggtaactttactggacttttcagtgttttcctcccaagcgttgcccaaacctgcatcctgcccagcagtgagagagcccagggaccacctcctcactcacacctgctgctggcaaatcctctggacaaagtgcaatgctgcaacattttacaaaacagagtcgcccttgatggtcataatggccgagaaggaaaactcacgacgacggaagccatcgactggcgaaatttgatatggatgagcaccggcccgtggttcaggttttcgtagtaaaatttatgtgggggagaatttttttttgagagaaacgtgtgtttaatggtaaaaattagcataccccatcaccaggaatggcgtggagtagggacgggcagcagggacaggcaggtgacccctgtggagcctcacgtggcgaggatgaggaagacgaccaccaaacagaacagccccatggcctcagacacagcaaagcccagaatggcatcggagatgagctgctgcttgagaaacagattcccggcatagccaacaagctgccagacaccgttccaatgccaggcccgaagccagccacaccgacaggggctgccccaacaccaatcaacgtggctgctgtgtcaacatcccgggagacagctctggtctggaactcccacctggccacctggtgtggggagcggctgtaggaaggctgttcagatgaattttctgggctgttcaagaaggagacagacacagcctgattagacccgtggtacaacagcggaccagagctggagaggtgagtaatgcccgggggtctgcattttctgtctgcactcccactgccctgcagcacctgcgggcccacagcactcgcccggctgaaggtgacctaaggtgaccgactcacttttactcattgcttatgaaataagctgaatgtggagatcatcggaaacatgtttcaaagtgcgtgagccttgaggaaagctttctcccgccctcatgagtatccgccccagggggtgctttcctcgagagctggtccgtgttgcgttcccacagtgaacactttcaaggctgctgcgggaagttgcacagaaacggctggtgggcctggaggggatggtgaggcgcagtgggcctgtgtaccggatgccaaatccacagcatgggaggcagggcccactgcaggagccacacagcagctgtgtgctgctctcccacctgcaacctgcacctgtggggtgcacctgagtgaccccggccccccggggtgtctctgggatgcctcctaggaggagaggctccacgcctggagggagacaggtatcacacaggtgcgtggggtggagtgtgatgcagggaggttggggcagggccacacagagagaccccactcaggcaggccttgggtcagggtaggcctcaccaagtgatattatgttgggactggaccgtggccaaggctggcctgcaggcagggggcacacatattcctggcaggtgaggctgcccacaaagctcacctgcctgagaaccctacctggctggggcatgcgggagcctctggaccttcgcgccggcggagcctgcagtgtcgccagatggccacaagggggctcccgagcccggctctgggtccctttgaggagggagccgcgggacccggctgtgagaccgggacctgccagtggtgccccgaccccccgaccccacaggaccctgcgcggccaaaggctgaggctgccccagccccaggctgtgctgatgcccctgaccagaacccgagcccgattctgctcactgaacactcatctgctcccttgcctctgcctgccccggcagcgagggcctggccagtgggttcgtatcaactcccacgtcacctcccgtgtcatctgtgtgtcacctccatgtcacctcctgcatcagctgtgtcacctcccacatcacctgcatcagctgtgtcacctcccacatcccctgcatcagctctgtgtcacctcccacatcacctgcatcagctctgtgtcacctcccgcatcacctgcatcagctctgtgtcacctcccgcatcacctgcatcagctctgtgtcacctcccgcatcacctcctgcgccacctttgtgtcacctcccggctgaccatggcccagcagcatctccctgttgcagcgtccggagaggctgcggttgcacggggtgggctaaggaaggtggggctgcctcagcctgggccctgagtgagctctggagtggatcccacctccccaccaaagcccaagcaggagacaaccctttgctgctgaagccactgagcgcttggggctgtttgtttcggcctcgtccccgacggacgtgtctcccacagtcccaggccctgagtgcaggtccacactgaaccttgacgctcatcgcagactgaccctggcttgccctgggtcacactcgggctgaggccccgacagcctggcccggtcgaagctccccggcttatctcactcactgttgtccagggcccagcctcacggtgacatctgccacaagaaggctgggactctgtcccacttgtgttcaggaacgagagaccctgacttggtgtctgttatcaacacattacaaacatcactgggcattacaaaagatttctgagggctgggtgctgtggctcacccctgcaatcccagcactttgggaggctgaggtgggaggaggattgcttgagcccaggagtttgagaccagcctgggcaatgtagtgagaccttgtctctaaaaaaattttaaaaattagccaggcatggttgcgcgtgcctgtggtcccagctactcaggaggctgaggcaggaggatcacctgagcccaggaggtcaaggctacagcaagcagagatggtgccactgcactccagcctggacaacatagcaagaccctgtctcaagaaaacccacacaaaacacaaagaaagaaataaaaatccagatttcaaataatttaaacttatttatccaacacaaagcagttcttcatggcacactttaaacttcgaaattctttgctctccccatgcttggctgattgggtctggggcaggcgatggtgctcactggatccagtttctgacaaatctggattgagacaagcttcagaactggcccagatgatcaattttcatataagttaaggtgtcctccttgttccacagcttttagtgatttttttttgttttttttttttgagacggagtcttgctttctcgccaggctggagtgcagtggtgcgatcttggctcattgcaacctccgcctcctgggttcaagcgattctcctgcctcagccttctgagtagccgggagtacaggcacatgccaccacactcggctaattttttgtatttttagtagagatggggtttcaccgtgttagccaggatggtctcgatctcctgacctcgtgatccgcccgcctcggcctcctaaagtgctgggattacaggcgtgagccaccacacctggcgcttttaggtgatttgataatacatttttctgttaaaattttatgatacataatatagaaagaatctacgtaaaatgatgtccatgcatttatgcacacagagcccactttgagagacagaatatgagggcctttggtcctgccaggagcaaagaaagttaataaaaaatcaagtctgggccaggggtggtggctcatgcctgtaatcccagcactttgggaggccgaggcaggcggatcacctgaggtcaggggttcaagaccagcctggccaacatggtgaaaccccatctctactaaaaatataaaaattagccaggcgtggtgacatacgtctgtagtcccagctactcgggagtctgaggcaggagaatcacttgaacccaggaggcagaggttgcagtgagccgagatcgcgccactgcactccagcctgggcgacaagagtgaggctctgtctcaaaaacaaaacacaaacaaaaaaaatcaactctgggccaggtgtggtggcttgcgcctataattccagcactttgggaggctgaggcaggaggatcgcttgagcccaggagttccagaccagcctgggcagcatggcaataccttgtcactacaaaaaattttaaaacttagcagggcatagtggtgtgcacctgtagtcccaggtacttgggaggctgaggtgggaggataccttgagcccaggaggtggaggctggaatgagctatgattgcaccactgcactccagtctgggtgacagagcaagaccctgtctcaaaaaaatgaaaaaaatcaccctggagaacctgtatttataggaagacatattgattccagcggcaaacgcttagggctgcagagccctgggcaggctggatgctgtcttggccccatgtggggtgagggctgcagattgtggtggaggccccggggaggcagagggaaccctcgggaaccatttccctgccttctgctctcgtgactgaccttttcttggcgaaacttggtgggggcagctgggcctctgccactggcatcctttggatgcttcctggtggtggcaaccctgtggggaggagttggggaacctgtgggccaacgcggctccgtgagcctcatcaggctgcagggcaccttggttctcccttcctgacccctctctgcccgtctcctttctgctctgtttgtcagatttttttttctcattttgattccattttgtttctgacaactttcccaagaccattgctcctccagaggcggctgggtccacacagcttccctttgtgccggaccctcgccttgctgggtcttgggctgcaaagctcggatgctgacagccttaggttcctgtgctgaccctcgcggtttccgcatcccactcatcccactctcacctctagttcctttggagatagaccttccatggaaaatcccagttggagcacacccgccgcattcccgttccctcacctgcccactccgtccacgtctccagggctgggctgcaactgtggagaccaccgcctccagccttctccatcatggagactggaaggtgaagcccggctagagggcagcctggtggtggggcaagaaataggacggctcaccggctgagccagggtgatgaggcctctctgctcccccttcctctctccaaagcttgccaggacccacccagaccaggctgcggccttcagcacttccccaggccacaccacaagacagaggaactgagcccctctggggcacatgccctcccaggccaaagtaacaagacgcctggagagaagagcgcctgaaagaaaaacagcaccctccacagcatgacttgtgtgcagcaggagtatgagaccctctgggcaaagaattaaagacaaatgcggtaacatccttgaagaattaaggaaagatattagcaataacagggagaaagcaataacagggagcacaaagaactaagtaggaatatcaggtatcaaaataatgattgagaaaaatgtggtaactgaaattcagtgggacggacgcagccgaggaaaacaatctgcgaagtgacagacgaggggaaggaatcctggcagagtggccagcatgcaggaagaaggacagggactgtgaggagagaagtgggtgggaggacagagcagaagaaaaagatgagagggattttcaaacattagggatgaaagacgccacagaaatccaaaagatgatatgaggaaaacctgtacctagtcacaattatattaaaattgaagaatattaggaaaaaaagggaatatttaaaaaatgttgaaaagaaggaaaaagttttaatggaagagcaagtggtggataaagggtaagaatcacaccgacttcagacctttcaacatgattcaaaaatgcaagaggactacaaattatttttaaggtatcaaaaaaacccactttatacctttttttttttttctgagacagggtcttgcactgtcacccaggctgcagtgcggtggctcaatcacagctcaccacagcgttgaactcctgtgctcaagcaatcctcccacctcagcctcctgagtacctggagcacaggtatgtgctaccacacctggctaatcttttaattttttgtagagatggggtttccctatgtttctcgggctggttttgaactcctagctgcaagcaatgctcccaccccagcctcccaaaatgctggggttacaggcatgtggccaacctacacctataatcttatatccagcaaatttttaaattcaaatgtgaaggtatactaaaaacatttttaggcaaaagaggcctcagaatacttgctatacagagaccacattgaaaacactgtaggaaaaagttctcgcaaacgaagggaaaatcccaggagctgttgcaagagatacaggaagaaagagcgagtaaaggttattgttaatatcatgatatatacctatataatatactgttgataacagatatcatgaaaatgaaaaattgataatatgtctacaattacccataaccaaaactccagacaatatcaatatgatgcgggataaggaattaatcaaggaactaagattatgctaaagcatatatcttgttgggagaatatgaattatatttatgaatacattcaataaatgagtaaagttattaaaagttaatcttaagaacaatcaccatgaaagttacaagtacaattttttaaactagtaaaagaagatgtaatctattcaatggaaaacaggaaatgtggaagaaacaaacaaaaaataactttgatgatagaactaaatcataatacagttgtaatcacaataaatattaatggcttaaactaatcagttaaaaagtagagattcttgtattgaaattaaaaaaaaattaagacaagacaaagctaggcatagtggcagacacttgcctatagcccctgctactcaggctcaggaggctggggtggaggattgcttgagtccaggaatttgagtccagcctgggcaacacagcaagaccctgtctctgaaacaaacaaatgaacaaacaaagaaacgagcactccaagagcaactttataattaaaacaaaagaagacacaagttgaaaaattacaaggatagaaaactatgaactaagagggttatcatcacagttatagcagggaagctaggagtggagagggatcctggccattgaatgcttagacctggaaattccatacatcgcttctcaaatatcattggccagaacgaatgacaaggccaaggggtgagggaggagtaactctgtgctcctggaagtagagaaccactggctattggtgaatatgaacaatgtttactgctaccacatacagattcttaatataagataaaaaggaaacaccacaaatcaatgagacaagatcgtttataaatggtgttggcaaaatcgactcactatacagggaataatagaaactgggcctccaccacttatcccatatgtgcgtggacttgagccagattatagatctgtgaattgcaaaactataaagttaatgctaaaaaaaggaggatcacttattgatgttggagcagggaaaaagttataaaataaaaattcggaagcacaaatcataaggcagatgattgaaaagacagcttacatgaaaattcagaaaatacttcctgactgttctgtgcttggcttccttcacctgtaaaatggggagttaatttaactaaggggttgagagcagcccccaggccattgtaagtgcttcgtgtgctacatgttattacaataatcagtatttcatgccctttaaaacatctctagtaatgctttttcccaaaacatcaattttgcctgacagtaaaatgccacaaacttgtgagttttgtgagctactgtgtgcctggtttatcttttcccatgattttccctcctaactcttctgtgtcattttgttttgtgtgtgtctcttgaaaaaccacatagctggattaagagcatccatcttttaactggagaatgtagtccatgtctttttattttcattactcgttatttatttctacctccttattttgtgtttctatttgtcttgctttttctgagtatcttttaaatcgttttcttatttctttaggagttattttcctcacttaatctttcttcttctgatttagaagttatacattcagtttctattcttttgttaaacaaattttaaattttaccttttagagacaaggtctcacttgtcacccatgctgggtgcagtggtgtgatcatagctcactgcaacctcaacctcttgggttcaaacgatcctctagccttagcctcccagtagctaagactacaggcatgggccacaacacctagctaacttttaatttgtttgtagagacaggatcttgctatgttgcccaggctggtctcaaacttctgggctcaagtgagccttctgccttggcctcccaaagtgctgggattataggtatgagccactgtgcctggcctggcatcttgtttttatatggtattgaaaagctaaacatatttgggtctgttattaacatgagaagctgtactatgaggaagcgtgtttttaaaaattatgaaatgttaggctgggcgtggtagctcatgcctgtaatcccagcactttgggaggctgaggcaggcggatcacatgaggccaggagctagagaccagcctggccaacatggtgtaactccatctctacaaaaaatacaaaaactagctaggcatggtggtgcatgcttgtaattccagctacttgggaggctgaggcacgaaaatcgctttaacctgggaggtggagtgagccaagattgcaccactgcactccactccagccttggcaacagagcaagactttgtctcaaaaaaaaaaaaaaaaaaaaaaagttgtaaaaggattgtggaaaagggatcttatgtggttaaagtcggcaccgtcccccaaatcaccaacccccaggtcccaaggcctgggctgggccagggctgacagggaagcccaggagtcttttgaacccactcttcctgcctagaatagagacaggacaggctttatgtcccccattcctccctcccaactccagggacattgaaagtgtcctttgtacctacctgcaggaaattggggggctgggagggagggaactgaaaatacacatttgttatcaaaaataaacccctgagggggaggcggcaggaagattgccccccacatcccttccttcacatccaccccaccaaatataggaagagatgactccctctcctctattgaaaagccccatttaaaaatagattatactatcaaaatggcagcaggggagagacagggagacctggagtactggctggaggggccccccagacaggaaccacccccacaaaacccctccatgggaggaaacaggcaggaccccagggagtttggcagacaaaggaatggcttctcagggggaagaagaacaaagggacattcctccctggccaaaaagttggttaaaaaaggataagctgtctgagagaaaggttgaggaggtggaaatttctattccaagggtgtgattctgccttggccaagactcccaacccattaaatggtacaaattcttcctggaccccgagtatggccaggaataataaaacgaaactaacttctactcacatcctaaaatggacacagggctccctcatctccccacgggcaggccgaggaatgaagaaagaaaggtcgttctcaagccagaccccgattgtcctgtcttggggaaaaaagcggggaggtgggggagacgtcctgaccaccctaataggttaggtcaggcgcttcccagtggccttcaaaaaataaataaataaaccgcccctaccattgaagtaggagacgtgtcagggcagccactgggggacggacagaaaagagagaaaagagagaagctgtggaagctgagtgttttctgtggaggagttaatgagagtcactcctgggagaaatccttcccaaggatccccaccccaccacaatcagagcatgagtctttcagttgaactgtgtttctccttgagagagcacggatggagggaccccagaaggggtggtggtgctggtggtggtcatggcctctggggccctggcgagagcaccgcgggggtcgagaggccagccacgccgatggaagggatgtgcacctgggcgccgccactggacggaagctggcaggagagcttggccgggctgcggggcgcagcgggactcaggctgctccggaagtgaacgctgggaggcagcgagctgggtgtcagcagcgccggggtcaacgtgtgcgtaggaagcagggacagggtcagcgccggcctcggcgcctggaggccggagccagttcccgatcctggggtccgttcggctcccggcgcacctagcaggctcgggctgagtggaagctctaggtcccggggcttccggcccttctgcggctgggagatctgagggctggaagccgcgtggccgcccgcctgccctgcggtgtccataaggacctcggcagccacgctggcacgccctcctgtggagggacttcaggctcggccttggcggtttctggcacgaaccctctctcccccgcgaattccagctcttcctcgggcccttccacttccacttccgggggcaaagggcggcgcaagcccggctccacattcggctcttccaatttcaggtttggggcctcgggcggggtcaggatgacctgcagagggaagccggcttcctcagcctccaggcaggcctcccaggggcttggactgcaggagctgcgttggggagcaccgcagcaggccgaggctgagggggtggctgcggctgcagagactggatgtgaaggtggaacagaggcccgagcgcatgtacttgttccggctgttgcgcgccaaaccgccagggcctgccattcctgcacccttgggtgtgcctggctttcctgaggcagtgccccctggggcggcatgtgcagcagcaggggccacaactgccatggtgaagtaaccgacacctctgggtggggcgggcagtcctcactcagtggagcaccctgcgacctcaggataggacacaaacttgtagaccaacttctggccgctcaccttgcggatgatgttctcgtcatagtcgtgagaggtgacagcatgctggcagccctcactcgctctcggtgcctcctcggccttggcgcccactctggccacgcttgaagagcccttcagcccgccgctgcaccgtgggagcccttgtctgggctggccgaggccggagccggctccctcggcttgcagggaggtgtgaagggagaggcacgggtgggaaccggggctgtgcgcggcgcttgcgggccagcgcgagttctgggtgggcgtgggctccgcgggccccgcactcggagtggcaggccccgcctgccctgggcagtgaggggcttagcacccgggccagcagctgcggagggtgcgccggggtccccagcagtgctggcccaccggcgctgtgctccatttctcactgggccttacctgcctcgccgtagggcagggctcgagacctgcagcttgccatgcctgagcctccccgccgccccccaccgccacccgccggcatgggctccggcctggcccgagcctcccggaagagcgctgccccctgctccactgcgtctggtcccattgaccgtccaagggctgaggagtgtgggcacacagcgggggactaacaagcagctccacctatagcccaggtgcaagatacactgggtgaagccagcagggctcctgagtctagtggcgacttggagaacctttatgtctagctaagggattgtaaatacaccaatcagcaccctgtatctagctcaaggtttgtaaacacaccaatcagcaccctgtgcctagctcagggtttgtggatgcaccagttggcacgctgtatctagttaatctggtggggacttggagaacctgtatgtctagctaagggattgtaaatacaccaatcagcactctgtatctagctcaaggtttgtaaacccaccaatcagcaccctgtgtctagctcagggtttgcggatgcaccaatcggcactctgtatctagttaatctggtggggacttggagaatctttatgtctagctaagggattgtaaatacaccaatcagcactctgtatctagctcaagagttgtaaatgcaccaatcagcgctctgtgtctagctaatctggtggggacttggagaatctttatgtctagctaagggactgtgaatgcaccaatcagcactctgtatctagctcaaggtttgtaaatgcaccaatgagcactgtgtctagctcagggtttgtaaatacaccaattgacactctgtatctagctaatctagtggggacgtggagaacttttgtgtctagctcagggattgtaaacacaccaatcagcaccctgtcaaaacggaccaatcagctccctgtaaaacagaccaatcggctctctgtaaaatggaccaatcagcaggatgtgggtggggccagataagggaataaaggcaggctgcctgagccagcagcggcaacccgttagggtcgtcttctataggggaaagctttgtttttcactgtttgtaataaatcttgttactgcttcgtttttgcatttacagtgcctttgtgagctgtgacactcatggtaaaggtctgtagcttcatttctgaaaccagcgagacccccaacccaccaggaagaacaaacaactctagacgcggtgccttaaaagctctaacactcaccacgaaggtctgcagcttcagtcttgaaccaccgagaccacaaacccaccagaagaaaaaaaaaaacaaaaactcggaacatgagggaacaaacggcgggacatgccgcctattaagaactgtagcactcactgcgagggtccgcggcttcgttgttgaagtcagtgagatcaagaaccgaccaattccagacacagtagtacggcaaggcccgcctgagcttgtcgtaattcacgttggtcttgttcttgcgtcgcccccacggctaggccaccttcctctgcaaccaccaccatcccatgaagtccaggagctgtggccgttgccttgctctcagctgcagcagaaagtgccagagcgtcacaggtgggtccatcgccgggggagtgctcacgccatcctaggggtacctgtgtgtagcggggcggtggtgctggccatgctggcagctccgggaggtggggggctccatacgcggccccgccgccccccaggcctgggtgcggaggccggaaggttttttttttttacgttttaagtaattggcttaggaaaaacaaggatttttgtgtgccatcaagataacttgtgcttcatgttgtttttcattatgtcagtgattcacgaaaaaggtaattttttttcgcaaagacatttttctgaagtagagagctgcgtttgacgtcccaagtctccgcaaggtgtaacaagacaagcatcaaaagtaatgatttggggtgactttgccgtggttacattaataatgagatgtggggtagctaagggaaagagaagaggaaatgcggacaggccaattaggcttttttctttcacgttactctggtgggggttggtcctgggatgaaggtccgtgactttggagagggagactcctttttgactgggtatggtgggtctactccttagcgggctgactgccgtctcagtcgttaggagcatcacataaggtcctttccaggtgggttcaagcttttcccctttccaacttctgataagaatgtgatctcggggctggtgttgaactgagaattcaagggaggagaggatagaagacagactggatacatagtttttaagaaactcatcgtttgtctcaaatgttgggaggtgagtagtggaacttaaataaagcaacccatgaagcatttcataaggggataggccgatgtcttttcagggagcagttcagactcttatagggccatgggaagacacttagtcatggtaaccgggtttctagaattaatttaggtaggtgggtttttagagtctggttcattctttctgctcttcctggtgagggtggatgccagggagtatggtattcccactttatttgtagtgcttgggttagccctttaatgagcacggtaaagtgggtcccattgtctgaatcagtggtctctgttagtttgaacctgggtatgatgtgttctaacagggttttaactgcatcactggctgttgcgcgtgggaaggggagagcttctgcccagtgggtaaggtggtctgctatcactagtaaatacttgaggtggcctattggggtcatttcaatatagtcagcttggatgctttggaatggccttacccctggattgtaggctgggcatggtggctcatgcccataatcccagcactttgggaggtcaaggtgggaggatcctttgagactaggagttgaagacaagtcttgggaacttagtgagaccctgtcactacaaaaaaataaaaattagcccggtgacatggcacatgtctgtaatccccaccactccgaagactgaggtgggaggatagcatgagcttgaaaggtggaggctgcagtgagcaatggttgcaccactgtattccagcctgggtgacagagcaagagcctgtctcaaaaaagagattttaaactaattaggcttttttttttgtttgttttttttttgagacagtctcactctgttgcccaggctggagtgcaatggtgagatcttggctcactgcaacctccgtctcatgggttcaagtgattctcgtgcctcatcctcccaagtagttggaactacaggtgtgtgccatcacgcccagctaaattttgtatttttagtagagatggagtttcaccatgttggccaggctggtctcaaactcaacctcaggtgatctgcccacctcagcctcccaaagtgctgggattacaggtgtgagcaactgtgcctggtctaattgggcttatttgataagtaaagttataaagaaaacaaatagtatttgatactacatctttaaatcatatttttggatatgtcattaatgaatgcttcagaaattatgtggaaatcctagaaatcggatatgtcctggtataattttatcagccataatttcagatattgtgttaaagtgttgtatgttacagaaataaccagatttccttgtcaattgtatcattattataatgaactctcatcagatctttaaaaatggccattttaagcctttgccattcagttattcttttcctttgattctttactaaagtaatttgcaattaggtagacaaaagtggctattcttcaagattcatgaaaaagactctgacagttactccgaaatacagaccgctgctgatagctttaagatcataccattggactgtgtaagaattttcagaaatggaatgaaaaaactgatgtcatcagactactaatccagcttcaaacagaacaagattcaattacatgggactgaatgaacaaaggaagataatttttttttttttttttgagatggagtctcactctgttgctcatgctggagtgcaatggcgcgatctcggctcactgcaaccaccacctcccgggttcaagtgattctcctgcctcagcctcctgagcagctgggattacaggggtgcgccaccacacccagctaatttttttgtatttttagtacagacggggtttcaccatgttgttcaggctggtctcgaactcctgacctcgtgatctgcccgccttggcctcccaaagtgctgggattataggtgtgagccactgcacccggccgaggataatttttaaatgactttttgttggaaacattgctggttctttaatgttttgtttttcagattttagaaaacttttttcccttaagctgtcaatagtttgcagcaatttggtaagttacatctttgtgaacagagaggaaacaactattttctcccttcctaatccctccagaaccccaaaaccagtagtgagtgtttttattgaagggggccagcccctccacacctgtgggtatttttcgtcaggtgggacgagagactgagaaaagaagtaagacatagatacaaagtatagagaaagcacagtgggccaaggagaccagggctcagcatacggaggacccgcaccggcacgggcctctgagttccctcagtatttattgattactattttcactatctcagcaagaggaatgcggcaggagaacagggtgacagtggggagaaggtcagcaagaaaacgtgagcaaaggaatctgtgtcacaaataagttcaagagaaggtactatccctggatgtgcacataggccagatttatgcttctctccaccctaacatctcagtgtagtgaagagtaacagcagcattgccaccagcatatcttgcctccagacacagggcggttttctcctcagaataaaatgaatgtatgatcaggttttacaccgagacattctgctcccagggacatgcaggagacggaggccttcctcttatctcatccacaagaggctttcctctttttttttttttttttttttttgttgagacagagtctcgctctgtcgcccaggctggagtgcagtggcatgatctgggctcactgcaaactccgcctcctgggttcatgccattctcctgcctcagcctcccgagtagctgggactacaggcgcccaccaccacgcccagctaattgtatttttttttttttttttagtagagacagagtttcaccatgttagccaggatggtctcgatctcctgacctacctggtgatccatccgcctcggcctcccaaagtgctgggattacaggcatgagccaccgcacccggccgaggccttcctcttttactaatcctcctcagcacagaccctttacaggtgtcgggctagggggacggtcaggtctttcccttcccatgaggccatatttcagactgtctcagggcggggaaaccttggacaatacccaggctttccagggcagaggtccctggctttccgcagtgcattgtgtccctggttaatcgagactggagaatggtgatgacttttaccaagcatactgcctgtaaacattttgttaacaaggcatgtcctgcacagccctagatcccttaaaccttgattccatacagcacaggtttctgtgagctcaaggttggggctaaagttacaggttaacagcatctcaaggcaaaacaatttttcttggtacagatcaaaatggagtttcttatgtcttccttttctatatagacacagtaacggtttgatctctcttttccctacacttatttttatgacagtagagttatttgtaaaagttcagtaagaatctgttctccttgtaacggcacaattacagactctgatgatattaccaaggctttgaccggaatatcctatcttcagatacgaccacacagctttaaggaactagagttgactttatggagccagtaaacccccccttggaaaaattggcctgagggttcccagtcttgcaggttgagtaaggcagcccagcaacctctgtattttggggactgagcagaaaggaactcacccagatctataggtaccctgtgccaagtcagatggcatgtccttgatgtggcttcccagccccgggaggcctttacagttcaatctgagattctttatgaaaagctccagcaaagcaattttttttttattttgagacggagtctcattctgtcacccaggctggagtgcaatggcgtgatcttgactctgcaacctccgcctgccaggttcatgtaattctcctgcttcagcctcccgagtagctgggattacaggtgcacaccaccacactcagctaatttttttatttttagtagagacggggtttcactatgttaggcagactggtcttgaattcctgacctcgtgatccacctgcctcagtctcccaaagtgctgggattacaggcatgagccaccacgcccagcctccagcaaagcaaatttaaagagagcgaatgtggtcaactgcttcttgttgcacttatgtaaacaatcaggccaagtatagtgaaactagactgactttgcaaacatatcactcttatttggatcaacatttatggaaatgtgggagtgactgtggagaaaaaaatgattcaatgcaaaactgcagggcaccgtgatgagatttcagccctgctcattgtttacgaggttttgttatttatctacaaactggactggatcttgaatttttagggaaaagaaagatcagactgttattgtgtctatgtagaaaaggaagacataagagattccattttgacctgtaccctaaacaattgctcacagaaacctgtgctgtatgggatcaaggtttaagggatctaggctgtgcaggacgtgccttgttaacaaagtgttcacaggcagtatgcttggtaaaagtcatcgccattctccagtctcgatgaaccaggggcacaatacactgcggaaagccgcagggacctctgccctggaaagccgggtattgtccacggtttctccccatgtgatagtctgaaatatggcctcgtgggatgagaaagagctgaccgtcccccagcccgacacccgtgaagggtctgtgctgaggaggattggtaaaagaggaaggcctcttgcagttgagatagaggaaggccactgtctcctgcctgcccctgggaacggaatgtctcggtataaaacccgattgtacatttattctattctgagataggagaaaaaccaccctgtggtgggagacgagacatgctggcagcaatgctgccttgttatttactccgctgagatgtttgggtggagagaaacataaatctgtcctacgtgcatgtccaggcatagtaccttcccttgaacttacttgtgacacagattcctttgctcacgttttcttgctgacctcctccccactgttctcctgctgcattccccttgctgagatagtgaaaatagtaatcaataaatactgagggaactcagaggccggtgccggtgcaggtcctctgtatgctgagcgctggtttcctgggcccactgtgctttctctatactttgtctctgtgtcttatttcttttctcagtctctcgtcccacctgacgagaaatacccacaggtgtggaggggctggccccttcagaattcttctagttttctctaatatcaggcaacaactctgcaaactaatttttccaatttttccctcaccctctgacttggaatcagtcaaatttaaaactgctctgttcctgaagccctgtgagctgaaatgggacaagttgatgtaaactttagagaaatcatccccacagatcctgtgcgggcagcttctgcaacacctgacctgcaaatcaggaaggcccttcagctgcctacctggctgcagctgaagatgcttcaggcccagcgtctagaaatcttccagcctggtgcccactgggttcggaaactgcatttctaagtgttaacctttgtgtttcgtttattttcagagtctctcctctttgaatgtccaactgctagcaccatgcggcaaaatgtcctcttctacccagtcccaacagaaaatccagctggttcttaatgaacgaaaggccacccaacaagaaaatgtacttatattgttggagggaaaccagaatgtctcctctttctttaaacagggtggactgacaaagattctctgcttggccaaactacagtcgggctctggaaccttctcctaggccagcctgcacttccttgtaagaaaaaggctttaaaaagtacccggtggggcccggagcggtggctcatgcctgtaatcccagcactctgggaggctgaggtgggcggatcatctgaggtcaagagttcaagaccagcctggccaacatggtgaaaccctgtctagtaaaaatacaaaaattagctgggtgtggtggagggtgcctgtaatcccagctactcgggaggctgaggcaggagaatcgcttgaacccgggaggcagaggttgcagtgagccaagatcatgccactgcactccagcctggtgacagagtgagactccgtctcaaaaaaaaaaaaagaacccccctaagtcaggttaaagacccactcttgacatctgatcacccttgatcctgagttcctcatcttccaccatctcccaggtctgatcaccctggtctgtcttcagcaaaaatcttcctgggctaatttagccagaaccctccttccccccaatatttcctcttgggaatgtccgtcctccgagtttacccagctccctccttggctgtcgatccctgccagcccatgctgtgttaagaactgagccccatctctctcccccatggccatggtccctgctcctgtggcggtggtcctgaatcacacctgcttccgcattgaacaactatcatggaataattttttctttaacatttctaaacacactcttaggaggcgccagcagccagcgtgcggagttaagtgcctgtgccctttgtatgaaagtgtcaccgttgtcctggtcttgaggggtggctttcgggtgtaaacggccggcagaggtgagtagatgctgggaggctgctccaggcgtcttgtttgctccagggttcttgagactctcctgtctatgagaacgtgcagtggcacgggacggccgccggggggctcccgagtccggctctggagtctgtggccgcgcgagtgcacctgcctgggccggccctgacggattttttttttttttttttgatggagtctcactctgtctcccaggctggagggtagtggcgcgatggcagctcactgcaacctccgcctcccgggctcaagcgattctcctgcctcagcctcctgagtagctgggaccacagacacccgccaccacgtccagctaatttttgtgtttttaatagagaccgggtttcaccatgttggcctggctggtctctccaactcctgacctcaggtgacccacccacctctgcctcgaaaagtgctgggattacagatgtgagccaccacgcccggcctccttttggatgcttctaaagtctctttgtctctggtgttggcagttccatcggcaagcgtcaaggtgtggacgcggtttgcttttatttatcctgcttgggacttggccttgatcctgacacatcctgttattcagcgattttggaaaattcccagccactgcctcccccgactctgtttctcctttgggcagaagaagcccttgtgggagcctcggtccagcctccgcggggctgcgctcgggctgggtggcgtctcctgctctttcttcggtgttaccagctcctgctcctgcgtgtcctctgcgctgcctgtcccatccattcttattttagcctcatctattacggttttcagttctagaagttcttcgtaaaactctcaggtcatttcaaaatgcaatgtgcagtaatttcccattttgcagtaatatttgaatagcttctgtaagtaagtttaaaaaatctcttggccgagcgtggtggccacgctgtaatcccagcactttgggaggctgaggcaggaagatcatgaggtcaggagatcgagaccatcctggctaacacggtgaaaccccgtgtctactaaaaatccaaaaaaattagtcgggcgtggtggcgggcacctgtagtcccagctattcaggaggctgaggcaggagaatcgcttgaactcgggaggcggaggttgcagtgagccgagatcgcaccactgtactccagcctgggcgacagagcgagactccatctcaaaacaaaacaaacaaaaaaaccctcttaagcacacattgcatattctatgtctgataacgccgacattttgcttttgtttgggttcttattctatagtttcttgtttcactgattcttgtttctgcttctttagggcttttctgatttgtatgtgagctgggttcctgggatcctgatctgggcgcgtctttgaggcttgcctctgaggtccgctgtccccgcatgagcggacggcagagcgcgcctgcctgggagcccaggaggctgccgggccagggaccccgggaaccccgggaaccccgggaacctctcagcagcagaactgcagtggcacaagacggccaccagggggtcccgagccggtctctggggtccctgctggggttgaggggctgtggctgcagacgcggacctggcagggggacccgaaccccaacagggccctgaccggccccaaggctgagcctgccctgtcccaccagcgcccagaccccgatgttgggccggggccttcctttccttgtcccgaccctctgaggttcctccccggggtgtgagctgattgtgagcacacggaggccttcctcctctctggggctctggagcccctgggggcctgcagggcctgggcctgggcctggctgctgtcctctgtgctcaggaggcttctcccacccacccacttccgggcacagcccccagccccacacccagccgccgggagggcatccccaggggaggaccctctgctccggagccgcgtcccttgtcctccagggacagtggccggaggctggtgcctcaagctcgtgcgcctcatgcagcatcccgtgggtccattcgcgaccatagtgaagacccgcaggccccaggcccgagccggctcccgggcaggccgcgttctggggcttctgcggggacactgggccacgccaggaggaagggtcctgaccagggtcagggagcatcggatgctgccggcagaagtggggggcgcggggccccaccgaggagcccaggccagcttccccatctgccccaggtgcagccctgcaaggcccccaggccacagcgtccccaggtcacagcgtccccaggtcacagcgtccccacacccagggaatgcaggactttggcagaggctgggatcccagaccacagagccccacaagctgacgcctgttcgcggatgccacagccatctccgcggcaggcgctggggaggggaggggatcacagtgctggacacggaccgggccccagccctgagcccaaggcagagccgggatccggccccgagagcgcccctgcccctgcccctgcccctgcccctgcccctgcccgtgcccctgcccgtgcccctgcccctgccccgagcccgggaagcgccgcgtggtcggcggcgttcgatgctgctgtcggccacacgggggcagcagagcctcagcggctgccgcagcgggtccagtttccggccgccggggttgggctggcggtgcctgggggtcctccccagaggcccgcgtgtgaaacgtccgagtgcgctgggcgctggacacggagatgggtgcttgggccacgggcctgggggaccccacacggccggctaggcaggcccagacagcccagggtgggggttccatgggggcaggaggggagaagcctgggctgtggagcagctgggacgtccggggaagggcctgggggtcagaggggcggctcccgggacagggaggcacgtggaggggcggggtttgtggcagccccggagccgcctctgaagcttccatctgcagcctcctgtggggccgggtctgcttctcttgctgggcacccacatccacccccgaggggtgtgcgacaacccccattccagcccactcagatggtctctagcccctcccgtcacagtgaaccccggtgtcggtgcgagacgcctccgtgtattcccggacgtccctctgcaggcccatccccacctcacagacagtcacacccttccaggccttgccccatccgcagtccctggcctcaccatcgcattgcagggaggcgggcatatgcaacctccatgaaataaagccctaacggagaaggccagagtgggaacttcgtttccaccagcaggtggggcagacaccctggctagccccggggaaaaccagtaaaaatactggatttaaatcccttcgaattctcctttctacaggcaagctgtttagtgagaaagaaagggccctgcaaagatcctccccaggtggacgggcagcccccaagcctgtattgagctcccggacgctgctcctggggaagggcctgccgaggacaggggccagtgggagcccctgcctgaccacaggctgttctgcagcccaggtcaggagcgctggtgcctgccgtgtggggtggccctggtcctgaccgcctggggtcccaggtggtcccgggttgtaagagtctgtggtgcttgtgaaaagcttgcacatccttccaggggagactcgcgcgtggggcgagggcaggagcaggagctcataatcacacaggaaaacaggaagccctgaaccccgggctcgggaagcggcggggcgtcaggtttggaggggcttcgtcccccaccacctccccatttgcacccccagtccctgacccgcatctttcctcacctggtcactgtcccccaccctgtcccccaccctgtcccccaccctgtcccctgtctgccatctccctcccaggagggggctgctcctgcctagcacgcggtgcccttcctcccacgtcgcttaattatatttgaaaatacaacatttgaaacgtgcaaagaatggaggggcttttctgtgagtgcagggttcccctcccgtgtccccccaccagggggcttccccgtccagccccggcttgtccctttcattttaacaaaacgtcctcaccacagtgcatgtgtgttttataaaagcagtattggaagttaatgcttttaatacagaaaaaaaagaacccgaaacaatataactgtcctaagtgatgttgagtggggagtgccgggtgggagttgaactgcgggaccacgatccctccacttccagcctgtcctgggggtgtcatgtggccccttctgaccagccctgggcaacttctggatggacgggtggggaggggccgtggaggggatctgggaccaggagagagagagcgtggccaggcagccccaggagggccctccagagcccgagtgggcctgcgtctgtggtccccaggtgcggtccctcgaggtggcgtgtgggccccccaggcccgcgccctgcggttccagcgcctccccaagcctctgtccctgcagcccccaccccccctgcactttcctctcctttgtctgtgctggtggtccctctctcactgtcccacacaacaccgcaccgccctcccccaggaaagcctccaccttttctcttagtgaaatagaagccctttcaaggtgacatgtcacctactcacagaacagtgccccaacccaggacgcagcctgaggcccctcaggagcattgtgtgcccccaggcctgtccccagtggtccccaccgtgggcccaccacagctcctgctgtcaagggcagcctgggtctgagccccgtccccctgtgcagggcacgggtctgggggctggcttgtcccctgctgggcggtgggcggcctggggtgtctcccagacacgctgcctgcggccggctggtgtggactgggcctggtgggccaggagctgccctcactatggtgacaggatcgggctgccaggctcctgtgggggctcagcaggaggggatgggagacggcaatgctcacgcctgacctgctgcccttgggggagccgtggtgccacctggccggcctgcctgagagacccccacggctggtgtgggagcctgggggagccctgggcaggtggtggggcagtgggcagaggtggctgcagagggacagggcctggccaggacgtcaccctgaggccactggagaggtcagcaggggcccaaggagatgcagggattggcagctggggagcacaggggtactcctgagccgtggtacccaaaggtcatgagctgagaggggaaaggcccagagccgctggatggtggattctgggcacctgatccgcagggtgtggtggccctctgagggacccctctgacagactgcaggcaagctgtcaagggtgtgtgtgtctgagggtgagtgagtgtgtgtgtgagggtgtaagggtgtgtgtgagagtgtgggtgtggagtgtgtgacagtgtatgagggtgtgggtgtgagggtatgtgagggtgtgtgggtgtgtgtgtgtgagggtgagtgtgagaatgtgaagtctgagggctgtgtgatggtgtgtgagggtgtgtgtgagagagggtgtgagggggtgtgtgagggtgtgtgagggtgagtgggtgtgtcggtgtgagggtgtgtgggtgtgagaatgcatgaagtctgagggttgtgatggtgtgtgtgggtgtgtcagggtgtgtgtgtgggcatgtgagggtgtgagggtgtatgagggtgtgggtgtgtgagggtgagtgggtgtgtcggtgtgagggcacatgagggtgtgtgggtgagtgtgagagagaatgcgtgtgaagtcagtgtgtgatgggtgagggtgtgtgggtgtgtgagggtgtgtatgagggcatgtgagggtgtgtaagggtgtgagggggtgagggtgtgactgagagtgtaagggtgtggggatgtgtgaggatgtgtgtgtgaggatataagtgttaggggtgcatgagagtgtgagggtgtgagggcttgtaaatgtttgtgaaggtgtgggagtgtggagatatgcggaagtgtggggtgagtgtgagggttgtgagaatgtgtgggagggtgtgagtgtgggatgtatgaagttgggattgtgtcagcatgtgtgtgagaatgtgggtgtatgagggtgtaagggtgtgtgagaatgtgggtgtgtatggatgtgtgggtgtgtggatgtgtgtgggtgtgtgaagtgagaatgtgtgtgtgggtgtgtgtatgagggtgtgagggtgtgagggttgtggatgtggggtgtgtgagggtgtgagggagtgtgggtgtgtggtgtgtgagggtgtgtgtatgtgtgtgaggatgtgtgggatgtgtgtggatgtgtgggagtgtgagggatgtgtggggtgtgtggatgtgtgggagtgtgaggatgtgtgagggtgtgtggggatgtgagggtgtgtgtggatgtgtggggatgtgagggtgtgtgtggatgtgtggggtgtgtgtggatgtgtggggtgtgtggggtgtgtgtggatgtgtgggagtgtgaggatgtgtgggtgtgtgtggggtgtgtgtggatgtgtggggtgtgtggggtgtgtgtggatgtgtggggtgcttcagaatgtgtgtggatgtgtgggagtgtgaggatgtgtgagggtgtgtggggtgtgtggatgtgtgagggtgtgagggtgtgtgtgcacgtgtggggtgtggggtgtgtgtggatgtgtggggtgtgtggggtgtgtgtggatgtgtgaaggtgtgagtgtgagggtgtgtggatgtgtggggtgtgtgagggtgtgtgagggagtgggtgtgtggtgtgtgagggtgtgtgtatgtgtgtgaggatgtgtgtggatgtggggtgtggggtgtgtggggatgtgtgggagtgtgaggatatgtgagggtgtggggatgtgagggtgtgtgtggatgtgagggtgtgtgtggatgtgtggggtgtgtgtggatgtgtggggatgtgagagtgtgtgtgagtgtgagggtgtgagggtgtgtgtggggtgtggggtgtgtggatgtgtgggggtgtgtggggatgtgagggtgtgtgtggatgtgtggggtgtgtggggtgtggggtgtgagggtgtgtggggatgtgaggatgtgtggggtgtgtggggtgtgtgtggatgtgtggggtgtttgaggatgtgtgtggatgtgtgggagtgtggggatgtaagggtgtgagggcttgtggggatgtgtggtgtgtgtgagcggctgtgtgcactggccgagttgcctgctgctgtcctggcctggggccaggcgtgtgccagctcctgtgtttgttgtgtgcccggcgtgtgctgggtgcccgagtcgggctgggtgtgtctgggtgtggccctggggtgtccctttctggacgtgtgtctccgtgcagaacggaggtcctcgtgttcccagaaggaagcccccagccccaggcgggtgcctgagaatagacctggggcctgtgggcgtggcagggctgcccctcggctcctcatggaccccccggacaccagtcccaccctgtgtctgtgatgctcactctctgagccttccctgaccccatgtgccaaagcctggcccagcaatgccacgtgtgcatgtgtgagcgtgagcttggcagcgggtgggagaatgtgtgcgtcagtgtgtgagcgtgagcacggcctgtgcttgtctggctgtgggactgggggcctctgtgacgctgtgagcccttgtggacctgagtgtgggccgtgtgagctgtgtgcacgtggctgtggctgagtgtgagcctctgagtgtgtgtgtctgtgccgtgtacctctgtgtgtctatatgtgtctgtgtgcctctgactttatgtgtgtctgtatctatctctgtgtgtgtctctgcgtgtggtagcatgtctgtgcttgtgtacctgtgtctgcgtgtgtctttgtctctgtgtgtgcctatgcgtgtctgtgtgtggtagtgtgtctgtgcttgtgtttctgtgtctgtgtgtctctgactctgtgtgcctatgtgtgtctgtgtgtctctgtgtgtgtggtagtgtgtctgtgtgtctctgactctgtgtgtgcctatgtgtgtgtgtgtctctctctgtgtgtgttagtgtgtttgtgtgtattgtgtgtctttatgtctctgtatgtctatgtgtctgtgtgtctctgtgtgtttgtgtgttctgtgtgtctctgtggggtgtgcatgactatatttgtgggaggctgtatgtgcaggaagggccccctgagcattgtcacccgggctgcaccctgggggtcttcccagggatcctttcctcaaacttgagtcctccctggagggcttaggttccactgagggggtgggcgcgggcacagacccctcctctaggaggctggggtggggctgtcctgcctggctgggacacgggtcagaatgtccccccatgtggtccaccctgttctaggcacagggtgtcatctcccagggtctcagctgctggggtgatgggccccggacagcccctgggtgtggggtggggtcctatggaggcctctgtgtcccactgaagatgcagggctggggttgggcaggtctgttctggggtggtctcgtggggcaaccccagagggtactgaggccggggtagggttgggcgaccccacctagggtctacgggctgaaagcgcctgggttggccaggcctgggcacaggggaggacagaggtttggtgacaggtgggctgtgaggggcccagcaggtgcacggaggaagctctgtccccaggtgacccacaaaatcctcttccgagggtgctgggggtcctgttcctgggggccatgcctgggacctccatgcaggggtctcctccctggcccagctcccctggggcaaggtccgacttgttaccccctccaccaggcagtcctctgggaagtgccctggggcctggtcactctgggcctggccacagcattggcctggacatggggtgtggctggggagtgtgaatagtcaggaatcctgcaaaccagctgcctgggtgccagccttccccccacctcccccaatgcaaatcgccatctcggaggtgggtgggggtttccacaccactgtcccacctgctctgtggttcccattttcagcatttttagaaatatttgcaagaatgtgtttgtgcctgtgtggtggggtgggggtgggagctgcggcccggtgcccatgaggtcttgtttttcagactggacgggggtgggggagggggagctgcggcccccccacctgctagtgtgtccagcctcctgagtggggcagcgagcgtcctggctgggccccagggcatgacccccgatgagtgtgaggcgctgaggccgagtctggtccttggcgaggaggcccagaaggcccaggtgcccgtcctgagcgttatccagggccctgcctcaggcctcatgccggggccaagcccagggctggctggtggccacgcagagctgagaggggcggggaagtgaggctgggttggaggaaagctgaggggcccaggcctcccactccagcccccgaggcagaccctggcccacccagggaccccctcccatgcacacaagcacacacaacacatatatgggcatgcgtgtgcacacacactcgctgcagcccgcagcactggctggcccaggtgtcctcgggacgtggtccacgcggtgctgacacgagctggccctgagcgcgggctctgcggggtgccattcccaggccctgcaggggcacatgcggtgtcgtggggcagcaactgtgacctctgccccgcagacccggacatgccgccagagaggccaaggcgtacgctctccgagccttccctgaccccatgtgcccaagcctggcccagcaacgccatgtgtgcatgtgtgagtgtgagcttggcaacaggtgggagaatgtgtgtgttagtgcatgagtgtgagcatgagcgtgtgagatgcaagcgtgtgtgcagtgagtggtggatgagctggaggtgtgaggttgtgcgtgatgcggacaggtgtgtagtgtggacaggtgtgtggtgtggacaggtgtgtggggtggacaggtgtgtggtgtggacaggtgtgtggggtggacggggtgtagtgtggacaggtgtctggtgtggacaggtgtgtggtgcggacaggtgtgcggtgtggacaggtgtgtattgtgggcaggtgtgtggggtggatggggtgtagtgtggacaggtgtgcagtgtggacaggtgtgcagggtggacaggtgtgcggggtggacaggtgtgcggggtggacaggtgtgtggtatggacaggtgtgtggggtggacagggatgtggggtggatgggtgtagtgtggacaggtgtgtggtgtggacaggtgtgtggggtggacggggtgtagtgtggacaggtgtgtggtgtggacaggtgtgtggggtggacggggtgtagtgtggacaggtgtgtggtgtggacaggtgtgcggtgtggacaggtgtgtggtgtgggcaggtgtgtggggtggatggggtgtagtgtggacaggtgtgtagtgtggacaggggtgtagtgtggacaggtgtgtggggtggacaggtgtgtggtgtggacaggggaggcaggttcatgacacggggcaggacagtggccaggggctgcaagcgtgacctgcgggagggggtgcctgtgtgcgggcatgtctgtgtgtgtctttatgtgtctgtgtgtgtgtgtctctatgtgtgtcagtgtgtgtctgtgcatccacgtgcatgtgtgtgtgcatatccgtgtgtctgtgtctttatgtgtctgtgtgtgtatgtgtttgcctgtgtgtgtctctgtgtctgtgcatccatgtggatgtgtgtctatatgtgtgtctctgtgcacatatgtgtgtgtctgtgcatgtccgtgtgtgtctgtgcatttctgtgtgtgtctctgtgcatgtctgtgtgtgtctctgtgcatgtctgtgcatgtctctgtgtgtgtgtctctgtgcatgtctgtgtgtgtctgtgcgtttctgtgtgtgcatgtctgtgtgtgtctgtgtgtatgtgtgtgtgtctgtgcatgtctgcgtgtctgagtgtcaggggatggcctgtgcggggctcgcagtgcaggcgggtttgctcacacctcccccgcagggctgagcctccagactcccagccccatacaggccccagcccaggggggagccgggcggtgcttggggcctggagccctgacccggggagtcagggcaggactagggtggaggctctggtgactcagcctcctcgtatgtgtgcactgcagtttgtcctccgtgcatcccttggtggacacttgtggggcttcctgggaggcggccccagacttgggcagattctaggacccagagggatggggcagaggcagggatgacagagacagacacaaagcagagagacggaggcagagggagacatgcagagtcgcggagacatccgggctcaggccccgactctcaggggccacccccagggaggacacgcagtgcacccccacacccacacctcacacacacactcacacccacatacccccatccacacacacccagagacacacagacacccacagccacacactcacactcacgaacttatccagtcacgtcccacacactcccacccaacccatacaccacacacctacacaacccatacaccacacacactcacaaactatataccacacacacaccaaccatacacctatatacactcacacacccatataccacacactcacacacaacccatacaccacacgcacacaacccatacacctatacacactcacacctacaaactatatactacacactcacacacaacccatacacctatacacacacacccatataccacacacaaccatacaccacacacacaaaccatataccacacactcacacaacccatacacctatacacactcatacccatataccacatacaaccaatataccacacacacacaacccatacacctatacacacacacctatacaccacacacagcccatacactacacaatcacaccacaaactgtataccacacactcacacataacccatacacctatacacacacacccatataccacacacacaacctgtgcacctacacacacacatacaccacacacacacaactcctacacctacacacacccaccacccatacacacacagcctatacacctacacacactcatacactcatatagcacacacacaacccatataccacacacacaacccacatacctatacacacacgcccatacaccacacactcacacaacccatgcaccacatacacccacaaactatatgctacacactcacacacaacccatacacctatacacaatcccacaacccatacacacttacacaacctatacaccacacacactcacaatctgtataccacacacacaacccatacagttatacacacacacccatataccacacactcacacacaacccatataccacacactcacacacaaaccatacatctatacacatacccatatgccacacatacaacccatacaccacacactcacacacaacacatacaccacacacacaacccatagaacacaaacacaagtcataaccacacacacagcccatatacctatacacattcacacacacaacccatacactacacacacaacacatacacctatacacacactcaattcatacaccacacacacacagcccatacatctatacacaaactcacacacaatccatataccacaaactcacacacaacgcatacacctatacacacacatgcaactcatacagcacacactcacacaacccacagaccataaacacacacaagccataaccacacacaaacccatacacctatacacacactcataaacaagccatacacccctacacaacccatacaccacacactcacaacccatacacctatatacacacacaaccatataccacaaactcacgctcaacacatacacctatacacacacacaactcatacaccacacactcatacacaacgcacagaccacatacacaagccataaccacacacacacaacccgtacacatatatacacactaataagccatacacctacacatacaacccatacaccacacattcacacataacccatacacctatacacacacacacacaacccatataccacaaacacacacaacctatacacacatacaacccatacaccacacacacaacacatacacaccacacacacacataatactcatacacacacccatacaccacccccacacagaacccatacaccacacacacacaacctatacacctatacacacactcacacacacaactcatataccacaaacacacacaacacatacacctatgcacacacacaacccatacaccacacattcacatacaacccatacaccacacacacacaacacatacatgaaacatacatacaacccacacaccacccactcatacacaacctatacaccacacacacaactcatacacctatacacacacaacacatacacctatcatacactcacaacacatatacctcctatacacacacaacacacacacttcctatacacacaacccacacgcctatacacacatcctcactcacactcaccctcacattcatatactcactaacacacttccacactcacaccctcacccacacttacacccccacccacactcaaaccccgacgctaagtcactgtcacatttgtacccatgctcacacgctcacacactcaccccccaccagctccagggctcactggtgtgtgcccaccaaacccccctcgggggtcccctctgtaagccgacagtgctctgctcatcggtggcctggggaaacagggcccacccaaggcctggctcaggaaaggctccaaacacacatggcccaggagcaaatgggcagagctcagcctgcagctgggagcggccgagcgggtgctgggccagagtcggggcctgtctgtgggtgaggggcacggcagcacgggcccacctgcacctacaaggcctggcccccgaggtcactgggccaccacccagccctcgccctgttccccgtctgtgctggccggggcaggactctgagcctcggggaaacccacagatacacacgggaccccgaacatcgggctggggaggctggggtgggtaacaacatcccagagggaggagcaggaggtcctgggaccctgcgcactgcgaccccagccctgggggctgaagcccaggacagcctcaggtctcccaggagggactggatagtgggggatggtcagagaacaggacagccagcagggtgcagcccgaggacagggatggatgctgggaggtcaacaggacaggggcaggggcaggggctgtggagtgtgagaaggtcctggagggcctggagaacctgtgggtcagtgtctgtgggaaggaggccaggagcagccctgagtggccaggctggcagggatgaggaggtgggggcagtgaggtgagggtgaccgagacaggcctctggccagggaggggaccttggctgggctctgactgaacccagggctcctggagaaggggccccaggcggggatgaggatgtgggcatctgactccatcaacaatggggcttccaacacgcacagcctgggcctcggagacctgggccctgacccgcctccccctggcactgggccgggtgccgtgtgtggtccccagtccccgcagcacctcccccacactggtcacgttccagggcccctctgaagcacctgctgtgaggggatgtgaggaggggacagggacttgggcctgagctgccgggtcgggggggagtcggggacccaggctcagcgtgtggctgcggaccagacagatggggatggaggaggacacgccctgtacccactgcctgccaaggggctggacccatgcccagtctaggccatgtcccccgaggcctgtgaaccttcactctgagccactaaaacattcaggagctttgaaagcagcccccgtccttgtcactatgcgatgactctgagcatcacgctgtccctgctggatccaccctccagccccagcgagggaggctgggccccgggcagcaggtggtgagggcagcgggcacagccacgctacagcacacacagggtctcagggacgcgtccaccacagcccgtgcacaggctccccacggcactgagttcacccggggcgcgggccgtttgtcctcaggagtcccgctgtaccctccgcccccagccctgtcctgctgaggctgcagctgggtcccggggcacagggcggccctgagcaccttgtcatgttggtccctgtcgggtgggctgctggctctctgtggagctggcagagccgcggttcagccttggaggccggtcctggggcccagcagccgtggggagcactgcccagtcccgtgcccacagggaatcacctgggctgaggaagggcccacacgccgacgggatcggggtcaggcagcgcacgcctggcaccgagatcccacgtcccgaagtggggacacggcccaggggcactgttccgggagggtctcaagatggggtctcctatttcaatcttcactccttctgcacctgttagctgggaaccttctagaaggaggggtgtcctcaatcatggggtggttgtgagctgagcacagatcatgcaggaaggtacatggcttctccttcaccaggaaaacagtgcagagagacagagacacagagacagagtaacagagaaagacagagagacagagacacagagacagagacagagtaacagagaaagacagagagacagagacacagagacagagacagagtaacagagaaagacagagagacagagagacacagacagagacagagtaacagagaaaggcagagagacagagagagacagagacagagtaacagagaaagacagagaggcagagagagagagacagagacagagacagagtaacagagatagagagacacagagacagagacagagtaacagagatagagagacagagagagacacagagacagagtaacagagaaagacagagacagagacaggcacagagataagaaagatacacagaaacagagagagacagagacagagatagtcactgtcacattcatacccacgctcacctgctcacacacacacacctcacacacactcacactcacactcacctcacacacacagtcacacacacactcactcacacacactcacacacacacactgagcttccctcaggccctgtcacttccgatggggcctacggcctgtctaagcctctgggccaccagcccctggctcaccggtgtgtgcccaccacaccccgccttgggggtctcctctatgagctgggcacatgccctccgctctgttcatggctggcctgggggaaacagggcccacccaaggcctggctcagggaaggcctcaaacacacatggcccaggagcaaaggggcagagctcagcctgcagctgggagcgggcaggggtagtggagtgggcggagggcctggagaacctgcagggcttcgatgtctctgggaagggggcccaggagcagctcagcgtggctgggccggcagggccgaggaggtgggggccgtgagggaggggtgactcggctgtgtggggtgccgggggacacgggctttgctccggctgagcccaggcagtggcgaatccctgagctgccaggaggagagcagggccggggtcaggcagaggtgggccgcggggccaagggctgcggccggtcgggagcagtcggtcggttgagggcaccattacatggagggctgtgagacgggagaccccattcccttcattccttgtgcacgtgttagtgaggaagcttctagaaggagggcattgctcgtagtgggtgagtgtgagcacagatcatgcaggctggcgtgctgccgtgaagtgcctctctttactttccagacctcagcatggcaagcccgtcctgcgccccagggtctttctggagtacacgccgcgcggtcctggtgggcaccatacctggcacccacgctttggccgggcccgaaccttgcgccctcccagcccccatgtggctctcccttggccatcctggccttttgccagtcctcctacctcaccctagggtctgcctggccctgccctcccttcctagccccccaaggaggctggagggcacccctgcgtccaccagcagcagctcctcatgggcgagtctccttgggccagtgacacatagtgtgccccgatggtgccacggcagcctgggccctccgccttcctgcttggcaggcacccccgctccctgcaccctcaccggggcacctgtgagccctgagggccagtgggggtctcactgctgctccctcccacagcctagcctcgggcctcagggctctgcatccaagcggcccagggctccctgcggtctcagcccgagtgggcctttgagccttcgcgttctctgcagggtgggacctgcccaagggctgctgagggcttcccaggggtcctgtgggtcccacctaggggcaagctggtgaggaaagtgggtcctgccatggcggccgggtgggctgagttttcggcatctctgggcccaacagcaggtccctggagcggcgcccacccctcccccaggcaggtgtgagggctctgatctgtttctccttgagtgactcattctgggcagacttggccctcagggcacatgcaaatggttgtttgttccacaccgaaaacatgtttcttgccctctgaggctgtttccagaaatagcttgcacgattctccacctgcagctgcagccgccacccacccagtgtggccaggctggcccaggcctccagattcggggacaccccccgccccctcccccagcgtggccaggctggctcaggcctccagattcagggacacccccccccccaacagcgtggccaggctggctcaggcctccagattcggggacacccccccaccacagcgtggccaggctggctcaggcctccagattcggggacacccgccccctcccccaggacaggcccacttgggttactgacactgggaccaccctgcaaacgtcaactttattgaattcagtggttctgaacttgttgccatctttgggaccaggacccaggggcagcccccaggttggcaggaagggcaggggagccaacgctggcagggcccccagccaacccccaccccagaagccccaaggaggctgagcggaggtggccctggtggcctgggcacaggcagcccgattggtacaaggcctgtctggtgcaggcccgcacctcccccaccctcatggcctggtggtccccactgtacagagagaacactgaggctcagcagggccagggacatggcctgaggttacatggtgatgggggctgggtctccgggcctgggggccgtggtgggtgcagcacccggactgcgtgggctgtggcctccctgctcccagctctgtcacacccgtctccatctgagcctccagctccatctttcccgctgtccctgtctctggccacccttctgtctccctgtctctctgcctctctgaaggtatctccctgcccgaatctctgtctctgtcccattgtcggtgtctctgactcatctctgtcaagcccgtctgctgggctttgtcccgccatcttgcctgtcttggcctctctctctttctgtgtgtctccgtctgtgcctcctttctccatccatctctcccccgtgtctgtctctatccctccgtctctcttcccgtctatccctccctctgtgcctgtccctttgctgtgtccctttctttgcctctgtctctctgtctgtctcttcgtgtccctgtgtgtgtctctctctgtctctctgcttctctttctgtatctctgtctatatctcagcctctttgtgtccctgtgtgtgtgtctctctcttctctgtctttccatgtctctgtctatatctctgtctctctgcctctgtatctctgtctgtctgttcgtgtccctgtgtatgtctctctctgtctctttctgtatctctgtctatatctgtctctctcatctgtctcttcctgtgtgtgtctctctgtctctctgcctctgtctctgtctctctgtctcttcatctctgtctgtctctgcctgtctgtgtcatttggtgtctctgtttttgtatgtctctctgtttgtctgtgtctcttcctctctgtagctctgcctctctctatctctccttatatctgtctttctctctccctgtttctttctctgtctctttttgtctttctgagtctgtctctgtctctgtctcttcctctctgtatatacctctctgtctttctgttgctgtctgtctctgtttctcttctcctctctctatctctctttgtctgtctttctctgcctttctaactctgtctttctctgtctctctgtctctatctcagtctctcttcttatctctctctctgtctctctcactctctgtatctctttgtctctgtctttctcttatctctatcgctctgtctctatctctctttctgtctctctgtatctctatctctgtctctctcatgtctatctctctgtctttctctgtctctctgtatctctgtctttcatctctatctctatctctgtctttctgtctctatctctgtctctctatctctttctctgtctctctgtatctctctgtctctatctctctctgtctttctctgtgtctctgtatctctgtctctatctctgtctctctatctctctctgtctctccctgtctctctctatctctgtctctccatcccatgtgggtctgtgggtttccccgaggctcagagccctgccccggtcagcacagacagggaacagggcgagggctgggtggtggcccagtgaccttgggggccaggcctggggggtgcaggtgggcccgtgctgccgtgccccccacccacagacaggccccggctctggcccagcacccgctccgccgctcccagctgcaggctgagctctgcccgtttgctgctgggccatgtgtgtttggggcctttcctgagccaggccttgggtgggccctgtttccccagaccacccatgagcagagtgtagggcacgtgcccagctcacagaggggacctctgaggcggggtgtggtgggcacacagcagtgagccatgaggctggtggcccagaggcttggacatgccgtgggccccataggaagtgacagggcttgagggaagctcagtgtgagtgtgtgagcgtgggtatgaatgtgacagtgactctctatctgtctctttgtatctctgtctctctgtgtgtatctttctatctctgtctctctatatgtctctctatctctgtctctctgtatctctatctctctgtgtgtatctttctatctctgtctctctttcttgatctctctctatctctgtctctgtaactctctttatctcttactgcttctgtttctctcactctgtctctgtctctctttatctctgtcttgctctctctctctgtaactttatctctgtctctctgtttctatctctgtttttctctgtctctgtctgtatctctgtctctctttatctgtctctctgtctctgtgtatctctgtctctctgtaactttatctctgtctttttctgtctctgtgtgtgtctgtctctgtgtctttgtttttctctctgtctctgtcaatgtctctttctgtatctgtttctttctctctgtctctgtctctctatctctgtctctatctctctgtctctctgtaactcctcatctctgtctctgtgtctgcatgtctctttctgtgtctctgtttctctctctgtctctgtctctctgtgactctgtctctgtctctgtctctgtctttctctgttactctgtctctctctctgtctctctgtgactctatctgttactctgtctctgtctctgtctctctctgtctctctttctctgttactctgtctgtgtctctgtgtctctctctcgtctgtctttctctgttactctgtctctgtctctgtgtctctgtctctctgcactgttttcctggtgaaggagaagccatgtaccttcctgcatgatctgtgctcagctcacaaccaccccatgattgaggacacccctccttctagaaggttcccagctaacaggtgcagaaggagtgaagattgaaataggagaccccatcttgagaccctcccggaacagtgcccctgggccgtgtccccacttcgggacgtgggatctcggtgccaggcgtgcgctgcctgaccccgatcccgtcggcgtgtgggcccttcctcagcccaggtgattccctgtgggcacgggactgggcagtgctccccacggctgctgggccccaggaccggcctccaaggctgaaccgcggctctgccagctccacagacagccagcagcccacccgacagggaccaacatgacaaggtgctcagggccgccctgtgccccgggacccagctgcagcctcagcaggacagggctgggggcggagggcacagccggactcctgaggacaaacggcccgcgccccgggtgaactcagtgccgtgaggagcctgtgcacgggctgtggtggacgcgtccctgagaccctgtgtgtgctgtagcgtggctgtgcccgctgccctcaccacctgctgcccggggcccagcctccctcgctggggctggagggtggatccagcagggacagcgtgatgctcagagtcatcgcatagtgacaaggacgggggctgctttcaaagctcctgaatgttttagtggctcagagtgaaggttcacaggcctcgggggacatggcctagactgggcgtgggtccagccccttggcaggcagtgggtacagggcgtgtcctcctccatccccatctgtctggtccgcagccacacgctgagcctgggtccccgactcccccccgacccggcagctcaggcccaagtccctgtcccctccccacatcccctcacagcaggtgcttcagaggggccctggaacgtgaccagtgtgggggaggtgctgcggggactggggaccacacacggcacccggcccagtgccagggggaggcgggtcagggcccaggtctccgaggcccaggctgtgcgtgttggaagccccattgttgatggagtcagatgcccacatcctcatccccgcctggggccccttctccaggagccctgggttcagtcagagcccagccaaggtcccctccctggccagaggcctcactgtctcggtcaccctcacctcactgcccccacctcctcacccctgccagcctggccactctgggctgctcctggcctccttcccacaaacacggacccacaggttctccaggccctccaggacctttgcccactccacagctcctgcccctgtcctgttgacctcccagcgtccatccctgtcctcgggctgcaccctgctggctgtcctgttctctgaccatcccccactgtccagtccctcctgggagacctgaggctgtcctgggcttcagcccccagggctggggtcgcagtgcgcagggtcctgggacctcctgctcccgcctctcccatgttgttacccaccccagcccgatgttccaggtcctgtgtggatctgcaggtttcctggaggctcagaggcctgccccgtccagcacagacggggaacagggcgagggctgggtggtggcccagtgacctcgggggccaggccttgtaggtgcaggtgggcccgtgctgccgtgccccccacccacagacaggccccgactctggcccagcacccgctcagccgctcccagctgcaggctgaggtctccccatttgctcctgggccatgtgtgtttgggtgtgagtgtgggtatggatgtgacagtgacttagtgtgtggctgtgagcatgggtatgtttctgtgtgtttgtgtgtgaatgttgtataatagtcgtggtgtgtgtttgtgagtatgactgtgtgagaggggcttgcacctgagttcctgggcccatcttgctgcctctttctctccctgtgtgttctctgcctctgttgtgttctctctgcatgtctgtctccatgtctctttttccctgttcccatctcctccctttttctcccatctctgtctctgtttcttatctatctcatctcatctctctctttctgtctcttgtgtctctgtccctccccgtccctgtctcttatctctctccatccccatctctctctctgtgtctgtctttgtccctgtctctatgtctcttgtctctccccatccctgtctctctctatgtctctgtgtctcttatctctccccatccctgtctctctatgtctctgtgtctcttatctctccttgtccttgtctttctctgtctacgtctctgtgtctctctccatccctgtctctctctatgtctctgtgtctcttatctctccccatccctgtctctctatgtctctgtgtctcttatctctccttgtccttgtctttctctgtctatgtctctgtgtctctccccatccctgtctctctctctctgtgtctcttatctctccccatccctgtctctctctatgtctcttcatctcttatctctctccccatccctgtctctctatgtctctatgtctcttatctctccttgtccttgtctttctctgtctatgtctcttgtctctccccatccctgtctctctctctctatgtctctgtgtctcttatctctccccatccctgtctctctctatgtctcttcatctcttatctctctccccatccctgtctctatgtctctgtgtctcttatctctccccatccttgtctctgtctatgtctctgtgtctcttgtctctccctgtccctgtctctctctatgtctctgtgtctctctgggcccctggtccaatgtccccttcccagaacccctgtttccctggtgtggggtgcaggtccttctgtggtcctgtgggccgtgcttgtgctgggcacagcctgccagggcagccgctcaagccccagggctgggcactgcgtcctggctctggccaagggccctggggagagctgagggaggtgcgtgcagggtgtgaggcccaccacagtcactgccagatgctcagtgctggtgcttccctgggtctgctgtgtggtgggcacagccctcgtgagggctgcccatggaggaggcctgccgcctagagagcccggacagggggacaatggcctgtgctgaccctggcggaaccctggctgaccccagatgaccccagatggccctggctgaccctggcggaacccagatgaccctggctgaccctggctggccctggctgaccccagatgaccctggctgaccctggctgatcctggctgaccctggctgacctctgcctaaccctggacctggaaagccctagctgaccccgggctggttggggctgggcctccctgtggctgcagcccctcgctcaggccccaggcacacctggccaggtctcggttttggggcatgtttctcagaacagcagttctctggctggaacacctggcctgggctgtgttcacaatgactcagccgccccacagggctattttggatatttctgcaggtgatggggtacaagaggcttcaggagagagagaaaagcaagagaatacaaacagcatggcctcccccgaccttcctgtccccactcctgtactgtaccccctccccagtgctaagtcgagacctggcgaccccttaggggctggggctgggtgtagctcacagggcctgggctggtcctctccccaccaagtcctcctggggcctacacacccctctgagcctggaaaaatggagcaagtcattggggtcatttcttcatctaccagtgagtacatgcactgagagggtctcggctcccctggaggcctccctccaccactgcaggtcacttactcatgagggccaaggctcagaaatcagacaggactcagtgtctagtcagactgatacatgctcagaaaaggaatcagatttcaaaatgaatatgtataagaaaagaaccggggatcagtgatcaggaacagggatccatgatctggtccagggctcagcggtcaggaacagggcccagcgatcaggaccagggctcagtaatcaggaccagggcccagtgatcaggaccagggcccagcgattgggtccagggctcagtgatcaggaacagggctcagtgatcaggaccagggcccagtgatcaggaacaggggccagtgactgggtccagggctcagtaatcaggaccagggctcagtgatcaggaccagggctcagtgatcaggaacaggggttagtgatcaggaacagggctcagtgatcaggaccagcattcagtgatcaggaccagggctcagtgatcaggaacagggctgagtgaccaggaccagggctgagtgatcaggtccagggctgagtgatgaggaccagggctgagtgaggaggtccagggctgagtgatgaggtccagggctgagtgacgaggtccagggctgagtgacgaggaccagggctgagtgacgaggtccagggctgagtgacgaggaccagggctgagtgaccaggaccagggctgagtgatgaggtccagggctgagtgacaaggaccagggctgagtgacgaggtccagggcaaaaaacaggagtaggactcagtgatcaggactaaggctcagtgatcaaggctagaattaagtgatcaggaacagggaccaagtagtaggaccagagctcagtgatcggtaaacgggcccactggtcaggaccagggccctgtgatcaggatgaggacccagtgaggaggaccagggctgtctaggttatgaggaatagggatcccatgtagttcttaggagcaggcttctttgccatggtctctggtgaatccagcattcatccttgggcctcagcctcattcaagatcaggtcatttcttgattttgggaccaggggtaccctctgtccatgcccaccatgaccaccatgacacccagggggactttgaagcaggcgttctccagtctaaagccaccaccctttccctgacccccgtctcctcattcagagtctgtgaacattttccttggggccactttattgcacctggaagccacgtgagtaagggcgggtcggtgatgtctgaaagggctgagttctggcaagcatagctggcttctccaagaggttcctccacacttcctccctgcaaagacagaggggtcacagcctgaaggagcagcatccttgccaacgccctctgtctcagccctggcctggctcatgggagcctggacggaatcctcgttactgcactggagggaagctcagccctgaccctgggcctgcgcgtgtcctcagtgtctgtgaagggcccccaggagagcacgtccccccacagtgggagcaggtggtgctctcctcttagccaatcactgcagcccaccccatctactgtgggctcatccccctcctgggctcccacctgtgccttgccggctcccgctcagtactgggggccctccctcttgccagatgggccccggacgctggtcacggtcagtgctgtgctatagaacaggctcagcaggaagagggtgaggaaggtgatggtggtgggccacaggttggcgccgggggtctcctcctccagggtctcctgcggcaagtccagcaccacatagggaggcggcatctgccaatctgcaacacagcaagagcctgccaggcccagactcccagactcgtgtgaacagcggctatgcttccttggggtctggggacagtggggtctgggtccccatctaaggcctgagactcccccagggaggatgaggaggcagggtcccaggtgaggggctgggaccttctgtctttgacattcttagggcacttcagggagagacttggcagggcagaaagtggacaccatctgcttctccaagggaagcttgagcccgaggtaccctcccgcccctcccaccccaccccgtctcagtcccagccacgtattcagtgactgggtcccggggccagagaggaccagacacacccaccctcaaggagatctgggtccaagacagagacctgggtctgacactcagtgtgccaaaggttgaatgggcaagaccagaggcctctgttgccttcccagggaatgtggctgaggggttacaagcgagggccaggtgagggccaccagcacgggcatcctcattttcctcagggtctcagggcatagacctcccatgtacagctgtacctgcttgtcatatgctgatacatccagtcattcacctgtctttctatccttccgtccatctatccatccatccatctataaagctattatccgtatatccacccctccatcagtaacactcctacccactcacccatccattcatcgtccattcatctattaatgtaaggctatcacttaaatatccacccatatatctataaagctattttccatccattcatccttcttccatctatccatccatccatccatccatccatctataaagctattttccatctcttcattcatccattcataaagcaattctccatccaattatcttccatacacctagcctccatagatctacccacccacccacccatctatcctcaatcctccctccatccacccatcctccattcacccctccatctatcttccatcctccatccacccttccatcctccatccgcctacccacccatccatcatccatccatccatcatccatccatcagtccatccatcttccatccttcatccactcatccatcctccatccacccatccttcatccatccatccatcacatatccatccgtccatcctccatccagccatttacccacccatccattttaccacccatccatccttcatctacccaccctccatccacccatccattcattatatgtcctaggatctacccatgtgtctgcctgatctctgtctgctggttcagcccctcatctgttgattctctctctttccccctctctttaaaagcccctccccaggccaggtcctgggtcccatgggctggagggcttctctgtggcagggcttccccaagtgacctgttgctctcaattaccctctggtgactggaccctcaggggtgacagtggcctccacctcaccttggccctgagagcagagggaggcagccagaaggcgggggcccctggggaggcccggaagatgtctaaggcacgagcaggggcctcactgcccccttgtgggagtctgggtgccaggtgtccccacagtggttgtgggactgttctttcactcctgggagccccaggcagaagccagaggcatgcagagggccctgggcaggccctgtctcactggcctgcttctgatgccaccccacgcggcccctccctgtctatgctttgggtcctagttgggcttaggaagggatgggagacttggccaggcagggagcaggggctgcctgggaggggtctgtggagttggtccctgagctgtgcacagtggaaacacagggaagccagaggggcctgggggagcaggctgagcttgggggcttgggaggggactcccctggcttttctggaactgggtctgggctgtgaacgttccactcctgcagggctcaggcgtatatgtgagtgtgagtgtgcatgtgtgcccacgtgccccgtacagagcagtgtggttaaggggaggtgccccttcctgcatgcgtcagtgggacgtcctgaggcccacccactagggtggtggggccctcctggagcttgtcctcccagtggggccctggagtccagcccctcactccctcgccactcctgccactacctgcgcctttcttggctagcctgctccttttaccctccctattccctcccagctacagccagaggcggctctctcagggacaaacggccatgccactgctcactcagaactgtccggggcatgtgcgtctctcagaacccatcctgggctgtgcctgccttggcagacctaagatctcacaccagcgaggcctcctgcaccacacactctcacactcacaactcacactcacaccagggtggaaagtctcatgggggtgccaggggccccccgaggctcagggcagggggtattcttccctgtccatgccctggccctttcccaagtgctgagaccctgaggatggacagacaggcgccggatggaagcgtggggctgcttgggggagcatggagtttattcaggggtggggacaggcgggcggctcagtagcaggtgccatccgcctccgccatgacaacagacacattgatgtgggtgggtttacccgccatgcggtcgatggtcttctgtgtgaaggccagcggcagggcctcgtggcccaccatgcaggagaaggtctcccccttcttccagtcctcagctgccacgcgcagtatgctggttacagcgtaggtggtggtgccctggctgggctcctgccgggatgcccaagtcaggtacttctcgcggggcagctcctgtgacccctgcagccagcgaaccagcacatccttggggctgaagccacgtgccaggcacgtcagcgtcaccagctcgttcagggccagctcctccgacggcggcggcagcaggtggacctcgggccggaatgtgtttcctggagggtagagagccaggtcagggggctgggcaggggatgagagagcccctctgctctggtgggcaccctgggctgtgtcctggcccctcagcctgcctcagtttccctctgtacttggcatgagcactggagcccaggattgggagggaggaggcaggccgggaatatgctttgcaaaccagagcactgagcagggccccgagcagggtctggacccaccggattttgtgatgttggcggttagtggggtcttcaactcggggtgggcagcagtgcaggtgaaggtctccccatggttccatggctgggcacagccaggcaggacactggacacgctgtagcagccacagaggtcacgctcaggtggtccttgaacagcgctcttcccacttgagggcgtccaggtgaaggtggcaccagaggcatctctcaggccggtcagtgtgcacgtgaggttcgcttctgaacctaagagcaggtcctcgagggccggtcggtgcagcgacagtcgggggtggcagcatgggggaggtgggggaactggagtggagagatggcctgagctggtcagaacgcccttccccgtgcccccgcctcgcccctcctggcctgtccaccaccacctcctggggctcggcccgcggtccactctggtgtgagtgaaggggcggctccctgtggggaacacgggtgcaggcgcagtgtcagggcaggacggggtggccccgccccactccccagcctgccctctgacctcggcagggcacagtcacatcctggctggaattcgtgtagtgcttcacgtggcatgtcacggacttgccgtctgggcactgtgtggccggcagggtcagctggctgctcgtggtgtacaggtccccggaggcatcctggctaggtgggaagtttctggcggtcacgttctgtccgctttcgctccaggtcacactgagtggctcctgggggaagaagccctggaccaggcatgcgacgaccacgttcccatcttggggggtgctgtcgaggctcagcgggaagaccttggggctggtcggggatgctggaacacagaatgcgctgtgaggacgcggccctcatgccatgtccccaggaggacaggctgtacctgcctctcctctacactggaggaacccagcacagagaggcctggtgacagccccaaggttacacagctcctgcaccatgggcctgcggttggacccagctgtctcatcccagcgacacagtttctgaacatgctccttagatagggcctctgacccaggccatcccagacacaagttatattaaacagggctctgccatggagtggctgagtcccctgagctccctgaccccagttcctgctctgggtgggggacatgtcttgctctttcccctgcccctagagaggattttggtgggggctctgaggagggggcctgggctctgagtgctgtgtgcatggggtaggggtggagtggcttggctgtgaccccatccccctgtccctggtcagagtctcagtccaacacccaccactccatgagccccaccccaggcccaaacaagccacagtggacccctgtggcctatgaggtctcgggactagaggccaacaggctaagccatgtccctgccaggccctccaggacagggcctgttacccaggggagctctgggcccagcccactccaaatttccttcaggcagtgggcaagagagaagacagaatcatggtgcaacagagctgcgtggccctcagaacccctaagaacacagctgggctcagggctctgcaggtggagtcacactcaacccacggcctccttcccacattagcagccacctcagctcatccagcccagcccagcccaggccagtccagctcagtccagctcagtccagcccagcccagctcagcccagctcagcccagcccaccccagggcagctcagtacagctcatcccagcccagcccagcccagctcagctcagctcagcccagcccagcccagctcagtccacctaagctcacccagctcagcccagtctagctcagctcagtccagctcagcccagtctagcccagcccagtacaggtcagcccagctcagcttagcccaggtcagtccagctcagtacagctcagctcagcccagcccagtccaacccagcccagcccagtccaacccagcccagctcagctcagcccagcccagctcagctcagctcagcccagcccagtccaacccagcccagcccagctcagcccaggtcaacgcaacccagctcagctcagcatagctcagtccagctcagcccagcccagctcagcccagctcagctcagcccagcccagctcagcccagctcagctcagcccagaccagctcagtccacctaagctcacccagttcagcccagtccagctcagatcaggtcagcccagcccagcccagcctagcccagctcagctcagcccagcccggcccagtccagctcagctcagctcagctcagctcagcctagcccagtccagtttagcccagctcagcccagcccagctcagcccagcccagcctagcccagcctagctcaccccagcctagtccagctcagcccagctcagctcagcccagctcagcacagcccagctcagcccagctcagcccagctcagcccagtctagctcagcccagctcagcccggcccagccgagctcagcccagcccagcccagtccagctcagcccagtctagctcagcccagctcagcccggcccagccgagctcagcccagcccagcccagtccagcccagcccaatctagcccagcccagctcagcccagcccagcccagcccagcccagtccagcccagcacagtccagcccagcacagtccagcccagcccagtctagcccagtctagcccagtccagctcagcccagcccaggccagcccagcccaggccagcccaggccagcccagcccagcccagcccagctcagtccagctcagctcagcccagctcagcctagcccagtccagcccagcccaatctagcccagcccagcccagcctagcccagcccagcccagcccagcccagcccagcccagcccagcctagcccagcccagcccggctcagtccagctcagctcagcccagctcagcccagcccagcccagcccagctcagcccagcccagcctagcccagcccagcccagcccagcccagcccagcccagcccagctcagtccagctcagctcagcccagctcagcctagcccagtccagcccagcccaatctagcccagcccagcccagcccagcccagcctagcccagcccagcccagctcagtccagctcagctcagcccagctcagcccagcccagcccagcctagcccagcccagcccagcccagcccagcccagcctagcccagcccagcccagcccagcccagcccagctcagcccagcccagcccagctcagtccagctcagctcagcccagctcagcctagcccagtccagcccagcccaatctagcccagcccagcccagcccagcccagcccagcccagcccagctcagtccagctcagctcagcccagctcagcctagcccagtccagcccagcccaatctagcccagcccagtccagcccagcccagcctagcccagcccagcccagcccagcccagcccagcccagcctagcccagcccagcccagctcagtccagctcagctcagcccagctcagcccagcccagcccagcccagtccacctcagccccagctccagctcagctcagcccagcccagctcagcccagcctagcccagcccagctcagcccagctcagctcagttcagctcagcccagtccagtgtagcctagctcagcccagtgtagcctagctcagcccagcccaggccagggcagctcagggcagcccacatggacgtgtatcagttggctccaggtcatcttctcctctgccctctggctcggctcagcctaggcctcggctcaacttaggcctcagctcagccatgaaagctgttcaccttgtatcccaggaagggccgggtcatcccagcttaggcctggccagcctggctcagcccccagtgcccagatccttcctgcctggttaggaagccctgccctgtggttccggagtccctgtggtgacctcttttgtccttccctcttgtcttggtgcctgttctccaccttttgcttccagaaggggccaggaccagcctggctggactcctcaatgtgcagagaaggagacggaggcctggagacctccaagacccacctggtcaggctgctggagggcccgcagtgctgagtgggcggcctccggcgtgcaggccctcatggcaggtccaccctcacgggcgtctggctgcctgccaagagggctgctgtggggagggagccctggcccggcccaggtcctgccttgatggccgtctgtccttagcagagccctgctccgccgcgctggctgtgtccacagatgtggctggatgctgaggggctggaggggagggcctgcatgcccgtacgtctggcctacagacggggtcactcgcccacttcctgccccagcagacacggctgcgcggctccacgtcatgtctggcctgtggtctggctgtggtggggccaggtgtgtgtggccagggctctgtgaccccaccggccgtggagcctcacggctccacatggctccacagggcggggtgggggccacgctgcagggaaacaggaacagacacagttagaggctcagagaccccgagacagagatggcaaaggggagacacagggccagagagggtccccgaccacccgcaggggaagggcgcctgtgagtggactcccgttgaaggggccttggggccacagggcgggcatcaggctggggagagtgagtcttgcgctgctgggttggagccactcgggcctggcctccctcggcctgccccatgggccactgggggccccagactgcagcccagggtgggggcatgggggcaccccgtctcctagcctgcagccctgcgggtcagggcggccaaggtgcctgctctaccctgtccagcactgcccaggtggcactcctactgtgggtcaccagagagctggccgttgcgttggagagatcccgccagcgatgctggccctggagtcgggggaggccagctatgtctgggggctcgggtggcaccggcaatgggaggccaggggcgcttcacagaggagctgctgcagcggagtcctggaaagcgtgggcgtgaatggaagatgccctggccatggggccgggccaccccggcggaggctgtcgggtgaaatccagggagtgacagtgaggccggatcagggcaggtggggccagaggaggagggaggtagcctggggctgccccagggtcctgggaagacacacctggcggttcagggaagctctggagcttttgttatgaaccttgggatgcccccggccctcgccagggggacgtggctgctgcgtcttagtcatttctggctgcaataacaaaaataccatagactggtgggttcagcagcaacattcatttctcagggaagctggaagttcaaggtcaggatggcagcagggtcaagttccaggaagggccgattcctggttcacagacccccatcttttcgctgcgtcctcacatggtggaaagagggcagggctgctctctggggtcccttttcttttgggtctctagtgagatcagggaccgagtcacatttttgagtgttccccctcaggccctaaccacctccctgaggccccagctctgcatgctctcactctgggatgacggctgtcacacaggagtttcgggcagacacagaccctcagaccatagcaccacccctgtctgcctctgcctctccccatccctgtgtctcctcgtctgtctccagctaggacacttgtcctcggacctagccccctcgataatccagggtgtccttcacctcgaaatccttgacaatccagggcgccctcacctcgaaatccttgacaatccagggcgccctcacctcgaaatccttgacaatccagggcgccctcacctcgaaatccttgacaatccagggtgccctcacctcgaaatccttgacaatccagggtgccctcacctcgaaatccttgacaatccagggttccctcacctcgaaatccttgacaatccagggcgccctcacctcgaaatccttgacaatccagggtgccctcacctcgaaatccttgacaatccagggttccttcacctcgaaatccttgacaatccagggttccttcacctcgaaatccttgacaatccagggttccttcacctcgaaatccttgacaatccagggcgccctcacctcgaaatccttgacaatccagggcgccctcacctcgaaatccttgacaatccagggcgccctcacctcgaaatccttgacaatccagggttccctcacctcgaaatccttgacaatccagggcgccctcacctcgaaatccttgacaatccaggattccttcacctcgaaatccttgacaatccagggtgccctgacctcgaaatccttgacaatccagggttccttcacctcgaaatccttgacaatccagggcgccctcacctcgaaatccttgacaatccagggcgccctcacctcgaaatccttgacaatccagggttccctcacctcgaaatccttgacaatccagggcgccctcacctcgaaatccttgacaatccagggttccttcacctcaaaatccttgacaatccagggctccctcacctcgaaatccttgacaatccagggctccctcacctcgaaatccttgacaatccagggcgccctcacctcgaaatccttgacaatccagggtgccctcacctcgaaatccttgacaatccagggttccttcacctcgaaatccttgacaatccagggtgccctcacctagaaatccttgacaatccagggttccttcacctcgaaatccttgacaatccagggcgccctcacctcgaaatccttgacaatccagggttccttcacctcgaaatccttgacaatccagggtgccctcacctcgaaatccttgacaatccagggttccttcacctcgaaatccttgacaatccagggtgccctcacctcgaaatccttgacaatccagggttccttcacctcgaaatccttgacaatccagggctccctcacctcgaaatccttgacaatccagggcgccctcgcctcgaaatccttgacaatccagggcgccctcacctcgaaatccttgacaatccagggtgccctcacctcgaaatccttgacaatccagggtgccctcacctcgaaatccttatcttgatgggatctgcaaaggcccttttgacaaataatgccgcactcaatggccccaggggctaggatgtggctctatcttttgggggccatggttgtacccacgggtgggttaataggggaatgaagagggggatggagaggccctgagacggcatcctcttgctcccgggaggccaggccatgtggaaggcaggggcgctgttccgagcctgggtgtgaatccgggcctctgcccctccccacgggccccgtctgtctcctctacgtgggtgctcatctggtcttcctctcaggcctttgaggcgatggaattttctgtgcgtgaggacgcctgccacacagtggggcagtgagctgactccttgcccttgctctggggccatggaggtctcatgatctagggtgcggggcagagaaagtcactgagctctgtcccccgggggggctcccggtccggggcaccttggctgcggagggccggtctgttgtaggagatgtgggtttgcgacaccctgggctggtgatggggtggatggagggcctggcttcctgagactgtgtgtgtgttggtatgagcgtgcccgagcgtgtcagcctgtgtgagtgcatgattggtgtgtgtgagtgcaaatgtgtatgagaggttgagtctgtgtgtgtgaacctgtgtgtttttgcatgtgcgagtgtgtgcctgcgtgtgtgtctgtgaatgagggagtgtgtgaggggagctgggcagcggctgtggccttggccctgtcctgcgacgccccctcctctggtgttgtttggacccagtcggcctcagcgctgcccgctttggggttttctaccccgtagggagccgtcgctcctcaccttctcccccgtgcccggctgctccgaggtcgcagcagaggacagggcggagggcccaggtgccgctgtcagactgaggcaggcttgcttcattccgctttgtgccagactccatgtgacgtggctctcctggcacagagcgaggctctccctgtggggccatcactgtgagaggactctcctgcattggggcattttgccaactggccctaaaaagtggtcttaatgatttacgtgccctcagtcagggccaagaagcacctccacccccttcatcccctcctccttcctttcacttttctcattgttaaaatggtttctttatattatcggccactgggtttttcctttccatgaagaacctattgctcacctttcttcttagtgatctctgagtgctctttgtatatgagggaaccctgccctttgtcatgcctatcatgcgttctctcccatttttaggatgttgtggagacccttgtaagcaggcctctccagccagggaggctgcacatttgccctgaggactggtgtgggtcaagcccacctgtggccccgatggctctggggccccagcctgctcctgggtcacctctcagctcttcaggaggtccaggctggtgggcggctgtgggctggggagtcagctttgtctgtgctcagtgggtgctggatcagggtgtgtggccagtggtcctaggggcccccatcagcctccaccttggtgactgtgcagctgcattcttggggcctcctgtgctgaccacagcatgggcctcttctggttttgcccacaaaggggtcgatgttgattgttgctttgactttacctgagaaggaggcatgagtctgggctggagaccagcagaccaggtatgacagggccgagctggggagtctctggggtgctgaggggtgattgatgggaaccactgcttgggcactttggctctcaggaccccagaatggcccctgcccttccttcccctctggctcctcctgcacgtcctcaggggtcctgcctcccgccagccactccagggccacacacacctcccacagagccctccggagacgtggggtttgtgaaaaggatctttactaagaaacccagagagaaagaagtatgactgctgaagccagaggctggacgaggtcatagggacgaggtcggcagctgctgtccctgcaggaaaccccttctctggctgtgggagcccctctacccactccaggggcccgaagccctcaactgtcctgtggcctggcctcagagggcttccctgtgccttcaggctgcagaaatgggggctgcaggtggatggcaggaggggtgggtgaagggatgggggctcaggtggatggcaggaggggtgggtgaagggatgggggctgaggatagatggcaggaggggtgggtgaagggatgggggctgtggatggatggcaggaggggtgggtgaagggatgggggctgaggatagatggcaggaggggtgggtgaagggatgggggctgtggatgggtggcaggaggggtgggtgaagggaaagaaggtctgggtgaggcttgggggacggggatgccagacacttggacctcagggctagaagggtcagaccgaggctggggagtgaggccgtgggctggtgttgggctggacgcagactcagctgtgtcctgggctgggtgccgggccctccttggcttttggtgattgtacagtcagaatgggagtgacccggagacccaggggcctgggatgagctcagaacggctagcagccacccctcctcgatgactctgttgaagggacagacacggttttcgggtgggggctgcgactggtggttctctcggcgcctgtaaccttgcggctgagccggcccctctgggctcaggttcactggccatcagcccacagtagtgaccttgtgcccccttttcttgtctgcttcccttttcccacccagggcagggcgcagcccgagggaggctcaggcgctggcagagaaaaagctgggcctggtggagcgtgagtggcccgcggcctaggcgtggggctggaggacgttggtgtagtcgagggaggtctggggcctcccctgccgcgtggctgagaggaaccgctgcacctgaggggagggcgtgggtcagggcgctctgctggctctgcccaaccccctgccctggccgggcccctggaggtgggtgcccaccatgaggagcgtgatggcggcgctgtagctcacgctgagcaggaagagtgcggcgaagatgcagaggccggtccacgtccacggcgcctcgccctcggcctcctccacgcacacgtccagctctgggggacctggccagtcagccctcccggctccacagtggcagcgggggtgggggacagagcctcctgctgctctcggcagtccctgctgctgtccggagtggcagagcaccctatccggggccctctgggactgcgcggagccgccagccagccctgagggtgggcacccaggtcccgagtcagtcaacggcccagagccaggccgaccactcctgacctctcgtccctgcgccccgactctggccccattttccctctgttccttacggcttctctcctgacctctggttacctccactccgcctctctagaccccacgccctccccagagaaggacccaacccctcggcacagcagtggccgcctcactcagggccctcggaaggatgcgtgagctctgcggcctggctcccaagacctgggactcactgcatgggtgctctgaggggctgtcctggtgtggactatgagcccaggcctgtgggtgtccagagctgcctcctggccctaccccggcccggccccgcccaccagcctggtccctctggctcctgccctgggtgccctccactcccttccccaacaccgtgagctgcctgctggtcccgggtcatcagcaggtgcaggtcccgcctcgggccctcacacctctttctgctgctccaggcccagagctgggtgcaggtgggctgggacgtgagagtgaagctgaatgtatggctgtgacggtgtgcagggactgtcttcagacatggaggggctttgtgctcatggggtgcccggtgcccgtgtttccgtgtggatttggtgggtgctgtgcccttggtgtgcatgaccggggggagcgtttggatctggggtgtcagatgcacatgtgggtttgaggtctgtgaggggcacgtagcctgctctggggttccggtgtgggtgagtgggggatggagcccacgcatccatcctgtgtttggctgtggggtgctgctgctgacagggtgacagggagggttggactggaggacaccacgtgagggcctctccatttctctctgggatccagcggcccaggtatggctcagaggaagggcttggcagtagcctcgctggaggcagcgtgagaggcggagtgtgggccacgtgtgaccacgtgtggggtgtctatggcgccctggtggtggtacagggtgctgtggagttgctatggggcctagtgtgtgcacagctgtgccttgagtgaggcgtgagtgggcgagactgggtgtgtgaggctggcgatcccctgggggccgattcaggatggaccaaggggcggtggggggcagtaggagagggggcctggctgctgacctgggcctggtgtgcccacagggcagggtggcggaggctgcggggtgtgagtgggctcggctccaccggccccggtgctggggccaggactcggcaaggcgggacagggcagagaggcgaacgccagtggcacagacttgggcgagggctgtcgggtcgtgtgtgtctgtgtgggggtttcacttagggctgtttttccacctggaggggcctgtgtgcccatctatacctgggggtgcaggggctcctgtccaggggggtagaagccaagcccccaagagagagggctgtgggggctcccttgccccttccctgaggacctcccctgggtctttggactccttggagggggtagacccagagtgggggcagagagggcccggggtagctgtgatgagtccctgcagatatgctgtttgacaaataaccctgacacgaaggcagatggatgagtggcacctcagccctgcccacctcctcccaccgcctctcctggggggactcagccctgcccacctcctcccactgcccctcctggggggcccattcctctgtgccaagatgcacctgcccacagccctgcccgctcccaagaatgggtgtacctggggctctgagcaggcacagtttattgggggtagcttcctggggtcattgcaacagtggacagaaggtctggccagtcctccccactgcacagctggatggagccctgggagggagggaggcaggagtacgtcatttaccgggatttacagacaccgctcgctggacggtctgtgaggggcttgctgcctcatggactgcacggcagatgaactcatctttctgctcccattcggccctggtcacctccaggcggctgaagacgaagaagccggagcccttggtcttgcggggctgcgtcgtgctgtgccgggcgtccgggagctgcacctcgttgtgcagccactgcaccgagatgtcctcaggcatgaagttctggatcaggcaggcgagggtgcgcttgtcccggctccccggccactccggcgtcgcaaacgcatagacttccggggcagcacgcgggcctgtggccagacgtggggtcagcccgggccccgctcactcgctccctcccttcccccacgaccccggcctgcccatggctcaccgctggtcttggtcgtggaccgcatgagggccctgggcaggtgggggtgggtcaccctgcactggtaggtctccccctcgatccagtctcgggtgcccaccggcagggtggacgtgacggttaacgtgccattgcgctgcttctcctcctttctggtggagtggttcacaggcttcccactggcccgggaccaggtcaggttcacggtccccttgctgggtgccaggtccaccaccagacaggtgatcgtgggcgacttgcggatgaacaggtcgaacgggctgggccggcttaggtaggcgctcacccctctcgggttggaatctgtggtacaccggagggctgtgtgaggcccacccgcccctcttctctggcctccgtggcggccaccagggcaggtgggaacgtacctgcacacttcttggtgctgtcctcaaaggtgtgaccttgataggtgacctggcaggtgtaggtgcggtctgacagccagtgcttctggctgagggtgagctcgctttgtgtggaggccagctcaccctcctgcgtggtagaggcggtggacaagtccacgtccatgacctgcccgtcctccagccaggtgatgttgatagtccctggggtgtacccagagacgaggcacaggagctggatggtcggggggaagtgcccgccgccgtcgcaggacgactgtaagatcttcacggtgggcggggtgaagtccctggagcagactgggggagagctggtggtcatgagggttgttggcctctctgagctctgtgtgccctcctcttgcccccgcgtcctggcccgggtccccaggcatgctgggtgttcccacgtttgagcccacccaccccctcaacccctgcccactctgccagccctcagcctggcactcctgggaactgtggtctctgagcttggccctctcttaccgctgaaggttttgttgtcgacccagtctgtggacgatggagtgtgtgccacacggcaggtgaacatctgcttggcccacgcacccgagacggtcagcaagctgatggtggcatagtgaccagagagcgtgagggtggtggctggtaaggtcatagttgtcccgttgagggagcctgtgtcccaggtcaccatcaccggctccgggaagtagcccgtggccaggcagcccagagtcacggaggtggcattggagggaatgtttttgcagcagcgggtcaaggggaagacggatgggctctgtgtggaggctgtgaggacagaacctagtcagtgccagcctcaggccagcgcccatcaggcctggggggcctggatgggggagctggggaccccgtggcagggatccagatggccaggctcattctgggcctttttccccacaatccccaggcccagggcggctcccagggcccccattcccccaccagaagctgttgctcagccactatcatcaggctgggctcaggaaggggggtgcctccaggatgaccccagcctccccctgcaagtgctgcacggtgggcactcaggagcagagacactgggccatgcccctaggctgaaacccagggaccccatggggcctgggaccccagagccctcccccttcaaactctctctgggctcatggtggatggtctgcctgccctccaaccctgaccccaaccccccaaggctgtggtctcagctcctcgggctcttgagtgccaagcctggatctccccatcacagcagccctcacctgacctgccagacccccatggtgctctgcccacccctgacctctaggggagggcgggaagacttgccctgatgccccaggcagtcagtccctcccaccacagaaccctggcccagatagtgcggtctgtacagcgtggcccttcgcccctggcctggagtcccaagtccccagcccatcctgcccctggagcccagtttagcttggtcttgaagtctgctctaggtacccccaaaatcacagtatccagccccgctctgcccaccgggacagccaagttcagctgagactggcctaccgggggagtcgccctctgaagttcactctaagccagcctggttcagcctggcccaggtcagcccaggacctccccttgcaggcagcaaactcttatttcagtccagccagctcaaccagcttgcttctgactcagctcctcttagccaggtgagaatggtcagtccagatcaatttagcccggtccagtttagctcagcaaagctggacctaaagtagccacctcaccccagcttcatccagatgaatacagtccagatcagcttagtcagttaagcctagcctagctagttaaatccagttacgaccagctcaactaatcctgctcaggcctgctcagcccagcccagctgaacccagtttagccgaggccaggccagcccagctgaatacagttgcccagtctagctcagcccagtccagcactgcccagtttagctgagctcagcctggcccagcccagctcatatcagcccatctcagctgaaccagtttgacccagtctaacccaaccccgctcagctgaacccagcccagcccagcccagcccagccaaacccagtttagcctagctcagctcagcccatttccacccaacccagctcagcccagcttacccagtccagcccagcagcccagttcagcccactcaggctagcccagtttagcccagcccagctaggttcagctctgctcagttcagcccagcgtagatcagcttatcccagcagaactcagtttaaatcaccccaacccaattcggttcaataatccaagcccagctcagtccagcttcttataaccctgtccatctcaggtcactcacccagcctagtcctccccagctcaacccagtttagcccaaaccagcttagtcagcccaactagctaagcttggctcaggtctgtccagctcagcccaggtcttccaatcacagctcaggcccggccaggccagctcagcccagctccatccacctcagtccagttggcccagcccagccaaacccagtttaggccaggccaggccagcccagcccatgtgaactcagttgagctcagcccaggtcagcccagttcagttaacctcaacctgacccagcccagcccatattagcatatctcagctgaacccagtttagcccaacccagcccaacctaggccagctgaacccaggttaggttaggttagcttagcctagagcagcccagcccaacccagcccaacccagcccagcctgccccagtctaacctagctcagcccagcccagcccagctgaacccagttgagaccaacccagctgagtccactcaggcgagcctagtttagcccagttcacgtgggcacagttcagcccagcccagctcatcccagctaaattcagatcaccccagcccaatttagttcaataatttaaggcctgctcactccagcttttaaccctgtccgtcgtcaggtctctcccccagcctagccctcctcagctcaatcccatttagctcagcccagcttactcagcccaaccagctaagcttggctcaggtctgtccagctcagcgcagccctgctgaactcaggccaggtcaggtaagctcagcaggtaataccccagcttggtctccttcagcccggatagtccacgagcacccattttatcctaagtagagaactgtagcttgtccctactcctgtgtcggcccagcttatttcaaccaagtccagtcaagtccaggtcagcctaattcagcttaactcaatcctggaccacccagggcaggccacctcagctcagcctgactttgccctgccccccagataagtccagctcagcccagctcagtccaccttagggcttaggataacccagctcaagcctagctcagctgagcctagctcatttccctctacccagtccactcactcaactcagctaaacccgcctggcccgggccagccccgatcgccctggctcaggacagcccagcttggccacctgtcctctaagggacagggtagccctctcagcccacccagctcgcctcagctcagtctgttaggcccgtctcagtctagtccactcagccaagcccccctcagtccgcccagctcagacttgccaagatcagccagttgcgcagtggagctcaggacagctccctgctgccgcctccccaccctccctcccagctctgggttggctgtccctgtcctaggggtggcaggcagtctgcacccagcctagccctgcccagcgtggggtctctgaccttcttggtcttgggcccagccaagattcccagccccctgccttctccaggtcggcgttaggctgtttctagctttcctgtgtccccatgcagggaagggatgcctagagtccacgcagtgaccaagaagcttggttgatgctgtgagggtggcccaggagtcccctcgctgtcaggggcccaggcagcctctccctcactgctgcctgggccggcccctcgattggggctcccggtgggctgggatacctgaagcgccgggtcgtccatttggtgcctgtggatggtgtggcccgtccggctccctgtcgggttcctggacagctcccagatgatcagtaaccgtggttgttatttctgtgccgggcagtggagcctgggtagggggagctctgcctcagtgctttcagctaaaaatggggtgggaacccccggaggcccgggccgccctggaagttcccttttctctctgttcttgggaagtcgattgagcaacagcgggggtcaggtgaggctccttcactaccgatgcacaccgagtgctgggggaggttctcttctctctcaggcccaaccccagggcccctgcctaggtcccggactctcactcttgacgcatgcgtggcttggtggtcccagtcagcaaacttggggtcccgttgcctgggaaagggagagggtactgggcatcgacgcctctgcttccacgaaagccttgtgaagaaaggatgggggcgcttttgtgcaggagaatgaggcgcactgaggtgaactggccctcgggggccgcgtgtcccagatgtgtgtgcagggcctcctgatggccgcagccctcgtccctgtgacccgcttggagctggcaccctgagtggtggcctcaccttgtactcactcccaggtcactgtcctgcagccgggggtcccaagctgggctgctcctcaaggcgagcacatgaaggctggggcctggctgggggctggcagggagctgtgcggaggtggctggtggctctgcaaggtccttgaagctgctggaggctggggacactgtgccccgtctatgccatgggtgggcgtgggcacatggagaaggctgggctcgggctcggtggccttcctggaggcgcccatggcattcgtccctggttgcacccagtgctctgctctgagcgagataatttccttcacaccattggcctgcctgtcccctggaggccagcatgcatggagtggccactggggaggggtgggttgtatagaatctttggggagggagacactgggacctgcccctgggaccctgggtgcccagggctggttgtcctgtggagggagaggggctgtcgggcctggtgccctcagagagatgctcaccacgtgtggaagacaccagaagggctgctggctgccagggccctggagggctatgatgtgaggctcagggaacgcaggctgggggtgagtgttcccaggctgtccaaggcccccatgccctgcttgtggccctggagaaaggtgccgtgtgggaggctgaggggaaaatgctgagttccctggaaggacccatgattctgagagaaaccacagcaggggtggtgagcctcctgttcccccacttcccgggccccggtgaggctgtgtgcactgtgtgggtgtgcctggggctccacttgcccctcccatgtacctgctcattttccccaggctgtgggcatttggggcaggggcctcagtgcctggtcggctctctcccggttctatccaatgccccaagctgtgctgggctggaggggccgggcagggtgagcccccaggaaggaggttggcatcccagctggggctccatctctggcctctgccagccttgagatccccagtcgtctgtgtctccctcctggggcccagcaggcctgctcagctctgagccccatgtccgttctcaccctgctctgcttttccttggggtgctggccctgccctggcctccagaaatggcccctgcccccaccccttcctgtctgaggggccgggctgttcctctcctgcccggcgtgtgcccacctaggcccaataggcatagtgcccccagcccctcctgccctgttctggccttcacgcccagccatgccggcagcctgcctcagtggcctgggccttcgccagcgcctggctctgtgtccagctgccactcctgtggccctacggtgctgcccctttccctcagtgatgggggctgggcttcctgggaacgggctgtgtctcagctgcacacacctgtgtgtgtcagtgtgcgcatgggagtgcgtgtgtgtgctgggggtgtgtgcaggaatgcttgtgtctgggggcagggggagcgtctgccttcctgccccaggcctggaatggccatgccagggtgggtgggagcagcgggtgcgaggacagtgctgctttgacgtctgcgtgtggctggtgggggcgggaggacgtggtgtggcacgagtctcgggctccccatctccatccagctgatcccagatggctgcgctcctgagggtttagagcagcccagggggtcaggaggctgttgggacgctggaggcaagcgctggcagggatgggggtgggctggccaggcagcgtggccagggggcttcgagccggggcagtgaaccatcccccaactttttaaagttttaaaagtcatatttacacaagtgtagtttacattcagtataatccatcctgtgacatgtgagtttcaacaaatgcacactcatgcaaccaccaccgtaatccagatgaacagttgcaagaagatgtagaatctctccaaatattccaccaggcccctttgcaatcaacgcctccctgatggccaggaatccattgatctgcattctgtcagaagattcagagtttatcattaaaatgatctattatggaaaatattataagcatacaaaacacaaaaccaagttttaaaaagtgaggtatttcttaaaagtttagtatacaaacaaaatgaaggtaccttcacattttactacagatgtgcagatagttttcttggtgcacagagataaggcagaattaagtcagaataaacgttctaaaactgacctccggaagaactagtcttagtcatttctttgcagagtatgtgaaccaagattcgggtttggtctttggtgttagcactgtgtcaaggatcagatagaaagtacaaatggaggggcccctttctgaggccaggccccactgtcggggcatgtggggtgaccaggggccaataccagctgaggctaagaggctgctctcagaagggtaggtttccaggtgtctcttgaaccctttgttcagaaccaggacatgtgtggctgggcagcagccttcagaccccccacaggctggtgcccggtgcccacagccctctcttgggtcgtcaggcccctgcacccgtggtggggtgttgggctccagagttccctgggaccagctgatctcttgtccttggttttggcccaaatgcaagcccctggtctcctccaagtaacttcctttccccagggctgtccaggccccaccgctccctgttccttcccagggcctcctgcaagtcccgatgctgacgcctctctgcccacctagtttgtggccgccgcctccagctctgtgtctgcctcccagcgagggagctgtggttgatgatctcgtgagtgtctgcccttctgaagggtacagtgtgaagtctcgtcagtctcacttcaatgcctaagcacctcttcagaaaccagggattcatccgggtttctccatctttaaccatgttttctaaaggttttcttggcaatttcctggcaatttgcaagacaggattttttggttgccaacttccaattagctttaaacttgccacgatctcccaggtcatcccatccatcgaggatgcttattacattcttcctgatttccatgtggccaaattcaatagttatttaccccaggcttgtattttggaggctaaagaactctgttaccagctatatccgtgctgtggctgccgtaacaaaatatcacaaatgtggcttaaaacaacaaaaattttttcagagttctgggagtcaggaatctgagatcaaggtgttggtggctgtctctgagtgctccaggggaggaccgtccacctcttccagcttcctgtggtgcaatagtttggatgtgtgtctcttcaaatttcgtgttgagatgtgattcccagtgttggaggtgggcctggtgggaggtgattagatcatggggctggacccctcatgaatggcctagcaccatctcccaggtgatgagcgagttctccctcagttagtccctgtgacagctcattgtttaaaagtctgggacgtgccacttctcttctcttgctccctcttgccatgtgacatgcctgctcccccttcgccttctgccgtgattgcaatctccctgaggcctcgccagaagcagatgccagggccgtgtttccagaatggctgcagaactgtgagctagttaatcctcccttccttgccacagtgcctggtgcaaacctcttttctttataaattaccagattcatgtttttttttttttctagtaacacaaatagactaactcagaacattggtattgaggagtggaacattgctataaggatacctgaaaatgtggaagcagctttggaatcaggtaacaggcagagaggttagaagaatttggaggactcagaagaagacaggaagatgagggaaagtttggaatttcttagagactattaaatggttgtcaccaaaatgctgatagacatatggactgtgaaagccaggctgatgaaatctcagatggaaatgaggaacttattgggaactggggtaaaggtcacgcttgttaaatcctaagaaacaacttggctgcattgtgttcatgccttagggatctgtggaagtttgaccttaagagtgatgacttagggcatctgtggaagacatttctaagcagatgtttctaaggtgtgacctggttgcttctaacagtctatggtaagatatgggagcaaagaaatgactgaaagttggaacttatatttaaaaggtgtaaacgacaaaataaaatgctaaaccaaggggattccaaagaaacctggaaaaccagttcaggccatgacaggaaggggagggtggtttggactccctcactataccctctccctgttggagcttaggctcagctgaccagtgttaacattaaaacagggagcttaagactgacaaagcagactctttgtagcaataaggtatcaaatcccaacctgactctggtatagcatcacatgacaggtggcaggcatggaaggaaattaaagtatttattgccagaatatgtttctctgacacattttggaagggccctgcaaagccgtctcttgtggaggaaatgtatattctgttgagaatctttttccctttccaggtctcttcctgattcaggagagatttatccaagagtctggcaccttttaggttctgataagagacattgaccatctcttctctctggaacgtggagccttcgtctacataacaagaaccttggcttccacaacccccttatcttaagcattgcttttcgctgacttcaactttttagataatttaaatttttcagccaatcgccaatcagaaaatcttcaaatccaccatgatttggaattccccactttgaattgtcctgcttttccaaaccaaatcaaaccaatgtatactttacatgtattgattgatatgtctccctaaaacataaaagcaggccgcaacccaaccaccttgcacaggtgttctcaggaccttttgaggctgtgccacagttcatggctctcatatttggctcagaatcaatttttcaagtgttttatggagtttggcttttttcatcaacaaagggaagcagagcataaaaaatgtggaaaattcacagcctggccatgtggtagaaaagaaaaggtattttcaggagacaaatataagtaggctatggagcagccagttgctagagagattagcataactaaaagggagctaagtgctcatatccagaacaaagggaaaaaggccttgaaggcattttggaaatctctgaggtggtctttcccatcacaggcccagaggccaagagggaaaggatggttttgtgggccatggccatggccactgctgcctgtgcagccttgggacactgctctccacatcctggttcctctggctccagccttggctcaaagggccccaagtacagcttaggctgctgctttggagagtgcaagccactataagccttggtgacttccatctggtgttaagcctgtaggcccccagaatgcaagagtgaaggaagcttggcatcttccctctagatttcagaaatgtatgagaaagcctagctgcccagacagaagcctcctgccagcatggagccctcacagagaacctctactagagcagtgccaaagagaatgtggggttgaacccccatataatgtccccaccagggcactgcctagcggagctgtgggaagggggccactgtcctccagaccccagaatggtggatccactggcagcttgcaccctgaatctggaaaagccacaggcactcaactctatcgtgtgagagaagccacaggggctacatcctccaaagccacaggggtagagatttccaaggccttgggagtccaccccctgcaccagtgtgccctggatatgggacacgcagtcaaaggagattaccttggagctttaagatttaataactgccctgctggatttctgacaagtatggggcatgtagatcctttctttttgccaacttctcccttgtggaatgggaatgtttacccaatgtctgcacactcattgtattttgggagtcaatttgtctttgatttcctaggctgataggtggaagggactcatcttcagatgagacttgggacttgggaattttgggttgattctggaatgaggtaagactttgggggattgttgagaaggcataattatattttgcaacatgagaaggacatgagatttgggggaccaggggtggaaggatatggtttatatatttgtcccctccaaatctcatgttgcaatatgattcccagtgttggaagtggggcctggtaggaggtgattagatcaagggggaagatccctcatgaatgattgagcatcttccccttggtgatgagtgaattctcccccagtcagctcacacacaatctagttgtttaagtctggggcccccctcagcctcttgctcccattcttgccatgtggcatacctgctgtcccttcaccttctgctatgctgtaagtttcctgaggtcctcgccagaagcagatgctggtgccatgcttcctatacagcctgcagaactgtgagccaattcaacctctttcctttataacttactcagcctcaggtatttctttacagtaatgcaaatggacaaacacaggtggctcctgacacacccctcatcttcttctttgtcatcatgtggcttatctccacgtgtgtctgtgtcctctcctcttatgaggacaccagtgtttggacttgggatccatccaaaatttagtatgatatcatctcaagtccttaacctaatttgtaaagaccctatttctaaatatggtcacattctgaggttccaggtgggcatacatttggccagggagatgccatcagcccaccacaccagcctatgcaggtacatttgcatatagcttagggttgacctttcccatggaagtattacatccccctctggactccagtttcacatgttttagaatgcttcgccttctccagcaggatgagtcttttttccttttttagtatttttctctcttttctttggattggattaaaaataattgatatattctattgatgcatctttaagttttcagttccttcttttgtcttctccaatctgttattaaacttgggtaatgtttttctctttcttttcttttttaataaaatagagatggggtttcaccacgttgcccaggctggtctcaagctcctgagatcaagtgatacttccctgttgggcccccaaagtgctaggattacaggtatgagccactgggcctggccaaatgtttttcatttcagaatcatacttttagttctagaattttcatttggttcttgtaactattttcagttttttatagagatacctcatctagtcactcatgataaccatattctctaagtctttgaacatttttaacataacttctttaaagtccttgtctgataactgtatctgcatctaggtcatcttggagttgatctccattgatccctttttcttctgactttggatcacattttcatgtttctttgcatccatggtaattttggatgtgcacctgatgttgttgataacatgtgtacaggctatggggtttgcatccttccttagcagagcattaattgtttttttcatgttagcaagcagttagcttgagttgactcaaactcccaagtctgtctgcctgggagttggcagtatctgcaatctcagttctcttgactatacaggtgctgctttctgctggaccctttggagttttccctacccatgcacacctaagggatcggccagaggtttcagtggagtttacctgcaggttgtggggtttcccttcggtgaccttctcctttatggacatcttctcttcatttccagctgctctgaaaatgtagccctgcatcccactcctcaccaggaggactgcagtttcctgcttgaactctagctgcacccattacatgccctggggtgtgacttcagatgaatatttcagggaataatccttactagtgtttgcctacttctggtcatgttccagtgcctgtaattggtgtgtgtgggtgttgtgtgtgcttacagcatttccagtgtttataattgccatctgccaaagggctagtctgatattagctgctccagcattattggaatcggaactactttctctcatgtggtttttcattttcatttccctgttgactagtgtggttcaacaccttttcatatgtttagtggctatttggatatcttctgtaaaacatctgttcaattctcttgcctattcctcgttggattatttgattttttttctcattggtttacaggggtcttctttatattatggatctgtttgtgtcagtcagttatatatgtttataggaagcattaagaagaactgaaatggaccaaatgattactaggtgccttccatggaaagcaaggcatcgtcttgtacactcttccaggttatttcattctgtggagctctgcatctttcatttcctttgaactattttacacctctataagccaggggtccccaacccctgggtcatgcactggaaccggttcatggcctgttaggaactgggccacagagcaagaggtgagggatgtgtgagcattcctgcccgagctccacctcccgtcagatcagtggcagcattagattctcataggagcgaaccctattgcgagctgcacattcctgggatctaagttgcacactcctcgtgaaatcctaatgcctaatgatctgaggtagaacagctttgtccccaagacatcccccgatcttggtctgtggaaaaattgtcttccatggaactggttcctggtgccaaaaatgttggggaccactgctctaagttgtacataattgatagcaatgcaaaaactctttgagttggtagaaatgcaagttctcacctttggaaggacaatgaattgctcctcatcttccagggaaaaggccagttttgcatctatctatgaactccttttagcattcctgaatcaattatgttaagtgtagtacttagaattccactttgaactggttacgacaccttaattaatgagataaagagcatctctgaaatgtgtcgtcatatgtttatgtgagtcctgatcataatagttttaaaaaatgatctcttaactcgttgtgatttcttctcccccacggccccacccagccgcagtatccacggagcttagttttctgtggcccaggagggcaggagacccggtgttgacggggagatctgagattggccccaacttttccccacagctctgcttcaaggagtgccctgggaaggcctcccaaccccacacctgtcctgttggccaaggcgagctccatgccatgtggcatctctgccgctggccacctggtgagtatctgttgaatagagaaatgtgcagcatctccacagagcttccagggcttctgtgctctccaaacatctctgggctcccggcaccctctcagggtatgatgtgttggtggctgggttgggcccctgtccctgagggtaggactcaggcaaggacaaagctctggactcaaagagctggtgtgggggtgagtgaaaggaacaggagctttggggtcagaaatgcgggtttcagcctgcattgtccccatgagcaggggcttgcaggctcaccaaggcctcagtttcttcgatggtgagagagtgtcagagactgcagcacgtatttgaaagtgtccagggacggcaggggtctgggttggaccagctctcctgaatactgagggtgcgatcttgaccattgtgaaaggaaaataaaatctcaggaccctaaagtcactatgccaaaaagaacagttgaggtgggaagctgagtcatgaaaaaaaaaaaaagtcatgcgtttccttttgtttccaaactgagagcagcagcagataggccaggtctacccaggtggcctccctcaccctgacaatataaattaacagcccggtcttcatgacatgggacaaaatgagacaagaaatcatccctcctgcccctgagacaaatgcatatttgacttcttcctctactctgtttattttcttataaagtgcagatttactgagcacaaggcgaatgcgtaattgctccctccacccctccttttcatgcaacgtgggggctcagtgagatgtaatcaaagcctcagaagaatgtgactctcccgtcttgcttttttctctttcatctttcccctcctccagcttttccccttttcaatattgaagcaggacatagtgtgactgcatctggggtcaggtgtggggtggtccatgtggatagtgaggaaggtggtccctgcccgtggtggtccgggtttcctgggagatggccagacgtgggtgctgaggggaggaggccagtgcagtcactggacgggagagagcatgtccattgtgctgagtgggctgggagggatccacagagaagacggtgtggctcaacagctggcactggggacaggaacgtgggtgaagggcctggcacatggagtagctcaaggcgtgaggctgtgacccacctggagagcctgtgcctgagtgtgctgggtgggtgctggggttgcaaacattcgtgtgcctgtgaggcccgtgtgtgtatgtgtgtgtcacgtggcccccatgcgtgtcaggcattgttgcgtgtcccccatgcgtggcaggcagcatcacatgtcccccatgcgtggcaggcattgtcgcgtggcccccgtgcgtggcaggcatgtgcagcctgagtaccatgccagatggggcgttctgtctcctccaggccctgccctgccatgtgagcagggagcttccccatgggactgatgttctgtctcctccaggcctggccctgtcctaccatgttagcagggagcttggccatgggagtggtgggcacaggcgtggctgtgccgggcctcactggctggattcggtggggacaccataccccttgctgagtgtgggtgttagagggttcgaggtgccctctgggaggtggtcgggcagaggcagggttgggagtgtgtggggagatgggtgttcagctaggttccttccctgtgcaggggctcagctgaaacctgggctctcactcccctcacccctgcctccccagcatcctcactctgcccctctcttcagcctgcctcgggccttgccctgggacccctgctgagatgacaggaggggcttcagcagcaccctgtgctgggtggacgccgaggtcacaggctcgctctgtgtctcctcacaaggccacgtggtggcaggtccttcctcctgtctaaccagagtcctgcttgctgctctgcaacccccttgggtcacgtggggcaggggcacctagcagggtgggcttcgtggactcaagggccaccagttcctccaggtcaacctgctcagatcgttccattctcccccttcccttggccacagagacctctgtatgctggggtgaccacaaatgtcacaacagcagagtcacaccaggaatgtcacaccatgtcacaccacatcacactatgtcatgccagggatgtcacgccacatcacaccatgaaactcatcatcacactagggatgtcgtaccctgccacaccccatcctgccacatcacaccatgtcacaccgcatcacatcacaccaaggatgtggcaccctgtcacagcacgtcacacgtcacatcatgtcacaccacacctcatcacaccacagatgtcataccccatcacaccacatcacattacatcacaccacgtcaaactacctcacaccccatcacaccagggatgtcacaccccatcacaccacatcacatgtcacaccacgtcacatgccacaccatatcacagtatgtcacagcctgttacacttcatcacaccacatcacaccagggatgtcacaccttgtcccatcacatcacatcatgtcacaccattccacatcatttcatattatagctcatcataccagggatgtcatacccatcacactatgtcacagcacatcacaccagggatgtcacactgtgtcacaccacatcccaccatgtgcaacaccacctcacaccagggacattacaccatgtcacaccacatcccaccatgtgcaacaccacctcacaccagggacattacaacatgtcacaccacatcacatcacccctcggatatcacactgtcataccacatcatacaacatcacaccatgtcctgtcacatcatgccacatgacatccacgtcacaccagagacatcacaccacgtcacaccatgtcatgttacatcacagcacggactgctggggtatgtgcaggggccgcccacagtgcagccttgctggagagttgagggagggtcctggggctgggcatggtgttccctcaggagggctgaccctctggaggatgctcggtcccaggtggaaagggggcggtgggccccgggtggctcagggaggggcccaatttccctaggggaacctggtccaggcgccaggccctgcaggggcaggagctgcaggaagcatctgcttcttcccaactcagcctgctcagtgcacggaatgacccggagcccggcaccatcctgggtttcctttccttatcctggccaggccgtccatcctcagacagtggactggagcccaccccaccagggcacccggaggcccgtagggccccttgaagggcagagggtggagatctctccagcagggtccctgagggctggcaccttctctggacaaagctctcctgcatctctgggacgccatccttgggcttgggatagagccggtgatgcagcagctgcccgccctgcaccccaggtgctgtctccctcaccccccgcggggctgcagcagcgtgtcctgagagttaaagggctgggcttcagcacccagttcaggccaggccccctggagcccaccctccagtggcgagccttcccacggcatggcagggcctggagtctggggatttagtccccaactccgtgtttggtgcagctccagctgctcgatgccacacaaacgaatccaaccactcctccttcctgggtgagatggtctctctcctgccacaggcaactccgacggcattttccagccaccgcagccaccgcagccactgcagtaacaagaccctgtccttgactgagttccagccaggctcctcggagcctctccactcggcctcaaccttggcttgtaaagacttgagcagacactaacagtttctaacagcttctggccgtacccctaggccgacccctgccccgtcaacacctgcctgagaaagctccgtgcaccagaactcaccgtttggaccaaccccgacctccctttctcagggtgtctgctgagagggccgcaaccacacgtccttctatccgttcccgatgtctgtgcatttcctgtgacccaggagggtctttctcaagacttgagagccgctccctgaagtgtcccctttgtgaaggatggggcctgtgtctccaggctctgggaggacagaatcctgacctcaacagtggccggcacggacacagcaggtcccatcccggggacgctgaccagcgctgggcaacttttcccttccccgacgactgagccccgagcacccaccctgctccccctaccacctccctttacaaggctgtggcctctgcacagatgaaggtgagtccaggtcatgccggactctttcttctgttgcaatagttatttctgttgaaaatccgtccttgctacatgatctagtgcccagctttatctttgaaaatgtctctctccacctttgcctctcctgccttgtcctcgttcctggcacccaccatgtgtcctatgggctgaattttaccatagaatgaatcacacaccaggtttcacctgtgcctgatgagggtgacagtttgatgagattttaggcttagaattgatgctgaaaggactaagacttgggggatgctgagacagatgaatgtattttgcatgtgagaagaacatgaaatttggggggccatagcatggactgttatgagttaaattgtggcccctacaaattcatatattcaagtcttaatccctggcctcacaatgtgactatttggagatggggtctttacagaggtcattaagttcatatggggtcactaatctaatgcgatgtgtgttcttataagaagagaagcttaggacacgggcacacagagggatggccatgtgaggaccagggaggagacggtgtctacaagccaaggagagagggcttgagagaaaccagccctgcctgcatcctgatctcagattcctggtctctaggcctgggaggatccatgtctgccgtgggagctgccccgctgtggtcctgagctgacgcacacagatctgacacccacctctcgcttcggaccatggttggttctggaaggccctccctgtggctctgcctggccagcctgagccagctcccagcctcgacccagctttccctggaggccctgtcccccgcagagtgaccagggcaggcagcaccgtgcccagcaggaggagaaactgcatccatgtagaaaagaggagaagccccgggggtccatgtagcgacaggggccagggagggccgctcgggcaatgcgtgtggctgcaggaggcggggggcgagtgcagggagcccccgaggtgcagctcgaccagcctcctcctgaccgtgcttcccaccgggggcaggaggcgcgtggacacaggaaggcggctcccatcacgaagtacaagacttaaaaaggatattttattgtcatcacaaaagaaacatcaaagacaattaatgagctttagaaaatttaaaagaagaagaaaagccaaagctgaaatggtgacacctccttcgagtgagcccgggagtcctccctgacggccgaggcaggcgctggccgcagtcccgctcgagcctcccttcctgtctgtggattctgcgtgacagtcacggaacggtgtgatgggggcagcagagcgtgggggcctctgtccagcactcgtggccagcagccccgctttcgcaagaacacgggcaccctctttgtcgtcttgcctctccacctggtgcccccagagtggctgcttgttcctgctgcacgtgacccgggactggacgccagcctctgtgatgagttctggctgtgtccacgctcctggctctcccggtgtccctccacctctctccccgatgctcctgggcctcctctgtcctcaggccccaccaaggctgagtcttgcccgcctgggacctggtcaccagccttctgtgggaggcctgtctgggcagatgcccagcccttccttgggctatcctcacccttgcactgtggggctcctgcagcggccacatggcccaggctcttctccgagtgatctcggtggactggagtgggtggtaggtggcagtgtcctgggcctggccctttctctccccagtgcggactctggggctggctgtccctgcgggtccagttccacccgagaatccagcagtgtgggcaggcagccaaggggtggtgctggcaccgagactgttcccaggagccagagagcagcgttctttgcttgaaatcagaacaacctcattcctcatgtcaggagttcacgggagtgcccggaatggaggctggctggctgcgggctgggaggaaggccgtctgagtgagccttcgcagctctcggaagcctccccaacagggcctgatggtgctgtggcttccctaccttggcgactgatgctcccactcaccatctggaaaccatgcctgtgttcaggaggctggcgtggacggggttggctccagggcgaggtcctgcctgagtgggggcctgggatgccggttacctccttttgtgtgagcacctggtggtccagagggcagggacgtcctgctgaggggacacctggccctcagcgccctgcatgcaccaagcagcggaggtctggggtagacctgctatgcacagggtctggaaggggggcgtttcagggctcagagggcgactgcgaagccagagagccatggggttgagggcggtgaggtcagggggcaggtgtggcctgggtggtggctgagcatggcccacggctcgtgtgtggggtctgggcggccctggacaccccgcagagggtggccctaggccccctgccttatcatgttcctgtagtcggggacgatggtctgcttcaggtccaccactgaggagaagatccacttcacctgtaggcaaggcacagcacaggggtgagcgaggccacagccctgcccctgagccccacccacccctcaggccacccaggccacagccctgctcccaaggcccatctgcctttcaggccacccaggtaccggggctctacactgcctgcccccaggcctggacatggagagcagagccatggtagtgacagcatgtggataacacagaagacaacgtcagggacaggtggggacagcgtgggggacagggagaggtggggagattgggggacaggtggggacagcatgggggacagtgtcagggacaggtagggacagcgtgggtgacagggagaggtggggagagtgggggacaggtgcggacagcatgggggtcagtgtcagggacaggtagggacagcgtgggggacagggaaagctggggaaagtgggggacagcatgggggacagtgtcagggacaggtagggacagcgtgggggacggggacaggtgcggacagcatgggggacagtgtcagagacagggacagtgtggggggtgagtgggggacaggtggggacagcatgggggagtgtcagggacaggtggggacagtgttggggaaggtggggactgtggggtacagtgttggggaaggtggggacagcatgggggacagtatcaggaatgggggaccgcatgtgggacagcgtcagggacaggcggagactgggggacagtgtgggggaaaggtgggacagcatggcggacagtgttggggacaggctgggggagagcattggggacaggtacagcgtgggggacagaatcagggagaggtggggagaccgtggggcacagcatcaaggacaggtggggacagtgtgggggacagtgtcaggatgggggatagcatgggggacagtgtcggacatgtggagacagcctgggggacactgttggacaggtgtgtacagcatgggggacagtgtcagggacagtttgtggagagagtgggggacagtgtcagggacagtgtgtgacagcatgggggacaatgtcaaggacagctggggacaacgtgcggccgaccttgaagaaggtgacggtggcactgtagcacacgcttagcaggaagagtgtgatgaagatggtgatggtcgtccacagcccgtccagctccccgtcctgcgcctccgcacagctctcctccagttgcagctctggacaggaagggggtggtcagtgctgtgtccccctgggcttgggcctctgggggtgattccctctgtggcggggcccaggatgtagggcccggccgggatgggccaacaatgtcctgaggtcagctcccggaagctgtccaccctgggcaccagctttggccctggggctcagccagacacccggccctagatagcgacctggccctcagcaggacccactccccgtctcccgtgtccctccctgagccccagagggcaggaggatggtgaaacccacccctcatgtgaccccagctgcagggaagggctgtattgggacgtgggccagtgccagggacgcgacgtggcgtgtgttcccctgtgtgtgtggcggctgcaggggcaccttgtgagaggagggctgggtttgtctgagctggtcagcatgtggagaagctgccgagcggctcgtgggccttgaggtgccgcgtggggctcgtgggggcctgtgtctgaggagtgttcacgtgtgcgaggaccttgctctggtctgggtgctgtgcggttcgcccgggtgaggctccgtgtgtgaggcgtgcacgtgtgtgtgtggtggccgtgtggccggccaacctcagtgcggggtttgttgaacgggtctgggctgagtgtgtgtgtgggcatctggaccagtccctccacagggcccgagagtgcatgtccccggagtcggttgtgtccccatgtgggttcgaggctgggcagggctgccaggggttagtgccgtgggggtagatgggtgagggagggcctgtccctacgcacatggactaggcatgcccccgagtgggcatgcgggtcggaggacagggcgctcacagaacaggacagtctcctacagaggcaggggctgtgtgtctgtccccaggggctcctagggcttctcgtggcccagcccagggcaggtgctgctggagggagggccacgctggcaaatcccccaccctgccgagggcagcccctggctgagccccaccctaggcggcccaggcacacctgcacagcctgggccagtgtggggacagtgggacccgctctgcctccctcatgccactcaggcctcagactcggcctgacccgtggaaagaaccatcacagtctcgcaggggcccagggcagcgctgggtgctttatttccatgctgggcgcccgggaagtatgtacacggggtacgtgccaagcatcctcgcgcgaccccgagagcccggggagcgggggcttgccggccctggcactcatttacccagagacagggagaggctcttctgtgtgtagtggttgtgcagagcctcatgcatcacggagcatgagaagacattcccctcctgccacctgctcttgtccacggtgagcctgctgtagaggaagaaggagccgtcggagtccagcacgggaggcgtggtcttgtagttgttctccggctgcccattgctctcccactccacggcgatgtcgctggggtagaagcctttgaccaggcaggtcaggctgacctggttcttggtcatctcctcctgggatgggggcagggtgtacacctgtggctctcggggctgccctgtagggacagaggttggcacagcggtcactcccagggcagagggtgggccgagctgacctctgtccatgtggccctcgcaccccgtgggtcccacctttggctttggagatggttttctcgatggaggacgggaggcctttgttggagaccttgcacttgtactccttgccgttcagccagtcctggtgcaggacggtgaggacgctgaccacacggtacgtgctgttgaactgctcctcccgcggctttgtcttggcattatgcacctccacgccatccacgtaccagttgaactggacctcggggtcttcctggctcacgtccaccaccacgcacgtgacctcaggggtccgggagatcatgagagtgtccttgggttttggggggaacaggaagactgatggtccccccaggaactcaggtgctgaggaagagatggaggtggatgcgtcagcacccggctggggcctgtccctggatgcaggctactctagggcacctgtcccgccttgagctggagggcgaggcctgggttggcttacctgggcatgatgggcatgggggaccatatttggactctgcagagagaagattgggagttactcagatctgggaggagagaaggtgtctgagctgagggagtggagagtttggcctttggggtgggcttaggtcaggggcagggtcctcccggatatggctcttggcaggtctgagcgcagcacctgcccctgtatgcgcagggcctggggtaggggcatccagcctgtggctgcccggagcctggtggaaaaatccagaagaccctctccctgagcatgagtggggtggtcagaggcctccgggtgaggagacagatggggcctgccttgctgccctgggctggggctgcacagccggggtgcgtccaggcaggagggctgagcctggcttccagcagacaccctccctccctgtgctggcctctcaccaactctcttgtccaccttggtgttgctgggcttgtgatctacgttgcaggtgtaggtcttcgtgcccaagctgctggagggcacggtcaccacgctgctgagggagtagagtcctgaggactgtaggacagccgggaaggtgtgcacgccgctggtcagggcgcctgagttccacgacaccgtcaccggttcggggaagtagtccttgaccaggcagcccagggcggctgtgctctcggaggtgctcctggagcagggcgccagggggaagaccgatgggcccttggtggaagctgcaagagaggtggtgccatgtgaccgcggtgtgggacagagctgggcccagggcgcagaggcccctcggttcttgtctatctgcgatggtccatgcagggtccagtgtctgggctcacgggcattgggtgtgcgcctggctggcgccacctgcgtcaccttagccccctccctgcccccagccaaagtcaggcccggcctgccccagaaagcttgcaggaccggtggccctgtggtgcccttctgcaggcacccctgcagcctagggggcggggctcggcagccaggtcagcgctctgtgcctgccgggagtcagcacagtccagtgtctctagcttggcctcagctctggccatcggtgccacctcagggacggctcatgcccattggccccactccagccttttatgggtgcctggcttgaccagtggacactgttctcagatggcttctcgtgggtcccccgagtcccctgaagctcctgaccctgccgccccagcgtggccctccgctagtgagtgggcctgacttgcccagggccctggtcatagcctgccctctgccctccaaggcccttttcttctgtgcagcagaggggccagacactgcatagggtcggcgcccttcagccccagggccccggaaccccctgccttggaatagcctcctggagcctcctcctcagcctctcccctcctttccccttagccccagtgtgcagcagcccaggtcagggccctgagtgcctggatgccccctgcctcccagtgtcctgcattacttctggaggctcagtcaccacaacctcaccctcccagccctggcctggccttctcggccaccagcccacctcctccctctctccagagcttcccccggcaaggtccctgctgggctcaacccaggccccccagcacaggtaggagccttgcacctgcccttggccctccccaccctgcatggtgccaggacccccaggccacagggaggccccatttctctctgccgctggcccagtggccctggagtcccactgcaggtggggtgtgcccctgacctctgaggaggctaagcgccctgccctcagccaggccatcccctctgctcggccccagggccccgctcaccaccccttcccctcacctgcaccacaggctctggctgactctgcccaggccctgaatgggcccctctggcagccctctgctgctacactgccctgcaccacctccactcagcttcattgtgctgatggtcctggctcctggcagcccatcttgctccttctggggcgccagcctcagaggccttcctgcccagggtccgctggggccagccctgggaccctcctggtctcaagcacacgttccccctgcagccacacctgcccctgcctgagagcccagccctgagccctggaatgccttcccttctccatcccagctcgcccttgccaactgctcagtgggatggactcacactcccttcccggcaccaggaggctgcactgcactttcaccagctctcagctgtctgctgccggcaactacccagctcctgccaaagtctaggagctgagtgatgcctcccaccagccctgctcacctgtggctgccttgccctgagctctagtgcctgtcccctgctcgtcctgcctcccaccggccctgctgacctgcggcggctctgccctggtcccctgacctccaggagctgccccttgctcctcctgccccccaccggcccttttcacctgaggctgctctgccccggtcgcctgagctccaggaggtgccccctgctcctcctgccccccacctgcccctgctcacctgcggcggctctgccctggtcccctgagctccaggagctgtcccctgctctgcaacctcccactggccctgctcaccttctgatgctctcccctgtttcctgagttccaggagccgccccctgttcatcctgcctcccacctgcccctcctcccctgtggctgctctgccctggtcctctgagctccaagagctgccccctactccttctgccccccacctgcccctgctcacctgtggctgctctgccctggtcccctgagctccaagagctgccccctgctcctcctgcccccccacctgcccctgctcacctgcggcgtctctgccctggtcccctgagctccaagagctgccccctgctcctcctgccccccctcccctctcctgtttgcctgtggctgctctgccctggtcccctgagttccaggagctgccccctgctccttctacccccacctgccctgctcacctgtggctgctcggtcctggtaccctgaactccaatgcctgccccctgctcactctgtcctccctcaacccggggcagcaatgtcactcaggccactgttgcccccctgcctgtcctggcaccctctgtccaggtttgggctgtttttctggcctcatttttgtttttgcagcacttggcttgttccctatgctgtggagcagccccagtgtccagtcaggtctccccaacagagccccttgcctatgtgcccctcctggatgagctcccggatcctcccgtccctgcactgctcctgctctggaagcctctccggaacctcagctcctcagtggcctctgctctgctgggcctcagcccctcccctcgccccaggcctgctgcactctgggcctttctgggcctccctggactcttccctcctcccgcccgtgcactcagcacagctctcccctcctctccgctgctgaccacagccctgctccccgccagcaggtgccccagccccatcagctggctctgagcccagcccctgtccctcccctgtccctgcctctgcctctgggctccttggcttccacccttctgtcctgctgccacactcaccctcgctgctctgctcccggctcacctgctgtccttggtcctggctgagaggagggccctacggccagctctgctgaccctgccctgggctctggtgatgctgccggcctggacaagcccctccgttcacctggggcctctcctcctccctcgctctgctgcctcctgagctcaggtcggtcgtgcccatcctggcatcaccccacagccggttctgccgcatcccgtcatgttcctcgtgctcccagcccggtcgtcctggaggcctcagtcagcctctggtgtgtcctgccctgttggcttggaagcccctgcccacggtccccgtcgtctcgcactgggtgggcatcagtgcctgaaggctgcccacctcccccgtgctggctccgcttgggcttccatgtggggctggcctcgcgcccgcgtctccccagcctcttgcagcctgttcagcagctcaggtctaggagcgccgacggctgcgcccaggctgtcctcctcccgagcctgtgcccctgccctgtgctgaccccactcaccgaggtgggggtctcaacccttcctgttctggcgaggtacatgtgggcggccccgcccccgccgtcagccgctatttgtcttcctaggaaatcacagctcaggtcccaggtccccaggggtgtgaactccacgctgcaaagactaagaacaggattgaaaccagcggcaccccttacttcctgaagttcccttttcttctggtggtttctgtgtcagagggcgagggggagtccacacagagccgaggctgcctcatgggtgtgtggggatgggggtggtggctgcccccatactcccccatactcacgggagaaggtggggagcccggaccttgtgtgctgctcttttctctgtctctgagtccctggggctggactgagactggcagcgattatgaccattctgcccatggtctcagcctctcaatacctgggcctctcacctgaagcttctggccccccactgggccctggtggctgctttggcctgggcatctctccagctgactctcactcatggtggagggaggggagtgtgagttcatcccactgagcagctggcaaaggcgagctgggatggagaagggaagacgttccaaggctcaggtctgagctcacaggcaggggcaggtctggctgcagggagaacgtgtgcttgagaccaggagggtcccagggctggccgagtggaccctgcacaggaaggcctctgaggctggtgctccagaaggaacaagatgggctgccaggaaccagggccaccagctgtgctcctgggggccgaggggacttgggacaggtggatgaacacactgaagctgagtggaggtggtgcagggcagtgtagcagcagaggggagccagaggggcccattcagggcctgggcagagttggccagagcctatcgtgcaggtgaggggaaggggtaaggggcagggccctggggctgagcagaggggatagcctggctagggacaggacacttaacttcctcagaggtcaggggcacacccgagttgcagtgggactccagggccactgggccagcagtagagagagaaatggggcctccctggggcctggggatgctggcatcatgcagggtggggaggtccaagggcaggtgctaggctcctacctgtgctgggggagcctggactgagctcatcagggaccttgccaggtggaaactctggagagagagaggagctgggcaaggacggatgtggaggtgggaggtagcgggggacgagatgcagccagagggactgggcagaccaaaagcccgaggaggtttcgcacaggaagcatccagagtggaacaggaagcatgcagagtggaacaggaaatgtccagcatggaacaggaagcatccagaatggaacagggagcatccagagtggaacaggaaatgtccagcatggaacaggaagcatccagcatggaacaggaaacatcaagcgtggaacaggaagcgtccagcgtggaacaggaagcgtccagcgtggaacaggaagtgtccagcgtggaccaggaagcatccagaatgggcactttgaagggaaatcatgtccctcccactaaatgtgctctccacaaggacccggcccacccttgtgtccctgctggatccctgagctgacaccagccctgccctcagagagaatgtccaggagacaggtggaggtgcacgtgtgggtccctggggaaatccatcctccagccgcaggctcccagtcggctcccagcttctggctccggcttcaccccatggagctcataatgggctcaacctcccaggctgggggaggatgcagtgaggggccccgcactgcccatggcacacccagggggctggggagtctgcactgggctggggcagggaggcctcgtgcagcctgtggggctggcagctcaggacaacactcgtatccgttaactgtggccctggcaacacagcaccccagactgcgtggcttaaacaacagacgtttattccgtcctggttctggaggccgggcatctgggatggaggcctcggcggggctggcacctctgtgtcatgggagactctgtcccaggctctctccttgctgctgggctttgccggccgtctctgctgctcttggcttatggaagcagcaccatcttcacagggtgttctccccacgtgctgtctgtacccagattcccccttttcatgaggacagcagtcatattggatcagaggcttgccctactccagggtgacctcatctgaacttgattgcagttgcaaagactgtttccaaacaaggtcacattctgtggtcctgggggttaggacttcaacacatgaatttataggggacacattttaacccacaacagtttgccctccgctccccccataatcatgtccttctcacatgcaaaatccctgcaccccatagcaacatctccaagatggctaaccccttccagcaccaactcttagtccacaatctcagaggaatatcacctgcatcaagtgtgggagaaaccacagcaggggtggcgagcctcctgccccctctggcccaggtggggctgtgtgcactgtgtgggtgtgcctggggatccacttgcccccccatctatctgctcattttccccaggctgtgggcatttggggcagaggcctcagtgcctggcctgctctctcccggttctatccaatgcctgtgctgggctggaggggccgggcagggtgggcccccaggaaggaggatgggtcacctgttgctcccataagcccaggtccagtcccagctggggatccatctctggcctctgccagccttgaaatcccccagtcctctgtgtctccctcctggggcccaccaggcctgctcagctctgagtcccatgtccattctcaccctgctctgaaaaatgatgtttttcatttcagaatcatactttcagttctagaattttcatttggttcttgtaaatattttccgtctcttatagagattccccatctagtcactcattataatagtattttcctttaagtctttgaacatgtttaacataacttctttaaagtccttgtctgataactgtatctgcatctaggtcatcttggagttgatctccattgatccctttttcttctgactatggatcacattttcatgtttctttgcatccatggtaattttggatgtgcacctgatgttgataacatgcgtacaggctatggggtttgcattctttcttagcagagcattaattgtttttttcaatgttagcagttagcttgagttgactcaaactcccaagtctgtctgcctggcagttggcagtagctggaatctcagttctctcgacttacaggtgttgctttctgctgggccctttggagttttccctacccatgcacacctaagggatcggccagaggtttcagtggagtttacttgcagattgtgtggtttcccttcggtgagcttctcctttatggacatcttctcttcatttccagctgctctgaaaatgcagccctgcatcccactcctcaccaggagggctgcagtttcctgcttaaactctagctgcacccattacatgcactggggtgtgacttcagacgaatatttcacggaataatccttactagtgtttgcctacttctggtcatgttccagtgcctgcaattggtgtgtgtgggtgttgtgtgtgcttacagtgtttccagtgtttataattgccatctgccaaagggctagtctgatattagctgctctagcattactggaatcagaactactttctctcatgtggtttttcattttcatttccctgttgactagtgtggttcaacaccttttcatatgtttagtggctatttggatatcttctgtaaaacatctgttcaattctcttgcctattcctcgttggattatttgattttttttctcattggtttacaggggtcttctttatattatggatctgtttctgtcagtcagttatatatgtttataggaaacattgagaaaaattagtaggtgccttccatggaaagcaaggcatcgtcttgtacactcttccaggttatttcattctgtggagctctgcatcttttatttcctttgaactattttacacctctataagccaggggtccccaatccctgggtcatgcactggaaccggttcatggcctgttaggaactgggccacagagcaggaggtgaggggtgtgtgagcattcctgcccgagctccacctcctgtcagatcagtggcagcattagattctcacaggagcgaaccctattgcgagccgcacattcccgggatctaagttgcacactccttatgacaccctaatgcctaatgatctgaggtggaacagctttgtccccaagccatcccccgatcctggtctgtggaaaaattgtcttccatggaactggttcctggtgccaaaaatgttggggaccactgctctaagttgtacataattgatagcaatgcaaaagctctttgagttggtagaaattcaagttctcatctttggaaggacaatgaattgctcctcatcttccagggaaaaggccagttttgcatctatctatgaactccttttagcattcctgaatcaattatgtaagtgtagtacttagaattccactttgaactggttacgacaccttaattaatgagataaagagcatctctgaaatgtgtcgtcatatggttatgtgagtcctgatcataacagttttagaaaatgatcttttaactcgttgtgatttcttctcccccacggccccacccagccgcagtatccacggagcttagttttctgtggcccaggagggcaggagacccggtgttgacggggagatctgagattggccccaacttttccccacagctctgcttcaaggagtgccctgggaaggcctcccaaccccacacctgtcctgttggccaaggcgagctccatgccatgtggcatctctgctgctggccacctggcgagtatctgttgaatagagaaatgtgcagcatctccacagagcttccagggctactgtgctctccaaacatctctgggctcctggcaccctctcagggtatgatgtgttggtggctgggttgggcccctgtccctgagggtaggactcaggcaaggacaaagctctggactcaaagagctggtgtgggggtgagtgaaaggaacaggagctttggggtcagaaatgcgggtttcagcctgcattgtccccatgagcaggggctgcagactcaccaagacctcagtttctaccatggtgagagagtgtcagagactgcagcacgtatttgaaaagcgtccagggacggcaggggtctgggttggaccagctctcctgaatactgagggtgtgatcttgaccattgtgaaaggaaaataaaatctcaggaccctaaagtcactatgccaaaaagaacagttgaggtgggaagctgagtcatgaaaaaaaaaaaaaaagtcatgcgtttccttttgtttccaaactgagagcagcagcagataggccaggtctacccaggtggcctccctcaccctgacaatataaattaacagcccggtcttcatgacatgggacaaaatgagacaagaaatcatccctcctgcccctgagacgaatgcatatttgacttcttcctctactctgtttatttgcttataaagtgcagatttactgagcacaaggcaaatgtgtaattgctccctccacccctccttttcatgcaacgtgggggctcagtgagatgtaatcaaagcctcagaagaatgtgaccctcccctcttgcttttttctctttcatctttaccctcctccagcttttccccttttcaatattgaagcaggacgtagtgtgactgcatctggggtcaggtgtggggtggtccacgtggacagtgaggaacgtggtccctgcccgtggtggtccgggtttcctgggagatggccagacttgggtgctgaggggaagaggccggtgcagtcactggacgggagagagcatgtccattgtgctgagtgggctgggagggatccacagagaagacggtgtggctcaatagctagcaccggggacgagtacgtgggtgacgggcctggcacatggactagctcaaggcgtgaggttgtgacctgcccagggagcctatgcctgagtgtgctgggtgggtgctgggttcgcaagcatttgtgtgcctgtgaggcccgtgtgtgtatgtgtgtgtcacgtgtcccccatgcgtggcaggcatcgtcgcgtggcccccatgtgtggcaggcatcgtcgcgtggcccccatgtgtggcaggcatcgttgcgtggcccccatgtgtggcaggcattgtcgcgtggcccccgttcgtggcaggcatgtgcagcctgagtaccatgccagatggggtgttctgtcttctccaggcctggccctgccgtgtgagcagggagcttccccatgggactgatgttctgtctcctccaggcctggctctgtcctgccatgttagcagtgaccttggccatgggagtggtgggcacaggcgtggctgtgccaggctttgctggctgggcttggtgggggcaccataccccttgctgagtgtgggtagcagagggttcgaggtgccctctgggaggtggtcgggcagaggcagggttgggagcgtgtggggagatgggtgttcagctaggctccttccctgtggaggggctcagctgaaacctgggctctcagtcccctcacacctgcctccccagcatcctccctctgcccctctcttcagcctgccttgggccttgctctgagaccgctgctgagaggaccggaggagcttcagcagcaccctgtgctgggcggacgccgaggtcacagcctcgctctgtctcctcacaaggccacgtggtggcaggtccttcctcctgtctaaccagagtcctgcttgctgctctgcaagcccacttgggtcacgtggggcaggggcacctggaagggtgggcttcgtggactcaagggccaccaattcctccaggtcaacatgctcagatggttccattctcccccttcccttggccacagagacctctgtatcctggggtgaccacaaatgtcacaacacaagagtcacaccagaaatgtcacaccatgtcacactgtggggaaaagaaagatcagactgttactgtgcctatgtagaaaaggaacacataagaaactccattttgatctgtacaaagaaaaattgttctgctttgagatgctgttaacctgtaactttagccccaaccctgtgctcacagaaacatgtgctgcatggaatcaaggtttaatcacaccccatcacaccagggatgtcccacaccatcacaccacatcacatcatgtcacaccacccacatcacactatgtcacagcctgttacatcacatcacaccagggacgtcacaccctgtcccatcacatcacatcatgtcacaccattccacatcatttcatattatacctcatcaagccagggatgtcatacccatcacactacgtcacaccaaatcacaccagggatgttacatctgtcgcatcacatcacactatgtccaacaccacctcacaccagggacatcacaccatgtcacaccacatcccaccatgtcacaccacatcacaccagggatgtcacactgtgataggacatcacaccatgtcacacgatgtcatgttacatcacagcatgggctgctggggggtgtgcaggggcagccttgctggagagttgagggagggtcctggggctgggcatggtgttcccgcaggagggctgaccctctggaggatgctcggtcccaggtagaaagtgggaggtgggccccgggtggctcagggaggggcccaatttccccaggggaacctggtccaggcgccaggccctgcagggggcagcagctgcaggaagcatctgcttcttcccaactcagcctgctcagtgcacggaatgacccggagcccggcaccgtcctgggtttcctttccttatcctggccaggccgtccatcctcagacagtggactggagcccaccccaccagagcacctggaggcccgtagggccccttgaagggcagagggtggagatctctccagcagggtccctgagggctggcaccttctctggacaaagctctcctgcatctctgggacgccatccttgggcttgggatagagccggtgatgcagcagctgcccgccctgcaccccaggtgctctctccctcaccccccgcggggctgcagcagcgtgtcctgagagttaaagggctgggcttcagcacccagttcaggccaggccccctggagcgcaccctccagtggcgagccttcccacggcatggcagggcctggagtctggggatttagtccccaactctgtgtttggtgaagctccagctgctcgatgccacacaaacgaatccaaccactcctccttcctgggtgagatggtctctctcctgccacaggcaactccgacggcatttcgcagccaccgcagccaccgcagccactgcagtaacaagaccctgtccttgactgagttccagccaggctcctcggagcctctccactcggcctcaaccttggcttgtaaagacttgagcagacactaacagtttctaacagcttctggccgtacccctaggccgacccctgccccgtcaacacctgcctgagaaagctccgtgcaccagaactcaccgtttggaccaaccccgacctccctttctcagggtatctgctgagagggccgcaaccacacgaccttctatccgttcccgatgtctgtgcatttcctgtgacccaggagggtctttctcgggacctgagagccactccctgaagtgtccccattgggaaggatggggcctgtgtctccaggctctgggaggacagaatcctgacctcaacagtggccggcacagacacagcgggtcccatcccggggacgctgaccagcgctgggcaacttttcccttccccgacgactgagccccgagcaccctccctgctccccctaccacctccctttacaaggctgtggcctctgcacagatgaaggtgagtccaggtcatgccggactctttcttctgttgcaatagttatttctgttgaaaatccgtccttgctacatgacctagtgcccagggggatgctgagacaggatgaatgtgttttgcatgtgagaagaacatgaattttgggggccagagtctggactgtgatgggttaaatcgtggcccctacaaattcatatattcaagtcttaatccctggcctcacaatgtgactatttggagatggggtctttacagaggtcattaagttcatagggggtcactaatctaatccgatgtgtgttcttataagaagagaagcttaggacacgggcacacagagggatggccatgtgaggaccagggaggagacggtgtctacaagccaaggagagagggcttgagagaaaccagccctgcctgcatcctgatctcagattcctggtctctaggcctgggaggatccatgtctgctgtgggagccgccccgctgtggtcctgagctgactcacacagatctgacacccacctctcgcttcggaccatggttggttctggaaggccctccctgtggctctgcctgggcagcctgagccagctcccagcctcgacccagctttccctggaggccctgtcccccgcagagtgaccagggcaggcagcaccgtgcccagcaggaggagaaactgcatccatgtagaaaagaggagaaaccccgggggtccatgtagcgacaggggccagggagggtcgctcgggcaatgcgtgtggctgcaggaggcggggggcgtatgcagggagcccccgaggtgcagctggaccagcctcctcctgaccgtgcttcccaccgggggcaggaggcgcgtggacacaggaaggcggctcccatcacgaagtacaagacttaaaaaggatattttattgtcatcacaaaagaaacatcaaagacaattaatgagctttagaaaatttaaaagaagaagaaaagctaccaaagctgaaatggtggcacctccttcgagtgagcccgggagtcctccctgacagctgaggcaggcgctggccgcactcccgctcgagtctccctgtctgcggattctgcgtgacagtcacggaacggcgtgatgggggcagcagagcgtgggggcctctgtccagcactcgtggccagcagccccgctttcacaagaacacgggcaccctctttgtcgtcttgcctctccacctggtgcccccagagtggctgcttgttcctgctgcacgtgacccggggctggacgccagcctctgtgatgagttctggctgtgtccacgctcctggctctcccggtgtccctccacctctctccccgatgctcctgggcctcctctgtcctcaggccccaccaaggctgagtcttgcccgcctgggacctggtcaccagccttctctgggaggcctgtctgggcagatgcccagcccttccttgggctatcctcacccttgcaccgtggggctcctgcagcggccacatggcccaggctcttctccgagtgatctcggtggactggagtgggtggtaggtggcagtgtcctgggcctggccccttctctccccagtgcggactctggggctggctgtccctgcgggtcgagttccacccgagaatccagcagtgtgggcaggcagccaaggggtggtgctggcactgagactgttcccaggagccagagagcagcgttctttgcttgaaatcagaacaacctcattcctcatgtcaggagttcacgggagtgcctggaatggaggctggctggctgcgggctgggaggaaggccgtctgagtgagccttcgcagctctcggaagcctccccaacagggcctgatggtgctgtgacttccctaccttggcgactgatgctcccactcaccatctggaaaccacgcctgtgttcaggaggctggcgtggacagggttggctccagggcgaggtcctgcctgagtgggggcctgggatgctggtcactacctccttttgtgtgagcacctggcgggccggagggcagggacgtcctgctgaggggacacttggcccccagcgccctgcatgcaccaagcagcggaggtctggggtagacctgctatgcacagggtctggaaggggggcgtgtcagggtcagagggcgactgcgaggccagagagccatggggttgagggcggtgaggtcgggggcaggtgtggcctgggtgatggctgagcatggcccacggctcctgtgtggggtctgggcggccctggacaccccacagagggtggccctaggccccctgcctgatcatgttcctgtagtcggggacgatggtctgcttcaggtccaccactgaggagaagatccacttcacctgtaggcaaggcacagcacaggggtgagcgaggccacagccctgcccccaaggcccgcccacccctcaggccacccaggtgccacggcctcaccactgcctgctctgaggcttgaacttggagaacagagccaggtcaccaacagtatgtggacagcacagacgacagcatcagggacaggtggggacagtgtgggggacagtgtcagggacaggtggagacagtgggggagagtgttggggacaggtgaggacagcatggaggaaagtgtgagggacaggggacagcatggggacagtgacagggagaggtggggacagtgtggaggacagcatcagggacaggtggggacagcatgggggagagtgtcagggacaggtggagagagtgtgggggagagtgttggggacaggtgaggacagcttggaggaaagtgttgggacaggtgggggcagcatgggcgacagtgacagggagaggtggggacagtgtggaggacagtgtcggggataggggacaggaggaaactgtgggggacattgttggggatggggggatagcgtgggggacagtgttgggcacaggtcaagacagcgcggaggagagtgtccgggacaggtggggacagcatgggggacagtgtcagggacatgtggggacagcatggggacagtgtgtgacagcatgggggacaatgtcaaggacagctggggacaacgtgcggccaaccttgaagaaggtgatggtggcactgtagcacacgcttagcaggaagagtgtgatgaagatggtgatggtggtccacagcccgtccagctccccgtcctgcgcctccgcacagctctcctccagttgcagctctggacaggaagtgggtggtcaatactgtgtcctgctgggctcgggcctctgggggtgattccctctgtggcaggacccaggatgtagggcccggccgggatgggccaacagtgtcctgaggtcagctccccacagctgcctgccctgggcaccagctttggccccgggactcagccagacacccagccctagatagcgacctggccctcagcaggacccgctccccatctcctgtgtccctccctgaggcccagagggcaggaggatggtgaagcccacacctcatgtgacctcagctgcagggaagggcggcattgggaagtgggccagtgccagggacgcgacgtggcgtgtgttcccctgtgtgtgggggcctgtgtgtgtgtggcggctgcaggggcaccttgtgagaggagggctgggtttgtctgagcaggtcagcatgtggagaagctgccgagcggctcgtgggccttgaggtgccgcgtggggctcgtgggggcctgtgtctgaggagtgttcacgtgtgcgaggaccttgctctggtctgggtgctgtgcggttcgcccgggtgaggctccgtgtgtgaggcgtgcacgtgtgtgtgtggtggccgtgtggccggccaacctcagcgcggggtttgttgaacgggtctgggctgagtgtgtgtgtgggcatctggaccagtccctccacagggcccgagagtgcatgtccccggagtcggttgtgtccccatgcgggtgcgaggctgggcagggcagccaggggttagtgccgtgggggtagatgggtgagggagggcctgtccctacgcacatggactaggcatgcccccgagtgggcatggaggtcggaggacagggcgctcacaggacaggacagtctcctacagaggcaggggctgtgtgtctgtccccaggggctcctagggcttcccgtggcccagcccagggcagctgctgctggagggagggccacgctggcaaatcccccaccctgccgagggcagcccctggctgagccccaccctaggcggcccaggcacacctgcacagcctgggccagtgtggggacagtggaacccgctctgcctccctcatgccactcaggcctcagactcggcctgacccacggaaagaaccatcacagtctcgcaggggcccagggcagcgctgggtgctttatttccatgctgggtgcccgggaagtatgtagacggggtacgtgccaagcatcctcgcgcgaccccgagagcctggggagcgggggcttgccggccgtggcactcatttacccggagacagggagaggctcttctgtgtgtagtggttgtgcagagcctcatgcatcacggagcatgagaagacgttcccctgctgccacctgctcttgtccacggtgagcttgctgtagaggaagaaggagccgtcggagtccagcatgggaggtgtggtcttgtagttgttctccggctgcccattgctctcccactccacggagatgtcgctggggtagaagcctttgaccaggcaggtcaggctgacctggttcttggtcatctcctcccgggatgggggcagggtgtacacctgtggttctcggggctgccctgtagggacagaggttggcacagcggtcactcccagggcagagggtgggccgagccggcctctgtccatgtggccctcataccccgcgggtcccacctttggttttggagatggttttctcgatgggggctgggaggcctttgttggagaccttgcacttgtactccttgccgttcagccagtcctggtgcacgacggtgaggacgctgaccacacggaacgtgctgttgaactgctcctcccgtggctttgtcttggcattatgcacctccacgccgtccacgtaccagttgaactggacctcggggtcttcgtggctcacgtccaccaccacgcacgtgacctcaggggtccgggagatcatgagggtgtccttgggttttggggggaagaggaagactgacggtcctgccacaggtggtgctgaggaagagatggaggtggacgtgtcagcacccagctggggtctgtccctggatgcaggctactctagggcacctgtcccgccttgagctggagggcgaggcctgggctggcttacctgggcacggtgggcactcgacacaacatttgcgctctgcagagagaagattgggagttactcggatctgggaggagagaaggtgtccgagctgagggagtggacagtttggcctttggggtcggcttaggtcaggggcagggtcctcccggatatggcttttggcaggtctgagccaagcacctgcccctgtgtgtgaagggcctggggtaggggcacccagcctgtgcctgcctggagcctggtggaaaaagccagaagaccctctccctgagcatgagtggggcgggcagaggcctccgggtgaggagacagatggggcctgccttgctgccctgggctggggctgcacagccggggtgcgtccaggcaggagggctgagcctggcttccagcagacaccctccctccctgagctggcctctcaccaactgtcttgtccaccttggtgttgctgggcttgtgatctacgttgcaggtgtaggtctgggtgccgaagttgctggagggcacggtcaccacgctgctgagggagtagagtcctgaggactgtaggacagccgggaaggtgtgcacgccgctggtcagagcgcctgagttccacgacaccgtcaccggttcggggaagtagtccttgaccaggcagcccagggccgctgtgctctcggaggtgctcctggagcagggcgccagggggaagaccgatgggcccttggtggaggctgcaagagaggtggtgccatgtgaccgcggtgtgggacagagctgggcccagggcgcagaggcccctcggttcttgtctatctgcgagggtccaggcagggtccagtgtctgggctcacgggcattgggtgtgcacctggctggcgccacctgcgtcaccttagccccctccctgccccaaagccaaagtcaggcccggcctgccccagaaagcttgcaggaccggtggccctgtggtgcccttctgcaggcacccctgcagcctaggaggcggggctcggcagccaggtcagcgctctgtgcctgccgggagtcagcacagtccagggcctctagcttggcctcagctctggccatcggtgccacctcagggacggctcatgcccattggccccactccagccttttatgggtgcctggcttgaccagtggacactgttctcagatggcttctcgtgggtcccccgagtcccctgaagctcctgaccctgccgccccagcgtggccctccgctagtgagtgggcctgacttgcccagggccctggtcatagcctgccctctgccctccaaggcccttttcttctgtgcagcagaggggccagacactgcatagggtcggcgcccttcagccccagggccccggaaccccctgccttggaatagcctcctggagcctcctcctcagcctctcccctcctttccccttagccccagtgtgcagcagcccaggtcagggccctgagtgcctggatgccccctgcctcccagtgtcctgcattacttctggaggctcagtcaccacaacctcaccctcccagccctggcctggccttctcggccaccagcccacctcctccctctctccagagcttcccccggcaaggtccctgctgggctcaacccaggccccccagcacaggtaggagccttgcacctgcccttggccctccccaccctgcgtggtgccaggacccccaggccacagggaggccccatttctctctgccgctggcccagtggccctggagtcccactgcaggtggggtgtgcccctgacctctgaggaggctaagtgccctgccctcagccaggccatcccctctgctcagccccagggccccgctcaccaccccttcccctcacctgcaccacaggctctggctgactctgcccaggccctgaatgggcccctctggcagccctctgctgctacactgccctgcaccacctccactcagcttcattgtgctggtggccctggctcctggcagcccatcttgctccttctggggcgccagcctcagaggccttcctgcctagggtccgctggggccagccctgggaccctcctggtctcaagcacacattccccctgcagccacacctgcccctgcctgagagctcagccccgagccctggaatgccttcccttctccatcccagctcacccttgccaactgctcagtgggatgggctcacactcccttcctggcaccaggaggctgcactgcactttcaccagccctcagctgtctgctgccagcaactacccagctcctgccaaaatctaggagctgagtgatgcctcccaccggccctgctcacctgtggttgccttgccctgagctctagtgcctgtcccctgctcgtcctgcctcccaccggccctgctcacctgtggctgctctgctctgattccctgaggctaagcctcagtcctgctcaccttctgatgctctcctctgtcccctgagctccaggggctgtcccctgctcgtcctgcctcctacctgcccctgcttacctgagggtgctctgccctggtgctctgagctccaggggctgtcccctgctcctcctgcttcctaccagcccctgctcacctgtggctgctctgccctggtcccctgagctccaggggcttccccctgctcttcctgcccccaccagcccctgttcaccttcagatgccctcccctggtcccctgaagtcccagagctgccccctgttcctcctgcctcccaccagcccgtgctcacctgccgctgctctgccctggtcccgagttccaggggctgcaccctgttcgcccacctcccactagccatgctcagctcttgatgctctgtcctggtcccctgagctccaggagctgtcccctactcgtcctgccacccaccagcccctgctcacctgaggcacctgaggctgctctgccctggtcccctgagctccagggtcttccccctgctcatcctgcctcccacctgcccttgttcaccttcagttgctctgccctggtctgctgagctccaggaggtgccccctgctccttctgcccccacctgccctgctcacctgtggctgctcggtcctggtaccctgaactccaatgcctgccccctgctcactctgccctccctcaacccgggcagcaatgtcactcaggtcactgttgcccccctgcctgtcctggcaccctctgtccaggtttgggctgtttttctggcctcatttttgtttttgcagcacttggcttgttccctatgctgtggagcagccccagtgtccagtcaggtctccccaacagagccccttgcccttgcccatgtgcccctcctgggtgagctcccagatcctcccgtccctgcactgctcctgctctggaagcctctccagaacctcagctcctcagtggcctctgctctgctgggtcagctccctgaacgcacggagcctcacccctcccctcgccccaggcctgctgcactctgggcctttctgggcctccctggactcttccctcctcccatctgtgcactcagcacagctctcccctccactccgctgctgaccacagccctgctccccgccagcaggtgccccagcgccatcaggtggctctgagcctagcccctgtgcctcccctgtccctgcctctgcctctgggctccttggcttccaccctcctgtcctgctgccacactcaccctccctgctctgctcccggctcacctgctgtccttggtcctggctgagagagggccccacggccagcactgctgaccctgccctgggctccagtgatgctgctggcctggacaagcccctccgttcacctggggcctctcctcctccctcgttctactgcctcctcagctcaggtgggtcctgcccatgctggcatcaccccacggccggctctgccgcatcccgtcaggttcctcgtgctcccagcctggtcgtcatggaggcctcagtcagcctctggtgtgtcctgccctgttggcttggaagcccctgcccacggtccccgtcatcttgcactgggtgggcgttggtgcctgaaggctgcccacctcccccgtgctggctccgcttgggtctccatgtggggctggccttgcccccacgtctccccagcctcttgtagcctgttcagcagctgaggtccaggagcgcccacggctgcacccaggctctgtccttctcctcccgagcctgtgcccttgccctgtgctgaccctactcaccgaggtgggggtctcagcccttcctgttttggcgcggtacatgtgggcagacttgcccacgccgtcagctgctatttgtcttcctaggaaatcacagctcggccctcaggtccccaggggtgtgaactccacgctgcaaagactaagaacaggattgaaaccggcggcaccgcttacttcctgaagttcccttttcttctggtggtttctgtgtcacagggtaagggggagtccagacacagccgaggctgcctcatgggtgtgtggggatgggggtggtggctgcccccatactcgtgggagaaggtggggagcccggaccttgttcactgctcttttctctgtctctgagtccctggggctggactgatactggcagtgattatgaccattctgcccgtggtctcagcctctcaatacctgggcctctcacctgaagcttctgacccccactgggccctggtggctgctttggcctgggcgtctctccagctggctctcactcatggtgcagggaggggagtgtgagttcatcccgctgagcagctggcaaaggcgagctgggatggagaagggaaggcgttccaaggctcaggtctgagctcacaggcaggggcaggtctggctgcagggagaatgtgtgtgcttgagaccaggagggtcccagggctggccgagtggaccctgcacaggaaggcttctgaggctggtgctccagaaggaacaagatgggctgccaggagccagggccaccagctgtgctcctgggggccgaggggacgtgggacaggtggatgaacacactgaagctgagtggaggtggtgcagggcagtgtagcagcagaggggagccagaggggcccattcagagcctgggcagagttggccagagcctgtggtgcaggtgaggggaaggggtagggggcagggccctggggctgagcagaggggatggcctctgcttagcttagggcacttagcttcctcagaggcgaggggcacacccgagttgcagtggcactccagggccactggactacaagcagagagagaaatggggcctccctggggcctgggggatgctggcatcatgcagggtggggaggtccaagggcaggtgcaagtctcctacctgtgctgggggagcctggactgagatcaggagggaccttgccaggccgaagctctagagagagggaggagctgaggaaggacgaacgtggaagtgggaggtaaggggggatggtatgaggccagagggactgggcagaccaaaagcccgaggaggtgtcgcacaggaagtgtccagaatggaataggaagtgtccggaatggaaaaggaagcatccagcatggaacaggaagcatccagagtggaacaagaaaggtccagcatggaaaaggaagcatccagagtggaatgggaagcgtccagagtggaacaggaagcatccagaatgtaacaggaagcatccagagtggaacaggaaatgtccagcatggaacaggaagcatcaagaatgtaacaggaagcatccagagtggaacaggaaatgtccagcatggaacaggaagcatccagaatgtaacaggaagcatccagagtggaacaggaaatgtccagcatggaacaggaagcatccagaatgtaacaggaagcatccagagtggaacaggaaatgtccagcatggaacaggaagcatcaagaatgtaacaggaagcatccagagtggaacaggaaatgtccagcatggaacaggaagcatccagaatgtaacaggaagcatccagcatggaacaggaagcatccagagtggaacaagaaacgtccagcatggaacaggaagcatccagcatgtaacaggaagcatccagagtggaacaagaaacgtccagcatggaacaggaagcatccagcatggaacaggaagcatccagcatggaacaggaagcatccagagtggaacaagaaatgtccagcatggaacaggaagcatccagagtggaatgggaagcgtccagcgtggaacaggaagcatccagagtggaacaagaaacgtccagcgtggaacaggaagcgtccagcatggaacgggaagcatccagaatgtaacaggaagcatccagcatggaacaggaagcgtccagcctggagcaggaagcgtccagtgtggagcaggaagtgtccagcgcggaacaggaagtgtccagcgtggaaaaggaagcatccagcgtggaacaggaagcatccagagtggaacaagaaacgtccagcgtggaacaggaagcgtccagcatggaacgggaagcatccagaatgtaacgggaagcatccagcatggaacaggaagcgtccagcgtggagcaggaagcgtccagtgtggaacaggaagcatccagagtggaacaggaagcatgcagagtggaacaggaaatgtccagcatggaacaggaagcatccagcatggaacaggaagcatccagcatggaacagggagcatccagagtggaacaggaaatgtccagcatggaacaggaagcatccaggatggaacaggaagcatccagtgtggaacaggaagcatccagagtgtaacaggaaacatccagcgtggaacaggaagcatccagcgtggaacaggaagcatccagcgtggaagaggaagcgtccagcatggaacgggaagcgtccagaatgggcactttgaagggaaatcatgtccctcccactaaatgtgctctccacaaggacccggcctgcccttgtgaccctgctggatccctgagctggcaccagccctgccctcagagagaatgtccaggagacaggtggaggtgcacgtgtgggtccctggggaaatccatcctccagccgcaggctcccagtcggctcccagcctctcgttccagcttcaccccatggagctcataatgggctcaacctcccaggctgggggaggacggagtgaggggccccccactgcccatggcacacccagggggctggggagtctgcactgggctggggcagggaggcctcgtgcagcctgtggggctggcagctcaggacaacactcgtatccgttaactgtggccctggcaacactgcaccccagactgcgtggcttaaacaacagacgtttattccgtcctggttctggaggccgggcatctgggatggaggcctcggtggggctggctcctctgtgtcatgggagactctgtcccaggctctctccttgctgctgggctttgccggccgtctctggtgctcttggcttatggaagcagcaccatcttcacagggcgttctccccacgtgctgtctgtgcccagattcccccttttcatgaggacagcagtcatattggatcagaggcttgccctactccagggtgacctcatctgaacttgattgcagctgcaaagactgtttccagacaaggtcacattctgcggtcctgggggttaggacttcaacacatgaatttataggggacacattttaacccatgacagtttgccctccgttccccccataatcatgtccttctcacacgcaaaatccctgcatcccatagcaacatctccaagatggctaaccccttccagcaccaactcttagtccacaatgtcagagaaacatcatctgcatcaagtgtgagagaaacccagggtgagattaggagagaaaccacagcggggtggcgagcctcctgccccctccggcccaggtgaggccgtgtgcactgtgtgggtgtgcctggggctccacttgcccctcccatgtacctgctcattttccccaggctgtgggcatttggggcaggggcctcagtgcctggtcggctctctcccggttctatccaatgccccaagcttgctgggctggaggggccgggcagcgtgggcccccaggaaggaggatggcttcccagctggggctccatctctggcctctgccagccttgagatctccggtcatctgtgtctccctcctggggcccagcaggcctgctcagctctgagccccatgtccgttctcaccctgctctgcttttccttggggtgctggccctgccctggcctccacaaatggcccctgcccccaccccttcctgtctgaggggctgggctgttcctctcctgcccggcgtgtgcccacctaggcccaataggcatagtgcccccagcccctcctgccctcttctggccttcacgcccagccatgccggcagcccgcctcagtggcctgggccttcaccagctcctggctctgtgtccagctgccactcctgtggccctacggtgctgcccctttccctcagtgatgggggctgggcttcctgggaacgggctgtgtctcagctgcacacacctgtgtgtgtcagtgtgcgcatgggagtgcgtgtgtgtgctgggggtgtgtgcaggaatgcttgtgtctgggggcagggggagcatctgccttcctgccccaggcctggaatggccgtgccagggtgggtgggagcagtgcgtgcgaggacagtgctgctttgacgtctgcgtgtggctggtgtgggcgggaggacgtggtgtggcacgagtctcgggctccccatctccatccagctgatcccggatggctgcgctcctgagggtttagagcagcccagggggtcaggaggctgttgggacgctggaggcaagcgctggcagggatgggggtgggctggccaggcagcgtggccagggggcttcgagccggggcagtgaaccatcccccaactttttaaagttttaaaagtcatatttactcaagtgtagtttacattcagtataatccatcctgtgacatgtaagtttcaacaaatgcacagtcatgcaaccaccaccgtaatccagatgaacagttgcaagaagatgtagaatctctccaaaaattccaccaggcccctttgcaatcaacgcctccctgatggctaggaatccattgatctgcattctgtcagaagactcagagttcatcattaaaatgatctattatggaaaatattataagcatacaaaacacaaaaccaagttttaaaaagtgaggtatttcttaaaagtttagtatacaaacaaaatgaaggtaccttcacattttactacagatgtgcagatagttttcttggtgcacagagataaggcagaattaagtcagaataaacgttctaaaactgacctccggaagaactagtcttagtcatttctttgcagagtatgtgaaccaagattcgggtttggtctttggtgttagcactgtgtcaaggatcagatagaaagtacaaatggaggggcccctttctgaggccaggccccactgtcggggcatgtggggtgaccaaaggccaataccagctgaggctaagaggctgctctcagaaaggtaggtttgcaggtgtctcttgaaccctttgttcagaaccgggacgtgtggctgggcagcagccttcagaatccccacaggctggtgcccggtgcccacagccctctcgggttgtcaggaccctgcacccgtggtggggtgctgggctccagagttccctgggaccagctgatctcttgtccttggttttggcccaaatgcaagcccctggtctcctccaagtaacttcctttccccagggctgtccaggccccaccgctgcctgttccttcccagggcctcccgcaagtcccgatgctgacgcctctctgcccacctagtttgtggccgccgcctccagctctgtgtctgcctcccagcgagggagccgtggttgatgatctcgtgagtgtctgcccttctgaaggtacagtgtgaagtctcatcagtctcacttcaatgcctaagcacctcttcagaaaccagggattcatccaggtttctccatctttaaccatgttttctaaaagttttcttggcaatttcctggcaatttgcaagacaggattttttggttgccaacttccaattagctttaaacttgccacgatctcccaggtcatcccgtccatcgatgatgcttattacattcttcctgatttccatgtggccaaattcaatagttatttaccccaggcttgtattttggaggctaaagaactctgttaccagctatatccgtgctgtggctgccgtaacaaaatatcacaaatgtggcttaaaacaacaaaaattttttcagagttctgggagtcaggaatctgagatcaaggtgttggtggctgtctctgagtgctccaggggaggaccgtccacctcttccagcttcctgtggtgcaatagtttggatgtgtgtctctccaaatttcatgttgagatgtgattcccagtgttggaggtgggcctggtgggaggtgattagatcatggggctggacccctcatgaatggcctagcaccatctcccaggtgatgagtgagttctccctcagttagtccctgtgacagctggttgtttaaaagtctaggacgtgccacttctcttctcttgctccctcttgccatgtgacatgcctgctcccccttcgccttctgccgtgattgcaatctccctgaggcctcgccagaagcagatgccagggccgtgtttccggaatggctgcagaactgtgagctagttaatcctcccttccttgccacagtgcctggtgcaaacctcttttctttataaattaccagattcatgttttttttttttttctagtaacacaaatagactaactcagaacattggtattgaggagtggaacattgctataaggatacctgaaaatgtggaagcagctttggaatcaggtaacaggcagagaggttagaagaatttggaggactcagaagaagacaggaagatgagggaaagtttggaatttcttagagactattaaatggttgtcaccaaaatgctgatagacatatggactgtgaaagccaggctgatgaaatctcagatggaaatgagaaacttattgggaactggtgtaaaggtcacgcttgttaaatcctaagaaacaacttggctgcattgtgttcatgccctagggatctgtggaaggttgaccttaagagtgatgacttagggcatctgtggaagacatttctaagcagatgtttctaaggtgtgacctggttgcttctaacagtctatggtaagatatgggagcaaagaaatgacttaaagttggaacttatatttaaaaggtgtaaacgacaaaataaaatgctaatccaaggggattccaaagaaacctggaaaaccagttcaggccatgacaggaaggggagggtggtttggactccctcactataccctctccctgttggagcttaggctcagctgaccagtgttaacattaaaacagggagcttaagactgacaaagcagactctttgtagcaataagatatcaaatcccaacctgattctggtatagcatcacatgacaggtggcaggcatggaaggaaattaaagtattttatgccagaatatatttctctgacacattttggaagggccctgcaaagccgtctcttgtggaggaaatgtatattctgttgagaatctttttccctttccaggtctcttcctgattcaggagagatttatccaagagtctggcaccttttaggttctgataagagacattgaccatctcttctctctggaacgtggaggcttcatctacataacaagaaacttggcttccacaacccccttatcttaagcattgctttttgctgacttcaactttttagataatttaactttttcagccaattgccaatcagaaaatcttcaaatccacctatgatttggaattccccactttgaattgtcctgcttttccaaaccaaaccaaaccaatgtatactttacatgtattgattgatatgtctccctaaaacataaaagcaggccgcaacccaaccaccttgcacaggtgttctcaggaccttttgaggctgtgccacagttcatggctctcacatgtggctcagaatcaatctcgtcaagtgttttatggagtttggcttttttcatcaacaaagggaagcagagcataaaaaatgtggaaaattcacagcctggccatgtggtagaaaagaaaaggtattttcaggagacaaatataagtaggctatggagcagccagttgctagagagattagcataactaaaagggagctaagtgctcatatccagaacaaagggaaaaaggccttgaaggcctttcggaaatctctgaggtggtctttcccataacaggcccagaggccaagagggaaaggatggttttgtgggccatgcccatggccactgctgcctgtgcagccttgggacactgctctccacatcctggttcctctggctccagccttggctcaaagggccccaagtacagcttaggctgcttctttggagagtgcaagccactataagccttgggaacttccatctggtgttaagcctgtaggcccccagaatgcaagagtgaaggaggcttggcatcttcactctagatttcagaaatgtatgagaaaccctaggtgcccagagagaagcctcctgccagcatggagccctcacagagaacctctactagagcagtgccaaagagaatgtggggttgaacccccatataatgtccccaccagggcactgcctagtggagctgtgggaagggggccactgtcctccagaccccagaatggtagatccactggcagtttgcaccctgaatctggaaaagccacaggcactcaactctatcgtgtgagagaagccacaggggctacatcctccaaagccacaggggtagagttgtccaaggctttgggagcccaccccctgcaccagtgtgccctggatatgggacatgaagtcaaaggagattaccttggagctttaagatttaataactgccctgctggatttctgacgtgtatggggcatgtagatcctttctttttgccaacttctcccttgtggaatgggaatgtttacccaatgtctgcactctcattgtattttgggagtcaatttgtctttgatttcctaggctgataggtggaagggactcatcttcagatgagacttgggacttgggaattttttgttgattctggaatgaggtaagactttgggggactgttgagaaggcatgattgtattttgcaacatgagaaggacatgagatttgggggaccaggggtggaaggatatggtttatatatttgtcccctccaaatctcatgttgtaatatgattcccagtgttggaagtggggccactaggaggtgattagatcaagggggcagatccctcatgaatgattgagcatcttccccttggtgatgagtgaattctcccccagtcagctcacacacagtctagttgtttaagtctgggccccccctcagcctcttgctcccattcttgccatgtggcatacctgctctcccttcaccttctgctatgattgtaagtttcctgaggtcctcgccagaagcagatgctgatgccatgcttcctataaagcctgcagaactgtgagctaattcaatctctttcctttataagttacccagcctcatgtatttctttacagtaatgcaaagggacaaacacaggtggctcctgacacacccctcatcttctcctttgtcatcatctggctacttccatgtgtgtctgtgtcctctcctctcatgaggacaccagtctttggatttgggacccatcgaaaatttagtatgatatcatctcaagtccttaaactaatttgtaaagaccctatttctaaatatggtcacattctgaggttccaggtgggcatacatttggccagggagatgccatcaacccagcacaccagcctacgcaggtacatttgcatatagcttagggttgacctttcccatggaagtattacatccccctctggactccagtttcacatgttttagaatgcttcgccttgtccagcaggatgagtctcttttcatttttagtatttttctctctcttctttgcattagattaaaaataattgacatagtctattgatgcatctttaagttttcagttccttctcatgtctgctccattctgttatgaaacttgagtaatgtttttctatttcttttcttttttaataaaatagagatgggatttctccatgttgcccaggctggtctcaaactcctgggatcaagtgatccttccttcttggcctcccaaagtgctaggataacaggcatgggccactgtgcctggccaaatgatgtttttcatttcagaatcatacttttagttctagaattttcatttggttcttgttaatattttccctttcttacagagattccccatctagtcactcattataaccatattgtcctttaagtctttgaacatatttaacatgacttctttaaagtccttgtgtgaaaactgggtctgcatctaggtcatcttggagttgatctccattgatccctttttcttctgactatggatcacattttcatgtttctttgcatatatggtaattttggatgtgcacctgatgttgttgataacatgtggtacaggctatgggttttgcgttcttccttggcagggcattgattgtttttttcaatgttaggaaacagcttgagttgactcaaactcccaagtctgtctgcctggcagttggcagtagctggaatctcagttctctcgaccttacaggtgctgctttctgctgggccctttggagttttccctacccatgcacacctaagggatcggccagaggtttcagtggagtttacttgcagattgtggggtttccctttggtgaccttctcctttatggacatcttctcttcatttccagctgctctgaaaatgcagccctgcatcccactcctcaccaggagggctgcagtttcctgcttgaactctagctgcacccattacatgccctggggtgtgacttcagaccaatatttccgggaataatccttactagtgtttgcctacttctggtcatgttccagtgcctgcaattggtgtgtgtgggtgttgtgtgtgcttacagcttttccagtgtttataattgccatctgccaaagggctagtctgatattagctgctccagcattactggaatcagaactactttctctcatgtggtttttcattttcatttccctgttgactagtgtggttcaacaccttttcatatgtttagcggctatttggatatcttctgtaaaacatctgttcaattcttttgcctattccttgttgaattatttgattttttttctcgttggtttacaggggtcttctttatattatggatctgtttgtgtcagtcagttatatatgtttataggaaacattgagaaaaacaaaagattagtaggtgccttccatggaaagcaaggcatcgtcttgtaccctcttccaggttatttcattctattgagctctgcatcttttatttcctttgacctattttacacctctataagccaggggttcccttcatcacaccatatcacactatgtcacaccagggatgtcacaccacatcacactatgtaactcctcatcacactggggatgtcgtaccaggtcacaccccatcatgccacatcacactgtgtcacaccgcatcacatcacaccaagtatgtgacaccctgacacagcacatcagacatcacatcatgtcacaccacacttcatcacaccccaccccaccagagttgtcacaccccatcacaccacatcacattacgtcacgccatgtcaaactacatcataccccattaccccagggatgttatgccacatcacattatgtcacaccacaatacaccacatcaaattgtgtcacaccacatcacaccccatcacaccagggatgttatgccacatcaccttatgtcatgccacatcacaccacatcacaccccatcacaccgtggatgtcacccgtcatcacaccacttcacataatgccacacaacatcacaccccatcacaccaggggcgtcacgccccatcagaacacgtcacattatgccaaaccacatcacatcatgtcacaccacaccacaccacactatgtcacagcctgttacacttcatcacaccacatcacactagggatgtcacaccttgtcccattacatcacatcatgtcacaccattccacatcaaaccatattatgccccatcataccagggatgtcataccatataatactatgtcacactgcatcacaccagggatgtaacaccacatcacaccatgtccaaccttgtagcccaacaccacatcacagaagggacattacaccatgtcataccacatcacaccatgcaactcctcatcacatgagggaggtcgaaccctgtcacaccccatcatgccacatcacaccatgtcacactgcattacatcacaccaacgatgtgacactctgtcacaccacatcacacatgtcacaccagagatgtcacactccatcacatcacatcacatcacacccgttaaatgatatcataccccatcacaccagggatgtcacaccgcatcacatcaggtcatatcacatcacactacgtcacaccacatcacaccaggggtgtcacactctgtcacaggatgtcccaccatgtcacaccataccacatcacaccatatcatatcctatcatactagggatgtcatgccccatcccactatgtcacaccacatcacaccatgtccaaccatgtcacatcacatcacaccacatcacaccatgtcacaccagggatgtcacactctgtcataccacatcacaccatgtcctgtcacatcacacattacaccctggcacaccatggatatcacaccacatcacaccatgtcatgttacatcacagcatggactgctagggggtgcgtggaggcagccttgctggagagttgagggagggtcctggggctgggcgtggtgttcctgcaggaggactggccctctggaggatgctcggttccaggtggaaagggggaggtggggcctgggtgcttcagggaggggccatccttgggcttgggatagagccggtgatgcagctgctgcccgccctgcaccccaggtgctctctccctcaccccccgcggggctgcagcagcgtgtcctgagagttaaagggctgggcttcagcacccagttcaggccaggcaccctgaagcccaccctccagcggcgagccctcccacggcacagcagggtccgggctctggggatttcacccccaactctggtgcagctccagctgctcgatgccacacaaacgaatccaaccactcctccttcctgggtgagatggtctctctcctgccacaggcaactccgacggcattttccagccaccgcagccaccgcagccactgcagtaacaagaccctgtccttgactgagttccagccaggctcctcggagcctctccactcggcctcaaccttggcttgtaaagacttgagcagacactaacagtttctaacagcttctggccgtacccctaggccgacccctgccccgtcaacacctgcctgagaaagctccgtgcaccagaactcaccgtttggaccaaccccgacctccctttctcagggtatctgctgagagggccgcaaccacacgaccttctatccgttcccgatgtctgtgcatttcctgtgacccaggagggtctttctcaagacttgagagccgctccctgaagtgtccccattgggaaggatggggcctgtgtctccaggctctgggaggacagaatcctgacctcaacagtggccggcacggacacagcgggtcccatcccggggacgctgaccagcgctgggcaacttttcccttccccgaagactgagccccgagcaccctccctgctccccctaccacctccctttacaaggctgtggcctctgcacagatgaaggtgagtccaggtcatgccggactctttcttctgttgcaatagttatttctgttgaaaatctgtccttgctacatgacctagtgcccagggggatgctgagacaggatgaatgtattctgcatgtgagaagaacatgaattttggggcccagagtctggactgtgatgggttaaattgtggcccctacaaattcatatattcaagtcttaatccctggcctcacaatgtgactatttggagatggggtctttacagaggtcattaagttcatagggggtcactaatctaatccgatgtgtgttctaagaagagaagcttaggacacgggcacacagagggatggccacgtgaggaccagggaggagacggtgtctacaagccaaggagagagggcttgagagaaaccagccctgcctgcatcctgatctcagattcctggtctctaggcctgggaggatccatgtctgccgtgggagccgccccgctgtggtcctgagctgactcacacagatctgacacccacctctcgcttcggaccatggttggttctggaaggccctccctgtggctctgcctggccagcctgagccagctcccagcctcgacccagctttccctggaggccctgtcccccgcagagtgaccagggcaggcagcaccgtgcccagcaggaggagaaactgcatccatgtagaaaagaggagaagccccgggggtccatgtagcgacaggggccagggagggtcgctcgggcaatgcgtgtggctgcaggaggcggggggcgtgtgcagggagcccccgaggtgcagctggaccagcctcctcctgaccgtgtttcccaccgggggcaggaggcacgtggacacaggaaggcggctcccatcacgaagtacaagacttaaaaaggatattttattgtcatcacaaaagaaacatcaaagacaattaatgaactttagaaaatttaaaagaagaaaagctaccaaagctgaaatggtggcacctccttcgagtgagcccgggagtcctccctgacggctgaggcaggcgctggccgcactcccgctcgagtctcccttcctgtctgcggattctgcgtgacagtcacggaacggcgtgatgggggcagcagagcgtgggggcctctgtccagcactcgtggccagcagccctgctttcgcaagaacacgggcaccctctttggcgtcttgcctctccacctggtgcccccagagtggctgcttgttcctgctgcacgtgacccgggactggacgccagcctctgtgatgagttctggctgtgtccacgctcctggctctcccggtgtccctccacctctctccccgatgctcctgggcctcctctgtcctcaggccccaccaaggctgagtcttgcccgcctgggacctggtcaccagccttctctgggaggcctgtctgggcagatgcccagcccttccttgggctatcctcacccttgcactgtggggctcctgcagcggccacatggcccaggctcttctctgagtgatctcggtggactggagtgggtgggaggtggcagtgtcctgggcctggccccttctctccccagtgcggactctggggctggctgtccctgcgggtcgagttccacccgagaatccagcagtgtgggcaggcagccaaggggtggtgctggcaccgagactgttctcaggagccagagagcagcgttctttgcttgaaatcagaacaacctcattcctcatgtcaggagttcacgggagtgcccggaatggaggctggctggctgcgggctgggaggaaggccgtctgagtgagccttcgcagctcttggaagcctccccaacagggcctgatggtgctgtggcttccctaccttggcggctgattttcccactcaccaactggaaaccacgcctgtgttcaggaggctggtgtggacggggttggctccagggcgaggtcctgcctgggtgggggcctgggatgccggtcactgactccttttgtgtgagcacctggtggtctggagggcagggacgtcctgctgaggggacacctggcccccagcgccctgcatgcatcaagcagcggaggtctggggtagacctgctatgcacagggtctggaaggggggcgtgtcaggggtcagaaggtgacttcgaggccagagagccatggggttcagggcggtgaggtcgggggcaggtgtggcctgggtggtggctgagcatggcccacggctcgtgtgtggggtctgggcggccctggacaccccgcagagggtggccctaggccccctgcccgatcatgttcctgtagtcggggacgatggtctgcttcaggtccaccaccgaggagaagatccacttcacctgtaggcaaggcacagcacaggggtgagcgaggccacagccctgtccccgagccccacccacccctcagggcactgagggccacatctcttcccccaaggtccacccacccctcatgccacccaggccacagccctgcccctgaggcccatccgcccttcagtccacccaggtgccagggcctcaccactgcctgctctgaggcctggacatggagagcagagccagggcaccaacagcatgtgggcagtacagaagacagcgtcagggacaggtggagacagtgtgggggatagtgttggggacaggtggggacagagtgggggacagtgtcagggacaggaggagacagagtggtggacagtgttggggacaggaggaaacagtgtgggggacatttttggggacaggaggggacagtgtgggggacagtgttggggacaggtggggaaagcatggtgtacagtgttggggactggtggggacagcgtgggggaaagtgttggggacaggaggggacagcgtgggggacagtgttagggagaggtgggaacagtgtaggggacagtgtcagggggaggtggggacagcgtgggggacagtgtcagggaaaggtggggacagtgtgggggacagtgtcagggagaggggacagtgtgggggacagcgtcagggagaggtggggacagcatgggggacagtgtcagggagaggtgcggacagcatggacagtgtcgggacaggtggggacagtgtgaggacattgttgggacaggtggggacagtgtgggggacagtgtcggggacaggtgggaacagcgtgggggacagtgtcagggacaggtggggacagcattggggagagtgtcagggacagatggggacagtgtgggggacagcatcagggacaggtggggacagcatgggggacagtgtcaaggacaggtggggacagcatggggtacagtgtcggagatgggtggggacagcatgagagacagtgtcggggacagtgtcagggacaggtggggacagcatgtgggacagtgggacaggtggggacagcatgggggacagtgtcagggacaggaggagacagcatgggggacagtgttgcatacaggaggggaaagcatggggacagtgtcagggactgtaggggacagagtgggggacagtgtcagagacaggaggagacagcatggggacagtgttggggacaggaggggacagcgtgggggacagtgtcggggacaggtggggacagtatgggggacagtgtcggggacaggtggtgacagcgtgggggacagtgtcagggacaggaggagacaggagaagacagcatgggggacagtgtgaggtacaggaggaaactgtgggggacattgttggggacaggaggggacagcgtgggggacagtgtcagggataggaggagacgagaagacagtgtaggggacagtgtcgggacaggaggggacaggaggaaacagcatgggggacattcagggacaggaggggactgtgggggacagtgttggggacaggtggggatagcatggggtacagtgttggggactggtggggacagtgtggggaatagtgtccgggacaggtggggatagtgtgggggacagcgtcagggacaggtggggatagtgtgggggacagcgtcagggacaggtggggatagtgtgggggacactgtcagtgacagtttgtgacagcacaggggacagtgtcagggacagggaacgtgtgggggacagtgtcagggacagtttgtgacagtgtgggggacagtgtcagggacaggtgggtgcagcattggggatagtgtcaggcacatgtggagacagtctgggggacactgttggacaggtgggtacagcgttggggagtgtcagggacaggtggcgacagcgttggggatagtgtcagggacatgtggagacagtctgggggacactgttggacaggtgggtacagagtgagggacagtttgtgagagcgtgggggacagcgtcagggacaggtggggacagcctggggacagtgtcagggacagtgtgtgacagcatgggggcaatgtcaaggacagctggggacaacgtgcggccgaccttgaagaaggtgacggtggcactgtagcacacgcttagcaggaagagtgtgatgaagatggtgatggtcgtccacagcccgtccagctccccgtcctgcgcctccgcacagctctcctccagttgcagctctggacaggaagggggtggtcagtgctgtgtccccctgggcttgggcctctgggggtgattccctctgtggcggggcctaggatgtagggcccggcctcgatggcccaacagtgtcctgaggtcagctcccggaagctgtccatcctgggcaccggctttggccctggggctcagccagacacccggccctaaatagcgacctggccctcagcaggacccgctccccgtctcccgtgtccctccctgagccccagagggcaggagatatgaagcccacccctcatgtgaccccaggagcagggaagggctgtattgggaagtgggccagggccagggacgtgacgtggtgtgtgatcccctgtgtgtgtgtggcggctgcaggggcactttgtgagaggaggactgggtttgtctgagctggtcagcaagtggagaagctgccgagaggctcgtgggccttgaggtgccgcatggggcttgtaggggcctgtgtccgaggagtgttcacgtgtgcgaggaccttgctctggtctgggtgctgtgcagttcgcccgggtgaggctccgtgtgtgaggcgtgcacgtgtgtgtgtggtggccgtgtggccggccaacctcagtgcggggtttgttgaacgggtctgggctgagtgtgtgtgtgggcatctggaccagtccctccatagggcccgagagtgcatgtccccggagtcggttgtgtccccatgcgggtgcgaggctgggcagggctgccaggggttagtgccgtgggggtagatgggtgagggagggcctgtccctacgcacatggactaggcatgcccccgagtgggcatggggggtcggaggacagggcgctcacagaacaggacagtctcctacagaggcaggggctgtgtgtctgtccccaggggctcctagggcttctcgtggctcagcccagggcaggtgctgctggagggagggccacgctggcaaatcccccaccctgccgagggcagcccctggctgagccccaccctaggcggcccaggcacacctgcacagcctgggccagtgtggggacagtgggacccgctctgcctccctcatgccactcaggcctcagactcggcctgacccgtggaaagaaccatcacagtctcgcaggggcccagggcagtggtgggtgctttatttccatgctgggtgcctgggaagtatgtagacggggtacgtgccaagcatcctcgtgcgaccgcgagagcccggggagcgggggcttgccggccgtcgcactcatttaccccggggacagggagaggctcttctgcgtgtagtggttctgcagaccctcatgcatcacggagcatgagaagacgttcccctgctgccacctgctcttgtccacggtgagcttgctatagaggaagaaggagccgttggagtccagcatgggaggcgtggtcttgtagttgttctccggctgcccattgctctcccactccacggcgatgtcgctggggtagaagcctttgaccaggcaggtcagggtgacctggttcttggtcatcttctgggatgggggcagggtgtacacctgtggttctcggggctgccctgtagggacagaggttggtacagcggtcactcccagggcagagggtgggccaagccggcctctgtccacgtggccttcgcgctccgtgggtcccacctttggttttggagatggttttctcgatgggggctgggaggcctttgttggagaccttgcacttgtactccttgccgttcagccagttctggtgcacgacggtgaggacgctgaccacatggtacgtgctgttgtactgctcctcccacggctttgtcttggcattatgcacctccacgccgtccacgtaccagttgaacttgacctcagggtcttcgtggctcacgtccaccaccacgcacgtgacctcaggggtccgggagatcatgagggtatccttgggttttggggggaagaggaagactgacggtccccccaggggttcagttgctgaggaagagatggaggcggacgtgtcagcacccggttggggcctgtccctggacgcaggctactctagggcacctgtcccgccttgagctggagggcgaggcctgggctggcttacttgcacatggtgggcatgtgtgagttgtgtcacaacatggggttttgggctctgcagagagaagattgggagttactcagatctgggaggagaggtgtctgagctgagggagtggagatcttggcctttggggtgggcttaggtcaggggcagggtcttcccggatatggctcttggccagtctaagtgcagcacctgcccctttgtgcgcagggcctggggtaggggcttccagcctgtggctgcctggagcctggtggaaaaagccagaagaccctctccctgagcatgagtggggcgggcagaggcctccgggtgaggagacagatggggcctgccttgctgccctggactggggctgcacagccggggtacgtccaggcaagagggctgagcctggcttccagcagacaccctccctccctgtgctggcctctcaccaactgtcttgtccaccttggtgttgctgggcttgtgatctacgttgcaggtgtaggtctgggtgcccaagctgctggagggcacggtcaccacgctgctgagggagtagagtcctgaggactgtaggacagccgggaaggtgtgcacgcttctggtcagggcccctgagttccacgacaccgtcaccggttcggggaagtagtccttgaccaggcagcccagggccgctgtgccctcagagacgctcctggaggagggcaccagggggaagaccgatgggcccttggtggaggctgcaagagaggtggtgccatgtgaccgcggtgtgggacagagctgggcccagggtgcagaggcccctcggttcttgtctatccgcgagggtccaggcagggtccagtgtctgggctcacgggcattgagtgtgcacctggctggtgccacctgcctcaccttagccccctccctgccccaaagccaaagtcaggcccggcctgccccagaaagcttgcaggactggtggccctgtggtgcccttctgcaggcacccctgcagcctagggggcggggctcggcagccaggtcagtgctttgtctcaaaaaaaacaaaaacaaaaacaaaaaacaaaacaaaacaaaaaacaaacaaataaaaagttgtaaaaggattgtggaaaagggatcttatgtggtcaaaggcggctgtgattggatttatttatttatttttttgagacagagtttcactcttgttgcctaagctggagtgcaatggtgtgatctcggttcactgcaacctctgcctcttgggttcaagcgattctcctgcctcagcctccagagtagctgggattacaggtgcccaccaccacgcccagctaatttttatagttttagtagagacaggggtttcaccacgttggccaggctggtctcgaactcctgacctcatgatccacccgcctaggcctcccaaagtgttgggattacaggcatgagccactgcacctggccggatttatttatttatttatttttgagacagggtcccactgtgttgcctaggcagcagtgcagtggcactcagcactgaggctgagggaggttgaggtgggagggctcaagcaatcctcccacctcagcctcccaagtagctgggactacgggcacgtgccaccatgcctggccaattttttttttgtattttttgtagagacagggcttccccatgttgcccaggctgatctcaaactcctgggcttaagtgatccaccctcctggaatgctgggactacaggtgtaagccaccttgcccagcctggatggaattatttataaggtttaattaaaattagctttaatattaacagttcatgtgaaactagaatttggtcttctctgttaaagtgacagttttctggaatattggtctgctcttcattatggcaggtttttcttttttttttttcaccttgaaaaatatatatttacaggaacaattccccattctctgggactctttagaaaaaaaaaaggtccattttggggaagcaaaacagtggagacgagtgtagcaccgtcccccaaatcaccaacccccaggtcccaaggcctgggctgggccagggctgacagggaagcccaggagtcttttgaacccactcttcctgcctagaatagagacaggacaggctttatgtcccccattcctccctcccacctccagggacattgaaagtgtcctttgtacctacctgtaggaaattggggggctgggagggagggaactgaaaatacacatttgttatcaaaaataaacatctgggggggaggcggcaggaagattccctcccaaatccctttcttcacacccaccccaccaaatataggaagagatgactccctctcccctattgaaaagccccatttaaaaatagattatactatcaaaatggcagcacgggagagacagggagacctggagtactggctggaggggcccccccagacaggaaccacccccacaaaacccctccatgggaggaaacaggcaggaccccagggagtttggcagacaaaggaatggcttctcagggggaagaagaacaaagggacattcctccctggccaaaaagttggttaaaaaaggataagctgtctgagagaaaggttggggaggtggaaatttctattccaagggtgtgattctgccttggccaagactcccaacccattaaatggtacaaattcttcctggaccccgagtatggccaggaataataaaacgaaactaacttctactcacatcctaaaatggacacagggctccctcatctccccacgggcaggccgaggaatgaagaaagaaaggtcgttctcaagtcagaccccgattgtcctgtcttggggaaaaaagcggggaggtgggggagacgtcctgaccaccctaataggttaggtcaggcgcttcccagtggccttcaaaaaataaataaataaaccgcccctaccattgaagtaggagacgtgtcagggcagccactgggggacggacagaaaagagagaaaagagagaagctgtggaagctgagtgttttctgtggaggagttaatgagagtcactcctgggagaaatccttcccaaggatccccaccccaccacaatcagagcatgagtctttcagttgaactgtgtttctccttgagagagcacggatggagggaccccagaaggggtggtggtgctggtggtggtcatggcctctgcggccctggcgagagcaccgcgggggtcgagaggccagccacgccgatggaagggatgtgcacctgggcgccgccactggacggaagctggcaggagagcttggccgggctgcggggcgcagcgggactcaggctgctccggaagtgaacgctgggaggcagcgagctgggtgtcagcagcgccggggtcaacgtgtgcgtaggaagcagggacagggtcagcgccggcctcggcgcctggaggccggagccagttcccgatcctggggtccgttcgggtcccggcgcacctagcaggctcgggctgagtggaagctctaggtcccggggcttccggcccttctgcggctgggagatctgagggctggaagccgcgtggccgcccgcctgccctgcggtgtccataaggacctcggcagccacgctggcacgccctcctgtggagggacttcaggctcggccttggcggtttctggcacgaaccctctctcccccgcgaattccagctcttcctcgggcccttccacttccacttccgggggcaaagggcggcgcaagcccggctccacattcggctcttccagtttcgggtttggggcctcgggcggggtcaggatgacctgcagagggaagccggcttcctcagcctccaggcaggcctcccaggggcttggactgcaggagctgcgttggggagcaccgctgcaggccgaggctgagggggtggctgcggctgcagagactggatggtgaaggtggaacagaggcccgagcgcatgtacttgttccggctgttgcgcgccaaaccgccagggcctgccattcctgcacccttgggtgtgcctggctttcctgaggcagtgccccctggggcggcatgtgcagcagcaggggccacaactgccatggtgaagtaaccgacacctctgggtggggcgggcagtcctcactcagtggagcaccctgcgacctcaggataggacacaaacttgtagacttaatgccatgtcaaatttgttctctatcttgagcggggatccagaatcgaatagtaaaagaacattaactccagaggccacgaaagaaattgaattagttgaagaaaaaattcagccagcacaagtaaatagaatagaccacttagccccactccgacttttgatttttgctactgcacattctccaacaggcatcattgttcaaaacacagatcttgtggagtggtccttccttcctcacagtacgattaagacttttacattgcacttggatcaaacggctacattaattagtcaggcaaaattacgaataataaaattgtgtggaattgacccagataaaatcattgttcctgtaaacaaggaacaggttagacaagcctttataaattctggtgcatggcagatgggtcttgctgattttgtgggaattattgataatcattaccccaaaacgaaaatcttccagtttttaaaattgactacttggattttacctaaaattaccagacagaaacctttaaaaaaatgctctgacggtgtttactgatggttctagcaatggaaaagtggcttacactgggccaaaagaacgagtcactgaaactcaatatcactcagctcaaagagcagagttggttgctgtcatttcagtgttataagattttaatcagcctattagcattgtatcagattctgcatatgtagtacagggtacaaaggatgttgagacagccctaattaaatatagcatggatgatcagttaaaccagctgtttaatttgttacaacaaactgtgagaaaaagaaatttcccattttatattactcaattcgagcgcatactaatttaccagggcctttaactaaagcaaatgaacaagctgacttgctagtgtcatctgccttcatggaagcacaagaacttcatgcctcaactcatgtaaatgcaacaggactaaaaaataaatttggtatcacatggaaacaggcaaaaaatattgtacagcattgcacctagtgtcaagtcctacacctgcccactcaggaggcagaagttaatcccagaggtctatgtcctaatgcgttatggcaaacggatgtcacacctgtaccttcatttggaaaattatcatttgtccatgtgacagttgatacttattcacattttgtatgggcaacctgccagacaggagaaagtacttcccatgttaaaagacatttattgtcttgttttgctgtcatgggagttccagaaaaaattagataatgggccaggatactgtagtaaaacatttcaaaaattcttaaatcagtggaaaattacacatacaacaggaatcctgtataattcccaaggacaggccataattgaaagaactaatagaacactcaaaatctcaactggtgaaacaaaaagaagaaaaagacaggagtataacgctccccagatgcaacttaacctagcaatctatactttaaattgtttaaacatttatagaaatcagaccactacttctgcagaacaacattttactggcaaaaagagcagcccacatgaaggaaaactgatgtggtggaaagacaacaaaaacaagacatgggaaatagggaaggtgataacatgggggagaagttttgcttgtatttccccaggaaaaaaccagcttccaatttagtatctacaacttacagaagaagttgccatccaccaaggaagcaaagccactgacctggggccaaatacaggagctgacacagttagctaagaaaagcctgaaaaaaacaaagtctacaggtatatcccgcagctctgaagagacagcgaccagcgagaaggggccataatgacgatggcggttttgtcaaaaggaaagggggctatgtagggaaaagaaagagagatcaaactgttactgtgtctatgtagaaaaggaacacataagaaactccattttgacctgtaccctgaacaactgctttgccctgaggtgttaatctgtaactctgccccagccactttgccccaacctggagctcacagaaacctgtgctgtatggaatcaaggtttcagggatctagggctgtgcaggacgtgccttgttaacaaagtgttcacaggcagtatgcttggtaaaagtcatcgccattctccagtctcgatgaaccaggggcacaatacactgcggaaagccgcagggacctctgccctggaaagccgggtattgtccacggtttctccccatgtgacagtctgaaatatggcctcgtgggatgagaaagacctaaccgtcccccagcccgacacccgtgaagggtctgtgctgaggtggattggtaaaagaggaaggcctcttgcagttgagatagaggaaggcctctgtctcctgcctgcccctgggaacggaatgtctcggtataaaacccgattgtacatttattctattctgagataggagaaaaaccaccctgtggtgggagacgagacatgctggcagcaatgctgccttgttattctttactccactgaaatgtttgggtggagagaaacataaatctgtcctatgtgcatgtccaggcatagtaccttcccttgaacttatttgtgacacagattcctttgctcacgttttcttgctgaccttctccccactgtcaccctgttctcctgccgcattcctcttgctgagatagtgaaaatagtaattaataaatactgagggaactcagaggccggtgccggtgcaggtcctctgtatgctgagcgccggtttcctgggcccactgtgctttctctatactttgtctctgtgtcttatttcttttctcagtctctcgtcctacctgatgagaaatacccacaggtgtggaggggctggccccttcagaattcttctagttttctctaatatcaggcaacaactctgcaaactaatttttccctcaccctctgacttggaatcagtcaaatttaaaactgcccttttcctgaagccctgtgagctgaaatgggacaagttgatgtaaacttcagagaaatcatccccacagatcctgtgcgggcagcttctgcaacacctgacctgcaaatcaggaaggcccttcagctgcctacctggctgcagctgaagatgcttcaggcccagcgtctagaaatcttctggcctggtgcccactgggctcagaaactgcatttctaagtgttaacctttgtgtttcatttattttcagagtctctcctcttcgaatgtccaactgctagcaccatgcggcgaaatgtcctcttctatccagtcccaacagaaaatccagctggttcttaatgaacgaaaggccacccaacaagaaaatggacttatattgttggagggaaacgagaatgtctcctctttccttaaacagtgtggactgacaaagattctctgcttggctaaactgcagtcgggctctggaaacttctcctaggccggcctgcacttccttgtaagaaaaaggctttaaaaagtacccggtggggcccggagcggtggctcatgcctgtaatcccagcactctgggaggctgaggtgggctgatcatctgaggtcaggagttccagaccagcctggccaacatggtgaaaccctgtctctactaaaaatacgaaaattagctgggtgtggtggcacgcgcctataatcccagctactcgggaggctgaggcaggagaattgcttgaacccaggaggcagaggttgcagtgagccaagatcgtgccactgcacgatgacacgtgccactgcctggtgacagagtgagactacgtctcaaaaaaaaaaaaaaaaagaaaaaaaaagaacccccctaaatcaggttaaagacccactcttgacatttgatcacccttgatcctgagttcctcatcttccaccatctcccaggtctgatcaccctggtctgtcttcagcaaaaatcttcctgggctaatttagccagaaccctccttccccccaatatttcctcttgggaatgtccgtcctccgagtttacccagctccctggctgtcaatccccgccagcccatgctgtgttaagaactgagccccatctctctcccgcatggccgtggtccctgctcctgcggcggtggtcctgaatcacacctgcctccgcattgaacaactatcatggaataattttttctttaacatttctaaacacactcttaggaggcgccagcagccagcgtgcggagttaagtgcctgtgccctttgtatgaaagtgtcaccgttgtcctggtcttgaggggtggctttcgggtgtaaacggccggcagaggtgagtagatgctgggaggctgctccaggcgtcttgtttgctccagggttcttgagactctcctgtctatgagaacgtgcagtggcacgggacggccgccggggggctcccgagtccggctctggagtctgtggccgcgcgagtgcacctgcctgggccggccctgacggattttttttttttttttgatagagtctcactctgtctcccaggctggagggtagtggcgcgatggcagctcactgcaacctccgcctcccgggctcaagcgattctcctgcctcagcctcccgagtagctgggaccacagacacccgccaccacgtccagctaatttttgtgtttttaatagagaccgggtttcaccatgttggcctggctggtctctccaactcctgacctcaggtgacccacccacctctgcctcgaaaagtgctgggattacagatgtgagccaccacgcccggcctccttttggatgcttctaaagtctctttgcctctggtgttggcagctccatcggcaagcgtcaaggtgtggacgtggagtttgcttttatttatcctgcttgggacttggccttgatcctgacgcgtcctgttattcagcgattttggaaaattcccagccactgcctcccccgactctgtttctcctttgggcagaagaagcccttgtgggagcctccgtccagcctccgcggggctgcgctcgggctgggtggcgtctcctgctctttcttcggtgttaccagctcccgctcctgcgtgtcctctgcgctgcctgtcccatccattcttattttagcctcatctattacggttttcaattctagaagttcttcgtaaaactctcaggtcatttcaaaatgcaatgtgcagtaatttcccattttgcagtaatatttgaatagcttctgtaagtaagtttaaaaaatctcttggccgagcgtggtggccacgctgtaatcccagtactttgggaggctgaggcaggaagatcatgaggtcaggagatcgagaccatcctggctaacacggtgaaaccccgtgtctactaaaaatccaaaaaaattagtcgggcgtggtggcgggcacctgtagtcccagctattcaggaggctgaggcaggagaatcgcttgaactcgggaggcggaggttgcagtgagccgagatcgcaccactgtactccagcctgggcgacagagcgagactccatctcaaaacaaaacaaacaaaaaaaccctctgaagcacacattgcatattctatgtctgataacgccgacattttgcttttgtttgggttcttattctatagtttcttgtttcactgattcttgtttctgcttctttagggcttttctgatttgtatgtgagctgggttcctgggatcctgatctgggcgcgtcttttaggcttgcctctgaggtccgctgtccccgcatgagcggacggcagagcgcgcctgcctgggagcccaggaggctgccgggccagggaccccgggaaccccgggaaccccgggaacctctcagcagcagaactgcagtggcacaagacggccaccagggggtcccgagccggtctctggggtccctgctggggttgaggggctgtggctgcagacgcggacctggcagggggacccgaaccccaacagggccctgaccggccccaaggctgagcctgccctgtcccaccagcgcccagaccccgatgttgggccggggccttcctttccttgtcccggccctctgaggttcgtccccggggtgtgagctgattctgagcacacggaggccttcctcctctctggggctctggagcccctgggggcctgcagggcctgggcctgggcctggctgctgtcctctgtgctcaggagggcttctcccacccacccacttccgggcacagcccccagccccacacccagccgccgggagggcatccccaggggaggaccctctgctccggagccgcgtcccttgtcctccagggacagtggccggaggctggtgcctcaagctcgtgcgcctcatgcagcatcccgtgggtccattcgcgaccatagtgaagacccgcaggccccaggcccgagccggctcccgggcaggccgcgttctggggcttccgcggggacactgggccacgccaggaggaagggtcctgaccagggtcagggagcatcggatgctgccggcagaagtggggggcgcggggccccaccgaggagcccaggccagcttccccatctgccccaggtgcagccttgcaaggcccccaggccacagcgtccccaggtcacagcgtccccacacccagggaatgcaggactttggcagaggctgggatcccagaccacagagccccacaagctgatgcctgttcgcggatgccacagccacctccgcggcaggcgctggggaggggaggggatcacagtgctggacacggaccgggccccagccctgagcccaaggcagagccgggatccggccccgagagcacgcctggccctgcccctggccctggccctgcccctgcccctgcccctgcccctgcccctgcccgtgcccctgcccctgcccctgccccgagcccgggaagcgccgcgtggtcggcggcgttcgatgctgctgtcggccacacgggggcagcagagcctcagcggctgccgcagcgggtccagtttccggccgccggggttgggctggcggtgcctgggggtcctccccagaggcccgcgtgtgaaacgtccgagtgcgctgggcgctggacacggagatgggtgcttgggccacgggcctgggggaccccacacggccggctaggcaggcccagacagcccagggtgggggttccatgggggcaggaggggagaagcctgggctgtggagcagctgggacgtccggggaagggcctgggggtcagaggggcggctcccgggacagggaggcacgtggaggggcggggtttgtggcagccccggagccgcctctgaagcttccatctgcagcctcctgtggggccgggtctgcttctcttgctgggcacccacatccacccccgaggggtgtgcgacaacccccattccagcccactcagatggtctctagcccctcccgtcacagtgaaccccggtgtcggtgcgagacgcctccgtgtattcccggacgtccctctgcaggcccatccccacctcacagacagtcacacccttccaggccttgccccatccccagtccctggcctcaccatcgcattgcagggaggcgggcatatgcaacctccatgaaataaagccctaacggagaaggccagagtgggaacttcgtttccaccagcaggtggggcagacaccctggctagccccggggaaaaccagtaaaaatactggatttaaatcccttcgaattctcctttctacaggcaagctgtttagtgagaaagaaagggccctgcaaagatcctccccaggtggacgggcagcccccaagcctgtcttgagctcccggacgctgctcctggggaagggcctgccgaggacaggggccagtgggagcccctgcctgaccacaggctgttctgcagcccaggtcaggagcgctggtgcctgccgtgtggggtggccctggtcctgaccgcctggggtcccaggtggtcccgggttgtaagagtctgtggtgcttgtgaaaagcttgcacatccttccaggggagactcgcgcgtggggcgagggcaggagcaggagctcataatcacacaggaaaacaggaagccctgaaccccgggctcgggaagcggcggggcgtcaggtttggaggggcttcgtctcccaccacctccccatttgcacccccagtccctgacccgcatctttcctcacctggtcactgtcccccaccctgtcccccaccctgtcccccaccctgtcccctgtctgccatctccctcccaggagggggctgctcctgcctagcacgcggtgcccttcctcccacgtcgcttaattatatttgaaaatacaacatttgaaacgtgcaaagaatggaggggcttttctgtgagtgcagggtgcccctcccgtgtccccccaccagggggcttccccgtccagccccggcttgtccctttcattttaacaaaacgtcctcaccacagtgcatgtgtgttttataaaagcagtattggaagttaatgcttttaatacagaagaaaaaaaaaacccgaaacaatataactgtcctaagtgatgttgagtggggagtgccgggtgggagttgaattgcgggaccacgatccctccacttccagccggtcctgggggtgtcatgtgaccccttctgaccagccctgggcaacctctggatggacgggtggggaggggccgtggaggggatctgggaccaggagagagagagcgtggccaggcagccccaggagggccctccagagcccgagtgggcctgcgtctgtggtccccaggtgcggtccctcgaggtggcgtgtgggccccccaggcccgcgccctgcggttccagcgcctccccaagcctctgtccctgcagcccccaccccccctgcactttcctctcctttgtctgtgctggtggtccctctctcactgtcccacacaacaccgcaccgccctcccccaggaaagcctccaccttttctcttagtgaaatagaagccctttcaaggtgacatgtcacctactcacagaacagtgccccaacccaggacgcagcctgaggcccctcaggagcattgtgtgcccccaggcctgtccccagtggtccccaccgtgggcccaccacagctcctgctgtcaagggcagcctgggtctgagccccgtccccctgtgcagggcacgggtctgggggctggcttgtcccctgctgggcggtgggcggcctggggtgtctcccagacacgctgcctgcggccggctggtgtggactgggcctggtgggccaggagctgccctcactatggcgacaggatcgggctgccaggctcctgtgggggctcagcaggaggggatgggagacggcaatgctcacgcctgacctgctgcccttgggggagccgtggtgccacctggccggcctgcctgagagacccccacggctggtgtgggagcctgggggagccctgggcaggtggtggggcagtgggcagaggtggctgcagagggacagggcctggccaggacgtcaccctgaggccactggagaggtcagcaggggcccaaggagatgcagggattggcagctggggagcacaggggtacccctgagccgtggtacccaaaggtcatgagctgagaggggaaaggcccagagccgctggatggtggattctgggcacctgatccgcagggcgtggtggccctctgagggacccctctgacagactgcaggcaagctgtcaagggtgtgtatgtgtgagggtgtgtgagagtgtgtgggtgtgtgagagtgagggtgtaagggtgtgtgtgagagagtgtgtgagggtatgtgtggagtgtgtgacggtgtgtgagggtgtgtgggtgtgtgagggtgtgagggtgtgtgaagttttcagactgtgagggtgtgagggtgtgtgagagtgtgtgagtgagggtgtgagagtgggggggtgtgagagtgtgggggtgtgagggagtgtgagggtgtgagggtgtgtgtggatgtgtgggatgtgtggggtgtgtgtgcatgtgtgtggatgtgagggtgtgtgtggatgtgtggggtgtggggtgtgtgtggatgtgtgggagtgtgaggatgtgtgagggtgtgtttggtgtgtggggtgtgtgtggatgtgaggatgtgtggggtgtgtggggtgtggggtgtgtgtggatgtgtggggatgtgagggtgtgtgtgcacgtgtggggtgtggggtgtgtgtggatgtgtgaaggtgtgagagtgtgagggtgtgtggatgtgtggggtgtgtgagggtgtgtgagggagtgggtgtgtggtgtgtgagggtgtgtgtatgtgtgtgaggatgtgtgtggatgtgtgtggatgtggggtgtggggatgtgtggggatgtgtgggagtgtgaggatatgtgagggtgtggggatgtgagggtgtgtgtgggtgtgtggggtgtgtgtggatgtgtggggatgtgagggtgtgtgtggatgtgtgggagtgtgaggatgtgtgagggtgtgagggtgtgtgtggggtgtggggtgtgtgtggatgtgtgggggtgtgtggggatgtgagggtgtgtgtggatgtgtgggggtgtgtggggtgtggggtgtgtgagggtgtggggatgtgagggtgtgtgtggatgtgtggggtgtgtggggtgtgtgtggatgtgtggggtgtttgaggatgtgtgtggatgtgtgggagtgtgaggatctgtgagggtgtgtggggatgtgagggtgtgagggcttgtggggatgtgtggtgtgtgtgagcggctgtgtgcactggccgagttgcctgctgctgtcctggcctggggccaggcgtgtgccagctcctgtgtttgttgtgtgcctggcgtgtgctgggtgcccgagtcgggctgggtgtgtctgggtgtggccctggggtgtccctttctggacgtgtgtctccgtgcagaacggaggtcctcgagttcccagaaggaagcccccagccccaggcgggtgcctgagaatagacctggggcctgtgggcgtggcagggctgcccctcggctgctcatggaccccccggacaccagtcccaccctgtgtctgtgatgctcactctctgagccttccctgaccccatgtgccaaagcctggcccagcaatgccacgtgtgcatgtgtgagcgtgagcttggcagcgggtgggagaatgtgtgcgtcagtgtgtgagcgtgagcacggcctgtgcttgtctggctgtgggactgggggcctctgtgacgctgtgagcccttgtggacctgagtgtgggccgtgtgagctgtgtgcacgtggctgtggctgagtgtgagcctctgagtgtgtgtgtctgtgccgtgtacctctgtgtgtctgtatgtgtctgtgtgtgcctctgactttatgtgtgtctgtatctatctctgtgtgtgtctctgcgtgtggtagcgtgtctgtgcttgtgtacctgtgtctgcgtgtgtctctgtctctgtgtgtgcctatgcgtgtctgtgtgtggtagtgtgtctgtgcttgtgtttctgtgtctgtgtgtctctgactctgtgtgtgcctatgtgtgtctgtgtgtctctgtgtgtgtggtagtgtgtctgtgcttgtgtttctgtgtctgtgtgtgtctctgtctctgtatatgtgtctatgtgtctgtgtgcctgtatgtgtgtggtagtgtgtctgtgcttgtgtgtctgtgtgtttgtgtgtgtctctgtctttgtatgtgtgtccgtgtgtgtgtgtgtgaggtatatctgtgtttgtgtgtctctgtgtctgtgtgtgtctctgtctctgtgtgtgtctatgtgtatctgtgtgtcgtgtgtgtgtggtatgtgtgcttgtgtttctgtgtgtttgtgtgtgtctgtctctgtatgtgtgtctaggtgtctgtgtgtgtgttagtgtgtctgtgtgtattgtgtgtctttatgtctctaagtctgtctatgtgtctgtgtctctgtgtgtttgtgtgttctgtgtgtctctgtggggtgtgcatgactatatttgtgggaggctgtatgtgcaggaagggccccctgagccctgtcacccgggctgcaccctgggggtcttcccagggatcctttcctcaaacttgagtcctccctggagggcttaggttccactgagggggtgggcgcaggcacagacccctcctctaggaggctggggtggggctgtcctgcctggctgggacacgggtcacaatgtccccccatgtggtccaccctgttctaggcacagggtgtcatctcccagggtctcagctgctggggtgatgggccccggacagcccctgggtgtggggtggggtcctatggaggcctctgtgtcccactgaagatgcagggctggggttgggcaggtctgttctggggtggtctcgtggggcaaccccagagggtcctgaggccggggtagggttgggcgaccccacctagggtctacgggctgaaagcgcctgggttggccaggcctgggcacaggggaggacagaggtttggtgacaggtgggctgtgaggggcccagcaggtgcacggaggaagctctgtccccaggtgacccacaaaatcctcttccgagggtgctgggggtcctgttcctgggggccatgcctgggacctccatgcaggggtctcctccctggcccagctcccctggggcaaggtccgacttgttaccccctccaccaggcagtcctctgggaagtgccctggggcctggtcactctgggcctggccacagcattggcctggacatggggtgtggctggggagtgtgaatagtcaggaatcctgcaaaccagctgcctgggtgccagccttccccccacctcccccaatgcaaatcgccatctcggaggtgggtgggggtttccacaccactgtcccacctgctctgtggttcccattttcagcatttttagaaatatttgcaagaatgtgtttgtgcctgtgtggtggggtgggggtgggagctgcggcccggtgcccatgaggtcttgtttttcagactggacgggggtgggggagggggagctgcggcccccccacctgctagtgtgtccagcctcctgagtggggcagcgagggtcctggctgggccccagggcatgacccccgatgagtgtgaggcgctgaggccgagtctggtccttggcgaggaggcccagaaggcccaggtgcccgtcctgagcgttatccagggccctgcctcaggcctcatgccggggccaagcccagggctggctggtggccacgcagaggtgagaggggcggggaagtgaggctgggttggaggaaagctgaggggcccaggcctcccactccagcccccgaggcagaccctggcccacccagggaccccctcccatgcacacaagcacacacaacacgtatatgggcatgcgtgtgcacacacactcgctgcagcccgcagcactggctggcccaggtgtcctcgggacgtggtccacgcggtgctgacacgagctggccctgagtgcgggctctgcggggtgccattcccaggccctgcaggggcacatgcggtgtcgtggggcagcaactgtgacctctgccccgcagacccggacatgccgccagagaggccaaggcgtacgctctccgagccttccctgaccccatgtgccaaagcctggcccagcaacgccatgtgtgcacgtgtgtgagcttggcaacaggtgggagaatgtgtgtgttagtgcatgagtgtgagcatgagcgtgtgagatgcaagcgtgtgtgcagtgagtggtggatgagctggaggtgtgcggttgtgcgtgatgcggacgggtgtgtagtgtggacaggtgtgtggggtggacaggtgtgtggggtggacaggtgtgtggggtggacaggtgtgtggtgtggacaagtgtgcagtgggcctggctcattgtcaccgccaggacaaggcctttgtccgcactgatagggctgagcaggtggtccaggctgtggtcaggcagcaatgtcctggcgtggagcaacaggggaggcaggttcatgacacggggcaggacagtggccaggggctgcaagcgtgacctgcgggagggggtgcctgtgtgcgggcatgtctgtgtgtgtctttatgtgtctgtgtgtgtgtgtgtctctatgtgtgtcggtgtgtgtctgtgcatccacgtgcatgtgtgtctgtatgtgtgtgtgcatatccgtgtgtctgtgtctttatgtgtctgtgtgtgtatgtgtttgcctgtgtgtgtctctgtgtgtctgtgcatccatgtggatgtgtgtctatatgtgtgtctctgtgcacatatgtgtgtgtctgtgcatgtccgtgtgtgtctgtgcatttctgtgcgtgtgtgtctctgtgcatgtctgtgtgtctgtgtgtgtgtgtgtctgtgcatgtctgtgcatgactctgtgtgtgtgtctctgtgcatgtctgtgtgtgtctgtgcgtttctgtgtgtgcatgtctgtgtgtctgtgcgtttctgtgtgtgcatgtctgtgtgtctgtgcgtatgtgtatgtgtctgtgcacgtctctgcgtgtctgagtgtcaggggatggcctgtgcttggttcgcagtgcaggcgggtttgctcacacctcccccgcagggctgagcctccagactcccagccccatacaggccccagcccaggggggagccgggcggcgcttggggcctggagccctgacccggggagtcggggcaggactagcgtggaggctctggtgactcagcctcctcgtatgtgtgcactgcagtttgtcctccgtgcatcccttggtggacacttgtggggcttcctgggaggcggccccagacttggacagattctaggacccagagggatggggcagaggcagggatgacagagacagacacaaagcagagagacggaggcagagggagacatgcagagtcacggagacatccgggctcaggccccgactctcaggggccacccccagggaggacacgcagtgcacccccacacccacacctcacacacacactcacacccacatacccccatccacacacacccagagacacacagacacccacagccacacactcacactcacgaacttatccagtcacctttccagcgaggcagggatgacagagacagacacaaagcagagagacggaggcagagggagacatgcagagtcacggagacatccgggctcaggccccgactctcaggggccacccccagggaggacacgcagtgcacccccacacccacacctcacacacacactcacacccacatacccccatccacacacacccagagacacacagacacccacagccacacactcacactcacgaacttatccagtcacgtcccacacactcccacccaacccatacaccacacacctacacaactcatacaccacacactcacactcacaaactatataccacacactcacacacccatataccaaacacgcacaacccatacaccacacactcacactcacaaactatgtaccacacagtcacacaccaaccatacacctatatacactcacacacccatataccacacacacacagctcatacaccacacactcacactcacaaactatataccacacactcacatacccatataccacatacacacaacccatacatcagacactcacacacaacccatacacctatacacactcacacaacccatacacctatacacactcacacccatataccacatacaacccatacaccacacacacacaacccatacacctatacgcacacacccacacaccacacacacagcccatacagtacacactcacaccacaaactatgtagcacacactcacacataacccatacacatatacacacacatatataacacacacacacacagcgcgcgcacatatacactcacacacctatttcccacatacaacacataccacacacacaacccatacatatatacacacacacacatacaccacacacagcgcatacactatatacacaccacactatatataccacactcacatatataacacatacacatatacacacacacccatgtcccacacacacaccccgtgtacatacatacacacccatacacaaaacactcacaacccctacccctatatatacacacacacaccccccatacacacacagagcatacacttacacacactcatagagcacacacacacaacccatataccacactctcacacagcccatatacctatacacactcacacgcccatacaccacacattcacacaactacaccacatacacccacaaactatatgctacacactcacacacagaccatacacctatatacactctcacagccatataccacacacaacccatataccacactctcacaaactttatgccacacactcacacaaactatataccacactcacacacaacccatacacctatacacaatcacacaacccatacaccacacacaacccatacaccacagacacattcacaatctatataccacacaaacccatacatttatacacactcacacacccatataccacacactcacacacagcccatataccacacgctcacacacaaatgatacacctatacacacacccatatgccacacacacaacccatacaccacacacacaaactcatacaccacacacacaacccatagaccacaaacacacacaagccataaccacacacacacacagcccatatgcctatacacattcacacacacaacccatacactgcacacacaacacatacacctatacacactcacactcacaattcatacaccacacactcacacacaacccatacatctatacataaactcacacacaatccatataccacaaacacacacaaccaaacacctatacacacacacacaactcatacagcacacacacaacccacagaccataaacacacacaagccataaccacacacacaacccatacacctatacacacactcataaacaagccgtacacccccccccacacaacccatacaccacacactcacacacaacccatacacttatatacacatacaacccatataccacaaactcacactcaacccgtacacctatatacacacacaacttatacaccacacactcatacacaacccacagaccacatacacaaaccatacccacacactcacaacccatacacctgtatacacactcataaacaagccacacacctacacacactcatacacaacccatacaccacacattcacacacaacccatacgcctgtacacacactcacacacataacccatataccacaaactcacacacaacctatacacctatacacacatacaacccatacaccacacactcacacacacatataccacaccacacacacaacacatacacgaaacactcatacacacacgcatacaccacccacacatacaacccatacaccacacacacaacccatacacctatacacacacacaaactcatgtaccacaaaaacacacaacacatatacctatacacacatacaacccatacaccacacattcatacacaacccatacaccacacacacaacccatagacctatacacacacaacacatgcaactatcacacactcacaacacatacacctcctatacacacacacaacacgcacacttcctatacacacaacccacacgcctatacacactcacaccctcactcacactcaccctcacattcatatactcactaacacacttccacactcacaccctcacccacacttacacccccacccacactcaaaccccgacgctaagtcactgtcacatttgtacccatgctcacacgctcccaccctcacacgctcaccccccaccagctccagggctcactggtgtgtgcccacgaaaccctgcctcgggggtcccctcggtaagctgacagcgctctgctcatcggtggcctggggaaacagggcccacccaaagcctggctcaggaaaggctccaaacacacatgcacatggcccagaaacagatgggcagagctcagcctgcagctgggagcggcggagcgggtgctgggccagagtcggggcctgtctgtgggtggggggcacggcagcacgggcccacctgcacaccccaggcctggcccccgaggtcactgggccaccacccagccctcgccctgttccccgtctgtgctggccggggcaggactctgagcctcggggaaacccacagatacacacgggaccccgaacatcgggctggggaggttggggtgggtaacagcatgccagaggcaggagcaggaggtccaggaccctgcgcactgcgaccccagccctgggggctgaagcccaggacagcctcaggtctcccaggagggactggacagtgggggatggtcagagaacaggacagccagcagggtgcagcctgaggacagggatggacgctgggaggtcaacaggacaggggcaggggctgtggagtgtgagaaggtcctggagggcctggagaacctgtgggtcagtgtctgtgggaaggaggccaggagcagccctgagtggccaggctggcaggggtgaggaggtgggggcagtgaggttagggtgaccgagacagtgaggcctctggccagggaggggaccttggctgggctctgactgaacccagggctcctggagaaggggccccaggcggggatgaggatgtgggcatctgactccatcaacaatggggcttccgacacgcacagcctgggcctcggagacctgggccctgacccgcctccccctggcactgggccgggtgccgtgtgtggtccccagtccccgcagcacctcccccacactggtcacgttccagggcccctctgaagcacctgctgtgaggggatgtggggaggggacagggacttgggcctgagctgccgggtcgggggggagtcggggacccaggctcagcgtgtggctggggaccagacagatggggatggaggaggacacgccctgtacccactgcctgccaaggggctggacccacgcccagtctaggccatgtcccccgaggcctgtgaaccttcaccctgagccactaaaacattcaggagctttgaaagcagcccccgtccttgtcactatgcgatgactctgagcatcacgctgtccctgctggatccaccctccagccccagcgagggaggctgggccccgggcagcaggtggtgagggcagcgggcacagccacgctacagcacacacagggtctcagggacgcgtccaccacagcccgtgcacaggctcctcacggcactgagttcacccggggcgcgggccgtttgtcctcaggagtccggctgtgccctccgcccccagccctgtcctgctgaggctgcagctgggtcccggggcacagggcggccctgagcaccttgtcatgttggtccctgtcgggtgggctgctggctgtctgtggagctggcagagccgcggttcagccttggaggccggtcctggggcccagcagccgtggggagcactgcccagtcccgtgcccacagggaatcacctgggctgaggaagggcccacacgccgacgggatcggggtcaggcagcgcacgcctggcaccgagatcccacgtcccgaagtggggacacggcccaggggcactgttccgggagggtctcaagatggggtctcctatttcaatcttcactccttctgcacctgttagctgggaaccttctagaaggaggggtgtcctcaatcatggggtggttgtgagctgagcacagatcatgcaggaaggtacatggcttctccttcaccaggaaaacagtgcagagagacagagacacagagacagagacagagtaacagagaaagacagacgagagagagacacagagacacagacagagtaacagagaaagagagacagagagacacagagacagagacagagtaacagatagagtcacagagagacagagagagagacagagtaacggagaaagacagagacagagagagacacagagacagagacagagtaacagagaaagacagagagacagagacacagagacagagacagagtaacagagaaagacagagagacagagagagacagagacagagtaacagagaaagagagacagagagagacacagagacagagacagagtaacagagaaagacagagagacagagacacagagacagagacagagtaacagagaaagacagagagacagagagagacagagacagagtaacagagaaagagagacagagagagacacagagacagagacagagtaacagagaaagacagagagacagagagagacacagagacagagacagagtaacagagaaagacagacagagagacacagagacagagacagagtaacagagagagacagagagagacagagacagagtaacagagaaagacagagaggcagagagagacacacagagacagagacagagtaacagagaaagacagagagacagagacagagagagaaagagagacagagaaatagagacacagagatacagacagagacaaagacacagagacagagacagagaaacagagagacagagacagagagaaacagagacacagaaagagacatgcagacacaaatagagacagagatgaggagttacagagagacagagacacagagacagaaacagagtaacagagaaagagagagacagagacagagagagacagagaaatagaaacacagagatacagacagagacagagagaaagacacagagacagagaaacaaagagacagaaacagagagagaaacagagacacagaaagagacatgcagacacaaatagagacagagatgagttacagagagacagatagatagagacagagatggagagacagagacagagagaaagaaacacagatccagaaagagacattgacagagacagagagagaaaaataggcagagagagagagagagaaaaacagagacacagagacagacacacagacacagagacagaaaaagacagagataaagttacagagagacagagatacacagagacagagagacagataaagagagacagagatataggcagagacagacagagaaaaacagagatagaaacagagagacagagataaagttacagagagacagagaccaagacagagataaagaaagacagagacagagtgagagaaacagaggcagtaagagataaagagagttacagagacagagatacagagagatacagagagacagaaagagagatagagacagagatagagatgagagagacagagatagagacagagcaatagagataagagaaagacagatacagagagtgagagacagagagagatagagacagagataagaagagagactgagatagagacagagagacagagaaagagagttagaaaggcagagaaagacagagacaaagagagacagagagggctgaagagaaacagagacagacagcaacagaaagacagagatatatagaggggaagagacagagacagagagacagagaaagacaaaaagagacagagaaagaaacagagagagagaaagagaggtataaggagagacagagagagggagagctacagagaggaagagacacagacagagagacatagagaaacacacacaaaatgacacagaggcagagacagagatgaagagacagagagagagagacagaggcagagagacagagagacacacacaggaagagacagatgagagagacagatatagacagagatacagaaagagaccgagagagacatacacagggacacgaacagacagacagagatacagaggcagagagacagagatatagacagaggcatggaaagacagagaagagagagacacacacacagggacacaaagaggctgagatatagacagagatacagaaagacagagatagaagcagagagacagagagagacacacagggacacgaagagacagacagagagacagaggcaaagaaagggacacagcaaagggacaggcacagagggagggatagacgggaagagagacggagggatagagacagacacgggggagagatggatggagaaaggaggcaccgacggagacacacagaaagagagagaggccaagacaggcaagatggcgggacaaagcccagcagacgggcttgacagagatgagtcagagacaccgacaatgggacagagacagagattcgggcagggagataccttcagagaggcagagagacagggagacagaagggtagccagagacagggacagcgggaaagatggagctggaggctcagatggagacgggtgtgacagagctgggagcagggaggccacagcccacgcagtccgggtgctgcacccaccacggcccccaggcccggagacccagcccccatcaccatgtaacctcaggccatgtccctggccctgctgagcctcagtgttctctctgtacagtggggaccaccaggccatgagggtgggggaggtgcgggcctgcaccagaccggccctgtaccaatcgggctgcctgtgcccaggccaccagggccacctccgctcagcctccttggggcttctggggtgggggttggctgggggccctgccagcgttggctcccctgcccttcctgccaacctgggggctgcccctgggtcctggtcccaaagatggcaacaagttcagaaccactgaattcaataaagttgacgtttgcagggtggtcccagtgtcagtaacccaagtgggcctgtcctgggggagggggcgggtgtccccgaatctggaggcctgagccagcctggccacgctgggggagggggcggggggtgtccccgaatctggaggcctgggccagcctggccacactgggtgggtggcggctgcagctgcaggtggagaatcgtgcaagctatttctggaaacagcctcagagggcaagaaacatgttttcggtgtggaacaaacaaccatttgcatgtgccctgagggccaagtctgcccagaatgagtcactcaaggagaaacagatcagagccctcacacctgcctgggggaggggtgggcgccgctccagggacctgctgttgggcccagagatgccgaaaactcagcccacccggccgccatggcaggacccactttcctcaccagcttgcccctaggtgggacccacaggacccctgggaagccctcagcagcccttgggcaggtcccaccctgcagagaacgcgaaggctcaaaggcccactcgggctgagaccgcagggagccctgggccgcttggatgcagagccctgaggcccgaggctaggctgtgggagggagcagcagtgagacccccactggccctcagggctcacaggtgccccggtgagggtgcagggagcgggggtgcctgccaagcaggaaggcggagggcccaggctgccgtggcaccatcggggcacactatgtgtcactggcccaaggagactcgcccatgaggagctgctgctggtggacgcaggggtgccctccagcctccttggggggctaggaagggagggcagggccaggcagaccctagggtgaggtaggaggactggcaaaaggccagtatggccaagggagagccacatgggggctgggagggcgcaaggttcgggcccggccaaagcgtgggtgccaggtatggtgcccaccaggaccgcgcggcgtgtactccagaaagaccctggggcgcaggacgggcttgccatgctgaggtctggaaagtaaagagaggcacttcacggcagcacgccagcctgcatgatctgtgctcacactcacccactacgagcaatgccctccttctagaagtttcctcactaacacgtgcacaaggaatgaagggaatggggtctcccgtctcacagccctccatgtaatggtgccctcaaccgaccgactgctcccgaccggccgcagccctcggccccgcggcccacctctgcctgaccccggccctgctctcctcctggcagctcagggattcgccactgcctgggctcagccggagcaaagcccgtgtcccccggcaccccacacagccgagtcacccctccctcacggcccccacctcctcgcccctgccggcccagccacgctgagctgctcctgggcccccttcccagagacatcggagccctgcaggttctccaggccctctgcccactccactacccctgcccgctcccagctgcaggctgagctctgcccctttgctcctgggccatgtgtgtttgaggccttccctgagccaggccttgggtgggccctgtttcccccaggccagccatgaacagagcggagggcatgtgcccagctcatagaggggacccccaaggcggggtgtggtgggcacacaccggtgagccaggggctggtggcccagaggcttagacaggccgtaggccccatcggaagtgacagggcctgagggaagctcagtgtgtgtgtgagagtgtgtgtgagtgtgtgagtgtgtttgtgagtgtgtgtgtgactgtgtgtgtgtgactgtgtgtgagtgtaagtgactgtgagtgtgagagtgtgtgtgagtgtgaggtgagtgtgtgagtgtgtgagcaggtgagcgtgggtatgaatgtgacagtgactatctatctctgtctctctctgtttctgtgtatctttcttatctctgtgcctgcctctgtctctatctctctctctgtctctctatctctgttactctgtctctgtctctttctgtctctctgttactctgtctctgtctctgtctctctgtctttctctgttactctgtctctgtgtctctctctgtctctctatctctgttactctgtctctgtctctgtgtctctctgtctatctctgttactctgtctctgtctctgtgtctctctctgtctctctttctctgttactctgtctctgtctctgtgtctctgtctctctgcactgttttcctggtgaaggagaagccatgtaccttcctgcatgatctgtgctcagctcacaaccaccccatgattgaggacacccctccttctagaaggttcccagctaacaggtgcagaaggagtgaagattgaaataggagaccccatcttgagaccctcccggaacagtgcccctgggccgtgtccccacttcgggacgtgggatctcggtgccaggcgtgcgctgcctgaccccgatcccgtcggcgtgtgggcccttcctcagcccaggtgattccctgtgggcacgggactgggcagtgctccccacggctgctgggccccaggaccggcctccaaggctgaaccgcggctctgccagctccacagacagccagcagcccacccgacagggaccaagatgacaaagtgctcagggccgccctgtgccccgggacccagctgcagcctcagcaggacagggctgggggcggagggtacagcgggactcctgaggacaaacggcccgcgccccgggtgaactcagtgccgtgaggagcctgtgcacgggctgtggtggacgcgtccctgagaccctgtgtgtgctgtagggtggctgtgcccgctgccctcaccacctgctgcccggggcccagcctccctcgctggggctggagggtggatccagcagggacagcgtgatgctcagagtcatcgcatagtgacaaggacgggggctgctttcaaagctcctgaatgttttagtggctcagagtgaaggttcacaggcctcgggggacatggcctagactgggcgtgggtccagccccttggcaggcagtgggtacagggcgtgtcctcctccatccccatctgtctggtccccagccacacgctgagcctgggtccccgactcccccccgacccggcagctcaggcccaagtccctgtcccctccccacatcccctcacagcaggtgcttcagaggggccctggaacgtgaccagtgtgggggaggtgctgcggggactggggaccacacacggcacccggcccagtgccagggggaggcgggtcagggcccaggtctccgaggcccaggctgtgcgtgttggaagccccattgttgatggagtcagatgcccacatcctcatccccgcctggggccccttctccaggagccctgggttcagtcagagcccagccaaggtcccctccctggccagaggcctcactggctcggtcaccctcacctcactgcccccacctcctcacccctgccagcctggccactctgggctgctcctggcctccttcccacaaacacggacccacaggttctctaggccctccaggaccttcgcccactccacggcccctgcccctgtcctgttgacctcccagcgtccatccctgtcctcgggctgcaccctgctggctctcctgttctctgaccatcccccactgtccagtccctcctgggagacctgaggctgtcctgggcttcagcccccagggctggggtcgcagtgcgcagggtcctgggacctcctgctcccgcctctcccatgttgttacccaccccagcccgatgttccgggtcctgtgtggatctgcaggtttcctggaggctcagagtcctgccccggccagcacagacggggaacagggcgagggctgggtggtggcccagtgacctcgggggccaggccttgtaggtgcaggtgggcccgtgctgccgtgccccccacccacagacaggccccgactctggcccagcgcccgctcggccgctcccagctgcaggctgaggtctccccatttgctcctgggccatgtgtgtttgggtgtgagtgtgggtatggatgtgacagtgacttagtgtgtggctgtgagcgtgggtatgtttctgtgtgtttgtgtgtgaatgttgtataatagtcgtggtgtgtgtttgtgagagtgactgtgtgagaggggcttgcagctgagttcctgggcccatcttgctgcctctttctctccctgtgtgttctctgcctctgttgtgttctctctgcatgtctgtctccatgtctctttttccctgttcccatctcctctctttttctcccatctctgtctccgtttcttcttatctctctcatctcatctctctctctttctgtctcttgtaactctgtctctgtcactggcctcgcctctgtccctccctgtccctgtctcttatctctctccatccccatctctctctctgtgtctgtctttgtctctcctttcctgtctctcttgtctctccccatccctgtctctctctctctctatgtctctgtgtctcttgtctctcccctcagatagaccatggttgaccctggctgacctctgcctaaccctggacctggaaagccctagctgaccctgggctggttggggctgggcctacctgtggctgcagcccctcgctcaggccccaggcacacctggccaggtctcggttttggggcatgtttctcagaacagcagttctctggctggaacacctgacctgggctgtgttcacaatgactcagccaccccacagggctattttgggtatttctgcaggtctattcaagaggcttcaggagagagagaaaagcaagagaatacaaacggcatggcctcccctcaccttcctgtccccactcctgtactgtaccccctccccagtgctaagtcgagacctggcgaccccttaggggctggggctgggtgtagctcacagggcctgggctggtcttctcgccaccaagtcctcctggggcctacacacccctctgagcctggaaaaatggagcaagtcattggggtcatttcttcatctaccagtgagtacatgcactgagagggtctcggctcccctggaggcctccctccaccactgcaggtcacttactcatgagggccaaggctcagaaatcagacaggactcagtgtctagtcagactgatacatgctcagaaaaggaatcagatttcaaaatgaatatgcataattaaagaaccagagatcagtgatcaggaacagggatccgcggtctggtccagggctcagtggtcaggaacagggcccagtgatcaggatcagggctcagtaatcaggaccagggcccagtgatcaagaccagggcccagtgatctggtccagggctcagtgatttggtccagggctcagtgatcaggaacaggggtcattgactgggtccagggctcagtaatcaggaccagggctcagtgatcaggaataggggttagtgatcaggaacagggctcagtgatcaggtccagggctcagcaatcgggaacaagggtcagtgatcaggtccaggggccagtgatcaggaccaggggccagtgatctggtccagggctcagtgattaggaacagaggtcagtggtcaggatcagagctcagttaccagaaatagggcccaacgatcaggatcagggctcagtgataaatactagggttcagtgatcaaaaggaggtctgagtgattagaatcagggcccagtgatcaggaccaggactggatgatcagcaccaggactcagaagtcaagagcagagcccattgatcaggaccaggagtcagggaccagaaccaggggccattggtcagaaccagagcccagtgattaggaacaagacccagtgatgagggccagggctcagtgatcaggaccaagattcagggataagaacaggacccagtgatcaggaccaggacccagtgatcaggaccagggctcagtgattgactattgactaggaccagagctcagttattgactgttgactgggacaagggctcagtggtcaggaccagagcatagttagcaggaccagggcccagtgatcagggccagggctcattgatccagaacatggcccagtgatcaggatcaagactcagcgatccagaccaggactgagttaggaccagagcctagtgatccagatcagggctcagtgatcacgaccagggcccactgatgaggactggaattgagtgatcaagtctaggactcagggatcaggaccaagactcagtaatcaggaccagagttcaggggtaaggaccagaacacagcatgaccagggcccagtgatcaggagcaaagccctttgatcagggccagggttcattgatcaggagcagggttcagtgattaggatcagggcccagtgcccagtgcccagtgactagcatcaggatctaataatcaggaccagagctgagtgatcaggaccagggctgagtgatctggaccaggactgagtgatcaggaccagggctgggtgatcaggaccagggctgagtgatgaggactaggatggagtgatcaggaccagggctgtgtgatctggaccaggactgagtgatcaggaccagggctgggtgatcaggaccagggctgagtgatgaggaccagggctgagtgatgaggtccagggctgagtgatgaggaccagggctgagtgaccaggaccagggctgagtgacgaggtccagggctaagtgaggaggtccagggctgagtgatgaggtccagggctgagtgaggaggtccagggctgagtgatgaggtccagggctgagtgatgaggaccagggctgagtgacgaggtccagggctgagtgacgaggtccagggctgagtgacgaggtccagggctgagtgaccaggaccagggctgagtgatgaggtccagggctgagtgaggaggtccagggctgagtgatgaggaccagggctgagtgatgaggtccagggctgagtgatgaggaccagggctgagtgaggaggtccagggctgagtgaggaggtccagggctgagtgaggaggtccagggctcagtgacgaggaccagggctgagtgaccaggaccggggctgagtgatgaggaccagggctgagtgatgaggtccagggccaaaaacaggagtaggactcagtgatcaggactaaggctcagtgatcaaggctagaattaagtgatcaggaacagggaccaagtagtaggaccagagctcagtgatcggtaaacgggcccactggtcaggaccagggccctgtgatcaggatgaggacccagtgaggaggaccagggctgtctaggttatgaggaacagggatcccatgtagttcttaggagcaggcttctttgccatggtctctggtgaatccagcattcatccttgggcctcagcctcattcaagatcaggtcatttcttgattttgggaccaggggtaccctctgtccatgcccaccatgaccaccatgacacccagggggactttgaagcaggcgttctccagtctaaagccaccaccctttccctgacccccgtctcctcattcagagtctgtgaacattttccttggggccactttattgcacctggaaggcatgtgagtaagggcgggtcggtgatgtctgaaagggctgagttctggcaagcatagctggcttctccaagaggttcctccacacttcctccctgcaaagacagaggggtcacagcctgaaggagcagcatccttgccaacgccctctgtctcagccctggcctggctcatgggagcctggacggaatcctcgttactgcactggagggaagctcagccctgaccctgggcctgcgcgtgtcctcagtgtctgtgaagggccccccaggagagcacgtccccccacagtgggagcaggtggtgctctcctcttagccaagcactgcagcccacctcatctactgtgggctcatccccctcctgggctcccacctgtgccttgccggctcctgctcagtactgggggccctccctgttgccagatgggccccggacgctggtcacggtcagtgctgtgctatagaacaggctcagcaggaagagggtgaggaaggtgatggtggtgggccacaggttggcgccgggggtctcctcctccagggtctcctgcggcaagtccagcaccacatagggaggcggcatctgccaatctgcaacacagcaagagcctgccaggcccagactcgtgtgaacagcggctatgcttccttggggtctggggacagtggggtctgggtccccatctaaggcctgagactcccccagggaggatgaggaggcagagtcccaggtgaggggctgggaccttctgtctttgacattcttagggcacttcagggagagacttggcagggcagaaagtggacaccatctgcttctccaagggaagcttgagcccgaggtaccctcccgcccctcccaccccaccccgtctcagtcccagccacgtattcagtgactgggtcccggggccagagaggaccagacacacccaccctcaaggagatctgggtccaagacagagacctgggtctgacactcagtgtgccaaaggttgaatgggcaagaccagaggcctctgttgccttcccagggaatgtggctgaggggttacaagcgagggccaggtgagggccaccagcacgggcatcctcattttcctcagggtctcagggcatagacctcccatgtacagctgtacctgcttgtcatatgctgatacatccagtcattcacctgtctttctatccttccatccatctatccatccatccatctataaagctattatccgtatatccacccctccatcagtaacactcctacccactcacccaaccattcatcctccattcatctattaatgtaaggctatcacttaaatatccacccatatatctataaagctattttccatccattcatccttcttccatctatccatccatccattcacccatccatctataaagctattttccatctcttcattcatccattcataaagcaattctccatccaattatcttccatacacctatcctccatagatctacccacccacccaccccagtatcctcaatcctccgtcagtccacccatcctccattcacccctccatctatcttccatcctccatccacccttccatcctccatccgcctacccatccatccatcatccatccatccatccatccatcatccatcagtccatccacccatccatccatccatcttccatccttcattcatccactcatccatcctccatccacccgtccttcatccatccatcatatatccatctgtccatcctccatccagccatttacccacccatccatcctccgtctaccaatcctccatccacccatccattcattatatgtcctaggatctacccatgtgtctgcctgatctctgtctgctggttcagcccctcatctgttgattctccctctttccccctctctttaaaagcccctcccctgggccaggtcctgggtcccatgggctggagggcttctctgtggcagggcttccccgagtgacctgttgctctcaattaccctctggtgactggaccctcaggggtgacagtggcctccacctcaccttggccctgagagcagagggaggcagccagaaggcggggggccctggggaggcccggaagatgtctaaggcacgagcaggggccccactgcccccttgtgggagtctgggtgccaggtgtccccacagtggttgtgggactgttcttacactcctgggagccccaggcagaagccagaggcatgcagagggccctgggcaggccctgtctcactggcctgcttctgatgccaccccacgtggcccctccctgtctatgctttgggtcctagttgggcttaggaagggatgggagacttggccaggcagggagcaggggctgcctgggaggggtctgtggagttggtgcctgatctgtgcacagtggaaacacagggaagccagaggggcctaggggagcaggctgagcttgggggcttgggaggggactcccctggcttttctggaactgggtctgggctgtgaacgttccgctcctgcagggctcaggcgtatatgtgagtgtgagtgtgcacctgtgcccacgtgccccgtacagagcagtgtggttaaggggaggtgccccttcctgcatgcgtcagtgggacgtcctgaggcccacccactagggtggtggggccctcctggagcttgtcctcccagtggggccctggagtccagcccctcactccctcgccgctcctgccactacctgcgcctttcttggctagcctgctccttttaccctccctattccctcccagctacagccagaggcggctctctcagggacaaacggccatgccactgctcactcagaactgtccggggcatgtgcatctctcagaacccatcctgggctgtgcctgccttggcagacctaagatctcacaccagcgaggcctcctgcaccacacactctcacactcacaactcacactcacaccagggtggaaaggctcaggggggtgccaggggccccccgaggctgagggcagggggtattcttccctgtccatgccctggccctttcccaagtgctgagaccctgaggatggacagacaggcgccggatggaagcgtggggctgcttgggggagcatggagtttattcaggggtggggacaggcgggcggctcagtagcaggtgccgtccacctccgccatgacaacagacacattgacatgggtgggtttacccgccaagcggtcgatggtcttctgtgtgaaggccagcggcagggcctcgtggcccaccatgcaggagaaggtgtcccccttcttccagtcctcggctgccacgcgcagtatgctggtcacagcgaaggtggtggtgccctggctgggctcctgccgggatgcccaagtcaggtacttctcgcggggcagctcctgtgacccctgcagccagcgaaccagcacatccttggggctgaagccgcgtgccaggcacgtcagcgtcaccagctcgttcagggccagctcctccgacggcggcggcagcaggtggacctcgggccggaatgtgtttcctggagggtagagagccaggtcagggggctgggcaggggatgagagagcccctctgctctggtgggcaccctgggctgtgtcctggcccctcagcctgcctcagtttccctctgtacttggcatgagcactggagcccaggattgggagggaggaggcaggccaggaatatgctttgcaaaccagagcactgagcagggccccgagcagggtctggacccaccggattttgagagggtggcggttagcggggtcttggactcggggtaggcagcagtgcaagtgaaggtcttcccatggttccatggctcggcacagcccggcaggacactggacacgctgtagcagccacagaggtcacgctcaggtggtccttgaacagcgctcttcccacttgagggcgtccaggtgaaggtgacacctgaggcatctctcaggccggtcagtgtgcacgtgaggttcgcttctgaacctaagagcaggtcctcgagggccggtcggtgcagtgacagtcgggggtggcagcatgagggagatggggtaggtggagttgagggagatggggtaggtggagttgagggaactggagtggagagatggcctgagctggtcagcacatacttccccatgcccccgcctcgcccctcctggcctgtccaccaccacctcctggggctcggcccgcggtccactctggtgtgagtgaaggggcggctccctgtggggaacacgggtgcaggcgcagtgtcagggcacgacggggtggccccgccccactccccagcctgccctctgacctgggcagggcacagtcacatcctggctgggattcgtgtagtgcttcacgtggcatgtcacggacttgccggctaggcactgtgtggccggcagggtcagctggctgctcgtggtgtacaggtccccggaggcatcctggctgggtgggaagtttctggcggtcacgccctgtccgctttcgctccaggtcacactgagtggctcctgggggaagaagccctggaccaggcaggcgatgaccacgttcccatctggctgggtgctgcagaggctcagcgggaagaccttggggctggtcggggatgctggaacacagaatgcactgtgaggacgcggccctctcctctatactgcctctcctctatactggaggaacccagcacagagaggcctggtgacagccccatggtcacacagctcctgcaccacaggcctgcagttggaccctgctgtctgatcccagcaacatggtttctgaacatgctccttagatagggtctctgattcaggccatcccagacacaagttgtattaaacagggctctgccatggagtggctgagtcccctgagctccctgaccgcagcccctgctctgggtgggggacatgtcttgctctatcccctgcccctagagaggattttggtgggggctcttaggagagggtctgggctctgagtgctgtgtgcatggggtaggggtggagtggcttggctgtgaccccatccccctgtccctggtcagagtctcagtccaacacccaccactccatgagccccaccccaggcccaaacaagccacagtggacccctgtggcctatgaggtctcgggactagaggccaacaggctaagccatgtccctgccaggccctccaggacagggcctgctatacaggggagctctgggcccagcccactccaaatttccttcaggcagtgggcaagagagaagacagaatcatggtgcaacagagctgcgtggccctcagaacccctaagaacacagctgggctcagggctctgcaggtggaatcacactcaacccacggcctctttcccacattagcagccacctcagcccatcccgcccagcccagcccaggccagtccagctcagtccagcccagcccagctcagcccaggccagtccagctcagtcccgcccagtccagcccaagtcatcctagcccatcccatcccagcccaggtcagcccagcttagtccagctcagcccaggtcaacccagcccaggccagctcagtacagctcagcccagcccaggccagcttagtacagctcagcccagcccagctcagcctggcccaggccagctcagtacagctcagctcagctcagcccagcccagcccagcccagcccagtccagcccagtccagcccagttcagctcagcccaacccagctcagctccgcccagcctagcttagcctagcccagctcaacacagctcagtccatgtcaaccaaacccagctcagctcagcctagctcagcccagctcagcccaccccagctcagcctagctcagcccaccccagctcagcccagctcagcccagtctagctcagttcggcccagcccagtccagctcagctcagcccagcccagctcagtccacctaagctcacccagctcagctcagtctagctcagctcagtccagctcagcccagcctagtccagcccagcccagcacaggtcagcccagcttagcttagcccaggtcagtccagctcagctcagtccacttaagctcacccaggtcagctccgtccagctcagcccagcctagcccagcttagcccagcccagcccaacacaggtcagcccagctcagcctagcccagcccagctcagcacaggtcagaccagctcagtacagctcaggtcagcccagaccagtccaacccagcccagcgcagtccaacccagcccagctcagctcatccaagcctagctcagctcagcccagcccaggtcagcctagcccagccgaacccagctcagcccaggtcaacccaattcagctcagctcagcccaggtcaacccaaccaagctcagctcagcctagcccagtccagctcagcccagctcagctcagcccagtccagctcaatccacctaagctcacccagctcagcccagtctggctcagcttaggtcagcccagcccagcctagcccagatcagtccagcttagcccagcccaggtcagcccagcccaggtcagcccagctcagctcagcccagcccagctcagcccagcccagcccagcccagctcagcgcagcccagcctagctcaccccagccaggtccagcttagcccagctcagcccagcccaactcagctcagcccagctcagcccaactcagctcagcccagctcagcccaactcagcccagcccagttcagcccaacccagcccagcccagtccagcttagcccagctcagcccagcccagcccagcccagtctagctcagcccaacccagcccagcccagctcaccccagcccagctcagctcagctcagctcaacccagggcagcccagctcgtccaagcccagcccagcccagcccagcctagcccagcccagctcaggccagcccagctcagctcagctcagctcagctcaacccaggccagcccagctcgtcccagcccagcccagcccagcccgtcccagcccagcccagcccagcccagcccagcccatcccatcccggcccagcccggcccagcccaacccggcccagcccagcccagcctagctcaccccagcctggtctagctcaacccagctcagctcagcccaccctagctcagctcagcccagcccagctcatcccagcccagcccagcccagctcgtcccagcccagcccagcccagcttgtcccagcccagcccagcacagctcagcccagcccagcccagcccagcacagctcagcccagcccagcccagcccagcccagcctggcctagctcacccgagcctggtctagctcagcccagctcagctcagcccagctcagacccgctcagcccggcccggcccggctcggcccggcccagtccggcccggcccggcccaatccggcccggcccagctcagcccggcccagtccagctcagcccagctcagctcagcccagtctagctcagcccaacccagcccagcccagcccagcccagcccagcccagcccagctcatcccagcccagcccagctcagctcagctcagcccagcccagctcagcccagctcagcccagcccagcccagctcatcccagcccagtccagctcatcccagcccagtccagcccagctcagctcagcccagcccagctcagctcagcccagcccagctcagcacagcacagcccagtccagcttagcccagctcagcccagcacagctcagcccagtccagcttagcccagctcagcccagcccagcccagcccagctcagccaagtctagctcagcccagcccagtccagctcagcccagcccagtccagcttagcccagcccagctcagcccagctcagcccagcccagcccagcccagcccagctcagcccagctcagctcagctcagctcaacccagcccagcccagctcgtccaagcccagcccagcccagctcagcccagcccagtccagctcagcccagactagctcagcccagcctagctcagcccagctcagcccagcccagtccagctcagcccagcccagtccagctcagcccagcccagtccagctcagcccagactagctcagcccagcccagctcagcccagcctagctcagcccagctcagcccagaccagttcagctcagcccagttcagcctagccttgctcagcccagcccagcccagggcagctcagggcagcccacatggacgtgtatcagctggctccacgtcatcttctttgccctctggctcggctcagcctaggcctcagctcagccatgaaacctgttcaccttgtatcccaggaagggccgggtcatccctggttaggcctggccagcctggctcagcccccagtgcccagatccttcctgcctggttaggaagccctgccctgtggttccggagtccctgtggtgacctcttttgtccttccctcttgtcttggtgcctgttctccaccttttgcttccagaaggggccaggaccagcctggctggactcctcaatgtgcagaggaggagacggaggcctggagacctccaagacccacctggtcaggctgctggagggcccgcagtgctgagtgggcggcctccggcgtgcaggccctcatggcaggtccaccctcacgggcgtctggctgcctgccaagagggctgctgtggggagggagccctggcccggcccaggccctgccttgatggccgtctgtccttagcagagccctgctctgcctcgctggctgtgtccacagatgtggctggatgctgaggggctggaggggagggcctgcatgcccgtacgtctggcctacagacagggtcactcgcccacttcctgccccagcagacacggccgcgcggctccacgtcatgtctggcctgtggtctggctgtggtggggccaggtgtgtgtggccagggctctgtgaccccaccggccgtggagcctcatggctccacatggctccacagggcggggtgggggccacgatgcagggaaacaggaacagacacagttagaggctcagagaccccgagacagagatggcaaaggggagacacagggccagagagggtccccgaccacccgcaggggaagggtgcctgtgagtggactcccgttgagggggccttggggccacagggcgggcatcaggctggggagagtgagtcttgcgctgctgggttggagccactccggcctggcctccctcggtctgccccatgggccgctgggggccccagactgcagcccagggtgggggcatgggggcaccccgtctcctagcctgcagccctgcgggtcagggtggccaaggtgcctgctctaccctgtccagcgctgcccaggtggcactcctactgtgggtcaccagagagctggccgttgcgttggagagatcccgccagcgatgctggccctggagtcgggggaggccagctatgtctgggggctcgggtggcaccggcaatgggaggccagaggcgcttcacagaggagctgctgcagcggagtcctggaaagcgtgggcgtgaatggaagatgccctggccatggggccgggccaccccggcggaggctgtcgggtgaaatccagggagtgacagtgaggccggatcagggcaggtggggtcagaggaggagggaggtagcctggggctgccccagggtcctgggaagacacacctggcggttcagggaagctctggagcttttgttatgaaccttgggatgcccccggccctcgccagggggacgtggctgctgcatcttagtcatttctggctgcaataacaaaaataccatagactggtgggttcagcagcaacattcatttctcacggttctcgaagctggaagttcaaggtcaggatggcagcagggtcaagttccaggaagggtcgattcctggttcacagacccccatcttttcactgcgtcctcacgtggtggaaagagggcagggctgctctctggggtcccttttctttagggtctctagtgagattagggaccgaatcacatttttgagggttccccctcaggccctaaccacctccctgaggccccagctctgcatgctctcactctgggatgacggctgtcacacaggagtttcgggcagacacagaccctcagaccatagcaccacccctgtctgcctctgcctctccccatccctgtgtctcctcgtctgtctccagctaggacacttgtccttggacctagccccctcgataatccagggtgtccttcaccttgaaatccttgacaatccagggcgccctcaccttgaaatccttgacaatccagggtgccctcacctcgaaatccttgacaatccagggttccctcacctcgaaatccttgacaatccagggtgccctcacctcgaaatccttgacaatccagggtgccctcacctcgaaatccttgacaatccagggttccctcacctcgaaatccttgacaatccagggttccctcacctcgaaatccttgacaatccagggtgccctcacctcgaaatccttgacaatccagggtgccctcacctcgaaatccttgacaatccagggttccctcatctcgaaatccttgacaatccaggtttccctcacctcgaaatccttgacaatccaggtttccctcacctcgaaatccttgacaatccagggtgccctcacctcgaaatccttgacaatccagggttccttcacctcgaaatccttgacaatccagggttccctcacctcgaaatccttgacaatccagggtgccctcacctcgaaatccttgacaatccagggtgccctcacctcgaaatccttgacaatccagggttccctcatctcgaaatccttgacaatccaggtttccctcacctcgaaatccttgacaatccaggtttccctcacctcgaaatccttgacaatccagggtgccctcacctcgaaatccttgacaatccagggttccttcacctcgaaatccttgacaatccagggttccttcacctcgaaatccttgacaatccagggtgccctcacctcgaaatccttgacaatccagggttccttcacctcgaaatccttgacaatccagggcgccctcacctcgaaatccttgacaatccagggttccttcacctcgaaatccttgacaatccagggtgccctcacctcgaaatccttgacaatccagggttccctcatctcgaaatccttgacaatccagggttccctcacctcgaaatccttgacaatccaggtttccctcacctcgaaatccttgacaatccagggtgccctcaccttgaaatccttgacaatccagggttccttcacctcgaaatccttgacaatccagggttccttcacctcgaaatccttgacaatccagggtgccctcacctcgaaatccttgacaatccagggttccttcacctcgaaatccttgacaatccagggcgccctcacctcgaaatccttgacaatccagggttccttcacctcgaaatccttgacaatccagggttccttcacctcgaaatccttgacaatccagggtgccctcacctcgaaatccttatcttgatgggatctgcaaaggcccttttgacaaataacgccgcactcaatggccccaggggctaggatgtggctctatcttttgggggccatggttgtacccacgggtgggttaataggggaatgaagagggggatggagaggccctgagacggcatcctcttgctcccgggaggccaggccatgtggaaggcaggggcgctgttccgagcctgggtgtgaatccgggcctctgcccctccccacgggccccgtctgtctcctctacgtgggtgctcatctggtcttcctctcaggcctttgaggcgatggaattttctgtgcgtgaggacgcctgccacacagtggggcagtgagctgactccttgcccttgctctggggccatggaggtctcatgatctagggtgcggggcagagaaagtcactgagctctgtcccccgggggggctcccggtccggggcaccttggctgcggagggccggtctgttgtaggagatgtgggtttgcgacaccctgggctggtgatggggtggatggagggcctggcttcctgagactgtgtgtgtgttggtatgagcgtgcccgagcgtgtcagcctgtgtgagtgcatgattggtgtgtgtgagtgcaaatgtgtatgagaggttgagtctgtgtgtgtgaacctgtgtgtttttgcatgtgcgagtgtgtgcccgcgtgtgtgtctgtgaatgagggagtgtgtgaggggagctgggcagcggctgtggccttggccctgtcctgcgacgccccctcctctgatgttgtttggacccagtcagcctcagcgctgcccgctttggggttttctaccccgtagggagccgtcgctcctcaccttctcccccgtgcccggctgctccgaggtcgcagcagaggacagggcggagggcccaggtgccgctgtcagactgaggcaggcttgcttcattccgctttgtgccagactccatgtgacgtggctctcctggcacagagcgaggctctccctgtggggccatcactgtgagaggactctcctgcattggggcattttgccaactggccctaaaaagtggtcttaatgatttacgtgccctcagtcagggccaagaagcacctccacccccttcatcccctcctccttcctttcacttttctcattgttaaaatggtttctttatattatcggccactgggtttttcctttccatgaagaacctattgctcacctttcttcttagtgatctctgagtgctctttgtatatgagggaaccctgccctttgtcatgcctatcatgcgttctctcccatttttaggatgttgtggagacccttgtaagcaggcctctccagccagggaggctgcacatttgccctgaggactggtgtgggtcaagcccacctgtggccccgatggctctggggccccagcctgctcctgggtcacctctcagctcttcaggaggtccaggctggtgggcggctgtgggctggggagtcagctttgtctgtgctcagtgggtgctggatcagggtgtgtggccagtggtcctgggggcccccaccagcctccaccttggtgactgtgcagctgcattcttggggcctcctgtgctgaccacagcatgggcctcttctggttttgcccacaaaggggtcgatgttgattgttgctttgactttacctgagaaggaggcatgagtctgggctggagaccagcagaccaggtatgacagcgctgagctggggagtctctggggtgctgaggggtgattgatgggaaccactgcttgggcactttggctctcaggaccccagaatggcccctgcccttccttcccctctggctcctcctgcacgtcctcaggggtcctgcctcccaccagccactccagggccacacacacctcctacagagccctccggagacgtggggtttgtgaaaaggatctttactaagaaactcagagagaaagaagtatgactgctgaagccagacactggacgaggtcatagggacgaggtcggcagctgctgtccctgcaggaaaccccttctctggctgtgggagcccctctacccactccaggggcccgaagccctcaaccgtcctgtggcctggcctcagagggcttccctgtgccttcaggctgcagaaatgggggctgaggatagatggcaggaggggtgggtgaagggatgggggctgaggatagatggcaggaggggtgggtgaagggatgggggctgaggatagatggcaggaggggtgggtgaagggatgggggctgaggtggatggcaggaggggtgggtgaagggatgggggctgtggatagatggcaggaggggtgggtgaagggatgggggctgaggatagatggcaggaggggtgggtgaagggatgggggctgaggatagatggcaggaggggtgggtgaagggatgggggctgaggatagatggcaggaggggtgggtgaagggatgggggctgaggtggatggcaggaggggtgggtgaagggatgggggctttggatgggtggcaggaggggtgggtgaagggatgggggctgaggatagatggcaggaggggtgggtgaagggatgggggctgtggatggatggcaggaggggtgggtgaagggatgggggctgaggatagatggcaggaggggtgggtgaagggatgggggctgtggatggatggcaggaggggtgggtgaagggatgggggctgaggatagatggcaggaggggtgggtgaagggatgggggctgtggatggatggcaggaggggtgggtgaagggatgggggctgaggatagatggcaggaggggtgggtgaagggatgggggctgtggatggatggcaggaggggtgggtgaagggatgggggctgaggatagatggcaggaggggtgggtgaagggatgggggctgtggatggatggcaggaggggtgggtgaagggatgggggctgaggatagatggcaggaggggtgggtgaagggatgggggctgtggatggatggcaggaggggtgggtgaagggatgggggctgaggatagatggcaggaggggtgggtgaagggatgggggctgtggatggatggcaggaggggtgggtgaagggatgggggctgaggatagatggcaggaggggtgggtgaagggatgggggctgtggatgggtggcaggaggggtgggtgaagggaaagaaggtctgggtgaggcttgggggacggggatgccaggcacttggatctcagggctagaagggtcagaccgaggctggggagtgaggccgtgggctggtgttgggctggacgcagactcagctgtgtcctgggctgggtgctgggccctccttggcttttggtgattgtacagtcagaatgggagtgacccggagacccaggggcctgggatgagctcagaacggctagcagccacccctcctcgatgactctgttgaagggacagacacggttttcgggtgggggctgcgactggtggttctctcggcgcctttaaccttgcggctgagccggccccctctgggctcaggttcactggccatcagcccacagtagtgaccttgtgcccccttttcttgtctgcttcccttttcccacccagggcagggcgcagcccgagggaggctcaggcgctggcagagaaaaagctgggcctggtggagcgtgagtggcccgcggcctaggcgtggggctggaggacgttggtgtagtcgagggaggtctggggcctcccctgccgcgtggctgagaggaaccgctgcacctgaggggagggcgtgggtcagggcgctctgctggctctgcccaaccccctgccctggccgggcccctggaggtgggtgcccaccatgaggagcgtgatggcggcgctgtagctcacgctgagcaggaagagtgcggcgaagatgcagaggccggtccacgtccacggcgcctcgccctcggcctcctccacgcacacgtccagctctgggggacctggccagtcagccctcccggctccacagtggcagcgggggtgggggacagagccccctgctgctctcggcagtccctgctgctgtccggagtggcagagcaccctatccggggccctctgggactgcgcggagccgccagccagccctgagggtgggcacccaggtcccgagtcagtcaacggcccagagccaggccgaccactcctgacctctcgtccctgggcccccactctggccccattttccctctgttccttacggcttctctcctgacctctggttacctccactccgcctctctagaccccacgccctccccagagaaggacccaacccctcggcacaggagtggccgcctcactcagggccctcggaaggatgcgtgagctctgcggcctggctcccaagacctgggactcactgcatgggtgctctgaggggctgtcctggtgtggactatgagcccaggcctgtgggtgtccagagctgcctcctggccctaccccggcccggccccgcccaccagcctggtccctctggctcctgccctgagtcccctccactcccttccccaacaccgtgagctgcctgctggtcccgggtcatcagcaggtgcaggtccggcctcgggccctcacacctctttctgctgctccaggcccagagctgggtgcaggtgggctgggacgtgagagtgaagctgaatgtatggctgtgacggtgtgcagggactgtcttcagacatggaggggctttgtgctcatggggtgcccggtgcccgtgtttccgtgtggatttggtgggtgctgtgcccttggtgtgcatgaccggggggagcgtttggatctggggtgtcagatgcacatgtgggtttgaggtctgtgaggggcacgtagcctgctctggggttccggtgtgggtgagtgggggatggagcccacgcatccatcctgtgtttggctgtggggtgctgctgacagggtgacagggagggttggactggaggacaccacgtgagggcctctccatttctctctgggatccagcggcccaggtatggctcagaggaagggcttggcagtagcctcgctggaggcagggtgggaggcggagtgtgggccacgtgtgaccacgtgtggggtgtctatggcgccctggtggtggtacagggtgctgtggagttgctatggggcctagtgtgtgcacagctgtgccttgagtgaggcgtgagtgggcgagactgggtgtgtgaggctggcgatcccctggaggccgattcaggatggaccaaggggcggtggggggcagtaggagagggggcctggctgctgacctgggcctggtgtgcccacagggcggggtggcggaggctgcggggtgtgagtgggctcggctccactggccccggtgctggggccaggactcggcaaggtgggacagggcagagaggcgaacgccagtggcacagacttgggcgagggctgtcgggtcgtgtgtgtctgtgtgggggtttcacttagggctgtttttctacctggaggggcctgtgtgcccatctatacctgggggtgcaggggctcctgtccaggggggtagaagccaagcccccaagagagagggctgtcggggctcccttgccccttccctgaggacctcccctgggtctttggactccttggagggggtagaccgagagtgggggcagagagggcccggggtagctgtgatgagtccctgcagatacgctgtttgacaaataaccctgacacgaaggcagatggatgagtggcacctcagccctgcccacctcctcccaccacctctcctggggggactcagccctgcccacctcctcccactgcccctcctggggggcccattcctctgtgccaagatgcacctgcccacagccctgcccgctcccaagaacgggtgtaccctgggctctgagcaggcactgtttattgggggtagcttcctggggtcgttgcaacagtggacagaaggtctggccagccctccccactgcacagctggacggagccctgggagggagggaggcaggagtacgtcatttaccgggatttacagacaccgctcgctggacggtctgtgaggggctcgctgcctcatggactgcacggcagatgaactcatctttctgctcccactcggccctggtcacctccaggcggctgaagatgaagaagccggagcccttggtcttgcggggctgcgtcgtgctgtgccgggcgtccgggagctgcacctcgttgtgcagccactgcaccgagatgtcctcaggcatgaagttctggatcaggcaggtgagggtgcgcttgtcccggctccccagccactccggcgtcgcaaacgcatagacttccggggcagcacgcgggcctgtggccagacgtggggtcagcccaggccccgctcactcgctccctccctccccccacgaccccggcctgcccgtggctcaccgctggtcttggtcgtggaccgcacgagggccctgggcaggtgggggtgggtcaccctgcactggtaggtctccccttcgatccagtctcgggtgcccaccggcagggtggacgtgacggttaacgtgccattgcgctgcttctcctcctttctggtggagtggttcacaggcttcccactggcccgggaccaggtcaggttcacggtccacttgctgggtgccaggtccaccaccagacaggtgatcgtgggcgacttgcggatgaacaggtcgaacgggctgggccggcttaggtaggcgctcacccctctcgggttgaacccagtgtagtgtcagctgaacccagtgtagtctagccgagcccagctcagctgaacccagttgagaccaacccagctgagtccactcaggcgagcctagtttagcccagttcacgtgggcacagttcagcccagcccagctcatcccagctaaattcagatcaccccagcccaatttagttcaataatttaaggcctgctcactccagcttttaaccctgtccgtcgtcaggtctctcccccagcctagccctcctcagctcaatcccatttagctcagcccagcttactcagcccaaccagctaagcttggctcaggtctgtccagctcagcgcagccctgctgaactcaggccaggtcaggtaagctcagcaggtaataccccagcttggtctccttcagcccggatagtccacgagcacccattttatcctaagtagagaactgtagcttgtccctactcctgtgtcggcccagcttatttcaaccaagtccagtcaagtccaggtcagcctaattcagcttaactcaatcctggaccacccagggcaggccacctcagctcagcctgactttgccctgctccccagataagtccagctcagcccagctcagtccaccttagggcttaggataacccagctcaagcctagctcagctgagcctagctcatttccctctacccagtccactcactcaactcagctaaacccgcctggcccgggccagccccgatcgccctggctcaggacagcccagcttggccacctgtcctctaagggacagggtagccctctcagcccacccagctcgcctcagctcagtctgttaggcccgtctcagtctagtccactcagccaagcccccctcagtccacccagctcggacttgccaagatcagccagttgcgcagtggagctcaggacagctccctgctgccgcctccccaccctccctcccggctctgggttggctgtccctgtcctgggggtgacaggcagtctgcacccagcctagccctgcccagcatggggcctctgaccttcttagtcttgggcccagccaagattcccagccccctgccttctccaggtcggcgttaggctgtttctagctttcctgtgtccccatgcagggaagggacgtctggagtccatgcagtaactaagaagcttggttgatgctgtgagggtggcccaggagtcccctcgctgtcagggacccaggcagcctctccctcactgctgcctgggccggccccttgattggggctcccggtgggctgggatacctgaagcgccgggtcgtccatttggtgcctgtggctggtgtggcccgtccggctccctgtcgggttcctggacagctcccagatgatcagtaaccgtggttgttatttctgtgtcgggcagtggagcctgggtggggggagctctgcctcagtgctttcagctaaaaatggagtgggaacccctggaggcccgggccaccctggaagttcccttttctctctgttcttgggaattcgattgagcaacagcgggggctcaggtgaggctccttcactaccgatgcacaccgagtgctgggggaggttctcttctctctcaggccccagtgttggaggtgggcctggtgggaggtgattagatcatggggctggacccctcatgaatggcctagcaccatctcccaggtgatgagtgagttctccctcagttagtccctgtgacagctcgttgtttacaattctgggacgtgccacttcttttctcttgctccctcttgccatgtgacatgcctgctcccccttcgccttctgccatgattgcaatctccctgaggcctcaccagaagcagatgccagggccgtgtttcccttctgctcttctgctctcccccgcccttcccttcttcttgtcttttcaagacaagttctcactatgttgcccaggctggtctcaaacttctgagctcaagtgatcctcctgcttctgcctcccaaaatgctaggatgacaggtatgagccacagtgcctggcctaaacaccttttctttataaattactagcctcatgtatttttttttctagtaacacaaactaacacagaacattggtattgaggagtggaacattgctataaagatacctgaaaatgtggaagcagctttggaattaggtaacaggcagagaggttagaagaatttggaggactcagaagaagacaggaagatgagggaaagtttggaatttcttagagactattaaatggttgtcaccaaaatgctgatagacatatgcactgtgaaagccaggctgatgaaatctcagatggaaatgaggaacttattgggaactggagtaaaggtcacgcttgttaaatcctaagatacaacttggctgcattgtgttcatgccctagggatctgtggaagtttgaccttaagagtgatgacttagggcatctggggaagacatttctaagcagacgtttctaaggtgtgacctggttgcttctaacagtctagggtaagatatgggagcaaagaaatgacttaaagttggaacttatatttaaaagttgcaaatgaaaaaataaaatgctaatccaaggggattccaaagaaacctggaaaaccagttcaggccatgacaggaaggggagggtggtttggactccctcactataccctctccctgttggagcttaggctcagctgaccagtgttaacattaaaacagggagcttaagactgacaaagcagactctttgtagcaataaggtatcaaatcccaacctgactctggtatagcatcacatgacaggtggcaggcatggaaggaaattaaagtattttatcccagaatatgtttctctgacacattttggaagggccctgcaaagccgtctcttgtggaggaaatgtatattctgttgagaatctttttccctttccaggtctcttcctgattcaggagagatttatccaagagtctggcaccttttaggttctgataagagacattgaccatctcttctctctggaacgtggaggcttcgtctacataacaagaaccttggcttccacaacccccttatcttaagcattgcttttcgctgacttcaactttttagataatttaactttttcagccaatcgccaatcagaaaatcttcaaatccacctatgatttggaattccccactttgaattgtcctgcttttccaaaccaaaccaaaccaatgtatactttacatgtattgattgatgtctcatgtctccctaaaacataaaaccaggccgcaacccaagcaccttgcacacatgttctcaggaccttttgaggctgtgccacagttcatggctctcatatttggctcagaatcaatttttcaagtgttttatggagtttggcttttttcatcaacaaagggaagcagagcattaaaaatgtggaaaattcacagcctggccatatggtagaaaagaaaaggtattttcaggagacaaatataagtaggctatggagcagccagttgctagagagattagcataactaaaagagagctaagtgctcatatccagaacaaagggaagaaggccttgaaggcattttggaaatctctgaggtggtctttcccatcacaggcccagaggccaagagggaaaggatggttttgtgggccatggccatggccactgctgcctgtgcagccttgggacactgctctccacatcctggttcctctggctccagccttggctcaaagggccccaagtatagcttaggctgcttctttggagagtgcaagccactataagccttggtgacttccatctggtgttaagcctgtaggcccccagaatacaggagtgaaggaagcttggcatcttccctctagatttcagaaatgtatgagaaagcctaggtgcccagacagaagcctcctgccagcatggagccctcacagagaacctctactagagcagtgccaaagagaatgtggggttgaacccccatataatgtccccaccagggcactgcctagtggagctgtgggaagggggccactgtcctccagaccccagaatggtggatccactggcagtttgcaccctgaatctggaaaagccacaggcactcaactctatcatgtgagagaagccacaggggcaacatcctccaaagccacaagggtagagttttccaaggccttgggagcccaccccctgcaccaatgtgccctggatatgggacatgaagtcaaaggagattaccttggagctttaagatttaatgactgccctgctggatttctgacatatatggggcatgtagatcctttctttttgccaacttctcccttgtggaatgggaatgtttacccaatgtctgcactctcattgtattttgggagtcaataatttgtctttgatttcataggctgataggtggaagggagtcatcttcagatgagacttgggacttgggaaatttgggttgattctggaatgaggtaagactttgggggactgttgagaaggcatgattgtattttgcaacatgagatttgggggaccaggggtggaaggatatggtttatatatttctcccctccaaatctcatgttgtaatatgattcccagtgttggaagtggggcctggtaggaggtgattagatcaagggggaagatccctcatgaatgatttagaatcatccccttggtgatgagtgaattctcccccagtcagctcacacacagtctagttgtttaagtctggggccccccctcagcctcttgctcccattcttgccatgtggcatacctgctctcccttcaccttctgctatgactgtaagtttcctgaggtcctcgccagaagcagatgctggtgccatacttcctatacagcctgcagaactgtgagccaattgaacctctttccttcataagttactcagcctcaggtatttctttacagtaatgcaaatggacaaacacaggtggctcctgacacacccctcatcttctcctttgtcatcatatggcttacctccatgtgtgtctgtgtcctctcctcttatgaggacaccagtgtttggacttgggatccatccaaaatttagtatgatatcatctcaagtccttaacctaatttgtaaagaccccatttccaaataaggtcacattctgaggttccaggtgggcatacatttggccagggagatgccatcagcccaccacaccagcctacgcaggtacatttgcatatagcttagggttgacgtttctcatggaagtattacatccccctctggactccagttttgcatgttttagaatgcttcgccttctccagcaggatgaatctcttttcattttttagtatttttctctttcttctttggattggattaaaaagaattgatatactctattgatgcatctttaagttttctgttccttcttatgtcttgtccaatctgttattaaacttgggtaatgtttttctctttcttttcttttttaataaaatagagatggggtttcaccatgttgcccaggctggtctccaactcctgaggtcaagtgatccttccttgttggccttccaaagtgctaggattacaggtatgagccactgggcctggtcaaatgatgtttttcatttccgaatcatacttttagttctagaattttcattcgcttcttgtaactattttcagttttttatagagatacctcatctagtcactcatgataaccatattttcctttaagtctttgaacatatttaacataacttctttaaagtccttgtctgataactgtatctgcatctaggtcatcttggagttgatctccattgatccctttttcttttgactttggatcacattttcatgtttctttgcatacatagtaattttggatgtgtgcctgatgttgttgataacatgtggtacaggctatggggtttgcattctttcttagcagagcattaattgtttttttcaatgttagcaagcagttagcttgagttgactcaaactcccaagtctgcctgcctggcagttggcagtagctggaatctcagttctcttgaccttacaggtgttgctttctgctggaccctttggagttttccctacccatgcacacctaaggaatcggccagaggtttcactggagtttacttgcagattgtggggtttcccttcggtgaccttctcctttacggatatcttctcttcatttccagctgctctgaaaatgcagccctgcatcccactcctcaccaggagggctgcagtttcctgcttaaactctagctgcacccattacctgcactggggtgtgacttcagacgaatatttcacggaataatccttactagtgtttgcctacttctggtcatgtcccagtgcctgcaattggtgtgtgtgggtgttgtgtgtgcttacagcatttccagtgtttataattgccttctgccaaagggctggtctgatattagctgctccagcattattggaatcagaactactttctctcacgtggtttttcattttcatttccctgttgactagtgtggttcaacatgttttcatatgtttagtggctatttggatatcttctgtaaaacatctgttcaattctcttgcctattcctcattagattatttgatttttttttctcattggtttacaggggtcttctttatattatggatctgtttgtgtcagtcagttatatatgtttataggaaacattgagaaaaactgaaatggaccaaatgattacttggtgccttccatggaaagcaaggcatcgtcttgtagactcttccaagttattttattctatggagctctgcatcttttatttcctttgaactattttacacctctataagccaggggtccccaacccctgggtcatgcactggaaccagttcatggcctgttaggaactgggacacagagcaggaggtgaggggtgtgtgagcattcctgccggagctccacctcccgtcaggtcagtggcagcattagattctcataggagcgaaccctattgcgagctgcacattcccgggatctaagttgcatgctccttatgacaccctaatgcctaatgatctgaggtggaacagctttgtccccaaaccatcccccgatcctggtctgtggaaacattgtcttccatggaactggttcctggtgccaaaaatgttggggaccacggctctaagttgtacataattgatagcaatgcaaaaactctttgagttggtagaaatccaagttctcatctttgaaaggacaatgaattgctcctcctctgccagggaaaaggccagttttgcatctatctatgaactccttttagtattcctgaatcaattatgtaagtgtagtacttagaattccactttgaactggttgcaacaccttaattaatgagataaagagcatctctgaaatgtgtcgtcatatgtttatgtgagtcctgatcataatacttttaaaaaatgatctcttaactcgtgatttcttctccctcatggccccacccagccgcagtatccagggagcttagttttctgtggcccgggagggcaggagaaccggtgttgatggggagatctgaggttggccccaacttttccccacagctctgcttcaaggagtgccgtgggaaggcctcccaaccccacacctgtcctgttggccaaggcgagctccatgccatgtggcatctctgccgctggccacctggtgagtatctgttgaatagagaaatgtgcagcatctccacagagcctccagggcttctgtgctctccaaacatctctgggctcctggcaccctctcagggtatgatgtgttggtgtctgggttgggcccctgtccctgagggtaggactcaggcaaggacaaagctctggactcaaagaggtggtgtgggggtgagtgaaaagaacaggagctttgaggtcagaaatgcgggtttcagcctgcattgtccccatgagcaggggctgcagactcgccaagacctcagtttctaccatggtgagagagtgtcagagactgcagcacgtatttcaagtgtccagggacagcaggggtctgggttggaccagctctcctgaatactgagggtgcgatcttgaccattgtgaaaggaaaataaaatctcaggactccaaactcactatgccaaaatgaaccgttgaggtgggaagctgagtcatgaaaaaaaaaaaaagtcatgcgtttccttttgtttccaaactgatagcagcagcagataggccaggtctacccaggtggcctccctcaccctgagaatataaattaacagctggtcttcatgacatgggacaaaatgagacaagaaatcgtccctcctacccctgagacgaatgcatatttgacttcttcctctactctgtttatttgcttataaagtgtagatttagtgagcacaaggcgaatgcgtaattgctccctccacccctccttttcatgcaacgtggggggctcagtgagatgtaatcaaagcctcagaagaatgtgaccctcccctcttgcttttttctctttcatctttaccctcctccagcttttccccctttcaatattgaagcaggacgtagtgtgactgcatctgaggtcaggtgtggggtggtccatgtggacagtgaggaaggtggtccctgcccgtggtggtccgggtttcctgggagatggccagacgtgggtgctgaggggaagaggccggtgcagtcactggatggtagagagcatgtccattgtgctgagtgggctgggagggatccacagagaagacagtgtggctcaatagctagcaccggggacgggaacgtgggtgaagagcctggcacatggagtagctcaaggtgtgaggttgtgacccgcccagggagcctgtgcctgagtgtgctgggtgggtgctggggttgcaaacattcgtgtgcctgtgaggcccgtgtgtgtatgtgtgtgtcacgtgtccccatgcatggcaggcatcgtcgcgtgtcccccacgcgtggcaggcattgttgtgtggccactatgcatggcaggcattgtcgtgtgtcccccgtgcgtggcagcattgtcgcgtggcccccgttcgtggcaggcatgtgcagcctgagtaccatgccggatggggtgttctgtcttctccaggcccggccctgccgtgtgagcagggagcttccccatgggactgatgttctgtctcctccaggcctggccctgtcctgccatgttagcagcgagcttggccatgggagtggtgggcacaggcgtggctgtgccgggcctcactggctggactcggtggggacaccataccccttgctgagtgtgggtagcagaggggtcgaggtgccttctgggaggtggtcgggcagaggcagggttgggagtgtgtggggagatgggtgttcagctaggctccttccctgtggaggggctcagctgaaacctgggctctcactcccctcacccctgcctccccagcatcctccctctgcccgtctcttcagcctgcctcggacgccgaggtcacagcctcgctctgtctcctcacaaggccacgtggtggcaggtccttcctcctgtctaaccagagtcctgcttgctgctctgcaagcccacttgggtcacgtggggcaggggcacctggaagggtgggcttcgtggactcaagggccaccaattcctccaggtcaacatgctcagatggttccattctcccccttcccttggccacagagacctctgtatcctggggtgaccacaaatgtcacaacacaagaatcacaccaggaacgtcacaccatgtcacactggggaaaagaaagatcagactgttactgtgcctatgtagaaaaggaacacataagaaactccattttgatctgtacaaagaaaaattgttctgctttgagacgctgttaacctgtaactttagccccaacactgtgctcacagaaacctgtgctgcatggaatcaaggtttaaggggtttagggctgcgcaggacgtgcctggttcacgatacgtttgcaggcagtgtgcttggtagaagtcatcgccattctccattctctgttaactaggcacagaatacgctgcggaaagctgaagggacctctgccggagaaagcctaggtattgtcccagtttctcctcactgagacagcctgagatatggcctcatggcaagggaaagacctgactgtcccccagcctgacacctgtaaagggtctgtgctgaggaggattggtaaaagaggaaggcctctttacggttgagataagaagaaggcctctgtttcctgcacgtccctgggaatggaatgtctgggctttacacccaccattcattctattctgaggtaggagaaaaccgccctaaggctggagacaagatatgctagcggtgatacggctctgttactcttcactacactgagatgtttgggtaaagagaaacataaatctagtctatgtgtacatcccagcacggtaccttccctgggagttatttatgatgcagattcctttactcacatgttttcctgctgaccttctccccatcatcaccctgttcacgctgttctcctgccgcactccccgtatggagatagtgaaaatagtcatcaataaatactgagggaacccagagaccggtgccggtgcaggtcctcgcgtgctgagtgtgccggtcccctgggctcactgttctttctctgcactttgtctctgtgtcttatttcttttctcagtctcgtgtttccacctgatgagaaatacccacagctgtggagggcgaggccctcttcatcacaccacatcacactatgtcacactagggatgtcacacatcacaccattaactcatcacactggggatgtcgtaccgggtcacaccccatcatgccacatcacaccgtgtcacaccgcatcacatcacagcaaggatgtggcaccctgacacagcacgtcacaggtcacatcatgtcacaccacacctcatcacaccccacaccaccacacccgtcaaacgacatcataccccattaccccaaggatgttacgccacatcacatcatgtcacaccataccacataatctcataccgcatcataccagggatgtcatacccatcacactctgtcacaccacatcacatcatgtccaacaccacctcacaccagggacattataccatgtcacaacacctcacaccatgtcataccacctcacaccagggacattacaccatgtcacaacacctcacaccatgtcacaccacatctcaccagggatgtcacactcggtcacaccacatcacactatgtccaaccatgtagtccaacaccacatcacacaaaggacatcacgccacatcacaccacatcacaccagggatgtcaccctgtcataggacatcacaccacatcacatgatgtcatgctacatcacagcatgggctgctgggggcgtgcaggggcagccttgctggagagttgagggagggtcctggggctgggcatggtgttcccgcaggagggctgaccctctggaggatgctcggtcccaggtagaaagtgggaggtgggccccgggtggctcagggaggggcccaatttccccaggggaacctggtccaggcgccaggccctgcaggggcaggagctgcaggaagcatctgcttcttcccaactcagcctgctcagtgcacggaatgacccggagcccggcaccgtcctgggtctcctttccttatcctggccaggccgtccatcctcagacagtggactggagcccaccccaccagggcacccggaggcccgtagggccccttgaagggcagagggtggagagctgtccagcagggtccctgagggctggcaccttctctggacaaagctctcctgcatctctgggacgccatccttgggcttgggatagagccggtgatgcagcagctgcccgccctgcaccccaggtgctgtctccctcaccccccgcggggctgcagcagcgtgtcctgagagttaaagggctgggcttcagcacccagttcaggccaggccccctggagcccaccctccagcagcgagccttcccacggcatggcagggtccgggctctggggatttcatccccaactctgtgtttggtgaagctccagctgctcgatgccacacaaacgaatccaaccactcctccttcctgggtgagatggtctctctcctgccacaggcaactccgacggcatttcgcagccaccgcagccaccgcagccactgcagtaacaagaccctgtccttgactgagttccagccaggctcctcggagcctctccactcggcctcaaccttggcttgtaaagacttgagcagacactaacagtttctaacagcttctggccgtacccctaggccgacccctgccccgtcaacacctgcctgagaaagctccgtgcaccagaactcaccgtttggaccaaccccgacctccctttctcagggtatctgctgagagggccgcaaccacacgaccttctatccgttcctgatgtctgtgcatttcctgtgacccaggagggtctttctcgggacctgagagccactccctgaagtgtcccctttgtgaaggatggggcctgtgtctccaggctctgggaggacagaatcctgacctcaacagtggccggcacggacacagcgggtcccatcccggggacgctgaccagcgctgggaaacttttcccttccccaacgactgagccccgagcacccaccctgctccccctaccacctccctttacaaggctgtggcctctgcacagatgaaggtgagtccaggtcatgccggactctttcttccgttgcaatagttatttctgttgagaatccgtccttgctacatgacctagtgcccagggggatgctgagacaggatgaatgtgttttgcatgtgagaagaacatgaattttgggggccagagtctggactgtgatgggttaaatcgtggcccctacaaattcatatattcaagtcttaatccctggcctcacaatgtgactatttggagatggggtctttacagaggtcattaagttcatagggggtcactaatctaatccgatgtgtgttctaagaagagaagcttaggacacgggcacacagaggtatggccatgtgaggaccagggaggagacggtgtctacaagccaaggagagagggcttgagagaaaccagccctgcctgcatcctgatctcagattcctggtctctaggcctgggaggatccatgtctgccgtgggagctgccccgctgtggtcctgagctgacgcacacagatctgacacccacctctcgcttcggaccatggttggttctggaaggccctccctgtggctctgcctggccagcctgagccagctcccagcctcgacccagctttccctggaggccctgtcccccgcagagtgaccagggcaggcagcaccgtgcccagcaggaggagaaactgcatccatgtagaaaagaggagaagccccgggggtccatgtagtgacaggggccagggagggtcgctcgggcaatgcgtgtggctgcaggaggcggggggcgtatgcagggagcccccgaggtgcagctggaccagcctcctcctgaccgtgttttccaccgggggcaggaggcgcgtggacacaggaaggcggctcccatcacgaagtacaagacttaaaaaggatattttattgtcatcacaaaagaaacatcaaagacaattaatgagctttagaaaatttaaaagaagaagaaaagctaccaaagctgaaatggtggcacctccttcgagtgagcccaggagtcctccctgacggccgaggcaggcgctggccgcactcccgctcgagtctcccttcctgtctgcagattctgcgtgacagtcacggaacggcgtgatgggggcagcagagcgtgggggcctctgtccagcactcgtggccagcagccctgctttcgcaagaacacgggcaccctctttgtcgtcttgcctctccacctggtgcccccagagtggctgcttgttcctgctgcacgtgacccggggctggacgccagcctctgtgatgagttctggctgtgtccacgctcctggctctcccggtgtccctccacctctctccccgatgctcctgggcctcctctgtcctcaggccccaccaaggctgagtcttgcccgcctgggacctggtcaccagccttctctgggaggcctgtctgggcagatgcccagcccttccttgggctatcctcacccttgcactgtggggctcctgcagcggccacatggcccaggctcttctctgagtgatctcggtggactggagtgggtgggaggtggcagtgtcctgggcctggccccttctctccccagtgcggactctggggctggctgtccctgcgggtccagttccacccgagaatccagcagtgtgggcaggcagccaaggggtggtgctggcactgagactgttcccaggagccagagagcagcgttctttgcttgaaatcagaacaacctcattcctcatgtcaggagttcacgggagtgcccggaatggaggctggctggctgcgggctgggaggaaggccgtctgagtgagccttcgcagctctcggaagcctccccaacagggcctgatggtgctgtggcttccctaccttggcggctgacgctcccactcaccatctggaaaccacgcctgtgttcaggaggctggcgtggacggggttggctccagggcgaggtcctgcctgggtgggggcctgggataccggtcactgcctccttttgtgtgagcaccttgtggtccggagggcaaggacgtcctgctgaggggacacctggcccccagtgccctgcatgcaccaagcagcggaggtctggggtagacctgctatgcacagggtctggaaggggggcgtgtcaggtgtgtcagggtcagagggcaactgcgaggccagagagtcatggggttgagggcggtgaggtcgggggcaggtgtggcctgggtggtggctgagcatggcccatggctggtgtgtggggtctgggcggccctggacaccccgcagagggtggccctaggccccctgtccgatcatgttcctgtagtcggggatgatggtctgcttcaggtccaccaccgaggagaagatccacttcacctgtaggcaaggcacagcacaggggtgagcgaggccacagccctgcccccgagccccacccacccctcagggcactgaggccacctctctgcccccaaggcccacccacccgtcagtccacgcaggccacagccctgcccctgaggcccatccggcccctcatgccacccaggtgccatggcctcaccactgcctgctctgaggcttggtgatagagagcagagccagggcaccaacagcatgtggacagcacagaagacagcgtcagggacaggtggggacagcgtgggggacagtgtcagacacaggtgaggacagtgtgggggacagtgtcagggacaggtggagacagagtgtggaagagtgttggggacagttaaggacagcatggaggagagtgttggggagagatggggacagtgtcagggagaggtggggactgtgtggaggacagcatcagggacaggtggggacagcatgggggacagtggtgcatacaggaggggacggtgtgggggacagtgtcagggattataggggacagagtgggagacagtgtcagggaccggtggagaccatgtgggggacaggtggggacagcatgggggacagtgtcagggataggaggggacaggaaacagtggggacattgtcagggacaggggagatagcatgggggacagtgttggggacatgggggacagcatggaggacagtgttggggactggtggggacagcatgggggacagtgtaggagacaggttgggacaggatggaggatagtgttggggacaggtggggacagtgtgggggacagtgtcagggacaggaggggagagcgtggagaacagtgtccgggacaggtggggacagcatgggggacagtatcagggacaggtggggagagtgtgggggacagtgttggactggtaggtacagcccgggggacagcatcggggacaggtggggactgcatgggggacaatatcagggacaggtggggacatggaggagagtgttggggacaggtggggacagcatgggggactgtgttgaggacaggtggggacagcttgggggacagtggtgcatacgggaggggacggcgtgggggacagtgtcagggattataggggacagagtgggagacagtgtcagggacaggtggggacagcatggcggacagtgtcagggataggagggaacaggaggaaacagtggggacattgtcggggacaggggggatagcgtgggggacagtgttggggacaggtggggacagtgtggaggaaagttttggggactggtggggacagcatgggggacagtgtaggggacaggtggggacaggaggggacagcatggaggatagtgttggggacaggtggggacagtgtgggggacagtgtcggggacaggaggggacagcgtgggggacagtgtcagggacaggtggggacagcatgggggacagtgttgtactggtaggtacagcctgggggacagcattggggacaggtggagactgcatgggggacaatatcagggacaggtggggacagcatggaggagagtgttggggacaggtggggacagcatgggggacagtgttgaggacaggtggggacaacgtggggtacagtgtcggagatgggtggggacagcatggaggaaagtgtcgggtttaggtaagaacaacgtggaggagagtgtcggggacaggtggggacagtgtgggggatattgtcacggacaggtggggacagcatgtgggacagggtttcatacaggaggggacagcatgggggacagtgccaggtactgtaggggacagcgtgggggacagggccaggaactataggggacagagtgggggatggtgtcagggacaggtggggaaagcatgggggacagtgtcagggacaggtggaaactgtgggggacagtgttggggacaaagggggacagggtgggggacagtgttggggacagatggggacagcatgggggacagtgtcggggacatgtggggagagcctgggggacactgttggacaggtgggggcagcattggggacaatgtcagggacagtttgtgagagcatgggggacagcgtcagggacaggtggggacagcctgtgggacagtgtcagagacagtttgtgacagcatgggggacaatgtcaaggacagctggggacaacgtgcggccgaccttgaagaaggtgacggtggcactgtagcacacgcttaacaggaagagtgtgatgaagatggtgatggtcgtccacagcccgtccagctccccgtcctgcgcctccgcacagctctcctccagttgcagctctggacaggaagggggtggtcagtgctgtgtccccctgggcttgggcctctgggggtgattccctctgtggcaggacccaggatgtagggcccggccgggatgggccaacaatgtcctgaggtcagctccccacagctgcccgccctgggcaccagctttggccccggggctcagccagacacccggccctagatagcgacctggccctcagcaggacccgctccccgtctcccgtgtccctccctgaggcccagagggcaggaggatggtgaagcccacacctcatgtgaccccagctgcagggaagggcggcactgggaagtgggccagggccagggacgtgacgtggtgtgtgatcccctgtgtgtgtgtggcggctgcaggggcaccttgtgagaggagggctgggtttgtctgagcaggtcagcatgtggagaagctgccgagcggctcgtgggccttgaggtgccgcgtggggctcgtgggggcctgtgtccgaggagtgttcacgtgtgcgaggaccttgctctggtctgggtgctgtgcggttcgcccgggtgaggctccgtgtgtgaggcgtgcacgtgtgtgtgtggtggccgtgtggccggccaacctcagtgcggggtttgttgaacgggtctgggctgagtgtgtgtgtgggcatctggaccagtctctccacagggcccgagagtgcatgtccccggagtcggttgtgtccccatgcgggtgcgaggctgggcagggctgccaggggttagtgccgtgggggtagatgggtgagggagggcctgtccctacgcacatggactaggcatgcccccgagtgggcatgcgggtcggaggacagggcgctcacagaacaggacagtctcctacagaggcaggggctgtgtgtctgtccccaggggctcctagggcttctcgtggcccagcccagggcagctgctgctggagggagggccacgctggcaaatcccccaccctgccgagggcagcccctggctgagccccaccctaggcggcccaggcacacctgcacagcctgggccagtgtggggacagtgggacccactctgcctccctcatgccactcaggcctcagactcggcctgacccgtggaaagaaccatcacagtctcgcaggggcccagggaagcgctgggtgctttatttccatgctgggtgcctgggaagtatgtacacggggtacgtgccaagcatcctcgcgcgaccccgagagcctggggagcgggggcttgccggccgtggcactcatttacccggagacagggagaggctcttctgtgtgtagtggttgtgcagagcctcatgcatcacggagcatgagaagacgttcccctgctgccacctgctcttgtccacggtgagcttgctgtagaggaagaaggagccgtcggagtccagcacgggaggcgtggtcttgtagttgttctccggctgcccattgctctcccactccacggcgatgtcgctgggatagaagcctttgaccaggcaggtcaggctgacctggttcttggtcagctcatcccgggatgggggcagggtgtacacctgtggttctcggggctgccctgtagggacagaggttggtacagcggtcactctcagggcagagggtgggccgagccggcctctgtccatgtggccctcgcaccccacgggtcccacctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggggaagaggaagactgacggtccccccaggagttcaggtgctgaggaagagatggaggtggacgtgtcagcacccggctggggcctgtccctggatgcaggctactctagggcacctgtcccgccttgagctggagggcgaggcctgggctggcttacctgggcacggtgggcatgtgtgagttttgtcacaagatttgggctctgcagagagaagattgggagttactggaatctgggaggagagaaggtgtccgagctgagggagtggagagtttggcctttggggtgggcttaggtcaggggcagggtcctcccggatatggctcttggcaggtctgagcccagcacctgcccctttgtgtgcagggcctgggttaggggcacctagcctgtgcctgcccagagcctggggaaaaagccagaagaccctctccctgagcatgagtggggcgggcagaggcctccgggtgaagaggcagacggggcctgccttgctgccctggactggggctgcatagccgggatgcgtccaggcaggagcgctgagcctggcttccagcagacaccctccctccctgtgctggcctctcaccaactttcttgtccaccttggtgttgctgggcttgtgattcacgttgcagatgtaggtctgggtgcccaagctgctggagggcacggtcaccacgctgctgagggagtagagtcctgaggactgtaggacagccgggaaggtgtgcacgccgctggtcagggcgcctgagttccacgacaccgtcaccggttcggggaagtagtccttgaccaggcagcccagggctgctgtgcccccagaggtgctcttggaggagggtgccagggggaagaccgatgggcccttggtggaggctgcaagagaggtggtgccatgtgaccgcggtgtgggacagagctgggcccagggcgcagaggcccctgggttcttaactgtccgcgaggttcagcgtccagtgtctgggctcacgggcattgggtgtgcgcctggctggcgccacctgcgtcaccttagcccaccccctgccccaaagccaaggtcaggcccggcctgccccagaaagcttgcaggaccggtggccctgtggtgcccttctgcaggcacccctgcagcctaggaggcggggctcggcagccaggtcagcgctctgtgtctgccgggagtcagcacagtccagggcctctagcttggcctcagctctggccatcggtgccacctcagggacggctcatgcccattggccccactccagccttttatgggtgcctggcttgaccagtggacactgttctcagatggcttctcgtgggtcccccgagccccctgaagcccctgaccctgccgccccagcgtggccctcccctagtgagttggcctgacttgcccagggccctggtcatagcctgccctctgccctccaaggcccttttcttctgtgcagcagaggggccagacactgcatagggtcggcgcccttcagccccagggccccggaaccccctgccttggaatagcctcctggagcctcctcctcagcctctcccctcctttccccttagccccagtgtgcagcagcccaggtcagggccctgagtgcctggatgccccctgcctcccagtgtcctgcattacttctggaggctcagtcaccacaccgtcaccctcccagccctggcctggccttctcggccaccagcccacctcctccctctctccagagcttcccccggcaaggtccctgctgggctcaacccaggccccccagcacaggtaggagccttgcacctgcccttggccctccccaccctgcatggtgccaggacccccaggccacagggaggccccatttctctctgccgctggcccagtggccctggagtcccactgcaggtggggtgtgcccctgacctctgaggaggctaagcgccctgccctcagccaggccatcccctctgctcagccccagggccccgctcaccaccccttcccctcacctgcaccacaggctctggctgactctgcccaggccctgaatgggcccctctggctgccctctgctgctacactgccctgcaccacctccactcagcttcattgtgctggtggccctggctcctggcagcccatcttgctccttctggggcgccagcctcagaggccttcctgcccagggtccgctgggaccagccgtgggaccctcctggtctcaagcacacgttccccctgcagccacacctgcccctgcctgagagctcagccctgagccctggaacgccttcccttctccatcccagctcgcccttgccaactgctcagtgggatggactcacactcccttcccggcaccaggaggctgcactgcactttcaccagccctcagctgtctgttgccagcaactacccagctcctgccaaagtctaggagctgagtgatgcctcccaccagccctgctcacctgtggctgccttgccctgagctctagtgcctgtcccctgctcgtcctgcctcccaccggccctgctgacctgcggctgctctgccctggtcccctgagctccagtgcctgccccctgctcctcctgccccccacctgcccctgctcacctgcggctgctctgccctggtcccctgagctccagtgcctgccccctgctcctcctgccccccacctgcccctgctcacctgcggctgctctgccctggtcccctgagctccagtgcctgccccctgctcctcctgccccccacctgcccctgctcacctgcggctgctctgccctggtcccctgagctccagtgcctgacccctgctcctcctgccccccacctgcacctgctcacctgcggctgctctgccctggtcccctgagctccaggagctgccccctgctcctcctgccccccacctgcccctgttcacctgcgactgctctgccctggtcccctgagctccaggagctgccccttgctactcctgccccccacctgcccctgttcacctgcgactgctctgccctggtcccctgagctccagtgcctgccccctgctcctcctgcaccccacctgcccctgctcacctgcggctgctctgccctggtcccctgagctccaggagctgccccctgctcctcctgccccccacctgcacctgctcacctgcggctgctctgccctggtcccctgagctccaggagctgccccttgctcctcctgcccctgttcacctgcgactgctctgccctggtcccctgagctccaggagctgctccttgctcctcctgccccccacctgcccctgttcacctgcgactgctctgccctggtcccctgagctccaggagctgccccttgctcctcctgcttcccaccagcccctgctcacctgcggatgatcttccctggctctctgagctccaggggctgcccacctgctcctcctgcttcccaccggccctgctcacctgcagctgctctgccctggctccctgaggctgagcctcagtcctgctcaccttctgatgctctccccttgtcccctgagctccaggggctgacccctgatctttctgcttcctacctgcccctgctcacctgtggctgctctgccctgatcccctgagctccaggagctgcctcctgctcttcctgcctcccacctgcccctgctcacctgcagatctgccctggctctctgaggtccaggggctgccccctgctcgcccacctcccaccagccatgctgacgttgtgatgctctgccctggtctcctgaggtccaggggctgtcccctgcttattctgcctcccacctgccccttctcacctgaggctcttctgccctggtgctctgagctccaaaagctgcccacttgctcctcctgcttcctaccagcccctgctctcctgtggatgatctgccctggctctctgagctccaggggctgcccacctgctccccatgcttcccacctgcccctgctgacctgcggctgctctgccttggctccctgagctccaggagcttccccctgctcatcctgccccccactggcccctgttcaccttcagatgccctccctggtcccctgaagtccaggagctgccccctgttcctcccgcctcccaccagcccgtgctcacctgcggctgctctgccctggtcccctgagttccaggggctgccccctgctcgcccacctcccactagccatgctcacctcctgatgctctgtcctggtcccctgagctccaggggctgccccctgcttgcccatctcccactagccatgctcaccttctgatgctctgccctggtcccctgagctccagggtcttccccctgctcatcctgccgcccaccagcccctgctcacctgaggctgctctgccctggtcccctgagctccaggaggtgccccctgctccttctgcccccacctgccctgctcacctgtggctgcttggtcctggtccctgagctccaatgcctgctccctgctcactctgccctccctcaacccgggcagcaatgtcactcaggtcactgttgcccccctgcctgtcctggcaccctctgtccaggtttgggctgtttttctgccctcatttttgattttgcagcacttggcgtgttccctatgctgtggagcagccccagtgtccagtcaggtctccccaacagagccccttgcccttgcccatgtgcccctcctgaatgagctcccggatcctcctgtccctgcactgctcctgctctggaagcctctctggaacctcagctcctcagtggcctctgctctgctgggtcagttccctgaacgcacggagcctcagcccttcccctcgccccaggcctgctgcactctgggcctttctgggcctccctggactcttcccttctcccgcccgtgcactcagcacagctctcccctcctctccactgctgaccacagccctgctccccgccagcaggtgccccaaccccatcagctggctctgagcccagcccctgtgcctcccctgtccctgcctctgcctctgggctccttggcttccaccctcctgtcctgctgccacactcaccctccctgctctgctcccggctcacctgctgtccttggtcctggctgagaggagggccccacggccagcactgctgaccctgccctgggctccggtgatgctgccggcctggacaagcccctccgttcacctggggcctctcctcctccctcgctctgctgcctcctgagctcaggtcggtcgtgcccatcctggcatcaccccacggccggctctgccgcatccagtcatgttcctcgtgctcccagcccggtcgtcctggaggcctcagtcagcctctggtgtgtcctgccctgttggcttggaagcccctgcccacggtccccgtcgtctcgcactgggtgggcatcggtgcctgaaggctgcccacctcccccgtgctggctccgcttgggcctccatgtggggccggcctcgaccccatgtctccccagcctcttggagcctgttcagcatctcaggtccaggagcgcccacggctgcccccaggctctgtcctcctcccgagcctgtgcccctgccctgtgctgaccccactcaccgaggtgggggtctcagcccttcctgttctggcgaggtacatgtgggcagccccgcccctgccgtcagccgctatttgtcttcctaggaaatcacagctcggcccccaggtccccaggtgtgtgaactccacgctgcaaagactaagaacaggattgaaaccggcggcaccacttacttcctgaagttcccttttcttctggtggtttctgggtcagagggcgagggggagtccagacacagccgaggctgcctcatgggtgtgtggggatgggggtggtggctgcccccatactcccccgtactcacgggagaaggtggggagcccagaccttgtgtgctgctcttttctctgtctctgagtccctggggctggactgatactggcagcgattatgaccattctgcccgtgatctcagcctctcaatacctgggcctctcatctgaagcttctggcccccactaggccctggtggctgctttggcctgggcgtgtctccagctggctctgactcatggtgcagggaggggagtgtgagttcatcctgctgagcagctggcaaaggcgagctgggatggagatgggaaggcattccaaggctcagggctgagctcacaggcaggggcaggtctggctgcagggagaacgtgtgtgcttgagaccaggagggtcccagggctggccaagtggaccctgcacaggaaggcctctgaggctggtgctccagaaggaacaagatgggctgccaggagccagggccaccagctgtgctcctgggggccgaggggacttgggacaggtggatgaacacactgaagctgagtggaggtggtgcagggcagtgtagcagcagaggggagccagaggggcccattcagggcctgggcagagttggccagagcctgtggtgcaggtgaggggaaggggttgggggcagggccctggggctgagcagacgggatagcctggctagggacaggacacttaacttcctcagaggtcaggggcacacccgagttgcagtgggactccagggccactggactacaagcagagagagaaatggggcctccctggggaccgggggatgctggcaccatgcagggtggggaggtccaagggcaggtgctaggctcctacctgtgctgggggagcctggactgagatcaggagggaccttgccaggccgaagctctagagagagggaggagctgggcaaggacgattgtggaggtgggaggtagcagggaacgggatgaggatagagggactgggcagacagaaaacccaaggaggtgtcgcacaggaagtgtccagaatggaataggaattgtgcggaatggaaaaggaagcatccagcatggaacaggaagcatccagaatggaactggaagcatccagagtcaaacaaaaaacatccagcatggaacaggaagcatccaggatgtaacagaaagcatccagcatggaacaggaaatgtccagcatggaacaggaagcatccagaatggaataggaagcatccagagtggaacaagaaacatccaacatggaacaggaagcatccagaatggaaaaggaagcatccagcatggaacaggaagcatgcagagtggaacaggaaacgtccaccatggaacaggaagcatccagagtggaacaggaagcatgcagagtggaacaggaaatgtccagcatggaacaggaagcatccagcatggaacaggaagcatccagcatggaacagggagcatccagagtggaacaggaaatgtccagcatggaacaggaagcatccaggatggaacaggaagcatccagtgtggaacaggaagcatccagagtgtaacaggaaacatccagcgtggaacaggaagcatccagtgtggaacaggaagcatccagcgtggaagaggaagcgtccagcatggaacgggaagcgtccagaatgggcactttgaagggaaatcatgtccctcccactaaatgtgctctccacaaggacccggcctgcccttgtgaccctgctggatccctgagctggcaccagccctgccctcagagagaatgtccaggagacaggtggaggtgcacgtgtgggtccctggggaaatccatcctccagccgcaggctcccagtcggctcccagcctctcgttccagcttcaccccatggagctcataatgggctcaacctcccaggctgggggaggacggagtgaggggtccccgcactgcccatggcacacccagggggctggggagtctgcactgggctggggcagggaggcctcgtgcagcctgtggggctggcagctcaggacaacactcgtatccgttaactgtggccctggcaacacagcaccccagactgcgtggcttaaacaacagacgtttattccgtcctggttctggaggccgggcatctgggatggaggcctcggtggggctggcacctctgtgtcatgggagactctgtcccaggctctctccctgctgctgggctttgccggccgtctctgctgctcttggcttatggaagcagcaccatcttcacagggcgttctccccacgtgctgtctgtgcccagattcccccttttcatgaggacagcagtcatattggatcagaggcttgcgctactccagggtgacctcatctgaacttgattgcagctgcaaagactgtttccaaacaaggtcacattctgtggtcctgggggttaggacttcaacacatgaatttataggggacacattttaacccatgacagtttgccctccgctccccccataatcatgtccttctcacacgcaaaatccctgcaccccatagcaacatctccaagatggctaaccccttccagcaccaactcttagtccacaatgtcagagaaacatcacctgcatcaagtgtggcagaaacccagggtgagattaggagagaaaccacagcggggtggcgagcctcctgccccctccggcccaggtgaggccgtgtgcactgtgtgggtgtgcctggggctccacttgcccctcccatgtacctgctcattttccccaggctgtgggcatttggggcaggggcctcagtgcctggtcggctctctcccggttctatccaatgccccaagctgtgctgggctggaggggccgggcagggtgggcccccaggaaggaggatggcatcccaggtggggctccatctctggcctctgccagccttgagatccccggtcgtctgtgtctccctcctggggcccagcaggcctgctcagctctgagccccatgtccgttctcaccctgctctgcttttccttggggtgctggccctgccctggcctccagaaatggcccctgcccccaccccttcctcaggggctgggctgttcctctcctgccaggcgtgtgcccacctaggcccaataggcacagtgcctacggcccctcctgccctcttctggccttcacgcccagccatgccggcagcccgcctcagtggcctgggccttcgccagcgcctggctctgtgtccagctgccactcctgtggccccgtggtgctgcccctttccctcagtgacgggggctggactgcctgggaatgggctgtgtctcagctgcacacacctgtgtgtgtcagtgtgcgcatgggagtgtgtgtgtgtgctgggggtatgtgcaggaatgcttgtgtctgggggcagggggagcatctgccttcctgccccaggcctggaatggccatgccagggtgggtgggagcagcgcgtgcgaggacagtgctgctttgacgtctgcgtgtggctggtgggggtgggaggacgtggtgtggcacgagtctcgggctccccatctccatccagctgatcccggatggctgcgctcctgagggtttagagcagcccagggggtcaggaggctgttgggacgctggaggcaagcgctggcagggatgcgggtgggctggccaggcagcgtggccagggggcttcgagccggggcagtgaaccatcccccaactttttaaagttttaaaagtcatatttacgcaagtgtagtttacattcagtataatccatcctgtgacatgtgagtttcaacaaatgcacactcatgcaaccaccaccgtaatccagatgaacagttgcaagaagatgtagaatctctccaaatattccaccaggcccctttgcaatcaacgcctccctgatggccaggaatccattgatctgcattctgtcagaagattcagagtttatcattaaaatgatctattatggaaaatattataagcatacaaaacacaaaaccaagttttaaaaagtgaggtatttcttaaaagtttagtatacaaacaaaatgaaggtaccttcacattttactacagatgtgcagatagttttcttgttgcacagagataaggcagaattaagtcagaataatgttctaaaactgacctccggaagaacttgtcttagtcatttctttgcagagtatgtgaaccaagattcgggtttggtctttggtgttagcactgtgtcaaggatcagatagaaagtacaaatggaggggcccctttctgaggccaggccccactgtcggggcatgtggggtgaccaggggccaataccagctgaggctaagaggctgctctcagaagggtaggtttccaggtgtctcttgaaccctttgttcagaaccaggacatgtgtggctgggcagcagccttcagaccccccacaggctggtgcccggtgcccacagccctctgttgggttgtcaggcccctgcacccgtggtggggtgttgggctccagagttccctgggaccagctgatctcttgtccttggttttggcccaaatgcaagcccctggtctcctccaagtaacttcctttccccagggctgtccaggccccaccgctgcctgttccttcccagggcctcccgcaagtcccgatgctgacgcctctctgcccacctagtttgtggccgccgcctccagctctgtgtctgcctcccagcgagggagccgtggttgattatctcgtgagtgtctgcccttctgaagggtacagtgtgaagtctcatcagtctcacttcaatgcctaagcacctcttcagaaaccagggagtcatccgggtttctccatctttaaccatgttttctaaaggttttcttggcaatttcctggccatttgcaagacaggattttttggttgccaacttccaattagctttaaacttgccacgatctcccaggtcatcccgtccatcgatgatgcttattacattcttcctgatttccatgtggccaaattcaatagttatttaccccaggcttgtattttggaggctaaagaactctgttaccagctatatccgtgctgtggctgccgtaacaaaatatcacaaatgtggcttaaaacaacaaaaattttttcagagttctgggagtcagaaatctgagatcaaggtgttggtggctgtctctgagtgctccaggggaggaccgtccacctcttccagcttcctgtggtgcaatagtttggatgtgcgtctctccaaatttcatgttgagatgtgattcccagtgttggaggtgggcctggtgggaggtgattagatcatggggctggacccctcatgaatggcctagcaccatctcccaggtgatgagcgagttctccctcagttagtccctgtgacagctggttgtttaaaagtctgggacgtgccactttcttctcttgctccctcttgccatgtgacatgcctgctcccccttcgccttctgctgtgattgcaatctccctgaggcctcgccagaagcagatgccagggccgtgtttccagaacggcctgcagaaatatgaactaattaaacctcccttccttccttctcttctgccttccctgcccttcccttctgccctgcccttctgcccttctgctcttccccacccttcccttcttcttgtcttttcaagacaagttctcactatgttgcccaggttggtctcaaacttctgagctcaagtgatcctcctgcctctgcctcccaaaatgctaggatgacaggtatgagccacagtgcctggcctaaacctcttttctttataaattactagcctcatgtatttttttttctagtaacacaaactaacacagaaatttggtattgaggagtggaacattgctataaagatacctgaaaatttggaagcagctttggaatcaggtaacaggcagagaagttagaagaatttggaggactcagaagaagacaggaagatgagggaaagtttggaatttcttagagactgattaaatggttgtcaccaaaatgctgatagacatatggactgtgaaagccaggctgatgaaatctcagatggaaatgaggaacttattgggaactggagtaaaggtcacgcttgttaaatcctaagaaacaacttggctgcattgtattcatgccctagggatctgtggaagtttgaccttaagagtgatgacttaggacatctggtggaagatacttctaagcagacatttctaaggtgtgacctggttgcttctaacagtctatggtaagatatgggagcaaaggaatgacttaaagttggaactgatatttaaaaggtgcaaatgaaaaaataaaatgctaatgcaaggggattccaaagaaacctggaaaaccagttcaggccatgacaggaaggggagggtggtttggactccctcactataccctctccctgttggagtttaggctcagctgaccggtgttaacattaaaacagggagcttaagactgacaaagcagactctttgtagcaataagatatcaaattccaacctgactctggtatagcatcacatgacagttggcaggcatggaaggaaattaaagtattttatgccagaatatatttctctgacacattttggaatggccctgcaaagccgtctcttgtggaggaaatgtatattctgtcgagaatctttttccctttccaggtctcttcctgattcaggagagatttatccaagagtctggcaccttttaggttctgataagagacattgaccatctcttctctctggaacgtggaggcttcatctacataacaagaaccttggcttccacaacctgctttatcttaagcattgctttttgctgacttcaactttttagataatttaaatttttcagccaattgccaatcagaaaatcttcaaatccacctatgatttggaattccccactttgaattgtcctgccattccaaaccaaacgaatgtatactttacatgtattgattgatgtctcatgtctccctaaaacataaaaccaggccgcaacccaagcaccttgcacacatgttctcaggaccttttgaggctgtgccacagttcatggctctcacatgtggctcagaatcaatctcgtcaagtgttttatagagtttggcttttttcatcaacaaagggaagcagagcataaaaaatttggaaaattcatggcctggccatatggtagaaaagaaaaggtattttcaggagacaaatataagtaggctatggagcagccagttgctagagagattagcataactaaaagggagctaagtgctcatatccagaacaaagggaagaaggccttgaaggcattttggaaatctctgaggtggtctttcccatcacaggcccagaggccaagagggaaaggatggttttgtgggccatggccatggccactgctgcctgtgcagccttgggacactgctctccacatcctggttcctctggctccagccttggctcaaagggccccaagtatagcttaggctgcttctttggagagtgcaagccactataagccttggtgacttccatctggtgttaagcctgtaggcccccagaatacacgagtgaaggaagcttggcatcttccctctagatttcagaaatgtatgagaaagcctaggtgcccagacagaagcctcctgccagcatggagccctcacagagaacctctactagagcagtgccaaagagaatgtggggttgaacccccatataatgtccccaccagggcactgcctagtggagctgtgggaagggggccactgtcctccagaccccagaatggtggatccactggcagtttgcaccctgaatctggaaaagccacaggcactcaactctatcatgtgagagaagccacaggggcaacatcctccaaagccacaagggtagagttttccaaggccttgggagcccaccccctgcaccaatgtgccctggatatgggacatgaagtcaaaggagattaccttggagctttaagatttaatgactgccctgctggatttctgacatatatggggcatgtagatcctttctttttgccaacttctcccttgtggaatgggaatgtttacgcaatgtctgcactctcattgtattttgggagtcaataatttgtgtttgatttcataggctgataggtggaagggactcatcttcagatgagacttgggacttgggaaatttgggttgatgctggaatgaggtaagactttgggggactgttgagaaggcatgattgtattttgcaacatgagatttgggggaccaggggtggaaggatatggtttatatatttgtcccctccaaatctcatgttgtaatatgattcccagtgttggaagtggggcctggtaggaggtgattagatcaagggggaagatccctcatgaatgatttagaatcatccccttggtgatgagtgaattctgccccagtcagctcacacacagtctagttgtttaagtctggggccccccctcagcctcttgctcccattcttgccatgtggcatacctgctctcccttcaccttctgctatgactgtaagtttcctgaggtcctcgccagaagcagatgctggtgccatacttcctatacagcctgcagaactgtgagccaattgaacctctttccttcataagttactcagcctcaggtatttctttacagtaatgcaaatggacaaacacaggtggctcctgacacaccgctcatcttctcctttgtcatcatatggcttacctccatgtatgtctttgtcctctcctcttatgaggacaccagtgtttggacttgggatccatccaaaatttagtatgatatcatctcaagtccttaacctaatttgtaaagaccccatttccaaataaggtcacattctgaggttccaggtgggcatacatttggccagggagatgccatcagcccaccacaccagcctacgcaggtacatttgcatatagcttagggttgacctttcccatggaagtattacatccccctctggactccagtttcacatgttttagaatgcttcaccttgtccagcaggatgagtctcttttcattttttagtatttttctctctcttctttggattggattaaaaagaattgacatattctattgatgcatctttaagttttcagttccttcttatgtcttgtccaatctgttattaaacttgggtaatgtttttctctttcttttcttctttaataaaatagagatggggtttcaccatgttgcccagggtggtctcaaactcctgagatcaagtgatccttccatgtttggcctcccagagtgctaggattacaggtatgagccactgggcctggtcaaatgatgtttttcatttccgaatcatactcttagttctagaattttcatttgcttcttgtaactattttcagttttttatagagatacctcatctagtcactcatgataaccatattttcctttaagtctttgaacatatttaacataacttctttaaagtccttgtctgataactgtatctgcatctaggtcatcttggagttgatctccattgatccctttttcttttaactatggatcacattttcatatttctttgcatacctggtaattttggatgtgcacctgatgttgttaacatgtgtacaggctatggggtttgcattcttccttagcagaacattaattgtttttttcaatgttagcaagcagttagcttgagttgactcaaactccccagtctgtctgcctggcagttggcagtagctggaatctcagttctcttgaccttacacgtgttgctttctgctgggccctttggagttttccctacccatgcacacctaagggatcagccagaggtttcagtggagtttacttgcagattgtggggtttcccttcggtgaccttctcctttatggacatcttctcttcatttccagctgctctgaaaatgtagcccggcatcccactcctcaccaggagggctgcagtttcctgcttgaactctagctgtacccattacatgccctggagtgtgacttcagacgaatatttaacggaataatccttactagtgtttgcctacttctggtcatgttccagtgcctgcaattggtgtgtgtgggtgttgtgtgtgcttacagcgtttctagtgtttataattgccatctgccaaagggctagtctgatattagctgctccagaattattggaatcagaactactttctctcatgtggtttttcattttcatttccctgttgactagtgtggttcaacatcttttcatatgtttagtggctatttggatatcttctgtaaaacatctgttcaattctcttgcctattccttgttggattatttgattttttttctcattggtttacagtggtcttctttatattatggatctgtttgtgtcagtcagttatatatgtttataggaagcattaagaagaactgaaatggaccaaaagattagtaggtgccttccatggaaagcaaggcatcgtcttgtacactcttccaagttatttcattctatggagctctgcatcttttatttcctttgaactattttacacctctataagccaggggtccccaacccctgggtcatgcactggaatctgctcatggcctgttaggaactgggccacagagcaggaggtgaggggtgtgtgagcattcctgcctgagctccacctcccgtcagatcagtggcagcattagattctcataggagcgaaccctattgcgagctgcacattcccagatctaagttgcacactcctcgtgaaatcctaatgcctaatgatctgaggtagaacagctttgtccccaagccatcccccgatcctggtctgtggaaaaattgtcttccatggaactggttcctggtgccaaaaatgttggggactactgctctaagttgtacataattgatagcaatgcaaaagctctttgagttggtagaaattcaagttctcacctttggaaggacaatgaattgctcctcatcttccagggaaaaggccagttttgcatctatctatgaactccttttagcattcctgaatcaattatgtaagtgtagtacttagaattccactttgaactggttacgacaccttaattaatgagataaagagcatctctgaaatgtgtcgtcatatgtttatgtgagtcctgatcataacagttttagaaaatgatcttttaactcgttgtgatttcttctccctcatggccccacccagccgcagtatccagggagcttagttttctgtggcccaggagggcaggagaaccggtgttgatgaggagatctgaggttggccccaacttttccccacagctctgcttcaaggagtgccctgggaaggcctcccaaccccacacctgtcctgttggccaaggcgagctccatgccatgtggcatctctgccgctggccacctggtgagtatctgttgaatagagaaatgtgcagcatctccacagagcctccagggcttctgtgctctccaaacatctctgggctcctggcaccctctcagggtatgatgtgttggtgtctgggttgggcccctgtccctgagggtaggactcaggcaaggacaaagctctggactcaaagagctggtgtgggggtgagtgaaaggaacaggagctttggggtcagaaatgcgggtttcagcctgcattgtccccatgagcaggggcttgcaggctcaccaagacctcagtttctaccatggtgagagagtgtcagagactgcagcacgtatttgaaaagcgtccagggacggcaggggtctgggttggaccagctctcctgaatactgagggtgcgaccttgaccattgtgaaaggaaaataaaatctcaggactccaaactcactatgccaaaatgaacagttgaggtgggaagctgagtcatgaaaaaaaaaaaaagtcatgcctttccttttgtttccaaagtgatagcagcagcagataggccaggtctacccaggtggcctccctcaccctgagaatataaattaacaggccggtcttcatgacatgggacaaaatgagacaagaaatcgttcctcctacccctgagacgaatgcatatttgacttcttcctctactctgtttatttgcttataaagtgcagatttactgagcacaaggcgaatgcgtaattgctccctccacccctccttttcatgcaacgtgggggctcagtgaactctaatcaaagcctcacaagaatgtgaccctcccctcttgcttttttctctttcatctttcccctcctccagcttttccccttttcaatattgaagcaggtcgtagtgtgactctgcctggggtcaggtgtggggtggtccacatggacagtgagaaggtggtccctgcccgtggtggtccgggtttcctgggagatggccagacgtggattctgaggggaagaggccagtgcagttgctggactggagagagcatgtccattgtgctgagcgggctgggagggatccacagagaagacggtgtggctcaacagctggcaccggggacgggaatgtgggtgaagggcctggcacatggagtagctcaaggcgtgagactgtgacccacctggggagcccgtgcatgagtgcactgggtgggtgctggggttgcaagtgcgtgtgtccctgtgtgaggaccgtgtgagtacccgtgtgtgccacatggcccccgtgcgtggcaggcatgtgcagcctgagtaccataccagacggggcgttctgtctcctccaggcccggccctgccatgtgagcagggagcttccccatgggactgatgttctgtctcctccaggcctggctctgtcctaccatgttagcagggagcttggccatgggagtggtcggcacaggcatggctgtgccgggcctcactggctggactcggtggggacaccataccccttgctgagtgtgggtagcagagtttgaggtgccttctgggaggtgttcgggcagaggcagggttgggagtgtgtggggagatgggtgttcagctagcctccttccctgtgcaggggctcagctgaaacctgggctctcactcccctcacccctgcctccccagcatcctccctctgcccctctcttcagcctgccttgggccttgctctgagaccgctgctgagaggacaggaggagcttcagcagcaccctgtgctgggtggacgctgaggtcactgccttgctctgtgtctcctcacaaggccacgtggtggcaggtccttcttgcagtctaaccagagtcctgcttgctgctctgcaagcccacttgggtcacgtggggcaggggcacctggcagggtgggcttcgtggactcaagggccaccaattcctccaggtcaacatgctcagatggttctattctcccccttcccttggctacagggacctctgtatcctggggtggccacaaatgtcagaacacaggagtcacaccaggaatgccacaccatgtcacaccacatctcattatgtcacgccagggatgtcacgccacatcataccatgaaacttatcatcacactagggatgtcgtaccctgccacaccccatcataccacatcacaccacctcacaccagggacattataccatgtcacaccacatcccaccatgtcacgccacctcacaccacatcacattatatcacaccacgtcacactatgtcacagcctgttacgcttcatcacaccacatcacaccagggatgtcacactgtgtcacaccacatcccagcatgtccaacgccacctcacaccagggacattacaccatgtcacaccacatcacatcacccctcggatatcacaccgtcataccacatcatacaacatcacaccatgtcctgtcgcatcatgccacatgacatccacgtcacaccagagacatcacaccacgtcacaccatgtcatgttacatcacagcatggactgctggggtatgtgcaggggccgcccacagtgcagccttgctggagagttgagggagggtcctggggctgggcatggtgttccctcaggagggctgaccctctggaggatgctcggtcccaggtggaaagggggcggtgggccccgggtggctcagggaggggcccaatttccccaggggaacctggtccaggcgccaggccctgcaggggcaggagctgcaggaagcatctgcttcttcccaactcagcctgctcagtgcacggaatgacccggagcccggcaccgtcctgggtttcctttccttatcctggccaggccgtccatcctcagacagtggactggagcccaccccaccagggcacccggaagcccgtagggccccttgaagggcagagggtggagatctctccagcagggtccctgagggctggcaccttctctggacaaagctctcctgcatctctgggacgccatccttgggcttgggatagagccggtgatgcagcagctgcccgccctgcaccccaggtgctgtctccctcaccccccgcggggctgcagcagcgtgtcctgagagttaaagggctgggcttcagcacccagttcaggccaggccccctggagcccaccctccagtggcgagccttcccacggcatggcagggcctggagtctggggatttagtccccaactctgtgtttggtgaagctccagctgctcgatgccacacaaacgaatccaaccactcctccttcctgggtgagatggtctctctcctgccacaggcaactccgacggcattttccagccaccgcagccaccgcagccactgcagtaacaagaccctgtccttgactgagttccagccaggctcctcggagcctctccactcggcctcaaccttggcttgtaaagacttgagcagacactaacagtttctaacagcttctggccgtacccctaggccgacccctgccccgtcaacacctgcctgagaaagctccgtgcaccagaactcaccgtttggaccaaccccgacctccctttctcagggtatctgctgagagggccgcaaccacacgtccttctgtctgttcccgatgtctgtgcatttcctgtgacccaggagggtctttctcgggacctgagagccgctccctgaagtgtccccattgggaaggatggggcctgtgtctccaggctctgggaggacagaatcctgacctcaacagtggccggcacggacacagcgggtcccatcccggggacgctgaccagcgctgggcaacttttcccttccccgacgactgagccccgagcacccaccctgctccccctaccacctccctttacaaggctgtggcctctgcacagatgaaggtgagtccaggtcatgccggactctttcttctgttgcaatagttatttctgttgaaaatccgtccttgctacatgacctagtgcccagggggatgctgagacaggatgaatgtattctgcatgtgagaagaacatgaattttgggggccagagtctggactgtgatgggttaaatcgtggcccctacaaattcatatattcaagtcttaatccctggcctcacaatgtgactatttggagatggggtctttacagaggtcattaagttcatagggggtcactaatctaatctgatgtgtgttcttataagaagagaagcttaggacacgggcacacagagggatggccacgtgaggaccagggaggagacggtgtctacaagccaaggagagagggcttgagagaaaccagccctgcctgcatcctgatctcagattcctggtctctaggcctgggaggatccatgtctgctgtgggagccgccccgctgtggtcctgagctgacgcacacagatctgacacccacctctcgcttcggaccatggttggttctggaaggccctccctgtggctctgcctggccagcctgagccagctcccagcctcgacccagctttccctggaggccctgtcccccgcagagtgaccagggcaggcagcaccgtgcccagcaggaggagaaactgcatccatgtagaaaagaggagaagccccgggggtccatgtagcgacaggggccagggagggtcgctcgggcaatgcgtgtggctgcaggaggcggggggcgtatgcagggagcccccgaggtgcagctggaccagcctcctcctgaatgtgcttcccaccgggggcaggaggcgcgtggacacaggaaggcggctcccatcacgaagtacaagacttaaaaaggatattttattgtcatcacaaaagaaacatcaaagacaattaatgagctttagaaaatttaaaagaagaagaaaagctaccaaagctgaaatggtggcacctccttcgagtgagcccgggagtcctccctgacggccgaggcaggcgctggccgcagtcccgctcgagcctcccttcctgtctgcggattctgcgtgacagtcacggaacggcgtgatgggggcagcagagcgtgggggcctctgtccagcactcgtggccagcagccccgctttcgcaagaacacgggcaccctctttggcatcttgcctctccacctggtgcccccagagtggctgcttgttcctgctgcacgtgacccggggctggacgccagcctctgtgatgagttctggctgtgtccacgctcctggctctcccggtgtccctccacctctctccccgatgctcctgggcctcctctgtcctcaggccccaccaaggctgagtcttgcccgcctgggacctggtcaccagccttctctgggaggcctgtctgggcagatgcccagcccttccttgggctatcctcactcttgcactgtggggctcctgcagtggccacatggcccaggctcttctctgagtgatctcggtggactggagtgggtgggaggtggcagtgtcctgggcctggccccttctctccccagtgcggactctggggctggctgtccctgcgggtccagttccacccgagaatccagcagtgtaggcaggcagccaaggggtggtgctggcaccgagactgttcccaggagccagagagcagcgttctttgcttgaaatcagaacaacctcattcctcatgtcaggagttcacgggagtgcccggaatggaggctggctggctgcgggctgggaggaaggccgtctgagtgagccttcgcagctctcggaagcctccccaacagggcctgatggtgctgtggcttccctaccttggcggctgatgctcccactcaccatctggaaaccacgcctgtgttcaggaggctggcgtggacggggttggctccagggccagctcctgcctgggtgggggcctcggatgctggtcactgcctccttttgtgtgagcatctggcggtctggagggcagggacatcctgctgaggggacacctggtccccagctccctgcatgcaccaagcagcggaggtctggggtagacctgctatgcacagggtctggaaggggggcgtgtcagggctcagagggcgactgcaaagacagagagccatggggttgagggcggtgaggtcgggggcagttgtggcctgggtggtggctgagcatggcccacggctcgtgtgtgggatctgggtggccctggacaccccgcagagggtggccctaggccccctgcccaatcatgttcctatagtcggggatgatggtctgcttcaggtccaccaccgaggagaagatccacttcacctgtaggcaaggcacagcacaggggtgagcgaggccacagccctgcccccgaggcctgctcacccctcaggccacccaggccacagccctgcccctgaggcctatccggcccctcatgccacccatgtgccagggcctcaccactgcctgctctgaggcctggacatggagagcagagccagggcagcaacagcatgtggacagcacagaagatagtgtcaggtggggacagcacgggggacagtgtcagagacaggtgaggacagcatgggggacagtgtcagggacaggtgaggacagcatgggggacagtgtcagggacaggttgagacagtgtggggggagagtgttggggacaggtgaggacagtgtggaggagagtgttggggacaggtgaggacagcatgggggacagtgtcagggataggtggggacagcgtggaggacagtgtcagggacaggtggagacagtgtgggggagagtgttggggacaggtgagaacagcgtggaggagagtgtcaggggcaggtggggacagcatgggtgacagtgtcagggagaggtggggacatcatggaggacagcatcagggacaggtggggacagtatgtgtacagtgtcagagatgggtgaggacagcatgggggacagtgtcagggacaggtggagactgtgtgggggacagtgttggagacacgtgggaacagcatgggagaaagtgtcggggacaggtagggacagtgtgggggacagtgttaggaaccggtggggacagcataggggacagtgtcagggaggagtggggacagtgtgggggacagcatcagggacaggtggagacagcgtaggggatagtgttggctacaggtggggacagagtgggggacagtgtcagggaaaggaggaaacagagtggcggacagtgttggggacaggaggaaacagcatgggggacattgttggggacaggaggggacagcatgggggacagtgttggggacaggtgggaaaagcatggtgtacagtgttggggactggtggggacagcatgggggaaagtgttggggacaggaggggacagtgtgtgggacagtgttagggagaggtggggacagtgtgggggacagtgtcagggggaggtggggacagtgtgggggacagcgtcagggacaggtggggacagtgtgggggacagcatcagggacagctggggacaccatagggacattgtcgggacagatggggatggcatgggggacagtgtcagggacaggtggggacagtgtgggggacagcatcagggacaagtggggaccacgtgggggacagcgtcagggagaggtggggacagtgtgggggacagcatcagggacagctggggacaccctggggacattgtcgggacagatggggatggcatgggggacagtgtcagggacaggtggggacagcgtgggggagagtggtggggacagattgggacagtgtgggggacagcatcagggacaggtggggacagcatgggggacattgttgaggacaagtggggacagcgtggggtacagtgtcgcagatgagtggggacagcatgagagacagtgtcagggacagtgtcagggacaggtggggatagcatgggggacagtgtcagtgacagtttgtgacagcatgggggacagtgtgagggacagtttgtgagagcgtgggggacagtgtcagggacaggtggggacagcctggggacagtgtcagggacagtgtgtgacagcatggaggacaatgtcaaggacagctggggacaacgtgcggccgaccttgaagaaggtgacggtggcactgtagcacacgcttaacaggaagagtgtgatgaagatggtgatggtcgtccacagcccgtccagctccccgtcctgcgcctccgcacagctctcctccagttgcagctctggacaggaagagggtggtcagtgctgtgtcctgctgggctcgggcctctgggggtgattccctctgtggcaggacccaggatgtagggcccggccgggatgggccaacagtgtcctgaggtcagctccccacagctgcccgccctgggcaccagctttggccccgggactcagccacacacccggccctagatagcgacctggccctcagcaggacccactccccgtctcccgtgtccctccctgaggcccagagggcaggaggatggtgaagcccacacctcatgtgaccccagctgcagggaagggctgtattgggaagtgggccagtgccagggacgcgacgtggcgtgtgttcccctgtgtgtgggggcctgtgtgtgtgtggcggctgcaggggcaccttgtgagaggagggctgggtttgtctgagctggtcagcatgtggagaagctgccgagcggctcgtgggccttgaggtgccgcgtggggctcgtgggggcctgtgtccgaggagtgttcacgtgtgcgaggaccttgctctggtctgggtgctgtgcggttcgcccgggtgaggctccgtgtgtgaggcgtgcacgtgtgtgtgtggtggccgtgtggccggccaacctcagtgcggggtttgttgaacgggtctgggctgagtgtgtgtgtgggcatctggaccagtctctccacagggcccgagagtgcatgtccccggagtcggttgtgtccccatgcgggtgcgaggctgggcagggctgccaggggttagtgccgtgggggtagatgggtgagggagggcctgtccctacgcacatggactaggcatgcccccgagtgggcatgcgggtcggaggacagggcgctcacaggacaggacagtctcctacagaggcaggggctgtgtgtctgtccccaggggctcctagggcttcccgtggcccagcccagggcagctgctgctggagggagggccacgctggcaaatcccccaccctgccgagggcagcccctggctgagccccaccctaggcggcccaggcacacctgcacagcctgggccagtgtggggacagtgggacccgctctgcctccctcatgccactcaggcctcagactcggcctgacccgtggaaagaaccatcacagtctcgcaggggcccagggcagcgctgggtgctttatttccatgctgggtgcccgggaagtatgtacacggggtacgtgccaagcatcctcgcgcgaccccgagagcccggggagcgggggcttgccggccgtcgcactcatttacccggagacagggagaggctcttctgcgtgaagcggttgtgcagagcctcatgcatcacggagcatgagaagatgttcccctgctgccacctgctcttgtccacggtgagcttgctgtagaggaagaaggagccgtcggagtccagcatgggaggcgtggtgttgtagttgttctccggctgcccgctgctctcccactccacggcgatgtcgctggggtagaagcctttgaccaggcaggtcaggctgacctggttcttggtcatctcctcccgggatgggggcagggtgtacacctgtggttctcggggctgtcctgtagggacagaggttggcacagcggtcactcccagggcagagggtgggtcaagctggcctctgtccatgtggccctcataccccgcgggtcccacctttggttttggagatggttttctcgatgggggctgggagggctttgttggagaccttgcacttgtactccttgccgttcagccagtcctggtgcaggacggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgggaaatcataagggtatccttgggttttggggggaagaggaagactgacggtcctcccaggagttcaggtgctgaggaagagatggaggcagatgtgtcagcacccgactgggacctgtccctggatgcaggccactctagggcacctgtcctgccttgagctggagggcgaggcctgggctggcttacctgggcaccttgggcacgggggaggtgtgtcacaagatttgggctctgcagagagaagattgggagttacggggatctgggatggaggtggatgcgtcagcaccctgctggggcctgtccctggactcaggccactctagggctcttgtcccgccttgagctggagggcgaggcctgggctggcttacctgggcaccgtgggcatgggggaggtgtgtcacaagatttgggctctgcagagagaagattgggagttacggggatctgggatggaggtggacgcgtcagcaccctgctggggcctgtccctggactcaggccactctagggctcttgtcctgccttgagctggagggcgaggcctgggctggcttacctgggcaccgtgggcacgggggaggtgtgtcacaagatttgggctctgcagagagaagattgggagttacggggatctgggatggaggtggatgcgtcagcaccctgctggggcctgtccctggactcaggccactctagggctcttgtcccgccttgagctggagggcgaggcctgggctggcttacctgggcaccgtgggcatgtgtgagttgtgtcaccaagtggggttttgagctctgcagagagaagattgggagttactcagatctgggaagagagaaggtatctgagctgagtgagtagagagtttggcctttggggtgggcttaggtcaggggcagggtcctcctggatatggctcttggcagctctgagcgcagcacctgcccctgtgtgtgaagggcctggggtaggggcatccagcctgtgcctgcccggagcctggtggaaaaagccagaagaccctctccctgagcatgagtggggcgggcagaggcctccgggtgaggagtcagacggggcctgccttggtgccctgggctgggactgcacagccgggatgcgtccaggcaggagggctgagcctggcttccagcagacaccctccctccctgcgctggcctctcaccaactctcttgtccaccttggtgttgctgggcttgtgattcacgttgcaggtgtaggtctgggtgcccaagctgctggagggcacggtcaccacgctgctgagggagtagagtcctgaggactgtaggacagccgggaaggtgtgcacgccgctggtcagggcgcctgagttccacgacaccgtcaccggttctgggaagtagtccttgaccaggcagcccagggccgctgtgcccccagaggtgctcctggagcagggcgccagggggaagaccgatgggcccttggtggaagctgcaagagagatggcgccatgtgactgcggtgtgggacagagctgggcccagggcgcagaggcccctcggttcttgtctatccacgagggtccaggcagggtccagtgtctgggctcacgggcattgggtgtgcgcctggctggcgccacctgcctcaccttagccccctccctgccccaaagccaaggtcaggcccggcccgccccagaaagcttgcaggaccggtggccctgtggtgcccttctgcaggcacccctgcagcctaggaggcggggctcggcagccaggtcagcgctctgtgtctgccgggagtcagcacagtccagggcctctagcttggcctcagctctggccatcggtgccacctcagggacggctcatgcccattggccccactccagccttttatgggtgcctggcttgaccagtggacactgttctcagatggcttctcgtgggtcccctgagtcccctgaagctcctgaccctgccgccccagcgtggccctccgctagtgagtgggcctgacttgcccagggccctggtcatagcctgccctctgccctccaaggcccttttcttctgtgcagcagaggggccagacactgcatagggtcggcgcccttcagccccagggccccggaaccccctgccttggaatatcgccccgggagcctcctcctcagcctctcccctcctttccccttagccccagtgtgcagcagcccaggtcagggccctgagtgcctggatgccccctgcctcccagtgtcctgcattacttctggaggctcagtcaccacaccgtcaccctcccagccctggcctggccttctcagccaccagcccacctcctccctctctccagagcttcccccggcaaggtccctgctgggctcaacccaggccccccagcacaggtaggagccttgcacctgcccttggccctccccaccctgcgtggtgccaggacccccaggccacagggaggccccatttctctctgctgctggcccagtggccctggagtcccactgcaggtggggtgtgcccctgacctctgaggaagctaagcgccctgccctcagccaggccatcccctctgctcagccccagggccccgctcaccaccccttcccctcacctgcaccacaggctctggctgactctgcccaggccctgaatgggcccctctggctgccctctgctgctacactgccctgcaccacctccactcagcttcattgtgctgatggtcctggctcctggcagcccatcttgctccttctggggcaccagcctcagaggccttcctgcccagggtccgctggggccagccctgggaccctcctggtctcaagcacacgttccccctgcagccacacctgcccctgcctgagagctcagccccgagccctggaacgccttcccttctccatcccagctcgcccttgccaactgctcagtgggatggactcacactcccttcccggcaccaggaggctgcactgcactttcaccagccctcagctgtctgctgccggcaactacccagctcctgccaaagtctaggagctgcgtgctgcctcccaccgtccctgctcacctgtggctgctctgccctggtgctctgagctccaggagatgccccctgctcctcctgccccccacctgcccctgctcacctgcagcggctctgccctggtcccctgagctccaagagctgccccctgctcctcctgtcccctgaccctgctcctgtttgcctatggctgctctgcccttgtcccctgagctccaggagctgcccctgctcattctgccgcccacctgcccctgttcacctgtggctgctcttccctggtcctctgagctccatgagctgccccttgctcctcctgctttccaccagcccctgctcacctaccgatgatcttccccggctctctgagctccaggggctgcccacctgctacccctgcttcccaccagccctgcttacctgcagctgctctgccctggctggcagagctgcagaagctgccccctgctctgcaacctcccaccggcccttctcatcttctgatgttctcccctgttccctgagctccaggagctgccccctactcgttctacctcccaccaacccgtgctcacctgcgactgctctgccctggtcccctgagctccaggggctgccccctgctcgcccacctcccaccagccatgctcaccttctgatgctctgccctgatcccctgagctccaggactgccccctgctcgtcctgcccctcacctgcccctgctcacctgaggctgctctgccctggtcccctgagctaaaggggctgccccttactcatcctgcctcccaccagcccctgctcaccttctgatgccctcccctggtcccctgagctccaggggctgccccctgctcgtcctgcctcccaccagcccctgctcacctgcagctacactgccctggttccctgagctccaggagctgccacctgcttgtcctgccttccaccagcccctgctcacctgcagctacactgccctggttccctgagctccgggagctgccgcctgcttgtcctgcctcccaccagcccctgctcacctgtggctacactgccctggtgccctgagctccaggagctgccccctgcttgcccatcttccactgagccctgctcacctgcaactgctctgccctggctctatgagctccaggggctgccccctgctggtcctgcctcccacctgccctgcgcacctgtggctgcctcctcacctgtggctgctctgccctggtcccctgagctccagggtcttcctcctgctcatcctgcccctccaccggctcctgttcaccttcagatgctctcccgtggtcccctgagctccaggagctgccccctgttcttcctgcctcccacctgccctgtgcacctgtggctgcttggtcctggtcccctgaactccaatgcctgccccctgctcactctgccctccctcaacctggggcagcaacgtcactcggtccactgttgcccccctgcctgtcctggcaccctctgtccaggtttaggctgtttttcttgcctcatttttgtttttgcagcacttggcgtgttccctatgctgtggagcagccccagtgtccagtcaggtctccccaacagagccccttgcccttgcccatgtgcccctcctggatgagctcccggatcctcccgtccctgcactgctcctgctctggaagcctctccagaacctcagctcctcagtggcctctgctctgctgggtcagttccctgaacgcacggagcctcagcccctcccctcgccccaggcctgctgcactctgggcctttctgggcctccctggactcttccctcctcccgcccgtgcactcagcacagctctcccctcctctccgctgctgaccacagccctgctcccggccagcaggtgccccaaccccatcagctggctctgagcccagcccctgtgcctcccctgtccctgcctctgcctctgggctccttggcttccaccctcctgtcctgctgccacactcaccctccctgctctgctcccagctcacctgctgtccttggtcctggctgagaggagggccctacggccagctctgctgaccctgccctgggctccggtgatgctgccggcctggacaagcccctcggttcacctggggcctctcctcctccctctctctgctgcctcctgagctcaggtcggtcatgcccatcctggcatcaccccatggctggctctgccccatcccgtcatgttcctcacactcccagcccggtcgtcctggaggcctcagtcagcctctggtgtgtcctgccctgttggcttggaagcccctgcccacggtccctgtcgtctcgcactgggtgggcatcggtgcctgaaggctgcccacctcccctgtgctggctccgcttaggcttccatgtggggctggcctcgccccagcctctccccagcctcttgcagcctgttcagcagctcaggtccagaagcgccgatggctgcgcccaggctctgtccttctcctgagcctgtgctcctgccctgtgctgaccccactcaccgaggtgggggtctcagcccttcctgttgtggcgaggtacatgtgggcagccttgcccacgctgtcagctgccacttgtcttcctaggaaatcacagctcggcccccaggtccccaggggtgtgaactccacgctgcaaacactaagaacaggattgaaaccggcggcaccacttacttcctgaagttcccttttcttctggtggtttctgtgtcagagggcgagggggagtccagacacagctgaggctgcctcatgggtgtgtggggatgggggtggtggctgcccccatactcccccgtactcacgggagaaggtggggagcccggaccttgtgtgctgctcttttctctgtctctgagtccctggggctggactgagactggcaacgattatgaccattctgcccgtggtctcagcctctcaatacctgggcctctcatctgaagcttctggcccccactgggccctggtggctgcttttgcctgggcatctctccagctgactctcactcatggtgcagggaggggagtgtgagttcatcctgctgagcagctggcaaaggcgagctgggatggagaagggaaggcgttccaaggctcaggtctgagctcacaggcaggggcaggtctggctgcagggagaatgtgtgtgcttgagaccaggagggtcccagggctggccgagtggaccctgcacaggaaggcctctgaggctggtgctccagaaggaacaagatgggctgcgaggagccagggccaccagctgtgctcctgggggccgaggggacgtgggacaggcggatgaacacactgaggctgagtggaggtggtgcagggcagtgtagcagcagaggggagccagaggggcccattcagggcctgggcagagttggccagagcctgtggtgcaggtgaggggaaggggtagggggcagggccctggggctgagcaggggggatagcctgtctgagggcagggtacttagcttcctcagagttcaggggcacaccccacctgcagtgggactccagggccactggactaccagcagagagagaaatggggcctccctggggcctggggatgctggcatcatgcagggtggggaggtccaagggcatgtgcaaggctcctacctgtgctgggggagcctggactgatctcagcagggaccttgccaggcagaagctctggatagagggaagagctgggcaaggacgtacgtggaagtgggaggtagcagggaacggaatgaggccagagggcctcgggaaagcccgaggaggtgtcgcacaggaagtgtccagaatggaagaggaagcgtccagcaaggaacaggaagaatggacacttgtgaggggaaatcatgtccctcccactaaatgtgctctccacaaggacccggcccgcccttctgtccctgctggatccctgagctggcaccagccctgccctcagagagaacgtccaggagacaggtggaggtgcacgtgtgggtccctggggaaatccatcctccagccgcgggctcccagtcggctcccagcctctcgctccagcttcaccccatggagctcataatgggctcaacctcccagcctgggggaggacggagtgatgggccccacactgcccatggcacacccagggggctggggagactgcacttggctggggcagggaggccttgtgcagtctgtggggctggcagctcaggacaacactcgtatccgttaagtgcggccctggcaacactgcaccccagactgcgtggcttaaacaacagacgtttattccgtcctggttctggaggccggtcatctgggatggaggtctcggtggggctggctcctctgtgtcatggagactctgttccaggctctctccttgctgctgggctttgccggccgtctctgctgctcttggcttgtggaagcagcaccatcttcacagggcgttctccacacgtgcgtctgtgcccagattcccccttttcatgaggacagcagtcatattggatcagaggcttgccctactccagggtgacctcatccgaacttgattgcagctgcaaagactgtttccaaacaaggtcacattctgtggtcctgggggttaggacttcaacacatgaatttataggggacacattttaacccatgacagtttgccctccgctccccccataatcatgtccttctcacaggcaaaatccctgcatcccatagcaacatctccacgatggctaaccccttccagcaccaactcttagtccacaatctcagcgacatatcacctgcatcaagtgtgggagaaatgcagggtgattcattctggggtgaaattcctctccatctgtggacctttgtaacttgacaagaagttatctgcttccaaagtacaatgatggggcaggcataggatggacattcctattccaaaagggatacattggaagggagagaggagccatgggtcctaagcaagcccaaaacctagtagggaaaactgcattagattttttttgaagaaaacaatatacttttattttagctgtttaaaagttttatgattgtttttaattgacacataataattgtatatattttggggtacattgtgatatttggatacatatatacaatgggtgatgatcaaatcaggataattagtattgggggaacctgcccccaatatttcaatgtaggttctttctgttttccataattgttggccagctgagaaataaagagagacagtataaagagaggattttacagctgggcagccgggggtgacatcacatatcagtaggactgtgatgaccgcctgagcctcaaaccagcaggttttttgttaagggtttcaaaaagggagggggtgtaagcacagggagtgggtacaaagatcacatgcttcaaaggcaaaaagcagaactactaataagggtctaacaaagatcacatgcttctgagggaacaggacaaagggcaaaagcagaaccactgataagggtccaacaaagatcacaaggcaaagggcaaaaacagaactactgataagggtctatgttcagcagtgcatatattatcttgataaacatcttaaacaacagaaaacagagtttgagagcagagaaccagtgtgaccacaaatttaccagggtggagtttttcacccccctaataagctgagggtactgcaggagaccagggcgtatctcagtccttatctcagtccttatctcaaccacataagacagacattcccagagcggccgtttatagacctcccccagggatgcattcctttcccagggtattagtattaatattccttgctaggaaaataatttagcgatatcttccctacttgcacgttcatttataggctttctgcaagaagaaaaatatggctctttttgcccaacccctcaggcagtcagaccttatggttgtcttcccttattccctaaaaatcgctgttattctgtctttttcaaggtgcactgatttcatattgttcaaacacatatgttttacaatcaatttgtacagttaacacaattatcccagtggtcctgaggtgacgtacatcctcagcttatgaagataacaggattatgagattaaagtaaagacaggcataagaaattataaaagtattatttgggaactgataaatgtccatgaaatcttcacaatttatgttcctctgccatggctccagctggtccctccattcggggtccctgacttcctgcaacaattagcatatccatcacctcaaacatttatcacttctttgtgctgggaacaatcaaaatttgctcttctagccgtatgaaaatatacaataaattgttgttagttatagtcaccctatggtgttagagaacaccggggcctattcctcctacctgactgtaattttttatttattaatcgacttctagctatcctatcccctcccattcccagcctctggttaccactattctactccctatttctatgagatcaacttatttggcttccatatatgagtgagaacatgtgatatttggctgtctgtgtctagctttatttcacttaacatgtcctccaagctcatccatgttacctcagatgacaagatttcattctttttcatggcagaatagaattcctctctctctctctctctgtgtgtgtttgtgtataaacactacattttctttatgcattcatctgttgatggacacgtaggttgattccaacactggcattgtgaatagtgctgcaatgaacatgtagtgtagatgtctctttgacatagatttcctttggataaatacccggtagaggatggtgggatcatggggcagtactcatttccattttttgaggaagctctttattgtttttcaatggctgtgctaattccaaagacaagatttcaaccaataatgcattaaagctcccctttctctgaatctttgacagcaattgttttttgccttttttaataatagccattttaactggggtgagattatatcttattgtggtttcaatttgcattttccttatgattagtaatgttgagcattttctcatatgtctgttggccattcgtatatcttccttttagagacgtctattcagttccttttttggttttaaaaacttttaaatattttttcatttgcctatttttaataaaaaaatttgttttcttttctgtttagttgtttgagtttccaatgtattctaaatattagtcccttgttggatggagagtttgcaaatattttctaacattctgtagattgtcttttcactctgttgattgtttcctttgttgggctcaagtgatcctcctgccttggcctcccaaagtgctagaattagaggcatgagccactacatctggcctgatatcattggcttgttccagattttagagaaaagctttcaactcttgcatgttcagtatgatgttggctgtgggtttgtcacatatagctcttattgtgttgaggtatattcctttcatacctaacttgctgagaatttttatgaagggatgttggattttatcaaatactttttctgtgtctgttatgatgataatacggtttttgtccttcattctgttgatgtgatttgcatatgttgaaccatccttgcattcctgggataaatctcacttgatcatgataaataatgtttttaatatgctgctggattcaatttgctagtatttggttgaaggttttcatctattatcttcatcagagtatttagcctatagtttgctttttttgttgtgtccttgtctggttttggaatcataataataatcacataatcataatcataatcataattaccataatagtggcctcatacaaggaatttagaagaattccctcctcttcaattttcgggaagattttcagaagaataggtattagtttttttagtgtttggtagaattccccactgaagccattggattactgtagaattggcattttgataggaatgtcattggtatttcaacaggaatttctttgggctttcctttgatgggagactttttgttacagattcaatctcaatgctcatgactggtttgtgcaggctttctatttcttctgggttcagtcttggtaggttgtattgtccagaaatatacctgtttctgctaggttttctaatctgttggtgtatggtctctaattatcctttgtgtttctgtgatatgagttgtaatgtttctgttttcatttctgatttcattcttttgggtcttttttgtttagtctagctaattatttgtcatttttgtttatcttttgaaaaattcaatttttcattttgttgatcttttttttttttagtctgaatttcatttatttctgctctgatctttattatttctttctttctactaattttgggtttggtttattcttgatttcctagttccttgacatgcattttcaaggatgagatttatttgaaatctctctgcttttttgatgtaggtatttattgccataaacttccatcttaatgctgctttttgctatatcttataaattctagtacgttgcatttctattttcattttctttgttgacattctaaaattcccttcttaattcctattggtcactcaggagtacattatttaatttcccatgtctttgtacagtcttaaaagttcctcttattgatttcgagttttattgtggtcataaatgatatttgatataattttaattctttcaaatttgttgagacttgttttgtgacttactgtatggtttatcctggagaatattccatgtgctgatgaaaagaatgtgtatttcacagctgttggatgaaatgttgtgtaaatatctgttagatgcatttggtctaaagtgctttttaaattgaatgcttctttgttgactttctgtctggattatctgtccagtgctgagagtggtgttgaagttatcaactattattgtattgggatctatctcttcctttcttctgcttcatcatatctgctgttgaagctcattactgtattttttaattttattcattgaattcttcacctgcagaattttagtttgcttcttttttatttctatctctgttgaaattttcattcatactgtaaattactttcctgaattcattgaattgtttatctgttttcttgtatcttattgagttatcttaagatcattattttgaattccttttccagcaatacattgatttctttttccattgaggtctattaatgagagttatgttcctttggtggtgtcatatttccttgctttctcatgtttattgtgttcctgcattgatgtctgtgcatctggcgaaatagtcacctcttccaaactttcaagagtgggttttttagagaaacaatttcacctgcagttgggtttagtgttttggttgggaaagtgtgatgactctgtttctgaataggtgcagtggcatagcttccatgcgtcttcttcaactgcattcaacctcagcaataactgtgggcacctcagtggactaggctgtagaagtttgtggatgtagtggtggcacaggttaatgtactcagtgtcaagggcttttgtagtcctcctcttcttgtttccccacaatgaggagatttagtcaaggggctctctcttggtagcaggtctaatgtggccaacgtgcagctgcaatggtgctggattccaggtgcagaaaattagagtagctgtgcaactggagtcctagtctcctggtttcaagaatctactgtggcatctgggtcttggggtgtaggttcagtttctgtggcaggtttggattaggtggctcacagtgctaggatctgtgactctgaggtaccctttaacaggttttgctcaaggggccaggttgtagctgtgagtctattcctggggggtgcagcatttgtccaactctggggaagaaggggtgttctggaggtgtggacctggggagtatggtatggctgcaatttgggaagctgagccaatagggcacaatggaaactttggtcccaggggatgaggcactgtatggtattgactctagaccctaggatggtagggctcagcaggatcccagactatgtgagaccaggtacagtgtcagcaagtatcccaagatggcagagcatagctgtaatttgggccttggtggggagtaggcagggaacagcacagtgctgattctacttcccagggagagggtgcctcagcagctcagaccctaggggcctaggcaagctccagggaagcagggcactacagttgtttggcctgtaggctgagatgtctcagcttagccactgctctgttttcctggggcatagggtactatatcagctcagccttgggatgtgctgctgctcagcttaagccagggcactgattccctagaaggtgatgtgttgcttcagctcaggccttctctgctgtaaggaaagtcctgcatttatgtatcagagggtgtgattgttctgagtggcccaggcaccatttctgtaggatacaggttgctgcttcagcctaagcactgcagtgtgtgaccttctgggtggccaaggcattagttcctggaatgcagggtgctgcttcaacgtagacactagaaaggcatggccaaagtcctgttttgctaggaggcaagaaactgctttagcttggactcaaagggtcagggggaggagtgggtagagctgatccacttggctctgtggggaagggtttaatagatgcccatagcttgacttggggacgtgggaccactagtctgggttgttcagtggcagcttagcctcagagatgaaggggagctgtgactactcactccttgggtaagacacactccagccatagttcctattccagtgtggtgaagcactagccatgtgggagtggggtacggtgtcagcaccttttttggagagcacagctatgtggcctccaggcaactccctccagtgcaaactgcaggggaccccagtggcgaggtctgcaggtgtccgaggtgttagtgggtgccactgggatcctcttgcttacctcctcatgtcagaaattcctcctgattcccagataatcctggttgggggatggagtggtggaggccgtgtgtttccttctgttttctatgtggccagcccacatttctgtgcttatcagggtttctgttactcctctgatgcactcagtgctctccctcagttattttcgttaaaatatagttgtctattgacttttctggctttctttatgaggatgatgagcactaggggcttctagttggccctttattagatttaagtctcaagattcatcctcctcggttaatgctccatcttccaggcccactggggtggccccacactctgggcccaaggtggcaacagcagccccaacagcctcctcacctgtggctctgatctcaaagtcattcttccttcattttatctggtctcatgtatttatttatttatttatttatttatttgcatgataggctttacttttaaatgattagtagtacaccgagtaataacatgtaacaagttcttgaattctatcatctagttattttgattaagaagctgaaacaattatactagtaatattcactgttctaattattagcagcaatggactactttaaggctggctgatgcttcacacaggttacagaaactactactttttcatagataaagcccctgaccttcaaaaaagcattaaggaaaaaatgatttaattccttccttttttcaaaggattgttttgctttttcttttaaacttgatacaagaaagaaaacatcaacagtgatatatatatatgtatatatattgcttgagccaaaaggcataataaaatagacaatatttacccattatattcctaagaaacatgaggtaaaaagatgaaatctttaagttttttttttttgagacagggtctcactctagcacccaggctggagtgcagtggcacaatcttggctcactataacctctgccttccgggcccaagtgatcctcctgcctcactcttccaagtaggtaggactataagcatgtaccaccatatctggctaatttttatatttccttgtagagacacagtctcactgtgttgttcaggcaggtctcaaactcctgagctcaagccatctgcccgccttggcccccgaaaatgctgggattacaggcgtgaaccaccatgcccagcctagataaattctaagtctgtacaaagaaactggatttgcttctctccgaaaagtgaatgggcctactctataatatacagagataagttaatgtcttcttataagaatataactagagcttcttattccatgagggcatctaaagtgccagtccatttaacaggtgcttctctcttttaatatctacttatgcgatagttttcagggatttctggctggatgctgcagacaaaggccaaaaggttatctaagacttcttccctgttctgctggaagtaggtctggaggatggttatcctgggtctgcgagatcctagtgctgcagcttccttggccttgaactctttctccttctgcaggcagtgctgttcaatttcagcctaagctgctcctttgggctgcttcagcctctggttcttttgcttgtgggccccagacaccttcttggcatcctgcttctcggcctgcagcagctgctggatcacctgtgactgaccggccatggccgtggtgattctgagaccaaggtgagcagcctaaatcagcttgaagggcccttgggtcagctgacccagccacctcagcacttccctcttcagctgatctctctcttctcatattttactgtaagcagcaaggagaaatcaagaatgccttcaacaattttcttaggaacttcgtcagctaaacatccaagttcatcatgtataatttctactttccacaaaacggaacacagttcagccaagtgctttgccactgtatgacaagggtcaccttcgttttcaataacaccttccttatttctgtctggagcctcagcagaggcatctttaacattcacgtttctagcaacattctgttcgtgacaatttatgtattctccaagatgacaggagttttctctatagctctcctctttctttctgagcccccaccaggatcacctttaatgtccaaatttctaacatagtcttcaaggaaacctaggctttttctaacacacacctcaaaactcttccagcctctaccccttactgaattccacattttgctacttatgacccctgggctcactgaaaacttactgcccacttctgatccttcagtttctcctttggcaacatgcacaaagtggcctgatcttgttcaacccagttctaggtctgctaccttctaataccagggcagactcagccaagtcctgggctgagctggtgtgattgggcctcccagccctgtaccctgagggtgcttgggcttcactgggagaacctgaccaagtatcgttcagtaccatgcatgtcactcaatatcacccctagagatttgggggttagcagtaccatggagttcctgatatgatttagatgtttgtcccctccaaatttcacattgaaatatgatccccagtgttggaggtgaggcctggtgggaggtattggggtcataaggccagatctctcatgaatggtttggtgccatccccttggtgatgggtgatttctcactctattagttcacacaagagctggttgtttaaaaaaacctgacacttccttcttatctctctttctccctctcaccattctcaccatgtgacatgctggctccttttttttttttttttttgagatggagtttcactcttgttgcccaggctggagtgcaatggtgtgatctcggctcactcactgcaacctctgtctcctgggttcaagcaattctcctgcctcagcctccctagtagctgggactacaggtgtgcaccaccatacccggataattttgtatttttagtagagatggggtttcaccatgttggtcaggctggtctcgaactcctgacctcaagtgatccacctgccttggcctcccaaagtgctgggattacaggcatgagccaccatgcctgtcctatgctggctccttttttgccttctgccttgattgtaaacttccagaggcctcaccagaagcagatactggcattatgcttcttgtacagcttgtagtgagccaaataaacttccttttctttacaaattatccagcctcaggtattcttttatagcaatgcaaaatggatgaaaacagaaaattggtagcaaggagtgcggtgttgctataaagatacctgaaaatgtggaagtggctttggaactgggtaatgggcagaggttggaagagtttggagggcccaggaagaagacaggaagatgaggggaaatttggaactttttagagactggttacatagttgtgatcaaagtgctgatagaaatatggacagtaaaggccaggccgatgaggtctcaggtagaaatgaggaatttattaggaactggagtaaaggtgatgcttgttatgcccccagcaaggagcttggctgtattgtgtccatgttccagggctttctgaaaggctgagattgacagtgatgacctaaggtatctggtggaagaaatttcaaagcagcagagcatccaagaagtaacctggctgctttgaatggcctaaatcaaatatgggagcaaaaaaaatgacttaaaattagaatttataattaaaaggtaagcagaacataaacatttggaaaatttgcaggctggccatgaggttgagaagaaaagagccttttcaggcaaggaacccaaatgccttatggagcaaccacttgctagagagattagcataactaaaaggcaactaaatgctaatagcaaagacaatgagaaaaaggtcttaaaggcatttcagaagtctttgggacagtctctcccatcacaggcccagaggcctaggaggatgaaattgttatgggggtcagggctggggccttgcttccctgtggtatcttgggaggttgctgctccaggttcagccaaggctcaaagagtcccaggtgcagctcaggctgccactccagaaggtgcaagctggaagccttggtagcttccacatggtgctaagcccacaggtgggcagaatacaagagtgaaggaggcatggcagctcctacctacatttcagagggtgtataggaaagtctgggtgcccatccaaatcagtaaaaaggaagtcagactgttgctgttcactgatgatatgatcacatacctagaaaaccctaaagctcatccaaaaagcttctagatctgttaaattaattcagtaaaatttcaggatacaaaatcaatgtacataaattagcagcactgctatacaccaacaatgaccaagctgagaaacaaatcaagaactcaatcccttttacaacacctgcaaaaaataaaatacttaggaacatacctaaccaaggaggtaaaagatctgtacaagaaaaactacaaaacactgctgaaagcaatcatcaatgacgcaaacaaatggagacacatcccatgctcttggatgggtagaatcaatattgtgaaaatgaccatactgccaaaaacaatctacagatttaatgcaattcccatcaaagtgccaccatcattcttcacagaaatataaaaaacaattctaaaattcatttggaaccaaaaaagaccccacatagccaaagcaagactaagcaaggtgaacaaatctggaggcattacattacccaaattcatactatactacaaggctatagttaccaaaatagcacggtacttgtataaaaataggcattagaccaatggaacagaacagagaatccagaaatgaagtcaaatacttatatccaactgatctttgacaaagcaaacaaaaatgtaaagtggggaaaagatgtcctattcaacaaatggtgctgggataattggcaagccacatgtagaagaatgaagctggatcctcatctctcactttatataaaaatcaactcaagatggatgaaaggcttaaatctaagacctgaaaccatgaaaattctagaagataacattggtaaaactcttctagacattggcttaggcaaagagttcatgatcaagaacccaaaagcaagtgcaacaaaaccaaaaataaataaataaataaataaatgtgacctaattagacaaaaaaaacttctgcacagcaaaagaaataatcagagagtaaacagacagcccacagaataagagaaaatatttgcaaactatgcatctgataaaggactaatatccagaatctacaaggaattcaaacaaatcatcaataaaaaaaataccatcaaaaagtgggcgaacgacatgaatagacaattctcaaaagaagatatacaaatggccaacaaacatataaagaaatgctcaatatcactaatttttggggaaatgcaaattaaaactgcaatgagataccacctcacttctgtaagaatgaccataattaaaaattaaaaactaacagatgttgtcatggatatggtgaaaagggaacagttttacactcctggttgggaatgtaaactagtacaaccactttggaaaacagtatggagattccttaaataactaaaagtagaatcaccatttgatccagcagtcccactattcgatatccagaaaaaaataagtcattatatgaaaaagacacttgcacacacatatttagagcagtgcaattgcaactccttgtaattgcaaaaatatggagccagcctaaatgcccattgaccaatgagtggataaaaaatgtggtatatatacaccatgggatactactcagccataaaaaggaataaaatagtggcatttgcagcaaactggatggagttggaggccattattctaagtgaaataactcaggaatggaaaaacaaacatcatatgttctcacttataagtgggagctaaactataaggatgcaaaggcataagaatgatataatggactttggatacttgagggcaagtgggggatggaggtgagggataaaagattacatattgggtacagcgtacactgcttgggtgacaagtgtgccaagatctcagaaattaccatgaaagaacttatctatgtaaccaaaaacctaaaactattgaaataaaaataaaaaaagagagagacaaaaaagaaagcctgggagcccagacagaaacctgccacaggggtggagttctcccacagagcctccagtagggcagtgtggagggaaaatgtagggttggagccccttcacagagtccccagtggggtactgcctagtggagctctgggaatggggctgctgccctccatacccaagaatggtagagccaccagcagcttgcgcccagagcctggaaaagattcaggcactcaactacaacccatgagagcagccatgtgggctgcactctgcaaagccatgggggcagaccagcccaaggccttgggaacccgctcctcacaccagtgtgccctggatgcaggacatggagtcaaggattattttggagctttaaagtttaatgtctttctctcagaattgtgtggggcctgttgcttcttccccctccttcttttggccaatttattccttttggaaggaagggaaatgtttacccaatgcctgtaccatcactgtatcttggaagtagcaacttgttttggatcttacagcctcataggtggaaggggcatgccttgagtctcagatgaaacttcggagttttgattgagtagatcctagaacaagttgagattttttgggcactattgggaagggatgattatattttgcaatgtgagagggacatgagatttggggggacagtgtggagtgacatggtttggatatttgtcccctccaaatctcctgttgaaatgtgatccccaatgttggaggtggggcctagtggaaatgtttgggtcatgccatggatccctatgaatggccttgctgccatcctcttggtgatgagtgagttttgctctactggttcacacaagagctggttgtttaaaagagcttggcacctcctctttccctctcttgctctctctctcaccatgttacatgctctctcccccttcaacttctgccatggttgtaagctccttgatgccctcaccagaagcagatgctggcaccagggttcttttatggcctgcaaaaccctgagccaaataaacctcttttctttataagttactgagcctcaggtattcctctacagcaatgcaaaatgaactaacaaagccagttgtactttaccatccaaccatcatggaagctacaagaggaattgtttctatctgattctacactccttttcagcatcagaatgttctgggagcaccaaaagagttcaggtggagatgagaatggtctctcctctgggtgcccacccctgatagctggggtgagctgttttgcggatgggaagacttggtagtctgctcaggttgacagcctgacagcctacagtgtctgacaatgagccctgtcatcacaactcatctgttatcagctctgacaagcctggccctcagggtctctctcaagctggatccccgaggctgtgggtgccatgacccacctggctctgctaacatcctccaggctggctccccacctgccccacagcctctgcccttggagtggactctggcctgcctcactccttgggtgctggatgggtcagctctttgggtgggctggctgcctgcaggagatcagaggaaggggatgctgatgctaagtggtgaccctggctctctccttgcagggttgcctggaccttattgccttcctcaacagacagcccaaggagcctctgttcctgcagatctcggagcggctctctctcctcctccagtgtgtggggaggtgcttgctcttgtaggggaagaaacatttttcccccttctacccatcttaggttcattagctggggtcttgtcaattagattaacaagatactaacatgagaaaaacaaacagaagtttactaacatgtgcattatgcctctatgtgggagccgtcagagatgaggaattcaaaggggcggttggaacgtgagcttacggagcatcttagcaaatgggcaatcatttttacagaattggcaagacaaaggaaaggggctttcaacctgtagggcagcaaattctgggaagtaaatatataggggaagctaacagaagatagcttgctagtttgttgtgtagattcctctagtgccttctctgggctgataagcatctagagttgtctccaaggactaagaatcctctgcttttcctggtagaaagggagtgggcagggatttttttcttgggtatgcttctttttaattgtcttcggctcaaaattattcttgtttgaaagtggcatattctgctactcttcactctgccggagccagctctggagtcctcagtgtcccaggggctcttgcactgagcccagatctgtgtcagcaaggtgtccttccattaaatcctgcctaaatgacttagttggaggtgcaaacccacagagcattgctggaggcatgtgggagagtggctgtcaggtgttgtctttgtccattaaattgctataagggaattcctgaagctgggtaatttataaagaaaagaggtttatttggctcatggttctgcaggctgtacaagaaccatggtatgtgcagagatcacatggggagagaggaagcaagaaagaggggagatgccaggctcctttcaccagccagctctagcaggaataagagtgagaactcaccctcaaaggagagcattttgggatctgcacccaaaatccaaacaccttctaccaggctccacctccaacactgggggtcgaatttcaacatgaagtcttgggggacaaacatccaactatagcaagggtcctgcagggactctctccctcccacttaacttcaagcttgagtgggtgatagaatttggtgtttggtcctgacaggatttgcactgcccaagtctgcagctacagctttagaattggaaggcccccttcacctccagggtgtcttgtgaccagggcaccaccggtgcccactaaggcctgcccctgcagcctggtcacatggggtggaggtagagtcaggatcttgattggcaggcagctccacccagaggagcaacctcctgactcccactgccccccacctcccacaatggcataccagcacccatggcagaggccacgaagacacctagggacacttctgggtcagaaggggtgccactgacggggtgagctccgtg

SEQ ID NO: 265 - DNA, 2611 bp, Homo sapiens
tcactgttctggatgttagaattcagcaaacgcttcttttttttgtaatctttctgttgctgagaaataaaacaaaaagctttaaaaactggtgggctccttctccaggcccctttctttctgagggtccatcccccatgagccacattgtcagtgccagcccagtggttcacctgccaacaagggcagtgtcctgaggacattcaggaaactctggaatcacacaagctgaattcatgaacttacacgaaggtttgctgaggataagattgagctattgggctgggcgcggtggctcacgcctgtaatcccagcactttgggaggccgaggcaggcagatcaccaggtcaggagattgagaccatcctggctaacacggtgaaaccccatctctactaaaaatgcaaaaagaaattagccaagcatggtagcgggcgcctgtagtcccaattactcgggaggctgaggcaggagcatggcgtgaacccgggaggcagagcttgcagtgagctgagatcgccactgcactccagcctgggcaacagaaagaatgagactccgtctcaaaaaaaaaaaaaattgagatattgttgtttctctagaactgagccaagagctgtccttgccttgtgcatggtattttccaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggtctgccagttccttcccttgcacacctcatgcagctgctgcgggatttgccgagctagcaacctgctgctagagagactgatttagaggaaaacaatcacaaatctgaggccttctaagcaacggctcttaaagggctccagttcattcagctaaagtggccacttccagcttttcttagagatagaaatggcacgaagagggtggttctgaacctcccaggaacgtatgagctgggaccttgagaaacagccgcttctagtagagggaggagggagtgcgcgggcagacaatggcaggtctgtatctggtatcccgggaagctcctgggatggctagagtgcccccctccccttctcctccccaccacaaggtcccagagcctgcaaagatcattccgtcacatcaggactgctgttaactaactggtccaagctggcccctggcaggagtggctgctcctctcaggccagcagccccctgtgctccccacaccccacccggctcctgcctttcccaggccccacccggcagcctcctccctgacctgcccagtttccaactccctgacctcaggcccacctcagccttccctcctctgggctcctaggtggttcggttgtctggtcaacctgcagcacctgtctaggcccgatcccctgacacctcctattctgtgtgcagctctgttctctccacgtaccctgggagcttgggaggtgccctcctgttgtgtgtgggtgacatgtgagatggacagtgctggcaagtcctgccctgccccgtccctgggccttcctctgtcccctggcccttcccccatccctgtcttcctcaccagtggcatctggaagggctgggatcagcagccacacaggctgtgaatatctggggactaaatgtgagttgggaggatgcagaaggggcccctatgtgtgtcaggataacgcacactgtccccctcactccctgcacccaaacacagctgctttcttgttgccagagctcagggagcacagcctacacatgccttcacatgcccggcacatacccagcacacacccgcacatgcccggcacatgcccagcacatacctgcacatgcctgcacacacctacacatgaccagcacatgcccacacatgaccagcacatgcccagcacatacccagcacacacctgcacacgcctgcacatacccatcacatgcccagcacatgcccagcacacgcctgcacatgcccagcacatgcctagcacatacccagcacacacccacacatgcccagcacacacccacacatgcccagcacacacccacacatgcccagcacacaccttgcctctggctgggaccccctttgctgctggccctgctcaggccccacagcttgatctcctcatgttcccactgctgacttccccaagctaactgtgccacagagtgggggaccccctcccggctctcacaacccccaccttcctctgcttcacttttcaccaactgaaatatggccaaaggcaaaaacccatgttcccactggcctgtgggtccccccatagatcgtaagcccaggaggaagggctgtgtttcagggctgtgatcactagcacccagaaccgtcgactggcacagaacaggcacttagggaaccctcactgaatgaatgaatgaatgaatgaatgaatgaatgtttgggcaaataaacgctgacaaggacagaagggcctagcgggaagggaacaggagtaagaccagcgcacagcccgacttgtgttcagaagacctggga

SEQ ID NO: 266 - DNA, 4938 bp, Homo sapiens
cagaatttaatgtttcaattagtaatttcagaggcccgcgttcttgcaagatctaggctatgagtacataacaaggtagcagaggtggaaggaattatatgatcaaatcacagaaccactgcctccttcacctatcttaacactcatccaaacacttattgccattcaattgcaggccctcgaattaatggtcctcaagagtctcactggaaggccgggtgaggtggctcacgcctgtaatcccagcattttgggaggctaaggcgggcaaatcacttgaggtcaggagttcgagaccagcctggccaacatggcaaaaccccgtctctactaaaaatacaaaaattagcctggcaaggtggcacacacctgtaatcccagctactcaggaggctgaggcaggagaatcacttgagcctggaaggcggaggttgcagtgagctgagattgcaccactgcactccaacctgagcgacagatcgagactccagtcaaaaaaaaaaaaaaaaaaaaaagagtctcactggaacctaccttttctgccttatttttccacttcatcccttcaaaatcctaggctccaggcaagatgaattataagctttcccatctttttgcctttgtacacaagattccatcctcctggatgctgtcactccaattcactaaattacacattttacctattctttaagctttagcttaaaagccttgacctctgtgaagccttcccagaactacttgcaagaactccgtcatgtgaattctcatgatacttcatgcatacctctcttaaggcatttattatttcctattttgtgtctttgtacttatttgattcaatgtgatctctctcttcttgtggagattaagattagaccatgcctaaagcaattttcaattccatcttcaagcatggtacccaactgtatgaatgtttccaaagtgtggtatgtgtgattattttacacagccaaacattttttaatagtgagatatttctttaaatgtatattagaaaaatattaaatacttttttttacttatgatcatggtaaaatgttttccttttaaaataagtatatttaagctttaaaatatggtttttttttaatactcagtacaggaactacacaggtagagaaaaattcatgaaggttatactcagatatctgaaacactgcactgaatggaaactgactagagaaccaaatcacagaaccacttcctccttcacatgagagttatctaaacagcagtaccaggatgtatcagtgctccctattgacaatcttctttaagtatataaatgcaagaatcacccaccttaaaaaaaaaaaaaactctccttcaattccctccagctactgcctgaaatgctaacctatagccccttgtgtccacttcctcaccctctattcactcaacccactgcagcacagcttccacccccagcacctgacatttgaaatgagcaactatctcctaaccgacaaaaaccagtgaaccctgttctgtccttatcttatttaactcggctctctaggcagcatttggcattgtggacttggggcattgcctattcattgttcctgaaaagttctttcctccgtagacttccacacactctcctgtcttttcagtcatcccttcttcaactcctttattgaatccccctcctttgtctatcccttaaatgttagagtttccctaatcttttactattaagatcatcataaaaggaatgaaaatagtaatgtttgcacacagtaaaaaaaaaaaaaggaaaaaaggaaaaagtacagaagagaaaccggaggttaacagtttcttatatatatatatttttccagaaaaaaaaaatgatgtgtaagtacattctcttttgttctttcacaaatattctgcaccttgtgacttgagttttgttttcatttttacttaacagagtatcttgaaggtcttttgtatcacctattggcacatacaattctcttattctcttaatggctgcttaagtattccccaaattaatgtattggaactaatttaactagtttcttgctgatgcacattagctagcttccaagttttatgctgttattagcaatgccacagtaaacacccttatacacatgtaaatttttaaaatgtttatacatatgtaaatttttaaaattcctataattttttaaattcctataaaagtaaacatccttcccagctactggagaggctgaggtgggaagatctcttggatctcaggagttccaggctgcattgagctgtgattgcaccactgcactccagcctgggtaacagaatgagacccggtctcaaaaaaaaaagaaaaagaaaagtaaacatccttgtacgtatgtaaattttttctatacatatgtaaattttaaaattcaggtggtggggtggaattgtcagacgaaaaggaacgtgtttttaattcttatcatcaaattgccctccacaaaacttaacaagaatgtacagcaccatcatgcatgagactgcctgtttaccctcacttttgcctcactttctttattgcctcacttttgcctagtcatctaaatttgtttgtcagtctgtaaggtaagaactaacacctcatgtttgttttcattcgtacttctttaatagtgaagttgagcatgcctcttctatttgttggtgttttatattcttttctgaaaactatttacatcctttgctaatttttctatcaggttgttcacttctttcctattgatctgtaagagctgtttgtgtataaaggaaattatacaatttgtgccgcaaaatatattttttcttttgatttagtttattttgcccgaaggtcatctttggccccacacagattctatcacattatatttgtcctctgagttgttgactcctaaatctataactttagcccagacctctatcctagctccaaatttcaactgcaggactgtatatcttcatctatatatgaagctaaaagcacatgtatgtttataaactcatcatacctggaactgaattattattttccaaatattcttttcctcttatgctcccttatattagttaatggtttgatcattcacctagaaactttacctggatgtcactcacttcttttttaccccctgcattcaactgatcaaaattctgaaatattttgcccaaatgactgcagtcagttactactagcaatgttgcatagtggttagagtataagctgcagagtcaaacaaaactgggcttctttcctggctctgacctttctacattatgtgacctaaagcgtatttctcacctaaagcctgtttcttcatctgcaaaaaataactatcttaacatctatttcacagggttattgaaaagacttaatgagattgtatgcagagtaatggaatataataaatgctcaataaatggtagctattatcttcctgctctagcttgtcccactcacttccaagccatcttccttgctgctgccagactcacactcacaaatccaaccatccccctgcttagagttgtccagtgactccccacctttttttttttcttttttgaaacagagtctcactctgtcacccaggcagaagtacagtggcactatcacagctcactacagactcaacttcccaggctcaagggatcccttccacctcagcctcctgagtagctgggactatagatgtgcaccaccacgtccagctaattttttctatttttttgtagaaacagggtctcactatattgcccaggttggcctgcaactcctgagctcaagcgatccggccacctcagcctcccagtgttgggattacaggcgtgagccaccgcacctggccttcccacttctttttctctgcacacacacttataacatctaaattccttagtatacaaggccatgtatacagccttttatcttttaccacagctgcatatgtgctaccctccagctacattaaactgtatgccacaccccaaacacaatttgaatgttttttcatacttccgtggtttcttgcacactgtacactgacagccaagcccttccctcagtccacttcttaagcatctactgcagactcagttcaagcatgtccttctttgtgcttccacagcactctgcactgccctggtacaaatcacactgttttgtagtcatatttacctgcttgtctcctccacaagattgtgagttccttaagggtggggattatgttttattcacatttgtatccccagcacccaccacaggacctaacgttttataggagcttcacctatgtttgttgaataaatggatgaatgaatagttctcgttctgagcagagctctgacctctattttcctactacttctgcagcaaacagtatccatatattaatatatgtggtcccttaccaaaccccctgactatccacccctcctcccagcagtgccaaacaccgcagccaaaatttctgatgctcaggcagttacaggagtgtgggactggtccaactagaagaggtggaacagaagccaatagtttcagtgtaggccctaaccaatgtcagtgttgctatcagagtccaccccaaatcccagagacaagtgttgctgtctacttatccagaacctaaccttaagtgtaatgaggggaaaacatatctcaagaccattcctttaagtgtgactggactggatggctacctacttacaccaccctcctcaaaccctgattcaacaagaagcacccacaggcacagcagatgcttttgtggtaactgaagaaaacacaaaggacacttctctgaggctcttcactcttaaaagtcaggctctacatctttagcaagcaaaaaacaggacacagtttatttttctactttcttttaatatcattttttaaagttggtaagcagc

SEQ ID NO: 267 - DNA, 4988 bp, Homo sapiens
ccattttaggttgcaatgacatcaaaatacaatgggactaatgatctttagagccacagtcaagaaaggatagagtggctggaacacaggggggagaacacttctaagaacccatcctgaagatattcttacacaagtgtacaaagatgtgtgtacaatgaggctcactgcagtattacatgtaagatttaaaagtaataatcataagtatggtatatccatataactaaatactatgtaatcgatataaagataacgaataaaacaagaaacgaagaatattaatgtatcaatgggattatggtggtaactgccagaacaaaaaccagagtggttcaaagtggttacctcaacttttgttaaacaagacgatggccggaacaaagagcacgtaagagacaaaggttgataagccacgtcaacacacttgggagacggaaggcaaatggggtgatttgcagaacagagaaagcaagatactcccgtatgcagagaggtggacacctttgaaaaaagcctaaattccagaaccctggaaaagctcagaactggaggaggcagggaacctgagagtctccaaatctcgagacgagccaaaataaggagaaatgccagactcagaaaactgggtggtaagaccttcagcccctgccccatagttggctccagaaacacggataaaactggcaaaatccatctcctaggagaggaggatttttctctggagaaactaaaaatcccagagaaaacatctgtaaggtacagacattggggcattcttcaccaaaatgactgagtccctgttagtcactctacaataaagtccatcaactgacaaactctgtctaggtacaaagcatttactcagctttgtacaaactgcaaaagctcaacagacaactaaaggatgctttcaacagaaaacagagacagacaaataaatggaagaatttgggagagagagacagggcagggagcaaaagaaaacttaggagaaaaaaacaggaaaaaacttcgattaatatcctcagagaaagaaaagaatatactgcatctaaaaccaagaacagggtgctaattcaaaaaggacagttagagaacaagaaaaaattcttggaaattcaaggtataagatctgaaataaatctggaaaagtcagaaattttagggatgttccctgaaggaagaaccctcccccaccccacacacacccagaaaaaatatgagaaaaacataagaaaattagaggatcagttcaggagtctaatatctaaagggcaggagttccagaaaccaagaaaagaaaaaatggagggaaagaaatgaacacaggaatacttcaagcacacagctctgaactgaaggcacaagtattcattgtgaaatgtcagaacactgaagataaggggggaagatcctaaaaatttcaagttagcaaatactggtcatatgcaaaggactaagaatcagaatggcaacagacttctcaacagcaaatttagaagccagaaaacaacaaagcaatgccttcaaaagtctgaaagaaaataattttcaatctaaacaagtcaaaccatcaacctgtatgagggcagaatacagattttcaaacatgttagaacttataaaatctaccccgtgtatgctttcttaggacgttcctagagttaagagtccaccagaacaagggaatgaatcaagaaagaggaaggcatgagatccaggaagcaggtgaaggagagtcccaggaggccttgacagcaactaattcagcctccaggagacagaaagctgtaagataaatgtctccagaggaaaataaaaaaggaagtaaagaactcaaatgagtttcataaatcttagagtttgggaagaattattaagcaataaccaaacaaatgaaagcaatgatctaactagttaagatcagatctatatttgcatactatacttgtctacaatcactttaatattgatttaaccaataattgtgatgtacctataccttgagcaagggaaactgaattctcatcttccataacatgatgtcagtagaagatataaactgctaaatcagtaaatagcaatataaacctttattttgaaatagaaataagtaggcaaggaaaaatacctaaaaagtgtccagagtggagcagcagcctgctttgtgtcaaaaagctgtgtagtactcttgacttttaaaaatcatcttcacgaattactttactactattaattaaaaaaaacaactggttacctctgaagagggagtctatgtgaaggattggggtgaggaaaactttttccattttgtgtacttttgcaccacatgaactacttttaaaaaatcaaatgcatatatgggttttataatttaaggaagaaaacaaaacattactcctacctagccaaaggtaataaaaactgggacaaaagggaaggaatagacttaagaaatccccaaaataagatctctaagacttggtgacttagcaatgtgttcaatcacatggaagagaaagctcctcttgtatatataaacataagaaaaattacataactaacctatgaaaatttaccttcacaataattgatgtaataagtcgttcagtggcaggttaaatttggaaagttaataacagtaataacaatgttattattattagagacagagtctcgtattattgcccaggctggagtgcagtggtatgatcatacctcactgtacctcaaactcctgggctcaagggatcctcccacctcagcctcctgaatagctgggacacaggtgcacaccaccaggctctggaaatttttgtagtttattttgcagaggcagggccttgctatgttgcccaggctggtctcgaacttccagcctcaagcaatcctcccacctcggcattccaaagtgttgggattacaagtgtgggctactgggcccagccattaattattattttgcccagctttcaaaccaagatggtagctactcattcttttctgttaaatgcaaatggttaagaatatcaatctccattacaggtttctgaccaaattttctcaacacactacaacactgttttaaaagatttaaagttgctcattacagatttggcattataatatttatttcagaacaaactttaaaccccagtagatcccactcgcttctgaaatgactatttttgacaatccttgaacactgaggctttcttgagcatgactttttaccctgcctagatggaaaaaccattctttgaagcagctcctcaaaatttggacttagctgcttcctcacctgatgtgcgagtacaattgcctaagagtataatccaaaaacgacttgctgaaactcatagatgattcatgtctctattctgtcctgctcctcctcaaacgagccagatcttagaggcgtttgttttccccagatacaaagaaaataaaatgaggttggcacctggaagaggcagtgccgtccgcaaagccaaagcaatgtaaccacttgtaccttaactcttctccgttttctccccttttcttcccctggaatctgcttctctcctttctttctctttttccgctttctgtccttgtgtttgtcatgatcgtttttgtcttcgaagaggctggagtcgtgccccgagctgcccgtggagagttcggtgacttcgttccctcctactttgaggaccagcttcaagggcttctctacatactcttaaaaaaagaaaagaaaagaaaggaaagcgcgtcgattaaaatcggggctctccagggagtgctaaggatgcagagcgccaaggcgcagcaagcccgaggcggctttgggcgctccgcgaagcacctgttgaatgacggaccccggcccgggggtgcggcggcgccgcccgccccgaacgctcccaggcctcccgggcccgcctcacgtctccccaccagagacccaccggaccagggggacccgggttcgaatgccgcggccgcacggggggcagcgcggcctccggcaggacgcgcccccttcgccggcctgggcctgccgtgggaaggaagggccccgggccgccccggagccactgggaaagagcggaagcccggcagagccgccgagggcccgccgcccgcaccccggccccctcctcaccctcgtagaggtgtttgtccgacttgtgcttcttgtgcttcttgcccatgtccgaccgggccccggtgcccgccccccgcgccaggcccaggccgtgcggcgccgcttccggtccgggccaggcgagcggagggcgggagcggggcccgcgagaccccgcgccgcgaggcaggggggcggcgcgcgccgggcggcgcgatgcccctctcgagaagacggcgcgcgagacccggccggagcccgagagcggcggcggggggggcgcgcggccggcgcagaggcgggaaagaaggcccgccgcgcgcacagggtgccggcggctgcgggtggcggcccctggcgaccggaggtggtgctgcagctcgcgggccgggggcggggccgagggcggggccggggcgggatccaccgctcagactctcgtctttcttccttcctccctttcccctcaatttgtctgtcttgtctctgtctctgtgtgtctctccctccgtctccacttccctcccttctttttactccctccctctctttctttctctttcccttcttcccttccttcctccttccttcctttctttcttccctccttactgcctcccttcaagccttccttctctcttttcttcctccctcatcacccttccttctcctcttcccgtctccttccctctttttttcttttctttttttccccttcctccttcccccactcttcctttctttccactttcccttgcttctgtttcttcccttttacgatattgactgaaccccatactgggtgccagacccagcaaactcagcacattggtgactgaagattctaatctta

SEQ ID NO: 268 - DNA, 5081 bp, Homo sapiens
tggtcaacaggcttaattttaacaattgcaaagaaactactatctgcctaactgcatacaacttatccttggtctttcagctatccataatttactttgattccgactggtactagttaatgatttttcagtttattgtgtggatttacagaatttgtttcaaatacacaccgaacaaagttgggagaggacacacattcaagacaccaatcatttaaaaaataggttggggtgaaacacacatgacactgttacatctcagggcttagcagtggaccaggtttgtaagagcaatggtcaaaagatgcttgaggctgggcgtggtggctcacccttgtaatcccagaactttgggaggctgaggcgggtggatcacctgaggtcaggagttcgagaccagcccgaccaatatggtaaaaccccatctctactaaaaatacaaaaattagccgggcgtgggcgtggtggcgtgcgcctgtaatcccagctgctcaggaggttgaggcaggagaatcgcttgaacctgggaggtggaggttgcagtgagccaagatcaagccattgcactccagcctgggtggcagagggagactgtctcaaaaaaaaaaaaaaaaaaaaaaacaacaaaacaaagatgcttgagctgaaaccagcccagtaatcccatagacagttgtgggttttttgttttttgtttttgtttttgtttttgttttttggataaacatagaaattgacccttccgctgttaaagcttgaaacctgtatttgttttgtctgagttccttcctcaggaaaagaccttcagatctctcaaaggcaggcagatcacctgaggtcaagatttcgaggccagcctggccaacatggtgaagccccgtctctaccaaaaaatacaaaaattagccaggagtggtggtgcgcacacctgtaatcccagcaactcaggaggctgaggaaggagaatcgcttgaacctgggaggcagaggttgcagtgagctgagattgcaccactatactccagcctgggtgacacagcgagactccctcaaaaaaaaaaaatcaactgaaactcaccacaactgaaactcaccacaacagatgtctccttgccccctccctagtcttgctttcttacacattgttatatttcttccatgctgtataaacccctagttttagtgagttagggagatggatttgaggctgagctcccatttcttcacctacggcagctgattaaagcttcttccttggcaatacccattgtctcagtcattggctttctgtgcagccagtagcaggacctagaccaaactcctggtgtttccgtaaccaagctttttttttttttttttttgagacagggtcatgctctgtcacccaggctggagtgcagtggcacaatcatggctcactgcagcctcaacctcccaggttcaagcgattctcccacctccgcctccagagtagctgagactacaggtgtacgccaccaccaccacacccagctaattttttgtagagacgggatctcgccatgttgcccaggctggtttcaaactcctgaactcaagcgatccgcctgccttggcctcctagattgctgaattacaggtgtgagccaccatgcccagccttgagctttacttgaaatgtttcagctttaataggaaagcagaaagtagagtgtgtgttaccttttaatagaagtatggaaggaaggaggaaaatatgccaaaaggttagcacagttaattctgagcaagaggaacgtgggtcatacgtttattcattatgagatttagatttttttgaaaagctcacctgggaattgttcatttcctgttcttcaccagtcagtaaagtcttgggaaggcagatctgagggaaaatggaaaagaaccatgaaatagcagaattcgctttggaagttggggatcatccagcatagaatgctccacaccctggataaaagctctccctaacccactcagaaaagccctgacttgtacctcagtgatccccttctgaaggtcttttttttttttgttttggtttttttgtgtttgtttatttattgagactgggtctcaaagaagaaagtgcaagccaggcacggtggctcacgcctgtaatcccagcactttgggaggctgaagcaggcagatcaccagaggtcaggagttcgagaccagcctgtccaacatggtgaaaccccgtctctactaaaaatacaaaattggctgggcgcggtgactcatgcctgtaatgccagcactttgggaggccgaggcaggcggatcacgaggtcaggagatcaagaccatcctggccaacacggtgaaaccctgtctctactaaaaatacaaaaacaaaattagccaggcgtggtggcgggcgcctgtagtcccagctactcgggaggctgaggcaggagaatggcgggaacccgggaggcggagcttgcagtgagccgagatcgcgccaccgcactccagcctgggcgacagagcgagactccgtcccaaaaaaaaaaaaaaagagagagagagaaagctaaacagcagttcaacagcacctttaaaacaagcctgtgcaaagacaatgaggcaagcatcagatcagctagagcacagtaaggaaggccgagagcagaaaccatgaatcctgaagcagctgtggtcgtgacgaataacgccgcagtgaacatgggatgcagatagcccttcagctttgccataagcgggacagctggatcattggtaattctttgccaaaagcgtagattttggccacgcgtggcagctcacacctataatcccagcactttggaaagccaaggtgggaggatcagttgagcccaggagttacttttttttttttttttttaagaccaagtcttgctctgtcgcccaggctggagtgcagtggcacagtctcggctcactgcaacctctgcctcccgggttcaagggattcccctgcctcagcctcccgtgtagctgggattacaggcatgcaccaccatgcccagctaatttttgcatttttagtagagacaaggttttaccatgttgttcaggctggtctcgagctgctgatctcaagtgatccgccggcctcagcctcccaaagtgctgggattataggcgtgaaccaccacatccagccaagcccaggagtttgagaccagcctgtgcaacatagtgaaacctctgtctcaatgtttaagtaataaagtttttattttttattttattttattgaggcagggtctcattctgtcacccaggctggagtgcagtgatgtgatcccggctcacagcagtttaaaaatccctggctcaagcaatcctcctaccttggcctcctgaatagttaagactatgggtgcatgctaccacatcagctaactttttattttttgtaaagaagggatcttgctatgtcacctaaactggtctcaaactcctaggctcaagcaatcctcctccctcagcctccccaaatcctgggattacatgcatgagccaccacaccagccaggaataaagttttaaataagtaaatatgtttttaaaaagaataaacttgccgggcacaactttaatgtttattaaagtttgaggagtccaattctagcacaaaaaatatatataattttaaaaaacagtaaattgtaaatgctttcaccacaaaaatagattaattagcttgatttaatcatccccccaatgtaaacatgtatcaaaacatcacattgtaccccataaataaacacaattattatttgtcaataaaaagtttttagaagtagctgtgggccagcagtaatgctaaggactggagggccacgaaaataattttgagtgtcctgggagcatcacttttcaatatgacaactaaaaaaaaaatctaaactaccaatgtaaaatatttagcttattccagcaaataggagaggtagaaaaatgaaactaagtaaaaatgcaaaacaaacaaacaaacaaaacccagacatttggttttcagggagaaaaaaaaatcagcttacctccagtggaatctggcataaattagcaagttgattgatttctgatgcctgtggtcttttcttctgaaagggactgaaaatgaaaaggcgtgtatactgaaaagctacactaatgactaaaacttaatcggccctctacccgctgtattccgcatcataatccagtcaagaaacaacccaaaacactcacttcctatcaaaagccccacctgatcctatcaggccacatcaaaatttcaattcccaattctttcctcgacttctccaaaactgaatgaactctcataaaaattgtgattgtgaaagcttaattttcaaatctgcccaatcagtttccaatggaattttttttaagttcatgcaagtaaaaattttttaccttaactttgaaatagaaagcatggaaaacattatccaaatgtcagaggatgaaaataaattaaaacaacaaaaattggctgggcacggtggctcatgcctgtaatcccagcactttgggaggacaggagttcaagaccagcctggccaacatggggaaaccccgtctctactaaaaatacaaaaattagctggtcatggtggcacgtgcctgtaatcccagctacttgggaggctgaggcaggagaatcgcttgaacccgggagacggaggcttcagtgagccaagatcgtgccactgcactccagcctgggcaatgagcgagactccatctcacgtctcaaaaaaaaaaaaagaaaggaaaagaaaaaagaaatagggccagcggaggtggaacaatgccttaaagtgctctccgcccgacagaaagaattcaggctccaacctccaactggcaaaatctcttcagctgtactaatactctcaaaatgagatcaacatgccaatccatccccaccctagtctgggtgttgaatttaaacacaggctacatgcccttgcctgcagacatggagaccttccaaaattgagcgtccaactgaattccaagagattaaaccagacttcatgggacaggatgcacca

SEQ ID NO: 269 - DNA, 5435 bp, Homo sapiens
acactagtatatacctgttaggtatatactagtgctatgcatctgccagaagcacctgagactctttctcaagagaggtcatagctcttggcaggtgctcggaggtgccccaggcccagaaaaaggtggggttatcttatagtctagatggattctcaaggtgatcgcaccctgaatatatcaccacacccaagatctgacctgtctatgcttgttactagataatgaagccagggctctagattattctatccaccaaggaagaggctttccaagcagcaggagattcacatgcatgttccaggcctctttttctgtgaggcagataatgtgcagggagagtcatgaaataaacccaactgccctagagcaggaaactgccgagggaacatccttctccccagggagggaggatcgaccctgtcttgcttgctattcaggcttcccatctacattgtctctggcatctgtgccatctcattttcggcatctgttgattctcttctcctatgtgagttgagatttccatgtttctttgtgttgccaagtaatctggggttgtgttctagacattttgaatattatgaggccctgagtcttgttgaaatcctttggccgggcgcggtggctcaagcctataatcccagcactttgggaggccgaggcaagtagatcacttgagctcgggagtctgagaccagcctgggcaacacagtgaaaccccgtctctacaaaaaaaataaaacaaatgagccaggcatggtggcttactcccatagtcccagctgctcagaggcggaggtgggaggaatgcttcagtccgggaggttgaggctgcaatgagctgtgatcacgccactgcactccagcctgggcaacagagcaacactctgccaaaaaaaaaaaaaaaagaagaagaagaagaagaagatagaagaagaaggagacggagaaggagaaggaggaggcttggcatggcagctcatgcctgtgaccccagcactttggaggccaaggcaggtggattgcttgagctgcttgagctactcgggaggctgaggtaggagaatcacctgagcctgggggaggtggaggctgcatgagccgagactgcattactgcactccagcctgggcaaccaggcttttcagagttccaagatggctgtgccatgtattttatccaggttttatagctgtgctcagtgggagaaaatgaggttcgtgcatgtttactccttcttatcttgaaccagaacttctaggcacagttttaatttgcattatatgcaagataattgtcattttatatatatataagtatatataatataaaattatattatataattataatataatataatatataatcatataatataatttatataatattatattatataaatataatataaaattatatatacatatattatatatacttatatatacatattatatatacttatatatacatattatatatactcatatatatacatattatatacacttatatatacatattatatatactttatatatatatatatatatacacacacacacacacacacacacacacacacacatatatatatatggcccagattggaattgtatagtgatttcctttgatttaatcactggaaaggatccctggtgagaaaggatggtgtcgtgcatggggtaagatgctatggggcagagctcagtgctctttggtttttgtaggcaccatggctgaggaaacagctccagcagttcttgagcggcaccagggggccctgtactccctctttcctgatcaccacgtgaaaaagtactttgaccaggtggacatttccaatggtttggattggtcgctagaccacaaaatcttctattacattgacagcctgtcctactccgtggatgcctttgactatgacctgcagacaggacagatctgtatgtatttttcattatttgtctcagtgctgccactattgttttcatatgtttgtgactagtaaggcgcctctccctcgcctcatgtgaagaagtcttcacttaaatggagagctttctgatgctactattctaatatagtaacgacagcacagacttgactgtgctgccaatcaaatcatggtcctcaacatatttaaatatggcaagagtttggcataatatggatagatctggggaagctaataaaaaataattaatacaaatatgggtagattctcaatccttttccttgccatcatcaccagaaagaggttcactgcaaaagagatcctattctaccaggaggtgcctaaaggcagataatacttaatggagtattggcgcaaaagagcagaaaacttgaggtttttgattgctatttcttgtttgtactttagttaaccataggcaagtactcagaagctaattaccaacctttcaaaatggaaaagcaaaaaaaaaaagtaattgcacgttgtccaactccatcaatacgcttgaaaggagccatagttggaaactgggagggaaggaattatttagaatctagaagggagtccttgaaactgtttcatgaaaggtgccaaaccttttatgaaacaaaagagcaacattaataataaaaatgacttggaaaaaatatccccagaactctgcatgcagatttaatcagaggcaaactattctggtgcagatgttttgctttgaaatatgtagtgctcgggaggctgaagcaggagaatcgcttgaacccgggaggcaggggttgcagtgagccgagatcgcgccactgtactcctgcctgacgacagagcgagacactgtcaaaaaaaaaagaaagaaagaaagaaaagaagaagaaagaaagaaagaaagaagaaggaaagaaagaaagaaagaaagaaagaaagaaagaaagaaagaaagaaagaaagaaagaaagaaagaaagatgtagtgctcttttttatgacagtttttacccattgtcattgtatgtggttttaacatttttccattatacctcaatctaatgactgtagtgacctggactttgtagtataaagttttggattttgatatttgttttttgtataccacggttacccccctttaagggcacctagtttgtttctgagtgcccctcctgcaagaaacaggctcttctaatatttagtcttgaatttggagcactcagtcaggcagaaaaagaattcatgtatcttgctagtttttgtgcatgaactgttcacgtggtaccattaagttgccttgcggatctcaagagttttgtaactgaaacagcaaaggtctaaccacaagctgacatgtacttgacatagacatgcagggccccagttcaggtcagcttcaaaaagaagtattattggtattttagtaagaattctgctttcttttttctctctccatctgaatgcttaaacagatatgcctgtacccaaacaaaagacaatgaatccatcccaatcatgtggtaaaaatcctttgttcacatgccagacactggataagctgaagtgatctgtatttataaccagcttgagagctctcggtttgattctcagtatttagtggcctgttgttttgttgtggttctgtttttgtttttgccttttaaccatagccaaccgcagaagtgtttacaagctagaaaaggaagaacaaatcccagatggaatgtgtattgatgctgaggggaagctctgggtggcctgttacaatggaggaagagtgattcgtttagatcctgtgacaggtaggcctgcagcaaaatgaaaaatccttgtcatggctaggcagagatatagcccgaaagttacagtcagaatttcttttcctgtagaggtgcgactttttgctcaaaataaattgtcagggaaagtagattaaatattaaatgcacagatgaatcctgacctccacagtcttcttagatcttccctagaaacaatacacaggttggaaattgctacaactaaacttaaaataaaatatttggtggtctagggaaaagacttcaaactgtgaagttgcctgttgataaaacaacttcatgctgctttggagggaagaattactctgaaatgtatgtgacctgcgcccgggatgggatggaccccgagggtcttttgaggcaacctgaagctggtggaattttcaaggtgatatggctatttcttttattttgggggtgggggatcccaaatacttacaggggtaagtaactgagtgattggtacttttgcatacttccaaagcataatcctatttagcatgttaagctcatcatactagactgaaaaacattttatttcaattttctagagagtaagttatctgaagtccaagatgatctgtttagcctactttgtacattaatttttttacttcctgtttattgaaattcttcagatcagtagaatgaacttggaaagccagtatttacaacatgcctagaagatcagttgattgttttgatgtcttaaggatttttcagattttaaacatcttttggcagcagaataaacactgataaaaatcgtagagcttttgagctgaaaagaaatacataatgtagaaacccctttcttagcaggcggcagatgataggagtaatccagttttaaatctaagttagtcgtaaatgattgctagttgaattattaactatatgaataattgggttggaccataaatatccagtcaggtaattcctttttatgataggagataaaacaaagataataggtggctaagtatattactacaaatcataaaaatgcttttgaagaatacttgtgaattacctttcacctgagattccctcttttctttttcaacagataactggtctgggggtcaaaggaattgctccctactcctatgcgggatgaggacaggtcttctttcctgccagagggagctctgaagacaactagagaattctgggcctgaaatttcaatctagttagaaagaaaaatgaggcaatgattttattaacagcgttaagttttaatttacaacttttaaaaggcagagcatttttaacaaggggtgacaggtggttttgataacacacttataaggctttctgtaaaaggtactatagaagggcgaagaatcgttcaactgtcaatcagcctcttgattctttgtaaattgccagggtgggtgggtacatatctcttcttgattctgcatttcatacttaactatattaaagcttcaaggaacaataaatagtaacctggtaatgacctattatgttcctttttattttcatcacaatcttataaaatataccacaatgctaactaacctacatagatatttcatctcctatatgttattttacaaactaaaatacggctggagggttagactcaaacatgctgtcaaaatccatggttccagctg

SEQ ID NO: 270 - DNA, 5622 bp, Homo sapiens
ggaggatatgttccaggagtttctttcaatgtctccaagaagccaattttcaaagattctgtgaaattggatggaagagtagagagaaaaattagtgacttcagtcaaaactacacactatcctagtgcctactcacttccttccctccctctcccgtgttacacactggcaagagctaagctctcactcgggcaagggtgaagagcctcatctcctagctggtagtctcatgactaaagagttcacatttccagtgcaggaccaggccctggactagacaggcaggcagaagagcagcaggctcccttcccttttccctagcccccaactatggacatgttagggggatattaacagataaaagaaatcagaaatacccaagaaaaatcctctctccttgccaatacgtgtccctcccttgttcaaaatccagctcagaactcttctctttccagaaagctgtcttaagaccactcccttaactccacatcacatctgctcttagattggcgtgtgtgtgggtgtgtatgtttgtgcacatgtacatatgtgggtgtgctttctatctcccaaactagaccatgagctacaaaaagacatttctcaggcaaaacccttacccttttctaccccttagcacaaggcaagttttacaaggcagaagaagagaggatgctccgagacaaaatacatccccagcctttgggattacctcagaaatgccccagtactctggatacagaccagtaattatggccccagtgcccagcagttggccaaagagaaggccaacacactgattaatactcattgatgtgcactgaggtttgcaaccctgctcaagagcagataactgtgctcatttctaacctgtcctaaagtacctttcacaatggtaccaccaggaaacccaacaaccctctaagctgcccttaactcttcccccacccagccccactccaacaacggacactgccctgtatactcactgagggccacatagacgatgttgaaggcgaagacatagattgtgaggagggagagagaaaggatgaagaggtagaagtagcggtagttcctctttccaacacaattccccacccaggggcagtgatggtcgaagcgctctgtgggagaaagagagagtccaaagccaaaagcctccagaacaaaaatcaaccccaccatccctataatacctaattcaaagacctccaggatcattgtctatttcagttgtaaaaaatatagggtttttttttttttttactttttcaaaatgttttcataaccatctcatttgatcctcacaatttccctggaacttgggcaaaaggagatactcttttccccactttacagatgaagaaacaaaggcatggagaggttaagtgatttgcctcactcagctcattaaaagcagagacactgcttttccaaataaaatcttaatcggtgggcctactaagttcaagaagaataaacaggtcaaaatagccaaggaaaaatgtaaaactacaatatttaaaatggtatggcatagttcaatggaatggaaagagcccagaaacagatcttagaatatataagattttgttgtctaataaactcagcattacaaaatcagaggtaaaaggaagtattattccataaacaattacgtgacaattggctatttggtgcaaaataaggatcgatttttttgtcttcatactacttgtcatagtaaattccagatgaattaaagaactaaatgtaaaaacaaagtgaatccataaaataactataaagaataaatgtttatttgtcctctatatgcagaaggactttctaagcataaaagtactggaagaaaacagatgacaaggaaaaatagatttgactccataaactttaaaaaagtactttgtggttttgatttgcatttccttggtgatcaatgatgtgattattacacattgcatgcctgtatcaaaacttctcatgtacaccataaatatatatacctactatataccaacaaaaaattaaaaatttaaaaaatattttgtgtatgttaaaattaccataaagaagactaaagaaaaaaaaacaatggcaatctatgtaaagttgtacctgactatatgaaaagttcttagaaatcaataggaaaatacaaatacttcgtcaagaaaataatagtcaaaagttacttgaaatttgctaagagagtaatcttaagtgtcctcaccacacacacacatgcacacacaatggtaactatgtgtggtgatgaatatgttcatttgattgtggtaagcattacaggcagacaccaaaatccacccatactcaagtcattcagcagccctgcagaacccacggataagaaaagttgcccctcatgtacacaggttttgcatcttgtgaatactgtacatttgaaccttgaacaactcaggttagaactgcgtgcgtccacttgtacatggatttgtttcaataaatacagttggccctccgtatcaacaggttctgcatccacaactaaacctagatcaaaaatacggtattcacaaaatatgaaactcctggagacggatacagagggctgacttcatatccatgggttccacagggccactgcaggacttgagaatgcatggggtttggtattcaagggcaatccctgaaaccaatcccccaaggatacttagggacgactgtattttggatccgcatttggttgcagatgaggaacacactgatactgtatttattggaaaaaaaaaaccctcattattaagtgggcccatgcagtacaaaactgcattgttcaagagtcgactgcacataaaacaaaaacaaaaaacaaacaaaaaggaaatagggcaaaaactaataaataccataaaacctatatttaatatttttcctagtcaccaataattcattgtaatactagtaaaataatagcatattttatgcctatcaaaataagaatataaataataaaatccagtgctagtgagaatagggtaaaatggacactctaacatactgcttgtgggagcataaaatgaaagaaccttcccagaaagcaatttggcagtacgtatcaagagccttcataaagcttgtacccctttggtagaataagtccattttcagcaatttctcataagaaaatagaaatgtacacagaaattttaagttcaaatttttatttttatttatttatttatttttgagacacagtttcacacttgtcacccaggctggagtgcaatggtgcgatctcggctcactgcaacctccacctcccaggttcaagcctcatcagctgcccgagtagctgggattacaggcatccgccaccacgcccagctaatttttgtatttttagcagagacggggttttgccatgttagccaggctggtctcgaactcctgacctcaggtgaaatgcccgcctcagcctcccaaagtactgggattacaggcatgagccactgcgcccggccgaagttcaaacttttaaattaaattttgtattgtttggaaggcccaggcaggggaatcatgaggtcaggagtttgagaccagcctggccaacatggtgaaaccccatctctaccaaaaaatgcaaaaatccgtgggtcgtggtggtgcacacctgtaatcccagccaatcacgaggctgaggtggggggatcacttgagctcgggaggcggaggttgcagtgagctgagatcacgccactgcactccagcctgggtgacagagtgagaccctgtcttaaaaaaaaaatctattatggtaaaatatacataacatacaatttgccattttaaccattttaagtgtgcaattcagtggcattaattacattcataatgtggaaccatcaccattatctatttccaaaaccctttcattactccaaacagaaactctgcacccattaagcagtaactctccatttcccccttccccatcccctagcaatctctaatcttctgtctctatgaatttgcccattctagatatctcatataagcggaatcacacaatatttgtctttttgtgtctttttttttttcacatagcatgttttcaaggttcatccacattgtatcagtactgtattcctttttatgactggataatattccaccgtatgtacataccacattttgtttaaccattcatctgttgatagacacttgggttggttacaccttttggctactgtgaataatgatgctacgaacactggcgtacaagtaggttttgagtccttgttgtcaattcttttggctattgttatggaatgaactgtacccccactccccagttccatatgttgaagccctaacccccaatgtagctgcacttggaggcagaacctttaaggaggtagctaaagttaaatgaggtcatctggatggggccctaatccgatgggactggtgtccttgtaaggagaggatgagacaccagtagtgtgtgagcacagagaaaaggtcacgtgaggacacagcaagaaggcagccatctgcaagccagggggagaggcctcaccagaaaccatcccttctcgcacctctatcttggacttccagcctccagaattgtgagagaaaaattcccattgtttgagccagccagtctgaggtattttgttatggtaacccaagcagactaatataggtatacacccaggagtggaattgctgggtcatgtggtaattctatgtttaactttttgaggaaccaccaaacttttccacagcagctgcatgattttacattctcaccagaaatgtatgaaggttccaattgttccacatccttaagtttaataattatgattgcagtgttacaacaatgaataaaatagaagaatgaataatgtctaatgacagaagactgcctgaataaacttgaatagaaccatatgatggattatgcagtcattaaaataatatattaaagaaacatttattaaagatgtagaaaaacgctcaggatagaatgttaaatgacaaaagcaggattaaaaactatcatgttacagtccaattttgcagaaacactagtaggaaatatagcaaaatggagagtgaatttaggattaagttttatttatactttctgcacttcccatattttccacaatgaacatgtgttattttgatgaataaaagactacaaaagaataaaatacatcaatttgggccaggcgtggtggctcacaccagtaatcccagcactttgggaggccgaggcaggtggatcacaaggtcaggagatagagaccatcctggctaacacggtgaaatcccgtctctactaaaaatacaaaaaaattagccaggcgtggtggcgggagcctgtagtcccagctactcgggaggctgaggcagaagaatggcgtgaacccaggaggcggagcttgcagtgagctgagatcgcgccactgcactccagactgggagagagagacagcctccgtctcaaaaaaaaaaaaaaaaaaaaaaaaagaataaaatatatcaatttgaaagaaaagtgagctgtgtactggtgaaaaaataaggctgtaaaaatggtctatctcctgctgaggaagcta

SEQ ID NO: 271 - DNA, 7010 bp, Homo sapiens
ctatttaaaagcatgctaagagaggaagtggaatgatgttgtatatgtttactttgaggaaattatgaatggaagggtagaaatacctttagttagataaagatagcaatagggacaaaaagtaaaataatctcttgtgttattattgctattattattactaatatttacggagtgctcattatgttcatggctgctctaagcacattgcaattaggaactcatttaatgctcacaatggccttatgagctaggttttactattatccttactttacagatgagaaaaccgagacatggtgatgataattaatgtgcccaatgtcacatgactaataggtagtggattggagagtctataataagacacttggccagaaggagacaacggatgctgattttcaacacagatcacaaaagcgtcgtaggaggaaagggtagtaaacatgagtgatttcaactccataaacatctgctagttgtatcgatttgcaaaatgcaaatatatggcaagttcccaaatttttgtgttaatgactacacctcccaaaaggtagagaaaataagaaacttgcctctctgactgacttagaaaaagagaaactggtgagttgaaggtgataggaacctttagaggaagtgaagtattttatcttagagtccataagtaccttataaggcccaaatcccagactttaggaaaagagcttgctgaagtaaagtaggtacaatttcatgccctgagatactctaatatggagatgaattaagagagttgggaagttattatattttattttttttaacctgttgaaaccagtgtgtctgtactgggtgttatccattcacattcagtttggatttcaaaagaacaggtgccaaaataaagggatgaaaaccaaaaataagtaagtttaagagggcatgatgaaaataatgctaagaagaattataccccaaatgagcctgaggcttgagaaaaaaactgctaaagatgacagaaaagtgctttttaaaaaatatatttaaaccaagaagagcaagggtaggagagacatgcaacccatgaaattgttattggatggccaatatctgagaggccttctcaactactgtactagttttctttgtgaaaaagaatgatgatagacttgaaatggtaaaatcaatatcagtaaccataaattgaagctaaaataggcaaagcagtcattaaaaggcatttggctgttctataataaatgaattaaaattctatcccagagtggtcagaggtcttggagattggattaccctgtcacagttgctaaagttttagcaactgtagtgtggttgaagtgtgacaggagactagaaacagaaaacattggctttagttttcaaaataaacaggaagcatatggactccttagactagaccaagaaacaggttgattaaatacaaaattctacaacaggttaataaaagaacagtttgtgagcgcttaggaaaaaagtagtaaccataagaaagcaagcagtataaattctctaagaacaagttatgttagacaatctcatttcatttctattcttgacatggttattagattggaagatcggtaagaatgtaagcatactatatctgaatatcagcaaggcatttaacaaggtctcccataatatggctatgaacaagatggagaaatgtgggttgttagtaaaagaatgttgcctaatagataaatgtcaccagtggcatgcacagagatctaaccctaatctggtcttatgtaacatttgtatcgataacttacataaaaaagagggaagcatacctaacaagcctacagatgacataattctgagagcaaaagcaaatagtttgtatggtagaattagaactcagcaacatttccacatgctaacaagatgagatcaaattaggccaaatcaaggctccaaatatatttccactgttatcttccataccaaacacaaaactgaaaaagaatcaactatgtacttacagaataaataaaacgtggtttagcttcagaacatgttaaacaggctttggggtttagtttccggtgttctcaatgtgtatggatagtgtcatgtggccaccaaaaaagctgatactggagtagacagcattaacgaaaatacataattagaacaagagaggtggctaattgttggtcatagcataaaatcctcagtgaatcagtcaaaatgactgactgctgagagtcccatctaaggaacatcaaatctgctcacggtccttcctcaagggacaaccatagatggccatgttgtttattttaatcacatgacttttctctccccgtagcctcagttgactatgagaataattgccagggcttgccaaaaaactgaaacacagcctgctataaaagggatgaactgggctaatcaaattccctcttagggttttgagcctacagtgaccaagataataatgcagttagcaatgggacatgcagctgaagggatgaggtgagaggtgtgaggaggtactcttggagtcatgtggtacagtggagaaaagacatcgttatgagatagtagaaactatgtggtagacaaaataaatattgagctgatggaaagaataagctattggacaaagaaacagacagagaggagcaaaaatgcagagaactgctgagtcttattaatgctagagatccacagtctttgcctttcctttggggattgaccagagtttcccgcgttcccggggactgacaacacatacactgaaaagatgttctcaattactcgaggcaacctgaatgtctctggcttcttgcaaccagagaggctaataagaacccacacctgcattcagccttgaacattacatttcaagagcagtttggacaaactggagtgttctaaagaaagagaccaggaagggagatttgaaacccattaatgtgaggaacaggttgaaggaattggggaaacatttagcacaaagaatagaggactcaagaatagtgaagggctgtcagttgtaaggggaattttacttattctgtgagaccctaaaattagatttgagaaaaatgggcagagttaagaagggatagattttggttcaaaaagaatcttctagtagttgtttgaggtagagtggaataacttaggaataagccaattacctattttggagatatttatgcaaaggcaagtggccacttagtagggatagtaatgttaccttttaattgtgtagtgctttacagtatatgaggcactttctactacgttagtttgattttcctaattaggaagtcaggcatttgtatattcatttttacagatgaggaggctgaggctcagacaggttctgttacacagttcatgtataagttcctggatacccacagttacctttattgactacatgagaaatgaacattttaaaggctatatttgaacaatgctagttgatagagctaataacgtttctggcttttaaaaaatcatcattgtgatgctaaatatatgttcaaatgtactaaaaaggtactctgttcactcttacatgaaaacttatgttcttctctgcgtcttaagaaactgagaccaattaatatattccttgcatagatacagaaggtccgtgggtgcagtttgtacaaacatgcctagatgtacatttcaaataagaataattttctctctccatttgcctgaacccattccccactctctcccagattttctgttatttggcttcaaagacgaaaggagtgtgtttgcttgtcagaactgctacttaaccatattgccctgttgtttcctcagctctctatcactaagctctgcaaatgaactaaaagtaaaatgaggaaataaccactgtttgaaaactccttgaagaagatatacattgttctttgcattttaccctttactcacctccccctttcaattaaaaaagaaagaaaagaaaagaaaagaaaagatacagggctgggcacggtggctcacgcctgtaatcccagcactttgggagggtgaggcgggcagatcacaaggtccggaattcaagaccagtctagccaatatggtgaaaccctgtctctactaaaaatacaaaaattagctgggcgtggtggcatatgcctatagtcccagctactctggacgctgaggcaggagaatcgtttgaatccaggaagtggaggttgtagtgagccaagatcttgccaccgcactccagcctgggcgacagaaggagactgtctcaaataaataaataaataaataaataaataaataaataaatacagaaactctatcactagtatagttctaattgggttattgtcaccataggtgctgactgctatatttttctcttggaatgtagcagaaatcaccctttatgaaaccatttaatctggtaagtgatggatgatactgtttcctggacatgggccatagtacttgcagtttgttgatggtgaaatattctctgatgccatggttggtatttaatttaatatgctgctaaacaacaaaaacaataacaaccagtcttaggagagttgactagtccttctctttccattccaattcccagagatcagattagaaggtgataccagacattgtttatcaagtagtatattatacccattttttacatacaaatgtctttagaaaaagtttctgtaaattggatagctataggtagaaggaaactggactcctatccctcactgtatacaaaaattaactcaagatggattaaatacttaaatataacaccagaaactataaaaatactagaagacagcctaggaaaaaactcttcaggacattggcctaggcaagaaattttatgaccaagacctcaaaagcaaatgcaacaacaacaaaaatagacaaatttggcttaattaagctaaaaagcttctgcatagcaaaataaataatcaacagagtaaacagacaacacacagaatgggagaaaatatttgcaaacaatgcatccaagaaaggactaatatccagaatctacaaggaacttaaacaaatcaacaagaaaaaaatacccaaaaattcctgttaaaaagtgggcaaaggacatgaacagacatttctcaaaaggtgctgtataagtggtcaacaaacagatgaaaaaatgctcaacattattaattatcagagaaatgcaaattaagaccacaatgaaatacgatctcataccattcagaatggctattattaaaaagtcaaaaaacaacaggtattggtgaaaatgtggagaaaaggcaatgcttatacactgttggtgggaataaaaattaacacaacctctggaaaacagtatggcgatttttaatagaacttccatttgattcatcaatgcacttctgggtatctacccaaagaaaaataaatcattatatcaaaaagacacctgcatgcatgtgtttatcacagcacaatacacaagagcaaaatcatggaatcaacctaagtgtccatcaatgaataattggatgaagaaaatgtggtatatatacaccatagagtaccacagagccttaaaaaaaaatcatgttttttgcagcaacatggatagagctgtaggccattattcaaagtaagctaactcagtaacagaaaatcaaataccacatgttctcacttataactgggagttaaacaatggctattcatggacataaaaatggaaatgatagacccttgggactccaaaaaagggaggatgggcggggagtgagggttagaaaattacctattgggtacaatgttcaccctttaggtgagggtacactagaagcccaaacctcaccactgcacaatatatccatgtaacaaacatgcacatgtatccccgaatctataaaaataaaacaaaaataaaagcttccattgtagaactaaataaggcacacaaaaaaacaaggggaagtccttgaatttcaaagaaaatagaatctatgttttattagttagtgtttttctatgtcaatataaagttgtaatgtttgatttaagaaagtgactagaaatgatgaataatttctttattaattgtatctggtgctaaaatctatcatgatcaagggacctagaactgcaaagagtagaacttttatcatgacaaagctctgaggagtcaatctagaaatctaaacatgtgaagaaaaacagaggcaaacttttttgctcaaaagaccaaaagcttcaccctaaaggcagaatttagtttttaaacttacacatatacttccattacatgaggctgatcctttttttttttaatgtttgaaggcaacttattttttcaaagaatcttacaataaataaaatagaaatgatcactcctcctccagttgtgtttgggttttcttgtaatactgcagttttttaaaacaagggacaattgcctttcactttgaggctgcagtgacagcttagataattgctttgttttatgtttttgtggatatgtgacagcagggtgtttatgtatctgcggcttcatcttttcacgtgtatctgctttggtctgtggctgtggctggatctagatgtttgtgtctgtttgcacatctgcgcctgtgaaggagtcttcctttttgcccatgcatctgggtgtgtatcggtttgtgcatttgtgtgtctctgcagatgtgtgtgatgaaatgagtttctgcaatcagtagaaccatcctctgccaatacttaagtttagtgggatcaataatagctcaagtacctggtctccaatggtatgttgctgttcaggacccagctgttatgcagatggactgaatcctgcgtgctggttgggggagctggagcagctgggctgggctggctgcgggtagtcattgatctcctctgaagagagtccgctgcagggggtggcttcctggcacaggtgcaggcatgaggaggcggaggtggcggtgggaggggtctgaaggtgaactggttgtgtgggctgc

SEQ ID NO: 272 - DNA, 7597 bp, Homo sapiens
tcctacttacttgactttataaagcaacatgtataaatttgtgttgatgttcatacagtgtataaatataaattattgtctaccaagatcttcactgttttaaaaaatgcctgcaggcatagcttttttttttcccccttttccaagttaagtcagtaccctcaagcagagctgcagagtcctttatccttatgtcctgcctttcctcctgggaagaatccctgaaccactgcaccagagctggagccagggacctgcttttatctgagtgatgcccctgctctgtgagatagttctaggaaggggtggcagctcctggtcctcttggattgcccattttggagtagaaaatatatttgaggaaataattgtcaaaattttccagatttgttgaaagatataaatttataaattcaagaagtttcatgaattccaaatggaataatctcaaagaaaaccacctctaggcacatcttattgaactgctgaaaatgaaaagtaaagaaaaaattttagactgatcattccaagatggccaaataggaacagctccggtctacagcttccagtgtgatcgttgcagaagacgggtgatttctgcatttccaactgaggtacctggtttaactcactgggactggttggacagtgggtgcagcccatggagggtgagctgaagcagggcggggcatcgcctcacctgggaagtgcaaggggtcggggatttccctttcctagccaagggaagcaatgacagatggtacctggaaaatcgggacactcccgccctaatactgcacttttccaatggtcttagcaaacggcacaccaggagattatatcctgcacctggctcggcgggtcccatgcccatggagccttgcttactgctagtgcagcagtccgagagcaactaggctgggggaggggcatctgccattgctgaggcttgagtaggtaaacaaagcagccaggaagcttgaactgggtggagcccaccacagctcaacgagacctgcctgactctgtagaatccacctctgggggcagggcatagcctaacaaaaggcagcagaaacttctgcagacttaaacgtccctgtctgacagttttgaagtgtgccatggttctcccagcatgtagtttaggctctgagaatggacagactgcctcctcaagtgggtccctgactcccgtgtagcctaactgggagacacctcccagtaggggccgactgacacctcatacagccagatgcctatctgagacacaacttccagaggaaggatcaggcaacaacatttgctgttctgcaatatttgctgttctgccacctctgttggggatacccaggcaaacagggtctggagtggacctccagcaaactccaacagacctgcagctaagggtcctgactgttagaaggaaaactaacaaacaggaatagcatcaacatcaacaaaaaggacatccacaccaaaactccaaatgtaggtcaccgtcatcaaagaccaaaggtagagaaaaccacaaagatggggagaaaccagagcagaaaagctgaaaattctaaaaaccagagcgcctcttctcctccaaaggatcgcagctcctcactagcaatggaatgaagcgggatggagaatgactttgacaagttgacaaaagtaggcttcagaagattggtaataacaaacttctctgagctaaaggaggatgttcaaacccattgcaaggaagctaaaaaccttgaaaaaagattagacgaatggctaactagaataaactgtgtagagaagatcttaggtgacctaatggagctgaaaaccatgtcacaagaactacatgacgtatgtacaagcttcagtagccgattcaatcaagtggaagaaagggtaccgattcaaccaagtggaagaaagggtatcagtgattgaagatcaaatgaatgaaatgaagtgagaagagaagttcagagaaaaaagagtaaaaagaaatgaaaaaagcctcaaagaaatatgggactatgtgaaaagaccaaatctgtgtttgattgatgagagaatggaaccaagttcgaaaacactcttcaggatattatccaggagaatttccccaacctagcaaggcaggccaacattcaaattcaggaaatacagagaacaccacaaagatactcctcaagaagagcaaccccaagacacataattgtcagattcaccaaggttgaaatgaaggaaaaaatgttaagggcagccagagagaaaggtcgggttacccacaaagggaagctcatcagactaacaggggatctctcagcagaaattctacaagccagaagagagtgggggccaatattcaacattcttaaagaaaagaattttcaaccccaaatttcatatccagccaaactaagcttcgtaagtgaaggagaaataaaatcctttacagacaagcaaatgctgagagattttgtcaccaccaggcctgccttacaagagctcctgatggaagcactaaacatggaaaggaacaaccggtaccagccactgcaaaaacatgccaaattgtaaagaccattgatgctaggaaggaactgcatcaactaatgagcaaaataaccagctaacgtcataatgacaggatcaaattcacacataacaatattaaccttaaatgtaaatgggctaaatgccccaattaaaagacacagactggcaaattggataaagagtcaagaaccatcagtgtgctgtattcaggaaacccatctcacgtgcagagacacacgtaggctcaaaataaagggatggatgaagatctaccaagcaaatggaaaacagaaaaaagcaggggttgcaatcctagtctctgataaaacagactttaagccaacaaagatcaaaagacaaagaaggccattacataatggtgaagggatcaattcaacaagaagagctaactatcctaaatatatatgcacccaatacaggagcacccagattagtaaagcaagtccttagagacctacaaagagacttagactcacacacaataataatgggagactttaacaccccactgtcaacattagatagatcaatgagacagaaggttaagaaggatatccaggacttgaactcagctctgcaccaagcggacctaatagacatctacagaactctccatcccaaatcaatagaatatacattcttctcagcaccacatcgcacttattccaaaactgaccacataattggaagtaaagcactcctcagcaaatgtaaaagaacagaaatcataacaagctgtctctcagatcacagtgcaatgaaactagaactcaggattaagaaactcactaaaaactgcacaactacatggaaactgaacaaccttctcctgaatgactactgggtaaataacgaaatgaaggcagaaataaagatgttctttgaaaccaatgagaacaaagacacaacataccagaatctctgggacgcatttaagcagtgtgtagagtgaaatttatagcactaaatgcccacaagagaaagcaggaaagatctaaaatcgacaccctaacatcacacttaaagaactagagaagcaaaagcaaacaaattcaaaagctagcagaaggcaagaaataactaaaatcagagcagaaatgaaggaaatagagacacaaaaaacatttaaaaaaatcaatgaatccaggggctggttttttgaaaagatcaacaaaattgatagactgctagcaagactaataaagaagaaaagagagaagaatcaaatagatgcaataaaaaatgataaaggggatatcaccaccgatcccacagaaatacaaactatcatcagagaatactataaacacctctatgcaaataaactagaaaatctaggagaagtggataaattcctcgacacatacacccttccaagactaaaccaggaagaagtcaaatctctgaatagaccaaaaacaggctctgaaattgaggcaataattaatagcctaccaaccaaaaaaagtccaggaccagacggattcacagccgaattctaccagaggtacaaggaggaactggtaccattccttctgaaactattccaatcaatagaaaaagagggaatcttccctaactcattttatgaggccaacctcatcctgataacaaagcctggcagagacacacacacaaaaaagagaattttataccaatatccctgatgaacatccatgcaaatatcctcaataaaatactggcaaacagaatccagcagcacatcaaaaagcttatccaccatgatcaagttggcttcatccctgggatgcaagcctggttcaacatatgcaaatcaataaacgtaatccatcacataaacagaaccaaagacaaaaaccacatgattatcttaatagatgcagaaaaggccttcgataaaattcaacagtgtttcatgctaaaaactctcaataaactaggtattgatgggatgtatatcaaaataataagagctatttatgataaagccacagccaatgtcatactgaatggcaaaaactggaagcattccctttgaaaactggcacaagacagggatgccctctctcaccactcctattcaacatagtgttggaaattaaggccagggcaatcaggcaggagaaagaaataaagtgtattcaattaggaaaagaggaagtcaaattgtccctgttcacagatgacatgattgtatatttagaaaaccccatcatctcagcccaaaatctccttaagctgataagcaacttcagcaaagtctcaggatacaaaatcaatgtgcaaaaatcataagcattcctatacaccaataacagacaaacagagagccaaatcatgagtgaactcccattcacaattgcttcaaagaggataaaatacctaggaatccaacttacaagggctgtgaaggacctcttcaaggagaacgacagaccactgctcaacgagataaaaaaggacacaaacaaatggaagtactttccaagctcatggatgggaagaatcaatatcttcaaaatggccatactgcccaaggtaacttatagattcagtgccatccccatcaagctaccaatgactttcttcacagaactggaaaaaaatactttaaagttaatatggaaccaaaaaagagcccgtattgccaagacaatcctaatcaaaaagaacaaagctggaggtatcacgctacctgacttcaaactatactacaaggctacagtaaccaaaacagcatggtactcgtaccaaaacagagatatagaccaatggaacagaacagagccctcagagataataacacacacatacaaccatctgatctttgacaaacctgacaaaacaagcaatggggaaaggattccctatttaataaatggtgctgggaaaactggctagccatatgtagaaagctgaaactggatcccttccttacatcttatacaaaaattaattcaagatggattaaagacttaaatattagacctaaaaccataaaaaccctagaagaaaacctaggcaataccattcaggacgtaggcatagtcaaggacttcatgtctaaaacaccaaaagcaatggcaacaaaagccaaaattgacaaatgggatccaattaaactaaagagcttctgcacagcaaaagaaactaccatcagagtgaacaggcaacctacagaatgggagaaaatttttgcaatctactcatctgacaaagggctaatattcagaatctacgaagaacttaaacaaatttacaagaaaaaatcaaaccaccccaccaaaaagtgggcaaagtatatgaacagacacttctcaaaagaagacatttatgcagccaacagacacatgaaaaaatgctcatcatcaatggtcatcagagaaatgcaaatcaaaagcacaatgagataccatctcacactagttagaatggcaatcattaaaaagtcaggaaacaacaggtgctggagaggatgtggagaaatagcaacacttttacactgttggtgggagtgtaaactagttcaaccattgtggaagacagtgtggcggttcctcagggatctagtactagaaataccatttgacccagcgatcccattactgggtatataccaaaaggattataaatcatgctattataaagacacatgcacacgtatttttattgcggtactattcacaatagcaaagacttgaaaccaacacaagtgtccatcaatgatagactggataaagaaaatgtgatacatataccccatggaagactatgcagccataaaaaaggattagttcatgtcctttgtagagacatggatgaagctggaaaccatcattctgagcaaattatcacaaggacagaaaaccaaacaccacatgttctcactcataggtgggaattgaacaatgagaacacttggacacacggcggggaacatcacacaccggagccttccgtggggttggaggatggggaagggatagcattaggagaaatacctaatgtaaatgatgaattaatgggtgcagcaaaccaacatggcacatgtatagatatgtaacaaacctgcacgttgtgcacatgtaccctaaaacttaaagtataataaaaaaataaaaaataaaaataaaaaagtggtatataaaaaaaagaaaaaaattttaaggtagttagaggaaaataactcatttcttctaggggaacaataatttgaatgactgtgattttcttatcacaatgaaggccagaaaacagtggaacatctttaaagtgttgaaagaaaagaattgccaacccataaatctatgtccagcaaaaatatccttcaaaaatgaagacaacatgaaaatattctcagatgaaggatagcaaacataatttgttgccagtagacatgctgtaccagaaatgttaaaggaagctcttcagactaaaggaaaatgataccagagggaaacttgaacctcaggaatggagaagcaatagaaatgataaatatctgagtaaatagaaaatacttttttcctcttttgttctttaaaaatagctgttacactagtttcctactgctataacaaattgtataaaatgttaccacacactcaattgcttaaaacaagacaaatttattatcatacagttctagaggtcagaagactaaaatgggttgaaagggctgtgttaccactggatgctctagtggagaatctatttccttgcattgtccagcttctacaggcggcctgaattccactgtttcactgcctgattctattgtcacatctttttctgactcatctgcttccttccttcctttacaaggacgctgtgattacactgggcccacccagatagaactggataatcttcctatctcaatattcttaacataatcacatctgcaaagtcccttttgctatatgaggtaacatattcacaggttccaatatgtagacatctttgaggagccattattcttcccacaacaacaattgtcaaggattcaataattcttatacaatttaaagtgttctagagc

SEQ ID NO: 273 - DNA, 8773 bp, Homo sapiens
gaatgtggacccccaaatctaggacagaggaagttggcaagaagcctcgtggagggagggggtttgaacggtgggcaggggtcttgacccccacctagctcccctgtccctcagggactctcctccaccctctctctctccctctctgagcccctttttcctgagtccctacacctcagacctttcacgcccccatttctctgacacttggctccctctccccatccccacatacctgatgccccatatccctgtgcctccatctctctatctcaccttctccctgtacccccctccctgcatcagtccccccatcgcgagccggtcctctccctctctcctctcgctctcccctcccatgtcagagctatgagtctgctattaatacccccgccaaggaccttgagggcatccaggcccccagcacccctcgccccaagctcccaccccttcctcaaggttctggaacacccttccagcctcttccaagcatcaggattcgggtggggagagaccgatgttgtgtgtgtgtgttgggaggtgaggggggaggaaacgggatgccgtctgcagcacaactcgaggttgtggggggagctgttgatcgaagtggccgctcctctcttctctgttggatgctgtggggggcaatgaagacagggacaccctaggaatttctggcaccctcctcctcctccccgcttggggacaggctgtgctatgtacaggatctaagtggggtgactagggaggccagagctcggtgggggggcacccaggatgttgggaaggatagggtttgaaaccaaaaggggatccttaagggaggacaggagccggaacccggactcctgggtccttgggggaagaggggagctggggacctggactcttggttcctgcagggagaggaggctgggcactggagttccagagtcttggggcaggaggggcctggcctcctgggtcctgggaaagaacaggaccgaatgcccagactcccaaggcctgggggaggaaggggctgccagaaggactcctgggtctttacgggaggaggtaggggatagcgcttccgtctgaggaaggcaggctgggagctcagtctcctgagtccctgacagggcaggagatgagtgttggggactttagccctatgcagatggaagtggaaacggaggctcatgaggaggtagagatggaggcggggggagcggggggttgtccagaggctggactctgtgatccctgagggcgtgggttctgggggttgggccttcagagtcctggaggactggggatgcccctcctcaggccctggagtgggggaggctgctctccctaatccctgtggttaggaactgagcatgcagcccccgtgagaagggtggggccgggggctgccctcctgggcctcagtagggagtgggacgcggggtccctaagagcagaagccaggtaggggtgggtctgggagaggcagaggaggggctggagggtgagcagccactgggaatggaggggagcgtgagtgttaaccccgcgggggccaggccacagctgtgggttattttggggcggagtgggggggttattctgagcgctgattgagccagctgcttggggaagggcaatggaaaggaggagcgaagagaagccaggatcggggagggatgggcatactaggagcccccaaccccttccctggggagacaggggcccgagatctctgggaaggtgaggtggtgggcagaggggacgggctgtggcctcgaggcaggggaggggtggtggacctttcccccgccctggctgtctgtggggtggacgaggcctgcgctaccatggcaaccagacaggagcatgacagccaggagagaacccttccttgtctggaccctcaccccttctggaagcccctagtgcggactccagtccttctctgggaaccaggagtccagactcccagtgccctcctccctcagtcccaggcaggacccaggagcctggctcccagcccaaccaccccaggcggctagtattcaacagggggcacaggaagagaggctgtatttcctctaatttaccaaattgctctgggctgggtgccagggacccccacacccaccccacccagctctccacagctgtgccccccaaccccacatcccagatggggccatgactcccttgctttgagaatgaggggatggggacaggactaaggggacaaaatgggttaggggttgtggtcagggtgaggagtaaggtcatgtggggattttctctccttggggtgccccactaatttctctctttctctccccacacacctgaccccttttccctctcattttttctctcccttttcctcccttttatttctgctccctcctgccactcgccttccccgccttactttcatgtctgtactgggcacctccctggtgggggtcccgatcttggccttgcttcgctatttctgtcctcctgttttcgctccgctctgcctgcctccctcaatctcaattgtttccccatcctttatgtgcgcgtgtctcttggtggccttggggtctctgtctccctcttcctgccttgctgtcttcttctctgtccaactttcttgcctcgcttatctctcccgccttcctgcatctcttcccgcctctatcatcctctccctgggcctccctcattcctgtttctgtcactccgtcctctctctctccgtcttctccccgtctctgctgcttccgtctctctccttcttcctgccgctctttccctccccgtctccctgggcctctctctgctcctatcttgatcccatctctgtgggtgtccccatccccaccttgtctatcttcctctctctcccctcttacctctgtatcttcccctgaccccattatccaccctcgtctttgcgtctcccccaatcccatactccacttcttcctatctctgtctcgccctatctctgcgtctctccctgtttcacctcttcctctggtgtttcttccccacctctcccttccacctccctctgctgtgtctgtctctccctctgtctctgcctgtctctcctccatctctctctctccgtctccccctctctctcccctccatctctctctacctctgcccgtctctccctctgtctctcctccatttctctctccctctgtctctctcccttccatctctctcgtcctccgttcctgtctctccctctgttccatcaccccgaccgctccctgtcctccccatctcggcgcctgtccctcgctgcatctcctcctctgtgcgtctctttatctcgtctccctgtccctgcgtctcccgtctgtgcctccctctcctccccgtctctcccggcccgggcgctcagaggccgcccggcggggcccgcaggcgatgcgcggcgccggtggcccccgcggccctcggggccccgctaagatgctgctgctgctggcgctggcctgcgccagcccgttcccggaggaggcgccggggccgggcggggccggtgggcccggcggcggcctcggcggggcgcggccgctcaacgtggcgctcgtgttctcggggcccgcgtacgcggccgaggcggcacgcctgggcccggccgtggcggcggcggtgcgcagcccgggcctagacgtgcggcccgtggcgctggtgctcaacggctcggacccgcgcagcctcgtgctgcagctctgcgacctgctgtcggggttgcgcgtgcacggcgtggtcttcgaagacgactcgcgcgcgcccgccgtcgcgcccatcctcgacttcctgtcggcgcagacctcgctgcccatcgtggccgtgcacggcggcgccgcgctcgtgctcacgcccaaggtgcgcgcgaccggggcggggcggggccacaggaggggcggggacagccgctgaggggcgggactgggacagccagcgggggcggggcctagagggggcggggactgtcctgtgggtccgagtctgggacaaggtgggcccagatggtaggcagggcttagggctagattagaggcggggctgacttggagggggctggtctatagggtaagctgggcctttagggtcagaaagaggccagtcctcgatgatcagagtatagggaggacgtgggcccattcattgcaggtaagggtctgtagtaaaggcgagtcgagggaagggttaggggctgggaacgaaaagggactagccccaaatggcaaaatctgagggaggggtgggacctaggatcagcacaggaagaagtcagttgaaaaggaatgggcctgggcgcggtggctcacgcctgtaatcccagcgctttggaaagccgaggccggcggatcacttgaggtcacaggagtttgagaccagcctggccaacatggtgaaaccccgtctctactaaatatacaaaaattagccgggcgttgtggcgggcgcctgtaatcccaactactcgggagggtgaggcaagagaattgcttgaatccgggaggcggaggctgcggtgagccgagatcgtgccactgcactccagcctgggcgacacagtgagactctgtccaaaagaaaaagaaaaggaatggagttcagaaagaaaggggcgaagtctagtggagaggtggcagctaggaagtatcagaggtatcaggtaccaaggacagagtttggggaggcgttcggccggtagagcatagggtctagaagtcagccagggatggaggagccatcttctaagtggaagtcggaaaagaggaagagtcattagagagaggaggacgggcaaggggtagaaccaggaagcaaggaattgagatttggtgcgaggccagtcagggaaggagtgagtcagaaaagggggcggggctagccagttgggggcggggccagcgaggggcggggcctaagcactctaataaaggggtgggtctagggaggaagccggtcctgagagtagggtttgagaaggggcataccccgctgtgaggtgtggaaagcgagagtccagaggatgggcaggaggatgaaggcttatggtggaggccgacccagccaatgacagatcaaagccaggagcctgctgggaagggatggtagaggctggagctggccagagcctggagaaaggcctgactcccaagggcacagaaggggccagttgtagcggacctctggtagagaaggagagaattggaccaagcctgctctgtggattgagaatgggtcagctaggaggtggggcctgagaaggggcggggcctctccagaggtggggccagcgcaacccagaggtggagcttcattcaatctgcccattccctgctgtgcgggcctgtggctgtgtgactgcatcactgttgtatgcagaggctcgtagtcctctcctgtccagagcattctgggaaggacctctgtccaactttcttgttctccttggcatggtacttttcagagatttgtaggtagatgccctgggaggcgaacttatttcttaactgccacttccaaggcatactcaaaagacgtgatccctcgtgccttcattgctgctgagaagtgtggtcctctctgtttcattgtccgctgggcactgcggtcggctcagtgtacgcccatagcattctgggaaatgtagtccccgtgctgcccctggatggaagaaagaatgatcttcacagctccatctgtgccccactgaatgctgggaatgtggtcccctcagcacacctccacctgctgaaggaagaggttctccttgcattacaataagacctcatttccggccaggtgcactggctcacacctgtaatcccagcactttgggaggccgaggcgggcagatcacctgaggccaggagtttgaggccagcctggccaacatggagaaaccccatctctgctgaaaatatgaaaattagccgggcatggtggcgcatgcctgtaatcccagctactcaggaggctgaggcaggagtaatcgcttgaacctgggaggcggaggttgcagtgagccgagattgcagtgagccgagatcttgccactgcactccagcctgggggacagagtgagactgttctcaaaaaaaaaaaaaaaacaataaacaaaaagaactcattccctcaggacaactgcagtatcccctgtgcgcctagggagaaagcccacttgctgttctcattgcattacaggaagatttattgagagctgattctgtgccagggctgttttaattcctagggaatacagttctagagggggggggaaaaaaagagagggagacaaggtccctgccttatagagcttgcattttaatggtgagacagacaaaaccagtaacagtaaaatccggctgtcctggaggaaatcaacacaggatgttgtaatgactgaggatggagtttcaatagatggcagtcaggggaggcctccctgaggcggtgacacctgagctggaggtgtcaggtggaggtctggcatggaggaggtagggaaaagtgtccccaggagaggcaacaacaaaggacaaagcccttgaagcaggaaggagcttgatgtatttgaggaagagcaagaagggagtgtggctggagcccactgggggattggggtggcaggagatgaggtcagagaagcaacgggggccagttcacgcagggccttggggccacggtgaggactttggctttgattctgaggtagaatcactggaaggttttcaattgagaagggatgtgatccaattaatattttgaaacaatcactctggctgctgtttggagaatagactggaagatgcaagattgaaaacaaagataggctgggcgcagtggctcatgcctggaatcccaccactttgggaggccaaggcgggtggatcacttgaggtgaggagtttgataccagcctggccaacatggtgaaacctccctctactaaaaatacaaaaatgagcttggcatggtggtgcatgcatgtaatcccagctacttgggaggctgaggcaggagaattgcttgaactcaggaggtggaggttgcagtgaggcgagatctcgccactgcattccagcctggacaacagagcgaaacttgaaagaaagagagaaagagaaggaaagaaagaaagaaagaaagaaagaaagaaagaaagaaagaaagaaagaaagagagaaaagaaaacagagatgggtgggaaagttgtagatagctgggcaagaaagggtgacaatgagagttgtgacagtgatggcagtgaggagtggacaactggagctatctttgaacgtagagctaagaagacttggagatggctgaatgtgtgagggaaagaaagggaaaggatgatttaggtttggggcctgagcatcagggtgaatgagagagagaggaaaaaaaaggcagctgctctttattccttaagattctttactcctggccgggcgcggtggctcatgcctgtaatcccagcactttgggaggccgaggcgggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcgtgaacccgggaagcggagctttcagtgagccgagattgcgccactgcggtccgcagtccggcctgggcgacagagcaagactccgtctcaaaaaaaaaaaaaaaaaaaaaaaagattctttactcctttacgagagagagagagagagagagagagagagagagagagagaatagggaacagtcttgagataggggaaagatcgagcaatctgtttttgacatgctaattttgagacaccttggaaatccaagaggagatattgaataaaaaggaggataggggccaggcatggtggctcacacctgtaatcccagcactttgggaagccgaggcaggcagatcacttgagttcagaagttcgagaccagcttggccaacatggtgaaaccctgtctctactaaaaatacaaaaattagctgggtgtggtggcatgtgcctgtaatcccagctactcagaaggctgaggcaggagaattgcttgaacccaggaggcagaggttgcagtgagtgaagatggtgccattgcactccagcctgggcaacagaggaagactctgtctcaaaaaaaaaaaaaaaaaaaaaaaaaggctggaggatagatttgtctggagctcacatgagaggttgtgactgaggacaggagccattaacatatccagcactgttcaataaaactttcagcaaagatgaagctgttctatagctgctctgtccgatttgaaagccacaagccacatgtggctgttgagtacttgacaagtggttagtgcacccagaaaactaagttttaaattctatttaacatttttttcctctggtccttgattcaggataaattttatttaattttaatttgaatagttatgagtggctaacagccaccctattggatagcatgggagacagtatttaaactcatgggcctggttgagatcaccagggagagaggaatagagaagagaacagtaaggcactcctagtgtttagaatttagaattctggctgaggaagaagggccagcaaaggaggcagaggaagaggtgacagagaggtaggaggaaaaccaaagaagggaaaggacactctgcaaagcttcttccagtaggga

SEQ ID NO: 274 - DNA, 9910 bp, Homo sapiens
aagaaatgactaaatcttaatctacatcaaggacacaaagatctgaaggcaacatcagggcaggtgtagaggcagggaagctggggtgattagaatacaatattgcctaattatatttccaagctgtaaattagcctccgccctctctatatcgacccagccttaagtcaggaacacttactgggctctgtggcaagaggctgctactggtctcttgagtactgggaggtcgacttccactttcctccagtggcaaaataccccttcgatccagcacactgaaggagataagagagttaacaaagaactgggcattcacccctccacccacctggcctacggaattttgctgcatagactggaaaatataaacctgtcctttggcaatctagcctgaacacagcacatgcctcttatctcccattcactttttcttccacaaaccaggaaatgtcacattaaccagggaacaaacaaatgaaattaagaatgaaagatcatccctccaaaacaaccagcccatggtctatggtccatgtagacatggtaccaagtggcaagccctggaaagacctatttgacaccaagaggccacactcagaaaaacacatcagacaaggtaacaggatcaggttgagctgctcatcccaacagtcccaggacttttgagtgccctgagcacctggggggcaaggggccacacagcacttcacagcagttcttcacaatattgccatggctgtagggattctggacgcgattcttccctgtccatgatcctttgatctgcaagataaaaaccaaggctgacattaaaaataatgttaaaatgaacaaataataataataaaattaaaaacagacacaaaaaagaaaaataataataataatgttgaagaaacacatgcagcatgggataataaaaaagttctggaaatggatggtggcaatggttgcacaacaatgtgatgccactgaactgtacatttaggatatgagggcgatctggctgcaacaactgtcaccccattgatcgccagggttgaaagacatttaatatagcacactttatatcatgtatattttatcacaacaaaaaagaaatacatacacagccatgaaaaatactcacaatagagtgaaaaaagcagataactgaatgatatatactatttttatttaaaagtacataatataaacacataaataaacatggaaaaaagtctagacaagtctagaatatataaatcatactactaacaaaggtgatgtctaagaagtaaagtaagaggaacttacttttttctttttgctcatctgtattttctgattttctacagtgaatgtagattaattgctaactttttttttttttttccagacagagtctcattctgttgtccaggctggagtgcagtggcgtgatctttgctcgctgcaacctccacctcccgggttcaagtgattctcctgcctcagcctcccgagtagctgggactacaggtgcacactaacacatccggctatatttttgtatttttagtagagacagggttttgccatgttggccaggctggtcttgaactcttgacttcaggtgatccgcccgcctcagcctcccaaagtgctgggattacaggcgtgagccaccacacccagcctaattggtaactttttatatagcaaggattcatccagtgcaactgtccctctccatgccaaacagaggcaccagctagcctttaaggacctgtgaacagttaaaggctgtatacccacccaacttttcaacctcttcttcctaatgctccacaagcattcaacaaagccctctcctttctcttccacacatctgacttaacaacctcgcataccacgtttctgcctgcctcaacctcccaggccctggagactcggtagttctctagcaggtagcaagaggataggctttgggaagaagaatatgtggtgaggagaagagaaagttgactcacgtcttcattggttgtctggttgagagccacgaggaaagtatgaaatccagtcagtcccacgacggaccagagtgtaaagaagcaaatgaggacttctagaacagtgaggtgtggttaaggagtattgaagaactcaacatcaggagacttgatgcctccgcccatattcagagcaccagtcagaccatctttacctcctggaacgtatatcacaaaaagccatgtttccatatataacaatagatgaattctgaacttactggatagatcccttatgaaagaatttctagcgtatctagggtatttaagggtgtgcctatttacccatcattggctcttggaaggggatgcatgggaggggccaaagctaaacaatgttggccatcactgccaatggaaattctgtcaaaaaacaaaattcatgtaatcccggcactttgggaggccaaggtgggcggatcacaaggtcaggagttcgagaacagcctggccaacatggtgaaacccccgtctctattaaaaatacaaaaaattagctgggcgtggtggcgggcatctgtagtccaagctactcgggaggctgaggcaggagaatcatttgaacccaggaggcgagctggggcaacagtacaagactctgtctcaaaaaaagaaaattcataaatgaagaactggtgggggaaaaaaaagaggatgtgatttatagaaatctcatctgaaccccctttgcagaaatgcagccactgtcctgagcagggggtgaaggaaagacctcccttttagtcccggtcatcttccattctggttgctaccactaagactatatttttttaaattattttagaccttggcactctctgatatctgaaaaactagatagtgggagaactgtggggaaaaagcatgctggaaagtagcttaagaaggcttcacagggacatactgccagcggaggatatgttccaggagtttctttcaatgtctccaagaagccaattttcaaagattctgtgaaattggatggaagagtagagagaaaaattagtgacttcagtcaaaactacacactatcctagtgcctactcacttccttccctccctctcccgtgttacacactggcaagagctaagctctcactcgggcaagggtgaagagcctcatctcctagctggtagtctcatgactaaagagttcacatttccagtgcaggaccaggccctggactagacaggcaggcagaagagcagcaggctcccttcccttttccctagcccccaactatggacatgttagggggatattaacagataaaagaaatcagaaatacccaagaaaaatcctctctccttgccaatacgtgtccctcccttgttcaaaatccagctcagaactcttctctttccagaaagctgtcttaagaccactcccttaactccacatcacatctgctcttagattggcgtgtgtgtgggtgtgtatgtttgtgcacatgtacatatgtgggtgtgctttctatctcccaaactagaccatgagctacaaaaagacatttctcaggcaaaacccttacccttttctaccccttagcacaaggcaagttttacaaggcagaagaagagaggatgctccgagacaaaatacatccccagcctttgggattacctcagaaatgccccagtactctggatacagaccagtaattatggccccagtgcccagcagttggccaaagagaaggccaacacactgattaatactcattgatgtgcactgaggtttgcaaccctgctcaagagcagataactgtgctcatttctaacctgtcctaaagtacctttcacaatggtaccaccaggaaacccaacaaccctctaagctgcccttaactcttcccccacccagccccactccaacaacggacactgccctgtatactcactgagggccacatagacgatgttgaaggcgaagacatagattgtgaggagggagagagaaaggatgaagaggtagaagtagcggtagttcctctttccaacacaattccccacccaggggcagtgatggtcgaagcgctctgtgggagaaagagagagtccaaagccaaaagcctccagaacaaaaatcaaccccaccatccctataatacctaattcaaagacctccaggatcattgtctatttcagttgtaaaaaatatagggtttttttttttttttactttttcaaaatgttttcataaccatctcatttgatcctcacaatttccctggaacttgggcaaaaggagatactcttttccccactttacagatgaagaaacaaaggcatggagaggttaagtgatttgcctcactcagctcattaaaagcagagacactgcttttccaaataaaatcttaatcggtgggcctactaagttcaagaagaataaacaggtcaaaatagccaaggaaaaatgtaaaactacaatatttaaaatggtatggcatagttcaatggaatggaaagagcccagaaacagatcttagaatatataagattttgttgtctaataaactcagcattacaaaatcagaggtaaaaggaagtattattccataaacaattacgtgacaattggctatttggtgcaaaataaggatcgatttttttgtcttcatactacttgtcatagtaaattccagatgaattaaagaactaaatgtaaaaacaaagtgaatccataaaataactataaagaataaatgtttatttgtcctctatatgcagaaggactttctaagcataaaagtactggaagaaaacagatgacaaggaaaaatagatttgactccataaactttaaaaaagtactttgtggttttgatttgcatttccttggtgatcaatgatgtgattattacacattgcatgcctgtatcaaaacttctcatgtacaccataaatatatatacctactatataccaacaaaaaattaaaaatttaaaaaatattttgtgtatgttaaaattaccataaagaagactaaagaaaaaaaaacaatggcaatctatgtaaagttgtacctgactatatgaaaagttcttagaaatcaataggaaaatacaaatacttcgtcaagaaaataatagtcaaaagttacttgaaatttgctaagagagtaatcttaagtgtcctcaccacacacacacatgcacacacaatggtaactatgtgtggtgatgaatatgttcatttgattgtggtaagcattacaggcagacaccaaaatccacccatactcaagtcattcagcagccctgcagaacccacggataagaaaagttgcccctcatgtacacaggttttgcatcttgtgaatactgtacatttgaaccttgaacaactcaggttagaactgcgtgcgtccacttgtacatggatttgtttcaataaatacagttggccctccgtatcaacaggttctgcatccacaactaaacctagatcaaaaatacggtattcacaaaatatgaaactcctggagacggatacagagggctgacttcatatccatgggttccacagggccactgcaggacttgagaatgcatggggtttggtattcaagggcaatccctgaaaccaatcccccaaggatacttagggacgactgtattttggatccgcatttggttgcagatgaggaacacactgatactgtatttattggaaaaaaaaaaccctcattattaagtgggcccatgcagtacaaaactgcattgttcaagagtcgactgcacataaaacaaaaacaaaaaacaaacaaaaaggaaatagggcaaaaactaataaataccataaaacctatatttaatatttttcctagtcaccaataattcattgtaatactagtaaaataatagcatattttatgcctatcaaaataagaatataaataataaaatccagtgctagtgagaatagggtaaaatggacactctaacatactgcttgtgggagcataaaatgaaagaaccttcccagaaagcaatttggcagtacgtatcaagagccttcataaagcttgtacccctttggtagaataagtccattttcagcaatttctcataagaaaatagaaatgtacacagaaattttaagttcaaatttttatttttatttatttatttatttttgagacacagtttcacacttgtcacccaggctggagtgcaatggtgcgatctcggctcactgcaacctccacctcccaggttcaagcctcatcagctgcccgagtagctgggattacaggcatccgccaccacgcccagctaatttttgtatttttagcagagacggggttttgccatgttagccaggctggtctcgaactcctgacctcaggtgaaatgcccgcctcagcctcccaaagtactgggattacaggcatgagccactgcgcccggccgaagttcaaacttttaaattaaattttgtattgtttggaaggcccaggcaggggaatcatgaggtcaggagtttgagaccagcctggccaacatggtgaaaccccatctctaccaaaaaatgcaaaaatccgtgggtcgtggtggtgcacacctgtaatcccagccaatcacgaggctgaggtggggggatcacttgagctcgggaggcggaggttgcagtgagctgagatcacgccactgcactccagcctgggtgacagagtgagaccctgtcttaaaaaaaaaatctattatggtaaaatatacataacatacaatttgccattttaaccattttaagtgtgcaattcagtggcattaattacattcataatgtggaaccatcaccattatctatttccaaaaccctttcattactccaaacagaaactctgcacccattaagcagtaactctccatttcccccttccccatcccctagcaatctctaatcttctgtctctatgaatttgcccattctagatatctcatataagcggaatcacacaatatttgtctttttgtgtctttttttttttcacatagcatgttttcaaggttcatccacattgtatcagtactgtattcctttttatgactggataatattccaccgtatgtacataccacattttgtttaaccattcatctgttgatagacacttgggttggttacaccttttggctactgtgaataatgatgctacgaacactggcgtacaagtaggttttgagtccttgttgtcaattcttttggctattgttatggaatgaactgtacccccactccccagttccatatgttgaagccctaacccccaatgtagctgcacttggaggcagaacctttaaggaggtagctaaagttaaatgaggtcatctggatggggccctaatccgatgggactggtgtccttgtaaggagaggatgagacaccagtagtgtgtgagcacagagaaaaggtcacgtgaggacacagcaagaaggcagccatctgcaagccagggggagaggcctcaccagaaaccatcccttctcgcacctctatcttggacttccagcctccagaattgtgagagaaaaattcccattgtttgagccagccagtctgaggtattttgttatggtaacccaagcagactaatataggtatacacccaggagtggaattgctgggtcatgtggtaattctatgtttaactttttgaggaaccaccaaacttttccacagcagctgcatgattttacattctcaccagaaatgtatgaaggttccaattgttccacatccttaagtttaataattatgattgcagtgttacaacaatgaataaaatagaagaatgaataatgtctaatgacagaagactgcctgaataaacttgaatagaaccatatgatggattatgcagtcattaaaataatatattaaagaaacatttattaaagatgtagaaaaacgctcaggatagaatgttaaatgacaaaagcaggattaaaaactatcatgttacagtccaattttgcagaaacactagtaggaaatatagcaaaatggagagtgaatttaggattaagttttatttatactttctgcacttcccatattttccacaatgaacatgtgttattttgatgaataaaagactacaaaagaataaaatacatcaatttgggccaggcgtggtggctcacaccagtaatcccagcactttgggaggccgaggcaggtggatcacaaggtcaggagatagagaccatcctggctaacacggtgaaatcccgtctctactaaaaatacaaaaaaattagccaggcgtggtggcgggagcctgtagtcccagctactcgggaggctgaggcagaagaatggcgtgaacccaggaggcggagcttgcagtgagctgagatcgcgccactgcactccagactgggagagagagacagcctccgtctcaaaaaaaaaaaaaaaaaaaaaaaaagaataaaatatatcaatttgaaagaaaagtgagctgtgtactggtgaaaaaataaggctgtaaaaatggtctatctcctgctgaggaagctacatcttttcaggaaagggaagaaaggtatagagaagaatggttatacagatatatattttttacagtattttaaatcacattttttctgataatacaagtaatacatgctcattgtagaaaacttgaaaaaaataaaaggaaaaatgaagaaatcacagtagtggaggatggcatatgaaaaaatgaaggaaacaaaatcactcataatcccacaacctatagataataaactataaaaattgtggcatatttcctgtatttccttgcatatttctttatacatcattagattttttaaaaataggtaactgacttcacactgtaaatgtagcctatctcccattttgtcatttagctttctggtatgaactctttccatcagtctaatgtacgaatgtcctattatttatttatttatttatttagagacagagtcttactctgtcgcccaggctggagtgcagtggcacaatctcggttcaatgcagcctccacctcatgggttttttattctcatgcctcagccagggtctcagctgggattacaggcacatgtcaccacgtccagctaatttttgtatgttttagtagagacgaggtttcaccatgttgctcaggccggtctcaaacttctggcctcaagtgatctgcccacctcggcctcccaaagtgctgggattacaggagtgagccaccacacccggctctataatttatttggctactcatctattggtagacaattaggttcttttcaacttttaattgtcataataatcctgagttaaacatttccaccccgaaatattttcccacatctctgatttcatgggacagactccctagaaagtgaaccactggcaccaaaaggtatagatgttttaaggctttcgattaatcttattagattgccttccaaaaagtttgttccaatttacactcttactagtggaagaataaacatcaggttttccttgctaattttctagatttaaaaaagcatattgggctgggggtattggctcacacctgtaatcacaacactttgggaagctgcagcaggtgggctgcttgagcccaggagtttgagaccagcctgggcaacatggggaaaacccatctctacaaaaaatacaaaaaaaaaaaaaaaaatagccaggcatggtagtgcatgcctgtagtctcagcaacttgggaggctgaggtgggaggatcacctgaacccaggaggttgagtctgcagtgagctgtgatcgtgccactgccctccagcctgggaaaaagagtgagatcctatctcaaaacaaaagcatcctgaaatcatttatttgactattagtcat

SEQ ID NO: 275 - DNA, 11076 bp, Homo sapiens
ctagggacatgtctacattctactgttgagattttagaagaaaaatgttttcagaaaaggtacgtatttatgtaaaatcgaatgcatatttaaacaaaaatgtctggaagagtatttaccaaaatgtcaacaatgtttatctctgagtggtgagatttgggagaattttactttatttatatttttcagttttttgttttgttttgttttgttttgttttgcaaagtcttgctctgttgcccaggttggagtgcaatggcacaatctcggctcactgcaacctccgcctcccaggttcaagcgattttcctgcctcagctccccgagtagctgggactaccggcgcacgccaccacgcccagctaactttttaaaaattatttttagtagagacggggtttcaccatgttggccaggatggtctcaatctcttgaccttgtgatctgcctgtctcagcctcccaaagtgctgggattacaggcgtgagccactgcgcccagctgatttttgttttgttttgttttgttttgttttgtttttgagacagggtctcactctgttgcccaggctgttgtgcagtggcacaatctcagctcactgcaacctccacctctctggttcaagtgattctcctgcctcagcctcgcaagtagctaggactacaggcatgcaccaccacacccagctcatttttgtatttttggtagagacggagtttcaccatgttggccaggctggtcttgaactcttgacctcaggggatccacctgccttggcctcccaaagtgctgggattacagacatgagctacagcacccagccccatttttcagtgtttttaaattttctacaataaacacatatttttatcattagggagaaaaagagacactattttcattttttaaaacccacaggaaaatgaaggagttcttatctgatgggcatgcattttctcaataaagtatgaggcaaagtcaacagcagagagtaggagggagagatctgaagaatgtgaataaggtaagtgagtggttttagagagttggagaattaagagtaaagggggatttttagctatgttgaagacctagttgattaagcttgactatcattaacctgcccattgtgtgattgcctccaccaatcctgaactatacaggttaaagtataaagaagatgaatgtgtggattcctccaggaggtgggtggaggggaactatggagtattgtgtaggcagttgaaggtatttgcaagagtcataataataaattcaggaatttaagtgaaaaagggagcaagcaaagtttggaggaggctgggtgcagtggctcatgcctataatctcaatactttgggaggccgaggtgggaggatcacttgagcccaggagttccagaccagcctaggcaacaggtttgtctcataaaaagaaattagccggacatggtggccagtgcctgtagtcccaactacttggaaggctgaggtggaagcatctcttgagcccaggaggtcgaggctgcagtgagctgtgatcatgccgctgcactccagcctgggtgacagagtgagatcatgtctcaaaaaaaaaacaacaacaacaacaaggattggaggagtgatgaaaagagagaaagtgtgtgtggtaggaggggcagtgaattggaggcttcatgaagccagagaattgtagtggggttacttgagccagtgagctagaaaagcttgggaagttttagaaagaaaacttaatgtgggggtttttggcttatttttaattgaaaaataataattgtatatatttataggatataatgtgatgtttcaatacacgtatatgttgtgcaatgatcaaatcagggtaattagcatatctgtcacctcaaatatttatcatttcttcacagtaagaacatttaaaatcctcttttagctattttggaatatacattagttgtttgtttgtttgtttgtttgagacagggtctcactctattgcctaggctggagtgcagtggcacaattacagctcactgcagcctccacctcccaggctcgggtgatcctcctgcctcaggctcccaagtagctgtgatcacagaggtgcaccaccgcactcgactaatttttttttttctagagacagggtctcactatgttgcccaggtggtctcaaactcctgggctcaaacgactctccccacttcacctcccaaagtgctggaattacaggcatgagccactgcacctggcccacaatacattataattgatgacagtcatcttgctgtgcaatagaacaccgtaacttattcctgctatctagctataactttgtacccattgggcaatatctccccttttaccatccacctccccactccctccagcctctggtaaccaccattctaccctctacttctacgagtttgacttatttagattccacatataggtgaaataatatggtatttgtctttctgtgtcaggtttatttcacctcacttaacataatgtcatctaggttcatccatgttgtaacgaatgacagaattttctcaaactcctgacctcaatgatccacccacctcggtctcccaaagtgctgggattacagatgtgagccactgcacccagccacaaatgacagaattttatatatatatactatatacatttataaatatatatagtatatatatattataatatatagtatatatattataatatataatatatatattataatatataatatataatatatatattataatatataatatataatatatgtagtgtatatatattatatatactatatattatatatattatatattatatattatatatattatatataatacatattatatataatatatataatatatataataatataatatattatatattatatattatataatattatgtatataatatatattatatattatataatatatgtattatataatatatattatatatattatatattatataatatatgtattatataatatatattatatatattatatattatattatattatatatatatatttcatatatatatatatatatatttttgagatggagtctcactctgttgcccaggctggagtgcagtggcacagtctcagctcactgcaacctctgcctcccaggttcaagcgattctcctgcctcagcctcccaagtagctgggattacaggcgcctgccaccacgcccggctaattttttgtattttcagtagagacagggtttcaccatgttggtcaagcggtcttgaactcctgacctcatgatccgcccaccatggcctcccaaagtgctgggattacaggcatgagccaccacgcctggctgtataccacattttttaatccattcatcccttgatggatacatagattgtttccatatcttggctgttgtgcataatgctgcaatgaacaagggagtgcaaacatctcttcggcataccgatttcaattcctttgggaatatccccagttgtggaattactggattatatggtaattctattcttagttttttgaggaactttcatactgttttccaaaatagccatactaatttacaataccaccaacagtttataagcgttctcttttctctacttcctcgccagtatttatctttcacctttttaataatagacaatctaacaggagtgacataaaatatctccttgtgcttttaatttgcatttctctgatgattagagatgttgaattgcttcttggccttttggctaagatcatgggtatgttatctcttttgtttgttttgttttgttttgttttgttttgttttgttctggggtttttgttgttgttgtttgaggcaggttctcactctgtcacccaggctggagtgcagtggcgcaatcatagctcactgcagcctcggcctcctggtctcaagcagtcttcccacctcagcctcccaagtaactgggaccacaggcatgtaccaccacgcccagctaatttttttttctttttttttggtggagacagagtctccctatgttgctcaggctggtctgggctgaagagatcctctggcctcgcactcccaacctgctgggattacagatgtgggccatcacactcagcctgtatgacttcttttgagaaatatgctttgcccacttttaatagagttgtttgttttcttattattaagcagttggagctccttgtatattttagatattagccccttacccaatgtataatttgcaaatattttttccagttcatgggttgtctccactctagtgcagtttttttagtttgaggcaatcccatttgcttttcttttttttttttttttttgagacggagtctgctctgtcgcccaggctgcatgcagtggtgcgatctcggctcactgcagcctccacctcccaggttcaagcgattctcctgcctcagcctcctgagaagctgggattacaggcatgccccaccatgccaggctagttttttttttgtatttttaatagagacggggtttcaccatattggtcaggctggtctcgaactcctgacctcttgatctgccagcctcagcctcccaaagttctgggattacaggtatgagccaccgtgcctggcccccatttgcttttgttgtctgtgcttttgaggtcatatcaaaaaaatctctgcccagactaatgtcatggaacttttcctctgttttcttctggtagttttaattttgcttcttttcttttcttttcttctcttttcttttctttttttttttttttaagacagagtctcgctctgtcatccagaccggagtgcagcagcgcaatcttggctcactgcaacctctgcatcctgggttcaagtgattctcatgcctcagcctctcaagtagctgggattagaggtgtgcgccaccatgcctggctaatttttgtatttttagtagcaatggggtttcaccatgttggccaggctggtctcaaactcctgacctcaggtaatctgtctgcctcagcctcccaaagtgctgaaattacaggcatgagccactgggcccagacaaattttataattttaagccttacatttaagtctttaatccattttgagttgattcttatataacggatgagataacggtccatttttactcttctgtatgtagatatccagttttctcaactcaatttattaaagagactgccctttcccctttttgtgttcttggtacctgttgcaaattaattcaccatagatttgtgggtttatttctgggctctctatctaattccactggtcaatgcatctgtttttatcctaatatcatgctgcttgattactgctatagtttggatgcctttctcttccaaatcccttttttttttttttttttgagacaaagtcttgctctgtcgcccaggctggggtgcaatggtgcgatctcagcttactgcaacctctgtctcctgggttcaagcgattttcttgcctcagcctcctgagtagctggaattacagatgtgtgtcaccacacccgctaattttgtatttttagcagagatggggtttcaccatgttggccaggctggtcttgaacttctgacctcaggtgatcctcttgcctcagcctcccaaaatgctgggattacaggcttgagccaccacgctcagcctctcctccaaatctaatgttgaaatttgatccccggtgttggagatggggcctaatgggaggtgtctgggtaatgagggcagatccctcatgaatagattattgccctccttccggaatgtgggggaaatgagttctttattacttcccaggatagctggttgctaaaaacaacttagcatctcccctcactcctcttgcttcctttcaccatgtgatctctgcacgtgtaggctccccttctgccaagagtggaagcagcccgaggttcctaccagatgccaaatcttgaacttttccaagcaagataattactatagctttgtaatatattttgaaatgcagtagagtgatgcctccagctttgttctttttggtaaaaagattactttggctactcaggatcttttgtgcagaatttaatgtttcaattagtaatttcagaggcccgcgttcttgcaagatctaggctatgagtacataacaaggtagcagaggtggaaggaattatatgatcaaatcacagaaccactgcctccttcacctatcttaacactcatccaaacacttattgccattcaattgcaggccctcgaattaatggtcctcaagagtctcactggaaggccgggtgaggtggctcacgcctgtaatcccagcattttgggaggctaaggcgggcaaatcacttgaggtcaggagttcgagaccagcctggccaacatggcaaaaccccgtctctactaaaaatacaaaaattagcctggcaaggtggcacacacctgtaatcccagctactcaggaggctgaggcaggagaatcacttgagcctggaaggcggaggttgcagtgagctgagattgcaccactgcactccaacctgagcgacagatcgagactccagtcaaaaaaaaaaaaaaaaaaaaaagagtctcactggaacctaccttttctgccttatttttccacttcatcccttcaaaatcctaggctccaggcaagatgaattataagctttcccatctttttgcctttgtacacaagattccatcctcctggatgctgtcactccaattcactaaattacacattttacctattctttaagctttagcttaaaagccttgacctctgtgaagccttcccagaactacttgcaagaactccgtcatgtgaattctcatgatacttcatgcatacctctcttaaggcatttattatttcctattttgtgtctttgtacttatttgattcaatgtgatctctctcttcttgtggagattaagattagaccatgcctaaagcaattttcaattccatcttcaagcatggtacccaactgtatgaatgtttccaaagtgtggtatgtgtgattattttacacagccaaacattttttaatagtgagatatttctttaaatgtatattagaaaaatattaaatacttttttttacttatgatcatggtaaaatgttttccttttaaaataagtatatttaagctttaaaatatggtttttttttaatactcagtacaggaactacacaggtagagaaaaattcatgaaggttatactcagatatctgaaacactgcactgaatggaaactgactagagaaccaaatcacagaaccacttcctccttcacatgagagttatctaaacagcagtaccaggatgtatcagtgctccctattgacaatcttctttaagtatataaatgcaagaatcacccaccttaaaaaaaaaaaaaactctccttcaattccctccagctactgcctgaaatgctaacctatagccccttgtgtccacttcctcaccctctattcactcaacccactgcagcacagcttccacccccagcacctgacatttgaaatgagcaactatctcctaaccgacaaaaaccagtgaaccctgttctgtccttatcttatttaactcggctctctaggcagcatttggcattgtggacttggggcattgcctattcattgttcctgaaaagttctttcctccgtagacttccacacactctcctgtcttttcagtcatcccttcttcaactcctttattgaatccccctcctttgtctatcccttaaatgttagagtttccctaatcttttactattaagatcatcataaaaggaatgaaaatagtaatgtttgcacacagtaaaaaaaaaaaaaggaaaaaaggaaaaagtacagaagagaaaccggaggttaacagtttcttatatatatatatttttccagaaaaaaaaaatgatgtgtaagtacattctcttttgttctttcacaaatattctgcaccttgtgacttgagttttgttttcatttttacttaacagagtatcttgaaggtcttttgtatcacctattggcacatacaattctcttattctcttaatggctgcttaagtattccccaaattaatgtattggaactaatttaactagtttcttgctgatgcacattagctagcttccaagttttatgctgttattagcaatgccacagtaaacacccttatacacatgtaaatttttaaaatgtttatacatatgtaaatttttaaaattcctataattttttaaattcctataaaagtaaacatccttcccagctactggagaggctgaggtgggaagatctcttggatctcaggagttccaggctgcattgagctgtgattgcaccactgcactccagcctgggtaacagaatgagacccggtctcaaaaaaaaaagaaaaagaaaagtaaacatccttgtacgtatgtaaattttttctatacatatgtaaattttaaaattcaggtggtggggtggaattgtcagacgaaaaggaacgtgtttttaattcttatcatcaaattgccctccacaaaacttaacaagaatgtacagcaccatcatgcatgagactgcctgtttaccctcacttttgcctcactttctttattgcctcacttttgcctagtcatctaaatttgtttgtcagtctgtaaggtaagaactaacacctcatgtttgttttcattcgtacttctttaatagtgaagttgagcatgcctcttctatttgttggtgttttatattcttttctgaaaactatttacatcctttgctaatttttctatcaggttgttcacttctttcctattgatctgtaagagctgtttgtgtataaaggaaattatacaatttgtgccgcaaaatatattttttcttttgatttagtttattttgcccgaaggtcatctttggccccacacagattctatcacattatatttgtcctctgagttgttgactcctaaatctataactttagcccagacctctatcctagctccaaatttcaactgcaggactgtatatcttcatctatatatgaagctaaaagcacatgtatgtttataaactcatcatacctggaactgaattattattttccaaatattcttttcctcttatgctcccttatattagttaatggtttgatcattcacctagaaactttacctggatgtcactcacttcttttttaccccctgcattcaactgatcaaaattctgaaatattttgcccaaatgactgcagtcagttactactagcaatgttgcatagtggttagagtataagctgcagagtcaaacaaaactgggcttctttcctggctctgacctttctacattatgtgacctaaagcgtatttctcacctaaagcctgtttcttcatctgcaaaaaataactatcttaacatctatttcacagggttattgaaaagacttaatgagattgtatgcagagtaatggaatataataaatgctcaataaatggtagctattatcttcctgctctagcttgtcccactcacttccaagccatcttccttgctgctgccagactcacactcacaaatccaaccatccccctgcttagagttgtccagtgactccccacctttttttttttcttttttgaaacagagtctcactctgtcacccaggcagaagtacagtggcactatcacagctcactacagactcaacttcccaggctcaagggatcccttccacctcagcctcctgagtagctgggactatagatgtgcaccaccacgtccagctaattttttctatttttttgtagaaacagggtctcactatattgcccaggttggcctgcaactcctgagctcaagcgatccggccacctcagcctcccagtgttgggattacaggcgtgagccaccgcacctggccttcccacttctttttctctgcacacacacttataacatctaaattccttagtatacaaggccatgtatacagccttttatcttttaccacagctgcatatgtgctaccctccagctacattaaactgtatgccacaccccaaacacaatttgaatgttttttcatacttccgtggtttcttgcacactgtacactgacagccaagcccttccctcagtccacttcttaagcatctactgcagactcagttcaagcatgtccttctttgtgcttccacagcactctgcactgccctggtacaaatcacactgttttgtagtcatatttacctgcttgtctcctccacaagattgtgagttccttaagggtggggattatgttttattcacatttgtatccccagcacccaccacaggacctaacgttttataggagcttcacctatgtttgttgaataaatggatgaatgaatagttctcgttctgagcagagctctgacctctattttcctactacttctgcagcaaacagtatccatatattaatatatgtggtcccttaccaaaccccctgactatccacccctcctcccagcagtgccaaacaccgcagccaaaatttctgatgctcaggcagttacaggagtgtgggactggtccaactagaagaggtggaacagaagccaatagtttcagtgtaggccctaaccaatgtcagtgttgctatcagagtccaccccaaatcccagagacaagtgttgctgtctacttatccagaacctaaccttaagtgtaatgaggggaaaacatatctcaagaccattcctttaagtgtgactggactggatggctacctacttacaccaccctcctcaaaccctgattcaacaagaagcacccacaggcacagcagatgcttttgtggtaactgaagaaaacacaaaggacacttctctgaggctcttcactcttaaaagtcaggctctacatctttagcaagcaaaaaacaggacacagtttatttttctactttcttttaatatcattttttaaagttggtaagcagc

SEQ ID NO: 276 - DNA, 13168 bp, Homo sapiens
ggattaaaagacagttagcaaccaagaacacaaattagttaataaagtagcattacgccctgttaaaagaagagaaagacttccagaataaacatgcaattacagtcaggaaaattctaaaaacaaaatcattaatggagggaggaagaggagcttgttcttccagatattaaaactattgcaaataaaattgtgtggtaatagtgcagacagataaatgaacagaatagagtccagaaacagacccaaatatacatagaaattattgaaatcagtggggcaaagaattattcaagaaaaagtgttgaaatgactttagagccatttgttaaaaaaaaaaactagatccttacctctcatttcatataccaaaataaattctacattaatcaaaaattaaatccaatcataaaatttctattaaaaataggtgtgaatatcttatagctttattaatatactaagacgtagtagttttttttttttaattttacctagttggcaagatctaaatatgatctggaaacccaaatcaaaaagggaaaacagtaagttttactgcataaaaaataactcttctgagtggcactataagcaaggttgaaagacaaaccacagactaaaaaaagattttttcaacatatgtaacagataaagacttaacatctctaacataaaaagagctcttcaaattaaaaagaaaaagacaaatactctagtaaataaaagctcataggacatgatcagacaaattacacaggaagagtacaaccaacaaacacataaaaagatactcggttgggcaagaaggcgcatgcctgtaatcccagcactttggcaggccgaggtgggaggattgcttgagtccaggagcttgagaccagcctggggaatgttgtgagacttcgtctctatgcaaaattagccaggcctggtgatgcacacttgtagtcccaactactctggagtttgaggtgagaggattgcttgagcccaggaggtggaggttgcagtgagcagagaacacaccattgcactccagcctgggcgacagagtgacccctggctcaaatattaattaattaattaattaaaaaatttaaaaaaataaaataaaaaagatactcaacctcactagtaatcgtagaaattcaaattaaagcaaggtaaaattttcatctatctgattggcaaaagttaaaaagattaagaaaaccttaaatttgtcaaaatatacaaaacaggcactcttgggcactgtaagtaggaatacaaattaaattaatgcaactttctggaagaaaggcagtttggcaatatatatcaaaatcttaaatgtgtgtaccctgtcacccaacaattacccttttaggatttttccaaaagaagaaattggaaaaatttgcaaagacagattaacggaaacattcactgaagcattgtaaaccacataaatgttcaccagcagactactggtgaagttatacaactacgttagttgtatatggaacatatattatggtttggaatacatatacaacctttaaaaactgttgtgatgggccgggcacagtggctcatgcctgtaatcccagcactttgggaggccgaggcaggtgaatcacctggggtcaggagctccagaccagcctggccaacatggtgaaaccctgtctctactaaaaataaaaaaattagctgggcatggtggtgggtccctgtattcccagctacgagggaggctaaggcaggagaatcgcttgaacctgagaggtggaggttgcagggagccaagatcgtgacacgcactccagcctgggcgacaaagagagactccatctcaaaaaaaaaaaaaaaagaaagaaagaggaagaaaaagtaaaactgttgtgatggttcaaatctgggtgccccctcaaaaaaaaaaaaaaaaaagaatggttgcagaaacaaccgggcttaatgcctcacatctataaccccagcactttgggagacggagataagagggccacttgagaccagtcaacactttttaattcagtgttgactagcctggacaacaatttataacaatttcatagttataaaactagggacatgtctacattctactgttgagattttagaagaaaaatgttttcagaaaaggtacgtatttatgtaaaatcgaatgcatatttaaacaaaaatgtctggaagagtatttaccaaaatgtcaacaatgtttatctctgagtggtgagatttgggagaattttactttatttatatttttcagttttttgttttgttttgttttgttttgttttgcaaagtcttgctctgttgcccaggttggagtgcaatggcacaatctcggctcactgcaacctccgcctcccaggttcaagcgattttcctgcctcagctccccgagtagctgggactaccggcgcacgccaccacgcccagctaactttttaaaaattatttttagtagagacggggtttcaccatgttggccaggatggtctcaatctcttgaccttgtgatctgcctgtctcagcctcccaaagtgctgggattacaggcgtgagccactgcgcccagctgatttttgttttgttttgttttgttttgttttgtttttgagacagggtctcactctgttgcccaggctgttgtgcagtggcacaatctcagctcactgcaacctccacctctctggttcaagtgattctcctgcctcagcctcgcaagtagctaggactacaggcatgcaccaccacacccagctcatttttgtatttttggtagagacggagtttcaccatgttggccaggctggtcttgaactcttgacctcaggggatccacctgccttggcctcccaaagtgctgggattacagacatgagctacagcacccagccccatttttcagtgtttttaaattttctacaataaacacatatttttatcattagggagaaaaagagacactattttcattttttaaaacccacaggaaaatgaaggagttcttatctgatgggcatgcattttctcaataaagtatgaggcaaagtcaacagcagagagtaggagggagagatctgaagaatgtgaataaggtaagtgagtggttttagagagttggagaattaagagtaaagggggatttttagctatgttgaagacctagttgattaagcttgactatcattaacctgcccattgtgtgattgcctccaccaatcctgaactatacaggttaaagtataaagaagatgaatgtgtggattcctccaggaggtgggtggaggggaactatggagtattgtgtaggcagttgaaggtatttgcaagagtcataataataaattcaggaatttaagtgaaaaagggagcaagcaaagtttggaggaggctgggtgcagtggctcatgcctataatctcaatactttgggaggccgaggtgggaggatcacttgagcccaggagttccagaccagcctaggcaacaggtttgtctcataaaaagaaattagccggacatggtggccagtgcctgtagtcccaactacttggaaggctgaggtggaagcatctcttgagcccaggaggtcgaggctgcagtgagctgtgatcatgccgctgcactccagcctgggtgacagagtgagatcatgtctcaaaaaaaaaacaacaacaacaacaaggattggaggagtgatgaaaagagagaaagtgtgtgtggtaggaggggcagtgaattggaggcttcatgaagccagagaattgtagtggggttacttgagccagtgagctagaaaagcttgggaagttttagaaagaaaacttaatgtgggggtttttggcttatttttaattgaaaaataataattgtatatatttataggatataatgtgatgtttcaatacacgtatatgttgtgcaatgatcaaatcagggtaattagcatatctgtcacctcaaatatttatcatttcttcacagtaagaacatttaaaatcctcttttagctattttggaatatacattagttgtttgtttgtttgtttgtttgagacagggtctcactctattgcctaggctggagtgcagtggcacaattacagctcactgcagcctccacctcccaggctcgggtgatcctcctgcctcaggctcccaagtagctgtgatcacagaggtgcaccaccgcactcgactaatttttttttttctagagacagggtctcactatgttgcccaggtggtctcaaactcctgggctcaaacgactctccccacttcacctcccaaagtgctggaattacaggcatgagccactgcacctggcccacaatacattataattgatgacagtcatcttgctgtgcaatagaacaccgtaacttattcctgctatctagctataactttgtacccattgggcaatatctccccttttaccatccacctccccactccctccagcctctggtaaccaccattctaccctctacttctacgagtttgacttatttagattccacatataggtgaaataatatggtatttgtctttctgtgtcaggtttatttcacctcacttaacataatgtcatctaggttcatccatgttgtaacgaatgacagaattttctcaaactcctgacctcaatgatccacccacctcggtctcccaaagtgctgggattacagatgtgagccactgcacccagccacaaatgacagaattttatatatatatactatatacatttataaatatatatagtatatatatattataatatatagtatatatattataatatataatatatatattataatatataatatataatatatatattataatatataatatataatatatgtagtgtatatatattatatatactatatattatatatattatatattatatattatatatattatatataatacatattatatataatatatataatatatataataatataatatattatatattatatattatataatattatgtatataatatatattatatattatataatatatgtattatataatatatattatatatattatatattatataatatatgtattatataatatatattatatatattatatattatattatattatatatatatatttcatatatatatatatatatatttttgagatggagtctcactctgttgcccaggctggagtgcagtggcacagtctcagctcactgcaacctctgcctcccaggttcaagcgattctcctgcctcagcctcccaagtagctgggattacaggcgcctgccaccacgcccggctaattttttgtattttcagtagagacagggtttcaccatgttggtcaagcggtcttgaactcctgacctcatgatccgcccaccatggcctcccaaagtgctgggattacaggcatgagccaccacgcctggctgtataccacattttttaatccattcatcccttgatggatacatagattgtttccatatcttggctgttgtgcataatgctgcaatgaacaagggagtgcaaacatctcttcggcataccgatttcaattcctttgggaatatccccagttgtggaattactggattatatggtaattctattcttagttttttgaggaactttcatactgttttccaaaatagccatactaatttacaataccaccaacagtttataagcgttctcttttctctacttcctcgccagtatttatctttcacctttttaataatagacaatctaacaggagtgacataaaatatctccttgtgcttttaatttgcatttctctgatgattagagatgttgaattgcttcttggccttttggctaagatcatgggtatgttatctcttttgtttgttttgttttgttttgttttgttttgttttgttctggggtttttgttgttgttgtttgaggcaggttctcactctgtcacccaggctggagtgcagtggcgcaatcatagctcactgcagcctcggcctcctggtctcaagcagtcttcccacctcagcctcccaagtaactgggaccacaggcatgtaccaccacgcccagctaatttttttttctttttttttggtggagacagagtctccctatgttgctcaggctggtctgggctgaagagatcctctggcctcgcactcccaacctgctgggattacagatgtgggccatcacactcagcctgtatgacttcttttgagaaatatgctttgcccacttttaatagagttgtttgttttcttattattaagcagttggagctccttgtatattttagatattagccccttacccaatgtataatttgcaaatattttttccagttcatgggttgtctccactctagtgcagtttttttagtttgaggcaatcccatttgcttttcttttttttttttttttttgagacggagtctgctctgtcgcccaggctgcatgcagtggtgcgatctcggctcactgcagcctccacctcccaggttcaagcgattctcctgcctcagcctcctgagaagctgggattacaggcatgccccaccatgccaggctagttttttttttgtatttttaatagagacggggtttcaccatattggtcaggctggtctcgaactcctgacctcttgatctgccagcctcagcctcccaaagttctgggattacaggtatgagccaccgtgcctggcccccatttgcttttgttgtctgtgcttttgaggtcatatcaaaaaaatctctgcccagactaatgtcatggaacttttcctctgttttcttctggtagttttaattttgcttcttttcttttcttttcttctcttttcttttctttttttttttttttaagacagagtctcgctctgtcatccagaccggagtgcagcagcgcaatcttggctcactgcaacctctgcatcctgggttcaagtgattctcatgcctcagcctctcaagtagctgggattagaggtgtgcgccaccatgcctggctaatttttgtatttttagtagcaatggggtttcaccatgttggccaggctggtctcaaactcctgacctcaggtaatctgtctgcctcagcctcccaaagtgctgaaattacaggcatgagccactgggcccagacaaattttataattttaagccttacatttaagtctttaatccattttgagttgattcttatataacggatgagataacggtccatttttactcttctgtatgtagatatccagttttctcaactcaatttattaaagagactgccctttcccctttttgtgttcttggtacctgttgcaaattaattcaccatagatttgtgggtttatttctgggctctctatctaattccactggtcaatgcatctgtttttatcctaatatcatgctgcttgattactgctatagtttggatgcctttctcttccaaatcccttttttttttttttttttgagacaaagtcttgctctgtcgcccaggctggggtgcaatggtgcgatctcagcttactgcaacctctgtctcctgggttcaagcgattttcttgcctcagcctcctgagtagctggaattacagatgtgtgtcaccacacccgctaattttgtatttttagcagagatggggtttcaccatgttggccaggctggtcttgaacttctgacctcaggtgatcctcttgcctcagcctcccaaaatgctgggattacaggcttgagccaccacgctcagcctctcctccaaatctaatgttgaaatttgatccccggtgttggagatggggcctaatgggaggtgtctgggtaatgagggcagatccctcatgaatagattattgccctccttccggaatgtgggggaaatgagttctttattacttcccaggatagctggttgctaaaaacaacttagcatctcccctcactcctcttgcttcctttcaccatgtgatctctgcacgtgtaggctccccttctgccaagagtggaagcagcccgaggttcctaccagatgccaaatcttgaacttttccaagcaagataattactatagctttgtaatatattttgaaatgcagtagagtgatgcctccagctttgttctttttggtaaaaagattactttggctactcaggatcttttgtgcagaatttaatgtttcaattagtaatttcagaggcccgcgttcttgcaagatctaggctatgagtacataacaaggtagcagaggtggaaggaattatatgatcaaatcacagaaccactgcctccttcacctatcttaacactcatccaaacacttattgccattcaattgcaggccctcgaattaatggtcctcaagagtctcactggaaggccgggtgaggtggctcacgcctgtaatcccagcattttgggaggctaaggcgggcaaatcacttgaggtcaggagttcgagaccagcctggccaacatggcaaaaccccgtctctactaaaaatacaaaaattagcctggcaaggtggcacacacctgtaatcccagctactcaggaggctgaggcaggagaatcacttgagcctggaaggcggaggttgcagtgagctgagattgcaccactgcactccaacctgagcgacagatcgagactccagtcaaaaaaaaaaaaaaaaaaaaaagagtctcactggaacctaccttttctgccttatttttccacttcatcccttcaaaatcctaggctccaggcaagatgaattataagctttcccatctttttgcctttgtacacaagattccatcctcctggatgctgtcactccaattcactaaattacacattttacctattctttaagctttagcttaaaagccttgacctctgtgaagccttcccagaactacttgcaagaactccgtcatgtgaattctcatgatacttcatgcatacctctcttaaggcatttattatttcctattttgtgtctttgtacttatttgattcaatgtgatctctctcttcttgtggagattaagattagaccatgcctaaagcaattttcaattccatcttcaagcatggtacccaactgtatgaatgtttccaaagtgtggtatgtgtgattattttacacagccaaacattttttaatagtgagatatttctttaaatgtatattagaaaaatattaaatacttttttttacttatgatcatggtaaaatgttttccttttaaaataagtatatttaagctttaaaatatggtttttttttaatactcagtacaggaactacacaggtagagaaaaattcatgaaggttatactcagatatctgaaacactgcactgaatggaaactgactagagaaccaaatcacagaaccacttcctccttcacatgagagttatctaaacagcagtaccaggatgtatcagtgctccctattgacaatcttctttaagtatataaatgcaagaatcacccaccttaaaaaaaaaaaaaactctccttcaattccctccagctactgcctgaaatgctaacctatagccccttgtgtccacttcctcaccctctattcactcaacccactgcagcacagcttccacccccagcacctgacatttgaaatgagcaactatctcctaaccgacaaaaaccagtgaaccctgttctgtccttatcttatttaactcggctctctaggcagcatttggcattgtggacttggggcattgcctattcattgttcctgaaaagttctttcctccgtagacttccacacactctcctgtcttttcagtcatcccttcttcaactcctttattgaatccccctcctttgtctatcccttaaatgttagagtttccctaatcttttactattaagatcatcataaaaggaatgaaaatagtaatgtttgcacacagtaaaaaaaaaaaaaggaaaaaaggaaaaagtacagaagagaaaccggaggttaacagtttcttatatatatatatttttccagaaaaaaaaaatgatgtgtaagtacattctcttttgttctttcacaaatattctgcaccttgtgacttgagttttgttttcatttttacttaacagagtatcttgaaggtcttttgtatcacctattggcacatacaattctcttattctcttaatggctgcttaagtattccccaaattaatgtattggaactaatttaactagtttcttgctgatgcacattagctagcttccaagttttatgctgttattagcaatgccacagtaaacacccttatacacatgtaaatttttaaaatgtttatacatatgtaaatttttaaaattcctataattttttaaattcctataaaagtaaacatccttcccagctactggagaggctgaggtgggaagatctcttggatctcaggagttccaggctgcattgagctgtgattgcaccactgcactccagcctgggtaacagaatgagacccggtctcaaaaaaaaaagaaaaagaaaagtaaacatccttgtacgtatgtaaattttttctatacatatgtaaattttaaaattcaggtggtggggtggaattgtcagacgaaaaggaacgtgtttttaattcttatcatcaaattgccctccacaaaacttaacaagaatgtacagcaccatcatgcatgagactgcctgtttaccctcacttttgcctcactttctttattgcctcacttttgcctagtcatctaaatttgtttgtcagtctgtaaggtaagaactaacacctcatgtttgttttcattcgtacttctttaatagtgaagttgagcatgcctcttctatttgttggtgttttatattcttttctgaaaactatttacatcctttgctaatttttctatcaggttgttcacttctttcctattgatctgtaagagctgtttgtgtataaaggaaattatacaatttgtgccgcaaaatatattttttcttttgatttagtttattttgcccgaaggtcatctttggccccacacagattctatcacattatatttgtcctctgagttgttgactcctaaatctataactttagcccagacctctatcctagctccaaatttcaactgcaggactgtatatcttcatctatatatgaagctaaaagcacatgtatgtttataaactcatcatacctggaactgaattattattttccaaatattcttttcctcttatgctcccttatattagttaatggtttgatcattcacctagaaactttacctggatgtcactcacttcttttttaccccctgcattcaactgatcaaaattctgaaatattttgcccaaatgactgcagtcagttactactagcaatgttgcatagtggttagagtataagctgcagagtcaaacaaaactgggcttctttcctggctctgacctttctacattatgtgacctaaagcgtatttctcacctaaagcctgtttcttcatctgcaaaaaataactatcttaacatctatttcacagggttattgaaaagacttaatgagattgtatgcagagtaatggaatataataaatgctcaataaatggtagctattatcttcctgctctagcttgtcccactcacttccaagccatcttccttgctgctgccagactcacactcacaaatccaaccatccccctgcttagagttgtccagtgactccccacctttttttttttcttttttgaaacagagtctcactctgtcacccaggcagaagtacagtggcactatcacagctcactacagactcaacttcccaggctcaagggatcccttccacctcagcctcctgagtagctgggactatagatgtgcaccaccacgtccagctaattttttctatttttttgtagaaacagggtctcactatattgcccaggttggcctgcaactcctgagctcaagcgatccggccacctcagcctcccagtgttgggattacaggcgtgagccaccgcacctggccttcccacttctttttctctgcacacacacttataacatctaaattccttagtatacaaggccatgtatacagccttttatcttttaccacagctgcatatgtgctaccctccagctacattaaactgtatgccacaccccaaacacaatttgaatgttttttcatacttccgtggtttcttgcacactgtacactgacagccaagcccttccctcagtccacttcttaagcatctactgcagactcagttcaagcatgtccttctttgtgcttccacagcactctgcactgccctggtacaaatcacactgttttgtagtcatatttacctgcttgtctcctccacaagattgtgagttccttaagggtggggattatgttttattcacatttgtatccccagcacccaccacaggacctaacgttttataggagcttcacctatgtttgttgaataaatggatgaatgaatagttctcgttctgagcagagctctgacctctattttcctactacttctgcagcaaacagtatccatatattaatatatgtggtcccttaccaaaccccctgactatccacccctcctcccagcagtgccaaacaccgcagccaaaatttctgatgctcaggcagttacaggagtgtgggactggtccaactagaagaggtggaacagaagccaatagtttcagtgtaggccctaaccaatgtcagtgttgctatcagagtccaccccaaatcccagagacaagtgttgctgtctacttatccagaacctaaccttaagtgtaatgaggggaaaacatatctcaagaccattcctttaagtgtgactggactggatggctacctacttacaccaccctcctcaaaccctgattcaacaagaagcacccacaggcacagcagatgcttttgtggtaactgaagaaaacacaaaggacacttctctgaggctcttcactcttaaaagtcaggctctacatctttagcaagcaaaaaacaggacacagtttatttttctactttcttttaatatcattttttaaagttggtaagcagc

SEQ ID NO: 277 - DNA, 13326 bp, Homo sapiens
ctaccttcatacacgtgttgtagagtgagatgtagttggtgaagaggtccagatatcgggcagtgaacaccacagcaaacaggacctggctcttccctgaaattcctgtggtccagagacagagaaagagagagagagagagacagagagagagagagagacagacagacagacagacagacagaaggagagaggaagctgggggtgggctgcatgggcaataaactaaggcagggcgcccgggaccagcctggaggcagctctggagtgcagctgtccccggaggcctccccagcccgccccgcctgagcagggccctttcccacggaccacagccagggggcagcccaggcccccgaagctactccagcccgaggctccgtcccagactaggcctcatggctacccctggcccctcagggtcctcccgcagtctggacctgaggtgaggcctagggaggaccttccctgacctcaggccccggatccggtcacctccctcccgttcccttcctggccgccacggtccacgtcaccaactcacagccacctccccgcctgccatggttccctgttcccggtccatgaaccctcgggctgcccagattggggctgggggtggctgaattgggggcctaaagccattcacatgaaactgtatgcacccccgccagtctggggaagggagctgatcccctggagacccagaacctagaagagagatccccagcaagcagtgggggtggaacctgtgcccctagtgcccccaaacccttcctgagtcctgcgacgtcccccaacccccgcccgcaatctctctccttcgccagccctggtgggcctctcaccggcgcacgagcgggacttccagattttgagcagtagcaagatgatggcgaggaggtgggagaggtctcccaggaatcggaagagattcatggctggggaaccctggcagggctgagcgggagggaggcaggctggcgggggggtgccccccgaggctgctggtctgaacgggtagctgggctggggggacggaagagggaccctaggtgcgctccgctccggggaggggactttgggagggggagcaaaggctggagctggcggcggagctggagccgggaagagggaggagagcgagagggggaggagtccgggaggagaggctccgcccccgagggcggggcctggatccccggcgccccctatcgcccacctcctgctttgccgtggcggcgctaaacgcacccccaaagctgccccataggaacttgggagggtcgcagggttcggaaagtgccaaatccagcaccggttcgcccaggcagtctgtgtctctggaagagacgcagtccagtacaccagcctcagcccttgcagggatgtagagactgccctctgagcttgaaaaatcctgcagggacccggaggctcagctgctagcttttgcagctttcaggcactctaactccaatcccccagaagacaagaaagataccccacctacttcctcccctagacccaggactcaaggccccagcccgttcgtcaaacccagaagtctgggtccccagcccctcctccctcagacccaggagtccagacccccagcctctcctccctcagacccagaagtccagacccccagcccctcctccctcagatccaggagtccaggcccagctcctcctcgctcagacccaggagtccaggcccccagcctcctccctcagacccaggagtccaggcccccagcctcctccctcagacccaggactccaggcccccagaccctcctcccccagatccaggagtccaggcccccagcccttcctccctcagacccaggagtccagacccccagcacctcctccctcagacccaggagtccagatccccagcccctcctccctcagacccaggggtccagggccccagcccctcctccctcagacccaggggtccagggccccagcccctcctccctcagacccaggggtccagggccccagcccctcctccctcagacccaggagttcagggccccagcccttttccctcctaggacgctgttccttggaacttagggtcccacccccaccatcttatggatcaaacatcctaaccttaagaatctagatctacagtttctccctttacgacccacagatttaggccctgattctcttctttttcaggaatgtgcacctcaccctgttctcccagaccttgaggatgaaggaaacaggagcctcacccaggaggctcaaggccaaaactctgacccaaactacctcaggagcccctggccctggcttcccccctgctccagagtttctgccctgcccacacacacacaccctcttccaccctcagaggccccggtgtcctgccccacgctctaccccagagccccacgggtggctttataaaagtgccgggcccagccctctagcaggaggggaatgctgggcatctgggtgtgggacccccggggaacagcctgtggtctggactcctgcatctatgaggggacagacgtggcttcccttccggatgatggggtacccacagatgatggaggccagggtccctcaataaaagaaggggtgcaggcgtgttgatttcttcagagggctggaaggacggggtgcccaagggtgacatccacgagtcttgggtccctgagggtggcttgtacgggggagagtcgggatgactgagtccttaaaagagactccgacttggaggcggtccccaaattcctgggtcccagtagagaaggggactcctgggtctgagggaggaggggctggggggtgggactcctgggaccagggtcgagacctggttttcaggcctggccttctggggcaataaaagccacagcttgggtcttagtgtggcgaacactgaagtcagggaaaggcctcctgtttccagagcctcaaggcagggcgggggcagagggcagcaacccccagccctggagtctagctctgaagctggtgtctccataccgggttctgagtccctgcctgcctgtccccagcctgacttcttcctccctttttattttcagcccctcactcccttgtcccaggaggaaggcagaggctggtagctaggggtggggggcggccccctccccaagcctggcaggagaaggggtccccagggaggccaggagggggggctgtgggtctcccggcagtggcagacggggactgaatgttaatcgcatcccgagtgagtgtgtgtgtgcgagaacacagcgagtgtgtgagtccctcccgctccagctcctccaagccgcggccgccgccgccaccctcgcccgcagcctcccgcagcctccctcggccaccggtgcctgctgggggtgttgcctgggtaggtcggcccggcccccaggggtctctcgagcgtctgccatctgcccggtgaggatctgtgtgtccgggtgtctggggctggctggtggagggggggtgtgtctgtaagcgctgcggcggcggagggagggaggggtctgtctgtctgtaccgaccctgagctgcctgcctgggtgtcgtggggctcccgctccttccccccggcccccccaaacccagatggatggtgtgtacctgggttctgtgcctcctgcctgcgtccggccaggcgtctgggcgtccccggctgcctgtgtcctcctgtctgtccaaacagcccctatcagcagtggcagcctggcccccattagaccccccactctgtgtgtgtgtgtctgtgtgtgtgtccctcctcaagctctgggggtgttgagggggaatcccagggaagtgagatcgtgcgtgtgtgcgtgagtgtatgtgtgtttctgcctgtgtttgagagtgggggagtcaagggggggtctagaggtggccaagcgaggaaggggcaagcagttccccaagcaggcaatctcccgctcctcacacgcacacaccagccactagcttcagaggtgacccagacagacagatagacacagacgctggaagggggggtgggggggctgagggcacaaagcgggggtgcgagtgagccagggagaggcgggactggacacatggaaaggggggaggagccggggctgaagcggcagaggggggcaccccgggtgggcggaggggggatccccacggggtcggggcggcaagaggacaccccgacagcctctgcaatgtccggggcccaacttccagagcaacatgtgtagccacgtcctcgcctagtccaggtggccgcaaccttgggggagagacagggcaggacaggaccaaggaagaggaaggagagacggagccagggacagacaggaggtccgggctgccgctgctgccgccaccaccactgccgccgccccggggcctgccccccgacatcggctctctgagccctcctcggaatcttggggtcgctggacgccgggttccggtcctggcccccccgccatccccccaacagaacagggtcatgaaaaggtaaggcggggacaggggatgcagggatggtggtgggaatgtggacccccaaatctaggacagaggaagttggcaagaagcctcgtggagggagggggtttgaacggtgggcaggggtcttgacccccacctagctcccctgtccctcagggactctcctccaccctctctctctccctctctgagcccctttttcctgagtccctacacctcagacctttcacgcccccatttctctgacacttggctccctctccccatccccacatacctgatgccccatatccctgtgcctccatctctctatctcaccttctccctgtacccccctccctgcatcagtccccccatcgcgagccggtcctctccctctctcctctcgctctcccctcccatgtcagagctatgagtctgctattaatacccccgccaaggaccttgagggcatccaggcccccagcacccctcgccccaagctcccaccccttcctcaaggttctggaacacccttccagcctcttccaagcatcaggattcgggtggggagagaccgatgttgtgtgtgtgtgttgggaggtgaggggggaggaaacgggatgccgtctgcagcacaactcgaggttgtggggggagctgttgatcgaagtggccgctcctctcttctctgttggatgctgtggggggcaatgaagacagggacaccctaggaatttctggcaccctcctcctcctccccgcttggggacaggctgtgctatgtacaggatctaagtggggtgactagggaggccagagctcggtgggggggcacccaggatgttgggaaggatagggtttgaaaccaaaaggggatccttaagggaggacaggagccggaacccggactcctgggtccttgggggaagaggggagctggggacctggactcttggttcctgcagggagaggaggctgggcactggagttccagagtcttggggcaggaggggcctggcctcctgggtcctgggaaagaacaggaccgaatgcccagactcccaaggcctgggggaggaaggggctgccagaaggactcctgggtctttacgggaggaggtaggggatagcgcttccgtctgaggaaggcaggctgggagctcagtctcctgagtccctgacagggcaggagatgagtgttggggactttagccctatgcagatggaagtggaaacggaggctcatgaggaggtagagatggaggcggggggagcggggggttgtccagaggctggactctgtgatccctgagggcgtgggttctgggggttgggccttcagagtcctggaggactggggatgcccctcctcaggccctggagtgggggaggctgctctccctaatccctgtggttaggaactgagcatgcagcccccgtgagaagggtggggccgggggctgccctcctgggcctcagtagggagtgggacgcggggtccctaagagcagaagccaggtaggggtgggtctgggagaggcagaggaggggctggagggtgagcagccactgggaatggaggggagcgtgagtgttaaccccgcgggggccaggccacagctgtgggttattttggggcggagtgggggggttattctgagcgctgattgagccagctgcttggggaagggcaatggaaaggaggagcgaagagaagccaggatcggggagggatgggcatactaggagcccccaaccccttccctggggagacaggggcccgagatctctgggaaggtgaggtggtgggcagaggggacgggctgtggcctcgaggcaggggaggggtggtggacctttcccccgccctggctgtctgtggggtggacgaggcctgcgctaccatggcaaccagacaggagcatgacagccaggagagaacccttccttgtctggaccctcaccccttctggaagcccctagtgcggactccagtccttctctgggaaccaggagtccagactcccagtgccctcctccctcagtcccaggcaggacccaggagcctggctcccagcccaaccaccccaggcggctagtattcaacagggggcacaggaagagaggctgtatttcctctaatttaccaaattgctctgggctgggtgccagggacccccacacccaccccacccagctctccacagctgtgccccccaaccccacatcccagatggggccatgactcccttgctttgagaatgaggggatggggacaggactaaggggacaaaatgggttaggggttgtggtcagggtgaggagtaaggtcatgtggggattttctctccttggggtgccccactaatttctctctttctctccccacacacctgaccccttttccctctcattttttctctcccttttcctcccttttatttctgctccctcctgccactcgccttccccgccttactttcatgtctgtactgggcacctccctggtgggggtcccgatcttggccttgcttcgctatttctgtcctcctgttttcgctccgctctgcctgcctccctcaatctcaattgtttccccatcctttatgtgcgcgtgtctcttggtggccttggggtctctgtctccctcttcctgccttgctgtcttcttctctgtccaactttcttgcctcgcttatctctcccgccttcctgcatctcttcccgcctctatcatcctctccctgggcctccctcattcctgtttctgtcactccgtcctctctctctccgtcttctccccgtctctgctgcttccgtctctctccttcttcctgccgctctttccctccccgtctccctgggcctctctctgctcctatcttgatcccatctctgtgggtgtccccatccccaccttgtctatcttcctctctctcccctcttacctctgtatcttcccctgaccccattatccaccctcgtctttgcgtctcccccaatcccatactccacttcttcctatctctgtctcgccctatctctgcgtctctccctgtttcacctcttcctctggtgtttcttccccacctctcccttccacctccctctgctgtgtctgtctctccctctgtctctgcctgtctctcctccatctctctctctccgtctccccctctctctcccctccatctctctctacctctgcccgtctctccctctgtctctcctccatttctctctccctctgtctctctcccttccatctctctcgtcctccgttcctgtctctccctctgttccatcaccccgaccgctccctgtcctccccatctcggcgcctgtccctcgctgcatctcctcctctgtgcgtctctttatctcgtctccctgtccctgcgtctcccgtctgtgcctccctctcctccccgtctctcccggcccgggcgctcagaggccgcccggcggggcccgcaggcgatgcgcggcgccggtggcccccgcggccctcggggccccgctaagatgctgctgctgctggcgctggcctgcgccagcccgttcccggaggaggcgccggggccgggcggggccggtgggcccggcggcggcctcggcggggcgcggccgctcaacgtggcgctcgtgttctcggggcccgcgtacgcggccgaggcggcacgcctgggcccggccgtggcggcggcggtgcgcagcccgggcctagacgtgcggcccgtggcgctggtgctcaacggctcggacccgcgcagcctcgtgctgcagctctgcgacctgctgtcggggttgcgcgtgcacggcgtggtcttcgaagacgactcgcgcgcgcccgccgtcgcgcccatcctcgacttcctgtcggcgcagacctcgctgcccatcgtggccgtgcacggcggcgccgcgctcgtgctcacgcccaaggtgcgcgcgaccggggcggggcggggccacaggaggggcggggacagccgctgaggggcgggactgggacagccagcgggggcggggcctagagggggcggggactgtcctgtgggtccgagtctgggacaaggtgggcccagatggtaggcagggcttagggctagattagaggcggggctgacttggagggggctggtctatagggtaagctgggcctttagggtcagaaagaggccagtcctcgatgatcagagtatagggaggacgtgggcccattcattgcaggtaagggtctgtagtaaaggcgagtcgagggaagggttaggggctgggaacgaaaagggactagccccaaatggcaaaatctgagggaggggtgggacctaggatcagcacaggaagaagtcagttgaaaaggaatgggcctgggcgcggtggctcacgcctgtaatcccagcgctttggaaagccgaggccggcggatcacttgaggtcacaggagtttgagaccagcctggccaacatggtgaaaccccgtctctactaaatatacaaaaattagccgggcgttgtggcgggcgcctgtaatcccaactactcgggagggtgaggcaagagaattgcttgaatccgggaggcggaggctgcggtgagccgagatcgtgccactgcactccagcctgggcgacacagtgagactctgtccaaaagaaaaagaaaaggaatggagttcagaaagaaaggggcgaagtctagtggagaggtggcagctaggaagtatcagaggtatcaggtaccaaggacagagtttggggaggcgttcggccggtagagcatagggtctagaagtcagccagggatggaggagccatcttctaagtggaagtcggaaaagaggaagagtcattagagagaggaggacgggcaaggggtagaaccaggaagcaaggaattgagatttggtgcgaggccagtcagggaaggagtgagtcagaaaagggggcggggctagccagttgggggcggggccagcgaggggcggggcctaagcactctaataaaggggtgggtctagggaggaagccggtcctgagagtagggtttgagaaggggcataccccgctgtgaggtgtggaaagcgagagtccagaggatgggcaggaggatgaaggcttatggtggaggccgacccagccaatgacagatcaaagccaggagcctgctgggaagggatggtagaggctggagctggccagagcctggagaaaggcctgactcccaagggcacagaaggggccagttgtagcggacctctggtagagaaggagagaattggaccaagcctgctctgtggattgagaatgggtcagctaggaggtggggcctgagaaggggcggggcctctccagaggtggggccagcgcaacccagaggtggagcttcattcaatctgcccattccctgctgtgcgggcctgtggctgtgtgactgcatcactgttgtatgcagaggctcgtagtcctctcctgtccagagcattctgggaaggacctctgtccaactttcttgttctccttggcatggtacttttcagagatttgtaggtagatgccctgggaggcgaacttatttcttaactgccacttccaaggcatactcaaaagacgtgatccctcgtgccttcattgctgctgagaagtgtggtcctctctgtttcattgtccgctgggcactgcggtcggctcagtgtacgcccatagcattctgggaaatgtagtccccgtgctgcccctggatggaagaaagaatgatcttcacagctccatctgtgccccactgaatgctgggaatgtggtcccctcagcacacctccacctgctgaaggaagaggttctccttgcattacaataagacctcatttccggccaggtgcactggctcacacctgtaatcccagcactttgggaggccgaggcgggcagatcacctgaggccaggagtttgaggccagcctggccaacatggagaaaccccatctctgctgaaaatatgaaaattagccgggcatggtggcgcatgcctgtaatcccagctactcaggaggctgaggcaggagtaatcgcttgaacctgggaggcggaggttgcagtgagccgagattgcagtgagccgagatcttgccactgcactccagcctgggggacagagtgagactgttctcaaaaaaaaaaaaaaaacaataaacaaaaagaactcattccctcaggacaactgcagtatcccctgtgcgcctagggagaaagcccacttgctgttctcattgcattacaggaagatttattgagagctgattctgtgccagggctgttttaattcctagggaatacagttctagagggggggggaaaaaaagagagggagacaaggtccctgccttatagagcttgcattttaatggtgagacagacaaaaccagtaacagtaaaatccggctgtcctggaggaaatcaacacaggatgttgtaatgactgaggatggagtttcaatagatggcagtcaggggaggcctccctgaggcggtgacacctgagctggaggtgtcaggtggaggtctggcatggaggaggtagggaaaagtgtccccaggagaggcaacaacaaaggacaaagcccttgaagcaggaaggagcttgatgtatttgaggaagagcaagaagggagtgtggctggagcccactgggggattggggtggcaggagatgaggtcagagaagcaacgggggccagttcacgcagggccttggggccacggtgaggactttggctttgattctgaggtagaatcactggaaggttttcaattgagaagggatgtgatccaattaatattttgaaacaatcactctggctgctgtttggagaatagactggaagatgcaagattgaaaacaaagataggctgggcgcagtggctcatgcctggaatcccaccactttgggaggccaaggcgggtggatcacttgaggtgaggagtttgataccagcctggccaacatggtgaaacctccctctactaaaaatacaaaaatgagcttggcatggtggtgcatgcatgtaatcccagctacttgggaggctgaggcaggagaattgcttgaactcaggaggtggaggttgcagtgaggcgagatctcgccactgcattccagcctggacaacagagcgaaacttgaaagaaagagagaaagagaaggaaagaaagaaagaaagaaagaaagaaagaaagaaagaaagaaagaaagaaagagagaaaagaaaacagagatgggtgggaaagttgtagatagctgggcaagaaagggtgacaatgagagttgtgacagtgatggcagtgaggagtggacaactggagctatctttgaacgtagagctaagaagacttggagatggctgaatgtgtgagggaaagaaagggaaaggatgatttaggtttggggcctgagcatcagggtgaatgagagagagaggaaaaaaaaggcagctgctctttattccttaagattctttactcctggccgggcgcggtggctcatgcctgtaatcccagcactttgggaggccgaggcgggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcgtgaacccgggaagcggagctttcagtgagccgagattgcgccactgcggtccgcagtccggcctgggcgacagagcaagactccgtctcaaaaaaaaaaaaaaaaaaaaaaaagattctttactcctttacgagagagagagagagagagagagagagagagagagagagaatagggaacagtcttgagataggggaaagatcgagcaatctgtttttgacatgctaattttgagacaccttggaaatccaagaggagatattgaataaaaaggaggataggggccaggcatggtggctcacacctgtaatcccagcactttgggaagccgaggcaggcagatcacttgagttcagaagttcgagaccagcttggccaacatggtgaaaccctgtctctactaaaaatacaaaaattagctgggtgtggtggcatgtgcctgtaatcccagctactcagaaggctgaggcaggagaattgcttgaacccaggaggcagaggttgcagtgagtgaagatggtgccattgcactccagcctgggcaacagaggaagactctgtctcaaaaaaaaaaaaaaaaaaaaaaaaaggctggaggatagatttgtctggagctcacatgagaggttgtgactgaggacaggagccattaacatatccagcactgttcaataaaactttcagcaaagatgaagctgttctatagctgctctgtccgatttgaaagccacaagccacatgtggctgttgagtacttgacaagtggttagtgcacccagaaaactaagttttaaattctatttaacatttttttcctctggtccttgattcaggataaattttatttaattttaatttgaatagttatgagtggctaacagccaccctattggatagcatgggagacagtatttaaactcatgggcctggttgagatcaccagggagagaggaatagagaagagaacagtaaggcactcctagtgtttagaatttagaattctggctgaggaagaagggccagcaaaggaggcagaggaagaggtgacagagaggtaggaggaaaaccaaagaagggaaaggacactctgcaaagcttcttccagtaggga

SEQ ID NO: 278 - DNA, 13533 bp, Homo sapiens
ggaaaggcaaagtagagaactattatctaccttataaaaagaattcacttaaaagtatgattctggccgggcgcggtggctcacgcctgtaatcccagcactttgggaggccgaggcgggtggatcatgaggtcaggagatcgagaccatcctggctaacaaggtgaaaccccgtctctactaaaaatacaaaacattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcagaaaaaaaaaaaaaaaaaaaaagtatgattctattttaaaacaaagttcaaactactaaaaatctattagaactaatgaacaagggccgagtacggtggctcgtgcctataattccagcactttgggaggccgaggagggtagatcacttgaggtcaggagtttgagaccagcctggccaacatggcaaaacccggtctctactaaaaacacaaaaattagccggtgtggtggtgggcacctgtaatcccagctacttgggaggctgaggcagaagaatcacttgaacccaggaggtggaggttgcagtgagccaagatggcgctgccgcactccagcctgggcaacagagcgaaactccatctcataaaataaaaacaaaaacaaacaaaaaagaactaatgaacaagcttggcaaggttttagggtataagatccatatataaaaatcaattgtctttcaatacactccaagtgaaaaatccaaaaatgaaattagtaaaacaatttcacttacaataacatgaaaaataatcaaatatttatgaataaatgtaacaaaagtgtaaaacttatactctgaaaactacaaaatgttgttgaaagaaatcaaatcatacctaaatatgtgaaaatacagtccatgtaaatggctcagaatatttaatcttgttaggatggcaatatttccccaaattgatctatagattcaatgaaatccccatcaaaattccagctggcttcttttcataaatgacaagttgatcctaagattcatacggaaatttaaggcacccagaagagccaaaacaatcatgaaaaagaagtataaagttggaggactcacatttcctgatttcaaaacttactacaatgctaaagtaatcaagacagcgtggtactagcataagaacagacatattgagcaatacaatagaactgaaagtccagaaatgaactctcacatttatagattttcaacaagggtgccaagacaagtctatgggagaagaatagtcctttcaacaaatggtgcagagacaactggatagctacaggcaaaagaaagaatgtggaccctctacctcacaccatatataaaaattaactcaaaatggatcaaaaacctaaatgtaagagccaaaactgtacagctcttacaagaaaacaagggcataaatcttcatgactttggattaggcaacagtttctcagatatgacaccaaaaagtacaaacaacaaaagaaaaaaatagacaaactggactacatcaaaatttaaaaattttgtgctccaaaggacactatcaagaaaattaaaagataacccatggaataggagaaaatatttgcaaattgtatatctggtaagagacttgcatacagattacataaagaactcttacaactcaacaataaaaaagacaaacaatccaattaaaaaatagacaaaagctctgaacagacacttctccaatgagcacataaaaatggccaataagcacatgaaaagatattcgacatcattagtcatcagggaaatgcaaatcaaaaccacaatgagataccacttcacattcactaagatggctagactcaaaatgtcagataataagtgttgcagaggatgtagagaaactggaaccctcaggcactgctagtgggggtataaaatggtgcagccactttggaaaacagttcagcagtaccttaaaggttaaacatagagctaccatgtgacctagctattttactcccaggtatatagccaagagaaatgaaaatatatggccatgcaaaaattggtacacaaatgttcatagcagcatcactcataataatcaaatggtggaaacaatccaaatgtccatcaactgatgaatggataaatgaaatgtggtatatccatataatggaatatcatttggccatataaaggaacgaagtactgctacatagtacaacatggacaaacctcgaaaacatgctaagtaaaagaagccagtcacaaaagaccacatattgtatgatttcatttacatgaaatacccagaagagagaaatctgtactaaaaggaagtagattagtggttgcctaggggtgtggctggggaagttcaggggaaagggagagtgactgctaatggctacagggtttcttagggtggaagggtaacgaaaatgctctaaaattgattgttataatgattgtacaactctgtgaatattctagaccagtgaatcatacattttaaatagggatcagttgggcgcagtggctcacgcctgtaatcctctactttgggaggctgaggtgggcagatcatctgaggtcagaagttcgagaccagcctgaccaacatggagaaaccccgtctctactaaaaaatacaaaattagctgggcgtggtggcacatgcctgtaatcccagctactcaggaggctgaggcaggagaacccgggaggcggaggttgcagtgagctgagattgcaccaccgcactccagcctgggtgacagagcgagactccgtctcaaaaaaaaaaaaaaaaaaaattgggacctatggtatgtgaatcatatctcaataaagttcttattaaaaaaagaaagctcagctgggcacggtggctcacgcctgtaatcccaacactttgggaggctgaggcgggaggatcacgaggtcaggagatgcagaccatcctggccaggatggtgaaaccctgtctctagtgaaaatacaaaaattagccaggcatggtggcgggcgcctgtaatcccagctactcggaggctgaggcagagaattgcttgaacctgggaggtggagttgcaatgagccgagatcacaccactgcactccagcctgggtgacagagcaaaactccatctcaaaaaaaaaagctcaagtaatatttttttttaggaaagtactttatatactttaaagatatactttatatatcttaaataggacagctgggagagtttccacaacttttgcatattccagttaggaagcccccttctaccacagtaaccacatcactaactctaatacaatcccctgacctctgtctttgcccctatagcattttatgctttcctcatcaaggcacttttcacaatgttgagcaatggcctgtttacttgtttcttgcccccactagacaatgagctccttgagagcagggacatcgtttgcctcattcattggtataaccctggcagctagtacagtggctggcacagagtcactcaatatacaccaaagaaatgactaaatcttaatctacatcaaggacacaaagatctgaaggcaacatcagggcaggtgtagaggcagggaagctggggtgattagaatacaatattgcctaattatatttccaagctgtaaattagcctccgccctctctatatcgacccagccttaagtcaggaacacttactgggctctgtggcaagaggctgctactggtctcttgagtactgggaggtcgacttccactttcctccagtggcaaaataccccttcgatccagcacactgaaggagataagagagttaacaaagaactgggcattcacccctccacccacctggcctacggaattttgctgcatagactggaaaatataaacctgtcctttggcaatctagcctgaacacagcacatgcctcttatctcccattcactttttcttccacaaaccaggaaatgtcacattaaccagggaacaaacaaatgaaattaagaatgaaagatcatccctccaaaacaaccagcccatggtctatggtccatgtagacatggtaccaagtggcaagccctggaaagacctatttgacaccaagaggccacactcagaaaaacacatcagacaaggtaacaggatcaggttgagctgctcatcccaacagtcccaggacttttgagtgccctgagcacctggggggcaaggggccacacagcacttcacagcagttcttcacaatattgccatggctgtagggattctggacgcgattcttccctgtccatgatcctttgatctgcaagataaaaaccaaggctgacattaaaaataatgttaaaatgaacaaataataataataaaattaaaaacagacacaaaaaagaaaaataataataataatgttgaagaaacacatgcagcatgggataataaaaaagttctggaaatggatggtggcaatggttgcacaacaatgtgatgccactgaactgtacatttaggatatgagggcgatctggctgcaacaactgtcaccccattgatcgccagggttgaaagacatttaatatagcacactttatatcatgtatattttatcacaacaaaaaagaaatacatacacagccatgaaaaatactcacaatagagtgaaaaaagcagataactgaatgatatatactatttttatttaaaagtacataatataaacacataaataaacatggaaaaaagtctagacaagtctagaatatataaatcatactactaacaaaggtgatgtctaagaagtaaagtaagaggaacttacttttttctttttgctcatctgtattttctgattttctacagtgaatgtagattaattgctaactttttttttttttttccagacagagtctcattctgttgtccaggctggagtgcagtggcgtgatctttgctcgctgcaacctccacctcccgggttcaagtgattctcctgcctcagcctcccgagtagctgggactacaggtgcacactaacacatccggctatatttttgtatttttagtagagacagggttttgccatgttggccaggctggtcttgaactcttgacttcaggtgatccgcccgcctcagcctcccaaagtgctgggattacaggcgtgagccaccacacccagcctaattggtaactttttatatagcaaggattcatccagtgcaactgtccctctccatgccaaacagaggcaccagctagcctttaaggacctgtgaacagttaaaggctgtatacccacccaacttttcaacctcttcttcctaatgctccacaagcattcaacaaagccctctcctttctcttccacacatctgacttaacaacctcgcataccacgtttctgcctgcctcaacctcccaggccctggagactcggtagttctctagcaggtagcaagaggataggctttgggaagaagaatatgtggtgaggagaagagaaagttgactcacgtcttcattggttgtctggttgagagccacgaggaaagtatgaaatccagtcagtcccacgacggaccagagtgtaaagaagcaaatgaggacttctagaacagtgaggtgtggttaaggagtattgaagaactcaacatcaggagacttgatgcctccgcccatattcagagcaccagtcagaccatctttacctcctggaacgtatatcacaaaaagccatgtttccatatataacaatagatgaattctgaacttactggatagatcccttatgaaagaatttctagcgtatctagggtatttaagggtgtgcctatttacccatcattggctcttggaaggggatgcatgggaggggccaaagctaaacaatgttggccatcactgccaatggaaattctgtcaaaaaacaaaattcatgtaatcccggcactttgggaggccaaggtgggcggatcacaaggtcaggagttcgagaacagcctggccaacatggtgaaacccccgtctctattaaaaatacaaaaaattagctgggcgtggtggcgggcatctgtagtccaagctactcgggaggctgaggcaggagaatcatttgaacccaggaggcgagctggggcaacagtacaagactctgtctcaaaaaaagaaaattcataaatgaagaactggtgggggaaaaaaaagaggatgtgatttatagaaatctcatctgaaccccctttgcagaaatgcagccactgtcctgagcagggggtgaaggaaagacctcccttttagtcccggtcatcttccattctggttgctaccactaagactatatttttttaaattattttagaccttggcactctctgatatctgaaaaactagatagtgggagaactgtggggaaaaagcatgctggaaagtagcttaagaaggcttcacagggacatactgccagcggaggatatgttccaggagtttctttcaatgtctccaagaagccaattttcaaagattctgtgaaattggatggaagagtagagagaaaaattagtgacttcagtcaaaactacacactatcctagtgcctactcacttccttccctccctctcccgtgttacacactggcaagagctaagctctcactcgggcaagggtgaagagcctcatctcctagctggtagtctcatgactaaagagttcacatttccagtgcaggaccaggccctggactagacaggcaggcagaagagcagcaggctcccttcccttttccctagcccccaactatggacatgttagggggatattaacagataaaagaaatcagaaatacccaagaaaaatcctctctccttgccaatacgtgtccctcccttgttcaaaatccagctcagaactcttctctttccagaaagctgtcttaagaccactcccttaactccacatcacatctgctcttagattggcgtgtgtgtgggtgtgtatgtttgtgcacatgtacatatgtgggtgtgctttctatctcccaaactagaccatgagctacaaaaagacatttctcaggcaaaacccttacccttttctaccccttagcacaaggcaagttttacaaggcagaagaagagaggatgctccgagacaaaatacatccccagcctttgggattacctcagaaatgccccagtactctggatacagaccagtaattatggccccagtgcccagcagttggccaaagagaaggccaacacactgattaatactcattgatgtgcactgaggtttgcaaccctgctcaagagcagataactgtgctcatttctaacctgtcctaaagtacctttcacaatggtaccaccaggaaacccaacaaccctctaagctgcccttaactcttcccccacccagccccactccaacaacggacactgccctgtatactcactgagggccacatagacgatgttgaaggcgaagacatagattgtgaggagggagagagaaaggatgaagaggtagaagtagcggtagttcctctttccaacacaattccccacccaggggcagtgatggtcgaagcgctctgtgggagaaagagagagtccaaagccaaaagcctccagaacaaaaatcaaccccaccatccctataatacctaattcaaagacctccaggatcattgtctatttcagttgtaaaaaatatagggtttttttttttttttactttttcaaaatgttttcataaccatctcatttgatcctcacaatttccctggaacttgggcaaaaggagatactcttttccccactttacagatgaagaaacaaaggcatggagaggttaagtgatttgcctcactcagctcattaaaagcagagacactgcttttccaaataaaatcttaatcggtgggcctactaagttcaagaagaataaacaggtcaaaatagccaaggaaaaatgtaaaactacaatatttaaaatggtatggcatagttcaatggaatggaaagagcccagaaacagatcttagaatatataagattttgttgtctaataaactcagcattacaaaatcagaggtaaaaggaagtattattccataaacaattacgtgacaattggctatttggtgcaaaataaggatcgatttttttgtcttcatactacttgtcatagtaaattccagatgaattaaagaactaaatgtaaaaacaaagtgaatccataaaataactataaagaataaatgtttatttgtcctctatatgcagaaggactttctaagcataaaagtactggaagaaaacagatgacaaggaaaaatagatttgactccataaactttaaaaaagtactttgtggttttgatttgcatttccttggtgatcaatgatgtgattattacacattgcatgcctgtatcaaaacttctcatgtacaccataaatatatatacctactatataccaacaaaaaattaaaaatttaaaaaatattttgtgtatgttaaaattaccataaagaagactaaagaaaaaaaaacaatggcaatctatgtaaagttgtacctgactatatgaaaagttcttagaaatcaataggaaaatacaaatacttcgtcaagaaaataatagtcaaaagttacttgaaatttgctaagagagtaatcttaagtgtcctcaccacacacacacatgcacacacaatggtaactatgtgtggtgatgaatatgttcatttgattgtggtaagcattacaggcagacaccaaaatccacccatactcaagtcattcagcagccctgcagaacccacggataagaaaagttgcccctcatgtacacaggttttgcatcttgtgaatactgtacatttgaaccttgaacaactcaggttagaactgcgtgcgtccacttgtacatggatttgtttcaataaatacagttggccctccgtatcaacaggttctgcatccacaactaaacctagatcaaaaatacggtattcacaaaatatgaaactcctggagacggatacagagggctgacttcatatccatgggttccacagggccactgcaggacttgagaatgcatggggtttggtattcaagggcaatccctgaaaccaatcccccaaggatacttagggacgactgtattttggatccgcatttggttgcagatgaggaacacactgatactgtatttattggaaaaaaaaaaccctcattattaagtgggcccatgcagtacaaaactgcattgttcaagagtcgactgcacataaaacaaaaacaaaaaacaaacaaaaaggaaatagggcaaaaactaataaataccataaaacctatatttaatatttttcctagtcaccaataattcattgtaatactagtaaaataatagcatattttatgcctatcaaaataagaatataaataataaaatccagtgctagtgagaatagggtaaaatggacactctaacatactgcttgtgggagcataaaatgaaagaaccttcccagaaagcaatttggcagtacgtatcaagagccttcataaagcttgtacccctttggtagaataagtccattttcagcaatttctcataagaaaatagaaatgtacacagaaattttaagttcaaatttttatttttatttatttatttatttttgagacacagtttcacacttgtcacccaggctggagtgcaatggtgcgatctcggctcactgcaacctccacctcccaggttcaagcctcatcagctgcccgagtagctgggattacaggcatccgccaccacgcccagctaatttttgtatttttagcagagacggggttttgccatgttagccaggctggtctcgaactcctgacctcaggtgaaatgcccgcctcagcctcccaaagtactgggattacaggcatgagccactgcgcccggccgaagttcaaacttttaaattaaattttgtattgtttggaaggcccaggcaggggaatcatgaggtcaggagtttgagaccagcctggccaacatggtgaaaccccatctctaccaaaaaatgcaaaaatccgtgggtcgtggtggtgcacacctgtaatcccagccaatcacgaggctgaggtggggggatcacttgagctcgggaggcggaggttgcagtgagctgagatcacgccactgcactccagcctgggtgacagagtgagaccctgtcttaaaaaaaaaatctattatggtaaaatatacataacatacaatttgccattttaaccattttaagtgtgcaattcagtggcattaattacattcataatgtggaaccatcaccattatctatttccaaaaccctttcattactccaaacagaaactctgcacccattaagcagtaactctccatttcccccttccccatcccctagcaatctctaatcttctgtctctatgaatttgcccattctagatatctcatataagcggaatcacacaatatttgtctttttgtgtctttttttttttcacatagcatgttttcaaggttcatccacattgtatcagtactgtattcctttttatgactggataatattccaccgtatgtacataccacattttgtttaaccattcatctgttgatagacacttgggttggttacaccttttggctactgtgaataatgatgctacgaacactggcgtacaagtaggttttgagtccttgttgtcaattcttttggctattgttatggaatgaactgtacccccactccccagttccatatgttgaagccctaacccccaatgtagctgcacttggaggcagaacctttaaggaggtagctaaagttaaatgaggtcatctggatggggccctaatccgatgggactggtgtccttgtaaggagaggatgagacaccagtagtgtgtgagcacagagaaaaggtcacgtgaggacacagcaagaaggcagccatctgcaagccagggggagaggcctcaccagaaaccatcccttctcgcacctctatcttggacttccagcctccagaattgtgagagaaaaattcccattgtttgagccagccagtctgaggtattttgttatggtaacccaagcagactaatataggtatacacccaggagtggaattgctgggtcatgtggtaattctatgtttaactttttgaggaaccaccaaacttttccacagcagctgcatgattttacattctcaccagaaatgtatgaaggttccaattgttccacatccttaagtttaataattatgattgcagtgttacaacaatgaataaaatagaagaatgaataatgtctaatgacagaagactgcctgaataaacttgaatagaaccatatgatggattatgcagtcattaaaataatatattaaagaaacatttattaaagatgtagaaaaacgctcaggatagaatgttaaatgacaaaagcaggattaaaaactatcatgttacagtccaattttgcagaaacactagtaggaaatatagcaaaatggagagtgaatttaggattaagttttatttatactttctgcacttcccatattttccacaatgaacatgtgttattttgatgaataaaagactacaaaagaataaaatacatcaatttgggccaggcgtggtggctcacaccagtaatcccagcactttgggaggccgaggcaggtggatcacaaggtcaggagatagagaccatcctggctaacacggtgaaatcccgtctctactaaaaatacaaaaaaattagccaggcgtggtggcgggagcctgtagtcccagctactcgggaggctgaggcagaagaatggcgtgaacccaggaggcggagcttgcagtgagctgagatcgcgccactgcactccagactgggagagagagacagcctccgtctcaaaaaaaaaaaaaaaaaaaaaaaaagaataaaatatatcaatttgaaagaaaagtgagctgtgtactggtgaaaaaataaggctgtaaaaatggtctatctcctgctgaggaagctacatcttttcaggaaagggaagaaaggtatagagaagaatggttatacagatatatattttttacagtattttaaatcacattttttctgataatacaagtaatacatgctcattgtagaaaacttgaaaaaaataaaaggaaaaatgaagaaatcacagtagtggaggatggcatatgaaaaaatgaaggaaacaaaatcactcataatcccacaacctatagataataaactataaaaattgtggcatatttcctgtatttccttgcatatttctttatacatcattagattttttaaaaataggtaactgacttcacactgtaaatgtagcctatctcccattttgtcatttagctttctggtatgaactctttccatcagtctaatgtacgaatgtcctattatttatttatttatttatttagagacagagtcttactctgtcgcccaggctggagtgcagtggcacaatctcggttcaatgcagcctccacctcatgggttttttattctcatgcctcagccagggtctcagctgggattacaggcacatgtcaccacgtccagctaatttttgtatgttttagtagagacgaggtttcaccatgttgctcaggccggtctcaaacttctggcctcaagtgatctgcccacctcggcctcccaaagtgctgggattacaggagtgagccaccacacccggctctataatttatttggctactcatctattggtagacaattaggttcttttcaacttttaattgtcataataatcctgagttaaacatttccaccccgaaatattttcccacatctctgatttcatgggacagactccctagaaagtgaaccactggcaccaaaaggtatagatgttttaaggctttcgattaatcttattagattgccttccaaaaagtttgttccaatttacactcttactagtggaagaataaacatcaggttttccttgctaattttctagatttaaaaaagcatattgggctgggggtattggctcacacctgtaatcacaacactttgggaagctgcagcaggtgggctgcttgagcccaggagtttgagaccagcctgggcaacatggggaaaacccatctctacaaaaaatacaaaaaaaaaaaaaaaaatagccaggcatggtagtgcatgcctgtagtctcagcaacttgggaggctgaggtgggaggatcacctgaacccaggaggttgagtctgcagtgagctgtgatcgtgccactgccctccagcctgggaaaaagagtgagatcctatctcaaaacaaaagcatcctgaaatcatttatttgactattagtcat

SEQ ID NO: 279 - DNA, 14929 bp, Homo sapiens
acgttcaattcctcaactgtagttatatctgcatccaaatctctaacaaatgtgtcgtgttattagagcttcagttgtattataatacggtaattttggagtcctaataaaggaaaaggagtcaggctggcgggagcaggagaaagcaagaagagaaagcagataatctataagcctgtctttcttcatggtccaggacacacacccctcctgcgcagataactcacaatcttcttgtgtccagctattaccaaaccctcgtctgatagaaaaatgcaagttagctcactgcagccttggcattatcagtactgcacgcagccctctccagcacaagcaccgtcctaaaaaatcgccagcaagcctttgtctttttgcagtcagctcctctcttcctgatttgcttgttgctttcttgcagcatattttcatactttctctaataaatttacctttatttacctacaactgtcttcataaattctttttactgctcatgccaccagcctggatagttgatacccgtggcagtaatcttgtatttgactaattggttttggtcaaggcttcacataaaaaattatttcttcacttaattttctttcacttttaacacaagttagaaattacatctttacctaaatgagtgattcatattcaaaggcaacctaatatgtagtgtctgttttactgaatgttgagatttaaacaatgaggcttctgttcagtaagttgtattctgatttagaaattttacatatatttgaaaggaaaatatgggctaaataaataatattgctgtggaaattatctatttagatttagaataactgtaccaacaatagttattacttttctttttctttttcttattgagatagagtctcactgtgtcacctggggtggagtgcagtggtggaatcactgttcactgcagccttgacctcctggtctcaagtgattctcctgcctcagcctcctcagtagctgggactacaggtgcatgccactatgctgagctaattctttttttgtacttctgcctcccaaagtgctgggactgcaagggtgagccaccacacttggcctgattattacatttacttttgtattttgaagtacactgagatagttgaaaagtaacagaccttttaagacagtatcaaagatgtgaaacaaaaaacaaacacctcatcagaagtacagaagaacctaatggatatgactgaaggtggaatttgttatttgggagatttaatcatggaattcttcctaaattaaaaagagatggaaattataaaagaaagattgagtgacatagaaattaaatccagtagatctaatatctactcaaggtttgtaaaaaaaaacaaacaaagaaataatagaaagaaatttcctgaaagtctgggtcctctagatttaaatgccccaccaaatgctgagtaagaaaaatttcagagcacacataagaatagttagacagatcttaagcacataaaacatataaaatcctacatgcttccagagggagaaaaaaggtaatttttaaagagaaaattaaaatgtaattggatttttttacccaaaaaagtttatgttagaatgtaatggagcaatgtctctaaaattctgaaggaaaaagatcatgaacctagaagtctgtacacaaccaattaatcatttgtagtagtaatattctgtaaagtttaatgcaattgtttgtaaagaattcctaaaattatagtgacatactataataacagagtaaaaaatagagaaataaaactgaagttcaaggtaatgtgaacacatttggaagcagagttaggatataattgaaagcatattaaaggtcgtatcttacttgagattgagtgcagttatagatagtggttaaatggtgacattagtaggaaatacatttatatacatttggtaaaattttcacttgtagtcaatagcagactagcattaaaatgtagaattttcaagtgactagagggaaaaatttgtcagaaaagaaaaactaaaaggagcaatacgaaatcatgattaatagaaagcataaatataagatggcaggaataaaaccaaaaagaagtaatcacaattaacatggatggttaaattcccttattaaaatacaaggatatccaggttggactaaatagccaacaatataatcttttcaagatacacatcaaaaacaaacacacaaagattgaaaataaaaagatttaaaaaacccaggtaaatgtgaattaaaaaatcagaattgctaagattaatatcagataagttaaattcgaagcttagctggtaagctttgaatatcagagcttatcagagcttaaaataactatcttattttatatctatatattttattttatatttataaatggtgtgatccgccaagaatatacaagaaactttatcaaacagcatagcattgaaatatataaattaaaattattagaaatatagcagaagccctattatccaatgaaatttggactggtagctcatcagttaattgaaaaataattgagacattggagaaaataataaaatatatattaggcattttaacttaaaatacacaaattctctttcacttggctgcctttgatatagaaccaacaacttaactttgagtataaatcttctggttagagtttcacatcattttccttgtataagccacatccatgatgtatcagctataattttcagttctgttaactataagtacaatgttttatagcaaatctccaaaacttgtttatcttgtatcactaaaattttatatccattgaacagcaactccccatttccccctacacccagctcctagcaaccaccattctattctctgtttctgagtttaactattttagatacctcatataagtggaatcctacagtatttgcccttctgtgactggcttatttcatttagcatgtctttcagtttcatccatattgtcacataggcacaagggcagaatttctttctttttaaagactgaataacactccattatatgtatattccacattttctttctccattcatcttttggtggacatttagattgttttctatcttgactactgtgaataatgctgcaataaacatgagactgcagatatctctctgagattctgatttcaatacttctagatatatatacagaagtagaattgctggatcatatggtagttctattttagttttttgaggaacctccatactgattttcataatggctgcaccactttacattcccatcaacagtgtgcaagggttccagtttctccacatcctcatcaacactggttatcttttttttttgataatagacattctaacaggtgtgaggtgatatctcattgtggttttgatttgcatttccctaatgattagtgatgttgagcatttttttatatacctgttggccatttgtatgtcttttttgaagaaatgtccattcaagtcgtttgcttattttaaaatcaagttatttggttttctcctattgagttttagaagttacttatatattttggagattaacccttatcagatatatgcatgatgctattttaaacagaattattttcctaattttattttttgattgcttgtgtatagaattataactgatttttgtatattaattaatcttgcatcctgcaacctttctttaaaactgttcatatacaaggttatgttatctgcaaatagacatcatattttttcctttccaatcaggatgcattttatttctttttcttatccaattaccctggctaggacctccactaaaatggtgaataaaagtggtaagagcagatatccttgtcttgttcctgattttcaccattgaatacgttatctgtgggtttttcatagacatcttttatcaaatggaggaagttctcttcccttcctagtttatcaagcattttttattatgaggagtgtttaattttgtcaaatgctttttctgtgtctattgaaatgatcatgtgttatttctcctttactttttaaatctggcatattacgttgattgattttcagatgttaacctgactttacattcctggggtaaatccttcttggtcgtgatgtataattatttttatgtgtgcaagtattgtgttgagaatgtttttgtctgtatttataagttatattggttagagtggttttcctttcctgtgacgcctttatctgattttggtatctgggtaatactggccttacaggatgagttttgaagtgttctctttaagtttttggaagaatttgtgaaatattcatattaatttttctttaaacatttggtagcatttaccagtgaagccgtttggtcctggaattttctttatgaggtttttttttaaaaaaattattactaattaaatgtctttttttttttttttgagatggagtttcgcttttgttgcccaggctgattggagtgcaatgatgaagtcttggctcaccacagtctccacctcccgggttgaagcgatcctccttcctcagcctcccgagtagctgggattacagatgcctgccaccatgcctggctaattttcatatttttagtagagacagggtttcaccatattggccaggctagtctcaaactcctgacctcaggtgatctgcccacctcagcctctcaaagtgcttggattacaggcatgagccactgtgcccagcctaaatctctttactaaattggtcaatttttattttgtatttcttctttagtcagttttggtaattttcagttttaggtatttgtccaatttcatatatgatatctaatttgttggcatacgatttttcatagtattccttataacacttcattttgtaaggctggtagtaatttccctgtttcattctttatcctagtaatttgggatctctctctttttcttggtcaatctagcctaaggtctgtcaattttgttgatctttttaaagagccagactttggttctattggttttctctattatttttctattctgtttcatttgtctcctctctaatacttctttctgcttgacttaagtttatttttctcttcttttcacagtatctttaggttaggttcttgatttgagaccttttggtatttatagctatatttttctctgtaagcactgtttcagctgtacctcataagttttggtatgttgtatctttgttttcattcagctcaaaatattttctaacttattttgtttgactcattggtgacataggcatatgtttaatttgcacatatgtgtgcatcaacccctattttttgttgttgattcttaatttcattatggtcaaagaacattcttcatatgatttcaatccttttaaatttattgagactcttaaaatctaatatgtgctttatcctgaagaatgttccatgtgtccttgagaagaatatgtatttttctgttgtttagtgaagtgttctatagatgtctgccacttcttgttgatttaaagtggtgttgaagtcttatatttccttgttgatcttttatctagttgttctatccattgttagaagtggagtattgaattattcaattattattattgaattgtatatttttccaattctgtctacttttgctttatgtattttggggatttgtcatgaagtacatatatgtttataattgttatatctttttgaccttttcatcattttaaattatccttctttgcctctaataaaaatgcttgtcttaaggtataatttttctggtattagtaaagccctccaggtcccttttggcaactgtttgcatggtatatctttttctgtcctactttcaacttgtttgtgtctttgaatctgaagtgtgtctcttatagacagcatatggttggatcacacgttttaaattaattctgtcaatctctgcctttacattagagtgtttaatccatttatattaatgcaattacttatagattgggattcacatatgccattttactatttgttttctatatgtctcatatcttttttgttctattcttctattactgcttcttttgtgttaaataggagtttcctagtgtaccattttcattcctttgccattccatttactatattttagaatttattttcttagaggttgcccttggagttacaattaatatcttaacataaaaatcaagttcatatcaatgtcaacttaatttcaaatctttgctcttaataacttcataacctcctcactcctttgcatcgttattgtcatacaaattacatttttatacattgtatgaacatcaacacagatttatacatatagctttataaagtcttgtaagttagataggagaaaagacagaattataacaaaattcatttatattgtattttatatttacctatgtcattgttgttgcatgtattggcagaacagccagggaaggagaccatcaataacaacccttctgggatcacatacaattcggggagttaggaaggctatgtacatatatgaagctacgttcacttaggagaaatcagagaaggatggagcaggcttgaaagaattcctcaagccacacacagacctataaacatagggcaaaagcaccagtggcacagggacttaaacacaacttctgagcaaatactgactcaaccataggctactctgacccaggggcaaatcctagaaatccaggatgaaaaataaaatcagtatcatccctggaagtctagaagaatgtgtgtatgcccaaggctatgcccttgaaggagcaatcacagaaggatcctccaaggtactagtggctgaatgaggtggtggataggggacaaggaaatatgtaaattcactgaactatgagagccatctccaagccatccacatatccaatggcaaaggataaaaatctaattggctaaaggatgcttaagcacaacctttaactaataaatagcttatgccaagctacggtcaaaacctaagtagccaggctaaaagataaaaataaagaaaaaatatctgagcagggacaccagagttgcacatgttgggggaaatagacttcacagaattagttcagccaagccaacaaacaaacccatgaccaagcaaacaacaacaatctccagggtgtgggcaggtggttcagtattcagggtttctataatatattatctaacatgtccagctttcaacaaaaaattacaacacatgcagcaacaactacataggtaaatacaagacaatataaatgaattttgtaataactctgtttttttctcctacttacttgactttataaagcaacatgtataaatttgtgttgatgttcatacagtgtataaatataaattattgtctaccaagatcttcactgttttaaaaaatgcctgcaggcatagcttttttttttcccccttttccaagttaagtcagtaccctcaagcagagctgcagagtcctttatccttatgtcctgcctttcctcctgggaagaatccctgaaccactgcaccagagctggagccagggacctgcttttatctgagtgatgcccctgctctgtgagatagttctaggaaggggtggcagctcctggtcctcttggattgcccattttggagtagaaaatatatttgaggaaataattgtcaaaattttccagatttgttgaaagatataaatttataaattcaagaagtttcatgaattccaaatggaataatctcaaagaaaaccacctctaggcacatcttattgaactgctgaaaatgaaaagtaaagaaaaaattttagactgatcattccaagatggccaaataggaacagctccggtctacagcttccagtgtgatcgttgcagaagacgggtgatttctgcatttccaactgaggtacctggtttaactcactgggactggttggacagtgggtgcagcccatggagggtgagctgaagcagggcggggcatcgcctcacctgggaagtgcaaggggtcggggatttccctttcctagccaagggaagcaatgacagatggtacctggaaaatcgggacactcccgccctaatactgcacttttccaatggtcttagcaaacggcacaccaggagattatatcctgcacctggctcggcgggtcccatgcccatggagccttgcttactgctagtgcagcagtccgagagcaactaggctgggggaggggcatctgccattgctgaggcttgagtaggtaaacaaagcagccaggaagcttgaactgggtggagcccaccacagctcaacgagacctgcctgactctgtagaatccacctctgggggcagggcatagcctaacaaaaggcagcagaaacttctgcagacttaaacgtccctgtctgacagttttgaagtgtgccatggttctcccagcatgtagtttaggctctgagaatggacagactgcctcctcaagtgggtccctgactcccgtgtagcctaactgggagacacctcccagtaggggccgactgacacctcatacagccagatgcctatctgagacacaacttccagaggaaggatcaggcaacaacatttgctgttctgcaatatttgctgttctgccacctctgttggggatacccaggcaaacagggtctggagtggacctccagcaaactccaacagacctgcagctaagggtcctgactgttagaaggaaaactaacaaacaggaatagcatcaacatcaacaaaaaggacatccacaccaaaactccaaatgtaggtcaccgtcatcaaagaccaaaggtagagaaaaccacaaagatggggagaaaccagagcagaaaagctgaaaattctaaaaaccagagcgcctcttctcctccaaaggatcgcagctcctcactagcaatggaatgaagcgggatggagaatgactttgacaagttgacaaaagtaggcttcagaagattggtaataacaaacttctctgagctaaaggaggatgttcaaacccattgcaaggaagctaaaaaccttgaaaaaagattagacgaatggctaactagaataaactgtgtagagaagatcttaggtgacctaatggagctgaaaaccatgtcacaagaactacatgacgtatgtacaagcttcagtagccgattcaatcaagtggaagaaagggtaccgattcaaccaagtggaagaaagggtatcagtgattgaagatcaaatgaatgaaatgaagtgagaagagaagttcagagaaaaaagagtaaaaagaaatgaaaaaagcctcaaagaaatatgggactatgtgaaaagaccaaatctgtgtttgattgatgagagaatggaaccaagttcgaaaacactcttcaggatattatccaggagaatttccccaacctagcaaggcaggccaacattcaaattcaggaaatacagagaacaccacaaagatactcctcaagaagagcaaccccaagacacataattgtcagattcaccaaggttgaaatgaaggaaaaaatgttaagggcagccagagagaaaggtcgggttacccacaaagggaagctcatcagactaacaggggatctctcagcagaaattctacaagccagaagagagtgggggccaatattcaacattcttaaagaaaagaattttcaaccccaaatttcatatccagccaaactaagcttcgtaagtgaaggagaaataaaatcctttacagacaagcaaatgctgagagattttgtcaccaccaggcctgccttacaagagctcctgatggaagcactaaacatggaaaggaacaaccggtaccagccactgcaaaaacatgccaaattgtaaagaccattgatgctaggaaggaactgcatcaactaatgagcaaaataaccagctaacgtcataatgacaggatcaaattcacacataacaatattaaccttaaatgtaaatgggctaaatgccccaattaaaagacacagactggcaaattggataaagagtcaagaaccatcagtgtgctgtattcaggaaacccatctcacgtgcagagacacacgtaggctcaaaataaagggatggatgaagatctaccaagcaaatggaaaacagaaaaaagcaggggttgcaatcctagtctctgataaaacagactttaagccaacaaagatcaaaagacaaagaaggccattacataatggtgaagggatcaattcaacaagaagagctaactatcctaaatatatatgcacccaatacaggagcacccagattagtaaagcaagtccttagagacctacaaagagacttagactcacacacaataataatgggagactttaacaccccactgtcaacattagatagatcaatgagacagaaggttaagaaggatatccaggacttgaactcagctctgcaccaagcggacctaatagacatctacagaactctccatcccaaatcaatagaatatacattcttctcagcaccacatcgcacttattccaaaactgaccacataattggaagtaaagcactcctcagcaaatgtaaaagaacagaaatcataacaagctgtctctcagatcacagtgcaatgaaactagaactcaggattaagaaactcactaaaaactgcacaactacatggaaactgaacaaccttctcctgaatgactactgggtaaataacgaaatgaaggcagaaataaagatgttctttgaaaccaatgagaacaaagacacaacataccagaatctctgggacgcatttaagcagtgtgtagagtgaaatttatagcactaaatgcccacaagagaaagcaggaaagatctaaaatcgacaccctaacatcacacttaaagaactagagaagcaaaagcaaacaaattcaaaagctagcagaaggcaagaaataactaaaatcagagcagaaatgaaggaaatagagacacaaaaaacatttaaaaaaatcaatgaatccaggggctggttttttgaaaagatcaacaaaattgatagactgctagcaagactaataaagaagaaaagagagaagaatcaaatagatgcaataaaaaatgataaaggggatatcaccaccgatcccacagaaatacaaactatcatcagagaatactataaacacctctatgcaaataaactagaaaatctaggagaagtggataaattcctcgacacatacacccttccaagactaaaccaggaagaagtcaaatctctgaatagaccaaaaacaggctctgaaattgaggcaataattaatagcctaccaaccaaaaaaagtccaggaccagacggattcacagccgaattctaccagaggtacaaggaggaactggtaccattccttctgaaactattccaatcaatagaaaaagagggaatcttccctaactcattttatgaggccaacctcatcctgataacaaagcctggcagagacacacacacaaaaaagagaattttataccaatatccctgatgaacatccatgcaaatatcctcaataaaatactggcaaacagaatccagcagcacatcaaaaagcttatccaccatgatcaagttggcttcatccctgggatgcaagcctggttcaacatatgcaaatcaataaacgtaatccatcacataaacagaaccaaagacaaaaaccacatgattatcttaatagatgcagaaaaggccttcgataaaattcaacagtgtttcatgctaaaaactctcaataaactaggtattgatgggatgtatatcaaaataataagagctatttatgataaagccacagccaatgtcatactgaatggcaaaaactggaagcattccctttgaaaactggcacaagacagggatgccctctctcaccactcctattcaacatagtgttggaaattaaggccagggcaatcaggcaggagaaagaaataaagtgtattcaattaggaaaagaggaagtcaaattgtccctgttcacagatgacatgattgtatatttagaaaaccccatcatctcagcccaaaatctccttaagctgataagcaacttcagcaaagtctcaggatacaaaatcaatgtgcaaaaatcataagcattcctatacaccaataacagacaaacagagagccaaatcatgagtgaactcccattcacaattgcttcaaagaggataaaatacctaggaatccaacttacaagggctgtgaaggacctcttcaaggagaacgacagaccactgctcaacgagataaaaaaggacacaaacaaatggaagtactttccaagctcatggatgggaagaatcaatatcttcaaaatggccatactgcccaaggtaacttatagattcagtgccatccccatcaagctaccaatgactttcttcacagaactggaaaaaaatactttaaagttaatatggaaccaaaaaagagcccgtattgccaagacaatcctaatcaaaaagaacaaagctggaggtatcacgctacctgacttcaaactatactacaaggctacagtaaccaaaacagcatggtactcgtaccaaaacagagatatagaccaatggaacagaacagagccctcagagataataacacacacatacaaccatctgatctttgacaaacctgacaaaacaagcaatggggaaaggattccctatttaataaatggtgctgggaaaactggctagccatatgtagaaagctgaaactggatcccttccttacatcttatacaaaaattaattcaagatggattaaagacttaaatattagacctaaaaccataaaaaccctagaagaaaacctaggcaataccattcaggacgtaggcatagtcaaggacttcatgtctaaaacaccaaaagcaatggcaacaaaagccaaaattgacaaatgggatccaattaaactaaagagcttctgcacagcaaaagaaactaccatcagagtgaacaggcaacctacagaatgggagaaaatttttgcaatctactcatctgacaaagggctaatattcagaatctacgaagaacttaaacaaatttacaagaaaaaatcaaaccaccccaccaaaaagtgggcaaagtatatgaacagacacttctcaaaagaagacatttatgcagccaacagacacatgaaaaaatgctcatcatcaatggtcatcagagaaatgcaaatcaaaagcacaatgagataccatctcacactagttagaatggcaatcattaaaaagtcaggaaacaacaggtgctggagaggatgtggagaaatagcaacacttttacactgttggtgggagtgtaaactagttcaaccattgtggaagacagtgtggcggttcctcagggatctagtactagaaataccatttgacccagcgatcccattactgggtatataccaaaaggattataaatcatgctattataaagacacatgcacacgtatttttattgcggtactattcacaatagcaaagacttgaaaccaacacaagtgtccatcaatgatagactggataaagaaaatgtgatacatataccccatggaagactatgcagccataaaaaaggattagttcatgtcctttgtagagacatggatgaagctggaaaccatcattctgagcaaattatcacaaggacagaaaaccaaacaccacatgttctcactcataggtgggaattgaacaatgagaacacttggacacacggcggggaacatcacacaccggagccttccgtggggttggaggatggggaagggatagcattaggagaaatacctaatgtaaatgatgaattaatgggtgcagcaaaccaacatggcacatgtatagatatgtaacaaacctgcacgttgtgcacatgtaccctaaaacttaaagtataataaaaaaataaaaaataaaaataaaaaagtggtatataaaaaaaagaaaaaaattttaaggtagttagaggaaaataactcatttcttctaggggaacaataatttgaatgactgtgattttcttatcacaatgaaggccagaaaacagtggaacatctttaaagtgttgaaagaaaagaattgccaacccataaatctatgtccagcaaaaatatccttcaaaaatgaagacaacatgaaaatattctcagatgaaggatagcaaacataatttgttgccagtagacatgctgtaccagaaatgttaaaggaagctcttcagactaaaggaaaatgataccagagggaaacttgaacctcaggaatggagaagcaatagaaatgataaatatctgagtaaatagaaaatacttttttcctcttttgttctttaaaaatagctgttacactagtttcctactgctataacaaattgtataaaatgttaccacacactcaattgcttaaaacaagacaaatttattatcatacagttctagaggtcagaagactaaaatgggttgaaagggctgtgttaccactggatgctctagtggagaatctatttccttgcattgtccagcttctacaggcggcctgaattccactgtttcactgcctgattctattgtcacatctttttctgactcatctgcttccttccttcctttacaaggacgctgtgattacactgggcccacccagatagaactggataatcttcctatctcaatattcttaacataatcacatctgcaaagtcccttttgctatatgaggtaacatattcacaggttccaatatgtagacatctttgaggagccattattcttcccacaacaacaattgtcaaggattcaataattcttatacaatttaaagtgttctagagc

SEQ ID NO: 280 - DNA, 18034 bp, Homo sapiens
gcaatgtaaggtattatttgcttctatatttggattagttttattttgttcaaaaatagcaaacatttaaaacaaaaaattgtcagtagtttcttttaaaagcttatccattaaaggtttctcattagcatctcctgtttatgattgtatttccttttctctgaaattttattgccatacaatagatatcagtaatttaaaatgcctgccttccgggaatgcacagttacagtcaaacattgcagttatctagacaaattatttgttaatgtacattgatgttgccaactagattttatgagtaaacatttattattgtcttgtagttctatattgtggttttttactataaatttcttaatatcagtttattgtgtttttggttttacttatgtattataattttagataattggcaattctgtttgtatactttaagttaatgtggggtttaattaaaagataaatgggccatatgtctatcacaatcagatatgtgtgtgtttatatctgcaaatgtgaccccaatttttgttgtagcttaccttgtatatattctttcttagctcattctctttttctctttttttttttttgtttatgtttttgagacggggttttgctcttgttgctgaggctggagtgtaatgcagtatctcggctcactgcaacctctgcctccagggttcaagcaattctcctgcctcagcctcccaagtagctgggattacaggcatgtgccaccaggcctggcaaattttgtatttttctttattagagacggggtttctccatgttggttaggctggtctcggattcctgacctcaggtgatctgcccacctcagcatctcaaagtgctgggattgcaggcattagccactgggcccgacctcttagctcattttcaatgttggttttatcttgtctaagtgagtagccttggaaatagtctcattttcgtcatgtgtttaatgatgaatatgtatttcctttgtgtgagacaaacactttgtgatttggaggtaatttttaaaaagatttataatttggtatttttttcagttttttaaaaagtaactgtaaaaacatgtaacatgtaatttagtttcttaaatctatttaaatatacatgtcacagccaggcatagtggtggctcacatctgtaaaaccaggattttgagaggccaggacagaaggattgcttgagcccaaaagattgagaccagcctgggcaaaatgtggagacaccctctctacaaacattttttttctaagaaatagccaggcagggttgtgtgtacctgtggtctcagctacttgagagaatgaggggcagggttacttgagcctgggactgtgaggctgcagtgagccataattgtgccacgcactcaagcttgggtgacagattgagaccctgtctcaaaaaaaaaaaaaaaaagttgtgtatttcaggtatgttaactatattcacattgttatgcaaaagacttctagaaattttatatcttgtaaaactaagactcaatatccattaaataacatttactcattttatgctctctccatcccttaacaaacacccttccactttctgtttttatgagtgtgactattttatatatcttacgtaagtgaaatcataatatctatgattttactactggctgatttcagttgacataatattttcaaagtgtatctttaaatgtgtcaagatttttaagattttttttaaggctgaataatattccattgtatcaaatatgtcttgaaggtcctatattgcatattttagatatagattaataaatggaattgctgtatttgataataattttatttttaattataagaagtacatttataacataaaataatggatgcctgcttgttttctactgacaatcaacacgggtttcttttttttttgagacagagtctcactctgttgcccaggctggagtgcagtggcatgatctcagctcactgcaacctctgcctcccaggttcaagcgattctcctgcctcagcctcctgagtagctgggattacaggcacgtgccaccacacccggctaatttttgtatttttagtagagatggggtttcaccatgttagtcaatctggtctggaactcctgaccttgtgatctgctcacctcggcctcccaacatgctgggattacaggcgtgagccaccgtgccagccagtccaacatgatgaaaccccatctctactaaaaatataaaaattggccaggcattgtggcaggcgcctgtaatcccagcttcttgggaagatgaggcaggagaattggttgaacctggaaggcggaggttgcagcaagctgagaccatgccactgcattccagcctgggcaacagagcaagactccatttcaaaataaaaaaaaaaaaaagaagttatcttctatgtctaattaaaagatttttcacttatggtttcaggaaataatcgaacttaattttatcagtattgatattcagtatggataattcagtatggatattcagttttaaaattatcttttttctattgtgtgctcatgtcaattttgtgggagattatttggccatattcagaagggttatttctgggctctctgttctttcatctgtttatctgtctttttgtcagtaccacattgtgtttgttattgctgcttttaatatgtttcaaaatcagaaattataatgcacctttgttctttttcatgggtgtttggctagaggtcataataaaattttaacattttaaacaatatttctttaaaaaactgctgttgggatttttatgaagattatattgaatttgtctaccactgtaagttgtattgacatctttgaaaaactattattttttgattcctgagcaaacatatgttgaagagtgtgttttattttcttatatttttggattttttttagttttaatttatagcttaattcagttttggtcagaaaacacagtgtataattttggtcttcttaaatatatttgttgttgttgttgtgtttgttgtttttgtttggagacaggatcttactctgtcaaccaggctggagtgtactgccatgattttgcctcactgcagcctcaacctaccaggttcaagtgatctttcctcctcagtgtctcatgtagttgggactacaaacataaagtaccatgtctgaataattctttgattatttgtagggatagagtctcactatgttgcccaggctggcctcaaacttttaactccaagtgatcctcctaccttgatctctaagtgttgggattataggcgtgagctacaccacccagctggcattcttaaatttaataaaacttagtatgtgtcctaacagaatacaccagatgcaaataagaatattgtatattctcttgcttttgactggaaagttttgtactcatgtgttaaacctagttggtctgtaacatggttttgatgttcatgttctccaaaccttattctgcagtgtaatccttaatgttggatgtgagacctggtgggaggtgtttgggtcatgggagcaaagtcttcataaatagctggtaatcaaaatgtttacactccattaattcaaatgtaagcaggtttattagaagaacctggctccttcacctcatacttgctctgtctgttattatgtgacatgtacagttactcttcgccttcaaccatgattgtaagcttgctgagacactcaccagaagcagatgctggcacacactttttgtacagtctgctggattgtgagccatataatctttatttctttataaattatccactcaggtactcctctatatgcaaaatgattaatacggtctgcaatgtcgtctaggctttgttttcttgttgattttttaatctgaattttctatttattattaaaaatggggtattgatgtctacaattatattctatgtatttcttgctttacttttgtcaatatttgctttatatattttggagaccttatgttatatatacatatacatacagataggtagatggatataatcattatagatttgtggtaaatcaacctattttatgagtatgtaatatcagtgtttgtctcatgttagcacttgacttaaaacatatctaatacacaattgtagttactattttcataaaatgtagttgttttttttttcgctctgtggttttcagcctatttgacttagtgctgaaatgattcccttgtaggcaacatactgtttgcttttttcttaagctagtaaagcattttattttttctttttataatttcatttatttacttgtttattcatttatttttgagatagggtctcactctgtcaaccaggctagtttgcagtgttgtgatcatggctcactgcagcctcaacttacaaactcagaagattctctcatttcagcctcttaggtagctgggttacaagtgtgtagcatcacgcctagccagttttttgtgtatttttggttgagacagagttttgccacactgtcaaggctgttctcaatcttctgagatccagtgatcagcccgccttaacctcccaaagtcctgagattacatttctttttattaagtaatttaatttatatttaaaactgcttcttaaaaatgaagttattggttttattgtaactgttttatgtgttcctgagtggtatgttttttcttattcactgttttattgccttaaattttattttaattgtgtagtgatgtgcttcaattatttttctaattttgttttgcacagtttctttaattattatctttataatcatgttgtctattcatgtgttttcatgctgctgataaaaacgtaccttaccctgggcaaattacagaagaaagaagtttattggacttacagtttcatgtgattgaagagacctcacaatcatggtggaaggtgaaaggcatgtctcacatggtggcagacagagagcttgtgcagaaaaactctgccttataaagccatcagatttcatgagacttattcactatcatgagactagtacagaagagacctgcccccatgattcaattaccttccaccacatccctcccacaacatgtgggaattaaagatgagacttgggttgggacacagccaaaccatattattttaaaaaatggagtttacattaaatatcttaaaattcaaacaatatactttaatgacaacttcaattgaatataaaattatacctctatgtttttcagtttgttattaacattaaaaatttttagactgggtgcagtggctcacgcctgtaatcccaacactttgggaggccgaggtgggcggataacctgaggtcaggagtttgaaaccagcctgaccaacatggagaaaccctgtctctactaaataatacaaaattagccaggcatggtggtgcatgcctgtaatcccagctactcgggaggctgaggcaggagaattgcctgaacccgggagggagaggttgcagtgagccaagattgtgccattgcactccagcctgggcaacaagtgcgatactccatctcaaaataaaataaataaatataaattattttgtgtatttattaacatatttatgcagattgtattctgttttaaatattttacagaggagctttaagggttttatgcatcattattatgatagtaaagacttctatatttgtatatttacatttaatatagacttttattttatatgtggttttgttagagaaaataggaggcaggagacacccagtaggtgaaactggaggattttattaaggtgcaccctggcacaatggattcgcatccaaaaagctgagccttggactaagacagggcttgtcttttatacatgcatgggccatctagtggcgcaaagctcgtggtgcaagtaagcaggctcacagaagcagaacagaggcagttaatcaaacagtgacaggttatgctgaccttgcagcttcactggaagggaaacatgaatttatcaaactaaagcaggccttgcagctggtacatgtcttactcaagctcgtcttgtaaccttgtcatgttatccagaacagagaaactggagttgttgtgaagtaaccttgagtttcactaaggaaggattactaaggggaggaggaagctaggagaggaggaaaaattgtttttcccatcattgctctatgggaggagaggggataaggactagttttctttacatcctctacttcatttccccctttgacgctttttataaatgacgtttaatagcatcactatgacttaatttttcatgaaaaggcaagttttcttcatttggcaaaggctgatatttagttagggtcattagttgtgtagtagtttgcctggttacaagagcctctgtggccatttagatgtttttgacaaggaggggtaagagacaagggagtatgaggcagactcctaatatggctagaactattcttactaaggttttaaattctgcaagggatgagaactaacccctgaagagggaatctggagaccatcctttctaagtcttgactggaatatgggctaatttttggattcttgcagctttttgtttgacgacctttccgttgtcatcgatttttagacagcaattagttaggctgaactttctacatactcctccctcttgggctaggaggtagtctaaagccagtctattttgataaacggcatttctcatttctgtagatttccgagccagcaaatttaaggctcttgcagtatcattcgtaatgatctccagtactgcctgcaaccatatgatgtgatttagcatgtaaataggggtgcggtatctccatgatccatctgcccatgtggctgggccatagtattgcattattctttcaggtggccattcattatctttaattctttatggttattccccttttatttcttttgacctgacatgaacctccaactaggttctaggtaaggactttgggtcataacatatataaggctggccacttcctgggttgcagattgagtaggttatctggttgtgcgtacaagttcctcaatgggtccctgcatacctataataagtggtagaacagggttctagtcatggtgcttcctgtctacgtattgtcagtgcagtgggggcatccttctaaggattctccctttaacgtggttaaagggaatagcaaaagtaatgaataacatgtttatacctagcatggagagaagaggtcctttcctagaggaggaggttgagcaaagcaacaggacaatagtaaaacaattaatattacaaggaaagtttccagacgtaagatttctaaccacttttactttcctgatgatgcctcgagctttggccgtacatagacgagtcagcttctggggtgactagaacagggctgttgtttcctcaagcttccaccgtgtgtagactggtcagcttctgaagtgaccagagcagggctgttgtagtcttcattggcacctcggtcccatcataggatcagctgggttggatggcctgggtccttctggctggtccacttgtcctgggctaccagtttcagccaactgtggtgaatccaaggcacgattcctgcaactttagcagcagtgagtagacaagattacaatatggggcccatcccatatgggtcccagtgttgttggattccattttttaaactaaacagagtccccgggtctaaagggataaattgggtctgtgaggcttatgggcattctttcccatacccagccatgaattttttgcatggctattcttaaagcctgcatctctctccttaaggctaattcctctagttcacagagatcacctttaaattggccgaacaagatctcataggtgaatacccagtttgtttggtgggggtgtacctcacttggaggaggaccatgggcaggacctgatcccaccttagatgagtttcttggcaaaatttttttagtagctgtttgagtgtctggttcatgtgttccactttttctgagctctgtggccagtaggctatgtgtaacttccactttattttcaataactgtgttagttcttgaactatcttggctatgaatgctggtccattgtctgacgctagagtcaggggcagtcgaaatccagggataatgtctcttaacagtactttagttacttctcgtgctttctcagtcctgatggggaaagccttgacccatcctgaaaaggtgcagacaagtactaacatgtttcaatatccccctgcttggggcaacccataagcagattttcacaaggtgtggcccctatttcctgcattcccagggtcctggtgggcccctgtattaggttgttctgggcacaagttaggcattgttcacaaatggctcatgtgatggcagtgagccgtggcacatagaagtggtgtcctaatagcgtctctagtgccgtttttcccatgtgagttccttggtggaattgcctcacaaatttggaggccaccatttcagggatggctagtctcacattagataatttccaccatcctccttcaatatgttctccagattcttgggcaaaccaggccctgtcacttagagagtaactccgggtctcctggaggggagattgcgggaggagaggcatggtcagggcttcttttctagagtgtggagcagtcaatgctgtctgtcttgcttctctgtctgcttttccatttcccttggcctcctgtgtccctgacttctggtgtcctttatagtgcataacagctaccttctctggggctcatacagcatctaagagctgtataatttcttctttgtatttatttctttgcccctggcagttaaaactcctccttatatatagcaatgtggcaaaagcatatttggaatcagtataaatattgatctttttgtcctttgctagcaaaagggctcttgttagagctatcagctctgctttttgggctgaagtttctgtgggcagagactgagcttccaccaccaagtgcaatgttactactgcatacccggcccattggactccttccagtacaaaactgcttctatctgtaaagtactcgatatctgggtccctgaggggttggtctgtaagatctctccagcttgagaatacctcatcaactgtgtctatacagcaatgaagagggcctcctggttctgattgaattgggagcaaaatagctgggtttagagtgttcacagtctctagagttacgtgaggatttttacatagaagcccttgataccaactcattattggatttgataaccaatggtgccctctctgatcgactaatgttataactcagtgcgatactcaggtggttagttgctgtcctagagttagtttgtcagcttcccatgccagtagggctgtggcagctaatgctttgaagcatgggggccatcccagcgccatggagtccaactgcctggataagtatgccaccaggcgatgccatgatcccgtgacctgagttaggactcctatagccattccctttcactcatgggcctatagaaagaaaggcttagttagacctggcagtcctaaggctggagccctagttaaggcttctttgatttgtttaaatgccttttcctggtctgcctcccagaggagggacttcttccctgcctcccccacttctaatgtgaccatgggctcctgggggcctagggagaaggaacccggttggtcctagtcctcatattcttaattctctgccagcccgatcaggtcggcatctggctccctcagggtgtggcagcccttggctgggggcctctttgtttcatagcctttgccattctcttcattgtcctctggacattcatttttctagtgtcccttctttttgcactgcacacattgacctccccttagcctcagccatctcttggctcgctgttcaacttggcctcttccatgcccacacccatgtgaacattcgcgtccctttacaatgttaattttcctttttgtgagggctgccgctaacaggttggcctttttcctaagcctctgctctgtttccttttttgcctcttggtcacagttaatgtacacctcggtggccacttctataagctgggtggcattcatgcctgcaaaaccctctagcttttgcagcttctctctgatgtcaccctgggcttgccttacaaatgctgcattcaccatgcactgattttcagcagcctcagggtcaaatggagtgtaaaactaaaatgcctcacagagtctctcataaaactggctagggctcccatcaattcgctggagtacttcagagaccttccttatattgattgccttttttccaccttccctcaatcattgcagctgtgcttcttagtacctttgcaggcgctgaagctgggttgcgtcatttgggtcccagttgggatctgtttctgggaattggccctgagcatatgcctggacattaagggtgccttcaggcacactggcttctagccagcagagagctgcctgggctatcctttgacactccttcgtgttaaacagcgttaggaggagattcctgcaatctggccaggttggattgtgcattaggaagatagactgcattagatctatgaggtcctgggggttctccgtgtaggagggggtatgatgtttccagtttaggagattagtggtagaaaaaggctggtaaataaaagtctgttgccccccttggacctggccctgttcatcataataaataggtccctgtgttttctggaggggcatctgcaaagctctggtgtgggcaaattgaaggtggcctgcttgatcatcttgacttccttcttcacctcctgggacaggggctcagatttgcccctttagggtgtagcctggggcatgataccatctgagttgggctgctcagtggccagccttggtaaaggtgggtagattggtgcatagggagggggggtttctatctcctccggtggttcctccaaaactggtttctcctgtctttcctgtggctttccctttgtctctgtagcttccagcaaagctgatttttttttggtggcttaggctcagcttgagcaaaaagctgccaggcaagtctgcaaccatgcaggtcgagtctgtactatatttaaccatgagtcaatacaagggaactggtctaggtgccctgactgtcctctgaccccagttaccaccttaaatacatagccaattgtttccttatctacatttccttcagctggccatctaacatcaaaagagggccattgtatttcacagagagttctcagcctctgggggtcaacttaattccatagtccccgaataacctttcttaaagttccttaacatacatgctaatcgggtgggttttggtgacttccctcccatttcctccccaatacagcacaacacattcattcttccttttgattcagaccaattaaaccatcccccttgcaggagttttcagacactgcttagctttggagtttgttaatcccctcacaattactaaattgtggggcacctccataagccgtatgtggattgccactagtcctggttggtcccacaattctctcagagcgcacagtctatactaagagacctgtagcccccacatgtcactgtctgcattggttcctcccaaaaccatctctttcacacacagtcacacaccgtcctactcccagttttctctcctaactgacttcgcgagccactcttatgccctagtcacttggggtgtaagtttccctgagtttgcaaaccattcttgcatcctgtgtcagtctactagttacaccttggaaggtgatcaggctccccttccatccttatgggacggttcctgccttgggccccaaaaccttaccgtggtcctgtagtgcactgttcctggaatcatcctgtagccccttagattctgttgtgctgtctgggaggggcattgggttgtgggatagctgatcccttcttcaggtttaagttctcctgagggcacctgaggtcatgggtctctcctggcttggggtctcacacctaaaggcaaagtagacagcaaacctgtcatctccatctcctggctggctcaccaaagtgttgcagaaaacaggaggcaggagaggccagtgggtgaaactagaggattttattaaggtgcacactggctcagtggattcacacacaaaaagctgagccctggacaagtacagggcttgtcttttatatgtgcatggtggccatctagtggcacaaggctcctggtgcaagcaagcaggctcacagaagcagaacaaaggcagttaattaaacagtgacaggttatgctgaccttgcagctgcattgggaggaaaacaggaagttaacaaactaaagctgaccttgcagctgcattgggaggaaaacaggaagttaacaaactaaagcaggccttgcagctggtatacgtcttactcaagctcgtcttgtgaccttgtcatgttgcccagaacagagaaactggagttgttgtgaagtaaccttgagtttcactaaggaaaaattactaaagagacagggaagctgggagaggaggaaaacttgtttttcacatccttgctctttgggagaagaggggctaaggactagttttctctacatcctctacttcagttttatgatggtgttcattattattttatttttaagcaaaattgactcattatagcatttctttttttttttttttttttgcagagtctcagaatgctcttaaactcttagtctctagtgttctgacagccttgacctcctaaaactaagattacaggcatgagccatggtgcctggtcaccatgtacctttttttgtagaactgtgctagtggtgatgaacatcttcaccttttattttggaaattctttattttcatcttctttttaaagggaagtaaatttaaatcaagtattattggttagaaatttttttttattacatcaaaatttgggaagttttcacccttttttatcttcaaataacctctgtattttttttcttcattttcttcttctaagatttcctaaatctagttgatggttatctaataagttgtttgttttgttttgtttttgtttttgtttttgttttttttgagatggagtctcgctctgtttcccaggctggagtgcagtggcacaatctcagctcatggcaaactctgtctcctgggttcatgccattctcttgcctcagcatcctgagtagctgggagtacaggtgcccgccaccacgcccagctatttttttatatttttgtagagactgggtttcaccatgttagccaggatgggcttgatctcctgacctcatgatctgcctgccttggcctcccaaggtatctaataagttttacattccatgttttaactttgttttgcaattatagatttttgtgttatatattttagggtatgccaccacacattcattaattgtgttttgattttttagtatttattataattatgcatgctaatttttaacatcttataatttaaggcagtgtggaagaaagtcaaatatgaatgagctatacgtctttttccaatagaattatctctgtgtttgttttcctgtatacaaaaataaatgttatccttgtattttttttctaacttgtatatttgttgtgtaggtttgttgtgaatggttttctaattctgcgtagatgagtcatcataaaattctctttttttttgagatggactcttgctcttcttgcccaggctggagtgtaatggcgcgatctcagctcactgcaacttctgcctcctgggttgaaatgattctagtgcctcagcctcctatgtagctgagattacaggcatgtgccaacatgcctggctaatatttttgtatttttagtagagacagggtttctccatgttggtcaggctggtcttgaactcccaacctcaggtgatctgcccgcctcagcttcccaatgtactgagattacaggtgtgagccaccatgctcagcccataaaatttttataatttcaacaacctatttatttgtaaatctatatgatttctgtgtgggagaaacacttttggatttgaatataatttaaaactatcataactctgtatctcttttagttattattgtttatttcttgtcaaaaaaaaacaaaatttaccacaaaatatttttaaatatttagtcatatcaattatcttgacattgtcatgcaacatattgctagaatgtttttatcttgcaaagctaaatcttaacacatattaaacaacaagtactaatttttaattttttctttttttcttttttctttttttttttgagctggagtcttactctgctactcaggctggagtgctgtggcatgattcacctcactgcaacttccacctcccgggttcaagcaattctcacgcctcagcctcctgaatagctggaattacaggtgcccatcaccatgcctggctaatttttgcatttttagtaaagatgcagtttcaccatgttggccagcgtggtttcaaactcctgaccttaggtaatctatctgcctcagcctttcaaagtgctgggattacaggtatgggccaccatgcctggccacaattttttctgttttatagcgttttgcaaacaccactctgttttttgtttttaacagtataactacttcatgtatgtcataaaatctgtgtctttttgtgattggctcatttcattttgcataatgccatcaagatttatatttatagttggtagaatatttcctgcttttgaatactgagtatattccagaatatatatatatattttttgagacagtcttgccctgtcacctaggctggagtgcagtggggcgatcttggctcactgcaacctctgcctcctgggttcaagcaattcttttgcctcagcctcccgagtagctgggattacaggcacgtgccaacacgtttggctaatttttgtattttttttttcagtaaggacagggttcaccattgttggtctggttgatctcgaactccttaccttgtgatctgcctgccttggcctcccaaagtgctgggattacaggtgtgaaccaccgtgcctgggaagaatttttatatttcaaattatatctactgaatgatttattgaaagatatttgcattgcttttacctatttgcttacagtaacaatgctgcagcttttccgcgctacctgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacactacatctataaaaggaaaagtgatggcatctatatcataaatctcaagaggacctgggagaagcttctgctggcagctcgtgctattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttctgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctccctctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaaaaaaaaaaaaaaaaaatgctgcaataattatgagtctataaatgactacttatatgaccatatatgtgaaagtttatatatgtgctgcattctattttattagtctactttttcacctttatactcatatcaaattgtttaatttggtagctttgtaatgtgttttgaatcaggcactttaatgcctgcagcattctttctttctttttttttttttaatattgttgggtagtttgtttttcttttgagtctctgtatacttttgaggttggtgtttctatttcttcaaaaatgcaatgagaaatttgaaaaatattgcattaaatctgtagattgcattgagcaggatggactctgcaatattaagtatttcaacctttgtgtaagagcacactcaagagtgtgttgtttagtttctatatatttgtaaatttttcagttttttttttttgcttttatcgttgtatattctcattccattttggtcatagaatgtagttcatagaaatttacttttaaaaaatttgataagacttcctttttgtcctaagatgtggtctttcaagggaaatgttgtatgagctattgagaagggtgtgtattctgatgttgttgaggagtgttctccataactctgtttggaataattgttttatactgcctttaagtagtctgttcttttattaacattctttcttgttttagttttattacaaaaagtgtggtattaaaatatattgttctaattatattgctttctgtgtgtttcttccattctgtcaatatttgctttatatacttggaaccctaatgtgagacacacacacacacacacacacacacacacacaaatttgtcatagattccctgtgaatgaatctattattttttgatgtccttctttgtttctttggagtttcaatttcaagcacattttataaaatattatactttctgacttaagatgtagcttgtgtgatattattttgactctttctgctcttatttgattaatgtttgcatggaatgtctacttccatcctgccacttacagtcttttttaattattagacttactgttattttattatgcattttatttgattattgcatctttgtgtcttattctctttccatctttgtgtctttttgatgtttgcattgatatgctttcgcttatttatttatttatttgtttgagactgagttttactcttgttgtccatgctggagtgcaatggcattgatcttggctcaccgcaatctccgcctcctgggttcaagcaatttacctgcctcaacctcctgagtagctgagattacaggcaggtgccaccatgcctggctaattttgtatttttagtagatatgaggtttctccatgttggtcaggctagtcttgaactcctgacttcaggtgatccacccgcctcggcctcccaaagtgctggaattacaggcataagccaccatgcccaacctcttttgtgtatttatacaaatatttttgtggtaccttggggactacatataatgtctaaaagatacaacaatacattttaatctggtagaaaaacaggttgcatacaaaaattcttctttattacatcttccctcaaatttgtcattgatgttgctaattatatcttatgttgtatgttcattaactgatgtttataatgatttctattcttttattgttcaaatttcagagaataat

SEQ ID NO: 281 - DNA, 19704 bp, Homo sapiens
tttcagccacacttttggaacatcctgcgtagatagagatcatttttggttttcagttccctttggtctctgaggatcacgctccaaggcgtcagggacaggaaagaggctcgcttattctcaggcatattttgaggctccactttcctgcctctctgggcagccacgtgcagcccttagcttaccagggtggactctctggactctcatttctcacacttgttttggcggtgatgccactatatttactgctaactatagtaccactataaataataacataaatattataatgataaatagtgttggagcaatgccttttttttttttttttttgagacagagtctccctctgtcacccaggctggagtgcagtggcgcgatctcggctcactgcaagctccgcctcccgggttcacgtcattctcctgcctcagcctcctgagtagctgggactacaggcgcccgccaccacacccggctaattttttgtatttttagtagagatggggtttcaccatgttagccaggatggtctcgatctcctgaccttgtgatctgcccgcctcggcctcccaaagtgctgggattacaggtgggagccaccgtgcccggccagagcaatgcctttttattgaactcctgtcggagacaccaaagagcttttgtcaccttttcctgggaaacacaaggggaattacctgtcatggctatgcccaactgactggattaaactttcagaaagcagccaagtgcggtggctcacacctgtaatcctagcatttgggatgccgagacaggtggatcacttgaggtctggagttcaagaccaggctggccaacatggtgaaaccccgtctctactaaaaacacaaaattagctgggtgtggtggcgcacgcctgtagtcccagctactcaggaggctgaggcaggagaattgcttgaacccgggaggtgggggttgcagtgagtggagatggcgccactgggtgggttccagcccgggtgacagagccagaccctgtctcaaaaactttcacaaagcaaagtgctcagggctggaattccttggcggctcaggtttacggagtggggccaccgtagattttccactctgccttgctcaggttatgcagcctgggaagtgtgagggaagactgaccaaatgtgttgctgactaagaaggcactcggctattctgagtccccaacccaggaagcctatttggtgggcaccaccaatgccatgctcctggcctggggcagccttggcactgcaaggctgaggtccagtctaaaacctcgggcgatgacaaacaccatggccctgacaggggtcccagctggctggtgtgcaatactgcagacatgcaagcagctgtcatgacagggtgaggctggtccggcaggcccagtctagcatacacatagtggggctgggagacacctggtgctacacagacttaatgcagagataaagctccaggttgggaggaaaagtgaaggcaaaaaaccaaacaaatgcatgtaagaattacaatctaaaacacacaaacacacacacacacgcgcgctgggaaacctcactctaaaacacacacacacacacacacacacacacacacacgcgttgggaaacctcgcaggttccaaagttcctaagcaaagcagaaccaagctgatggtggactggtcaggcaaaccaagaacctatcaacatgaaactcagagaagcagagagaacaggaagacggctgctcagaagggcaggggctggcgtccctgcacctccatctcacaacagcaagaggccacctccagtccttcatgttacatttctaaaccttttgtgttctttaaatttcctttgagacatataaatcaagagatgaggtccccgaaaactagaaattatgtgtgtgtattttcaatcagttttagaagaaatgtggttttcttctagatttccagtcatctgtctgttctagtgcaataaagcaggctgggccggcctgttcagggtcccagggcagaagaaagaaggggagtggccacctggggacccttcctctctggtccaagggttgttttgagtctttttaatgatttctttggaaatcacaaagtccagctatgtgaggaagggaaatcttcattctttatactctgtggctgaaaaaaggaactttcagagcctttaggtagttcactgagagccactgaaagagcctggagcgtgacacacagagcacagggcaggggtaggagtcggcccctctggacaggaggtggcattcccaatgctccgagggctgcttggagctttgctctgcccatgggagaaatgagacgggtgctatggcacagaaatggggcttcggggtggccttttggggatgcaggcacagaggggcaagggcaaccaggttttacatatgaggctccagatctcaaaagggtgattttccctccaattaacgaatattactaagtgctctaagaatgacacaagagcagaaacagaaaagaaacctaattctggcattgccgtcgtcctcacgggcgtggcgagaacagggcctaaagtccacaagagactccctgcagtggggaacgtccccttcaagcagcagcccccacgtggtgggcagaacccgagaagtcttgaatttacgcagcataatggtctgggaaaggggaagtgatgagctgatgagcccaccttcaaagggttatgagtgtcagtggtggggcactgtgtgattcacaaggcatcctgagtttcctttttcttttttttttttttttttttttgagacggagtctcgctctgtcgcccaggctggagtgcagtggcgggatctcggctcactgcaagctccgcctcccgggttcacgccattctcctgcctcagcctcccaagtagccgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcctcctgagtttcctttttctatttatttcatttccccctggaacttgctggaattctaaatccaaaaagctagtagctgcagtccgggaacccagaggagaaagcagctcactacctcttctcactcgagcaagggcgggtaaagaaagcaggagatgcgggctgggcgcggtggctcaggcctgtaatcccagcactttgggaggctgaggcgggcggatcacctgaagtcaggagttggagaccagcctggccaacatggtgaaaccccgtctctactaaaaacacaaaaattagctgggtggggtggtgggtacccgtaatcccagctactcgggaggctgaggcaggagaatcgcttgaacccgggaggcggagcttgcagtgagccaaaatcgcgccactgcattccagcctgggcgacagagcgagactccatctcaaaaaaaacaaacaaacaacaacaacaacaacaaaaaacccaaaaaacaaagaaagcaggagatgcgatggtgtgttaccggcatcttgaactgggagggaagtgtggatacaatcctaaagaaacgcgttctgacggccccttccaggagattctgaatgtaaacaatttttttttttttttttaagagacagggttttgctttgttgcccagactggagtgcagtgctgcgatcacagctcactgcagcctcaaactcctgggctcatgtgatcctcccaccttagcctccctagtagatggaactacaggcacgtgccactatgcccagctaatttttaaaatttctttatagagacggggtttcaccatcttgcccaggctagtttcaaactcctgggctcaaatgatacacctgccttggcctcccaaattgctgggataacaggtgtgaattttttcacacagtgaaattcacttagaatagacataaacactcccgaggtggtgttaggagaaggcaagaggcattagatgggaaaagcgtctgttaattggaatgtaagcaccggcccttctgcagcaccagtggtcgttgagtgtggaggtctctgaacacaccagaagccctgggacactgagggagtctccaagggcgtgggtccgtgggagcgtgggactggagaacacaggaagcacagacagcaacagtctctcttcccagggaggtgagagccccgccttggacgtggcactgtctgataggtggaatcacagaactatgacattggtttttaaatgaatgggccaagaagtgaccctcttaaaggaatggggtcagggtaaaacacgagacaattatctttgccattcttctgtttgaagaccacctctaggcatggagcctccacggggagatgaagggggtagactgccagatcaaggacacacggacagggaggaggagccacagtccccaggattcccctcaacagaatgacagctgcccaggagaaaagctgcctgaagcttagaaatgagacatgggggtcagccattcctctgaactaacacaaatggcaagatgccaaacatactgcaacctctaagctagtggttctcctgctctagagggcatcagaacccactggaaggtctgttacagcagataaccaggcctcaccccagagtttctgattctgcaggtctggggcagggcctgaggctgtgccttcctaacaggctcctaggtgatgttgctgctggtccagggaccacactttgagaaccacggcctggagcttttcctgtcttcactgaaaagaagtacaaagtgagccccaggacagagcaaggagggagggacgttgttatgggcacccgtcaacctggctttgagtttggtgactccgggcagaaatcactacagagaagcctttccctcgcactcagctcttctgggagaaacgagaccacgacccagtgaaaatggtcgggctgagatcttggcatgtttgcttctttgcgtaagtgtggcaggcagtgagctccctagcagatatgattcctacaagcagtgagggatgagattcagggcaaaagctgtgttggagtgtgtgtatttaggggaccaggacgcagatgcaaggctggtggagtcgggtgggcaaagttttattataaaaaattaaaaacgaccccaggcagcaaaagcaagctcagatcttcctctggagcacatgtgggcagcggggagatcagcacgctgctctgttttgagctggaaaagggtctgtgcttttgccatttggttattgggttgatttctccttgtttttgtgagcagggactgggaagcgtgggtggagaaagggcgtcagcggggttagtgtcagcacaggcgctgccatacataccacccagatgcaagtcgatgaggtcactgtaataagactctccccaatagtctacaacaaggaatcggtgaagagagagttattccatcaggtagtcctcctgtccccccatacccaatcaatgatatgatatggagcaatcaatgatatggagcgcaagaaacacagacacagcgaggcggcagaggaacggctggaaggcatgcgtgcctaagtgcatcacatactgcatgtccacacatgccgtatctgcatactgcgtggctgcgggaggagggcggtaactaaaactcactgtggggagtcaatggtcactatcaacatgatcccacgtacaccagggatcagccaggacagaggctttggctttgctgggaactcctgcccctgggactgaaccttctctaactaagagttaatagagcggggctgcctgcgtgtcagttgctgatactggaagccccaggctgagggcctggaggcaggaggcaaacgtcctacagaagctctgaaatccttaggtttcgtgcagtcagtgctctcccaggaattcccacgaccccactgctgactctatcaaatgccttgcagacccacttttgccgaatgggtttgagagaaaggggatcctgtttcgaggcttaggcctccaaattcagtcggccttcttaacaacaggaaacgagcagagactcatgcagagttcttcccccaggcactcggccgaaggctcctggaggtgtgctggcctggggcactcctagcctggtagttccacagctgtctggccaagagcgctatgtaatttccacgcctgagatgcagactgggcactgccgagaggctgggcttgagcaggcggtcctcatctccccagaatcataaagacacacagagcacagcactcggccgccatggtgttgccctctctccaaaccccgcattctgaatgcagatcctcacagcctccggtcccacctgagggcctccccttgagagtgacacagcagacacagtggtagaatgcggtcctgccccagtttttcaatgcatgctcaaggctgagtcagtgtttttgtaacaaaaaggcttcccaggtgccccaggactggaaattacctaagttgtggcctggccctaggatcaaaggtgctgaagctaatccttgcagcctggccatacgtcgtcataccttagacaaacggagaacgggatggcaggtccatgctagagcgcttctctggaaaggcagcttggctaacaaagtctgacgccctcagacggtgatggaagctggagacccccaagtgagatgatggcaggttccagccagtttactacagtccccagggaagggcagactgccatgatgagaagactccagattattatcatgcccagctgccactgccttcttcagggctcagccaggtgccacaagactaagaagaggaacgggacgcagaagcaggagagaaagcagcagcagcacgcacacctgggcttcagagacggcatcggccaaggaggggcagggccacggggaactgtgatgggagaccagcttggaagggatgtattcacgtaagagaaggaacatatttggaaattcttatattcttatggtaggaaccataattcctgaaaattccagagagtttctcaaatgcatcacaacgaaatatcccaacagagctactaaggcccatcttgaaaaacagaacagaaacatctttggatagagatatctgctgaagactcatctaaaggaaggagtttgcactacgacagtggttttcaagcctctgtggaaccctaaggttcttccaaaggcattccaaggggtctcccaaatacctgatgtacaaatacttgtagctctttcaagagcccttattaaaataagacacaccaccttcaaatgtttttgtttttgagacagagtttcgctcttgttgcccaggttggactgcaatggcgtgatctcggctcaccgcaacctccacctcccaggttcaagcgattctcctgcctcagcctcccgagtagctgggattacaggcatgtaccaccatgccaggctaattttttgtatttttagtagagacagggtttctccatgttggtcaggctggtctcaaactcccggcctcaggtgatccgcccacctcggcctcccaaagtgttgggattacaggcgtgagccaccgcgcccggcccaaatgttttatatgccaacttttcacccactggagaccatcaacccaataatttgtgctgccaggtgagcttgattttgtggagccctcaggatcaagtttccgcctctctctgtgtgtaagtggctgaactccctgtaaatgtgttagtgaagaggacattttattcatttgtttatttaaattctggcctgcagcatagtgctcacctgccaccgttcagggtctgtccgggagagctacagctcactgacagcacgcacgcctgtcagcgagtccctttatgtaggtgggtaacacgttttgctgcggtattacagcatggctgggtttttgtttactttgtttgggagcctcttgtttgagacttgcttgtcatgaggaataggaactgctgttagatttgctgtgatccaactgtggaaaaaaaaaaaaaaaagctcttgcctcattttaaacttctagtgtctacatcatttaaactgcagaaatcctgagatttccaagtaagctgttaaaaaaaccaaaaaccaaccaaataaaaaaaaccatgttgtcacttatagcaactacagttcttgtgtgtactggctggatgccggggcttggtcatgtccaccactctctgctataacctgtgttttcaaatctgtgttaattattaacatttgagagtaattctttttgattttaaacttgaacttatcatcttgtgaaaagaggtctgctgctagttttttgaaaaccactgacttagacggcatttgggttgtgtatgtttgaggaaatgtgattatctaatgactagaagaaataattctggcaaaaccctaacgccaatcttcagtggtatattattttccggccctttggcagaagcttgaataacagggcccgtgacaggggcgtcgaagcactgttttacactcagacttcacggaggccacaggcgctcaagtgctttacggaaaccaccaaccttgatggcaccaccacctcaacctcatgagtaaggagggcagggagctgtcttcttcctgaagggcttaaaccatgaaatgcggttattctgtctgtgtgttgagatctaatccactgctttccatcttggcagaagtgatttgtggagaagggcaagaaggaatgaagatgagcctaggctctctcctgatatcttctgcaagaagagaaatggcacgagggcagggccccataggcccggacgcagtcgggcacaggtgggctggggccaactccatctgggctcaggcttaactgaggaggccaaatcagagtgcgcagagcagggcaggggggcaggggcaccgcaggttcgctgggaaacctcagaccttcttaggtgaacccaaatctccttgctgtgcttgtctcacagtaacacatcccagtcgtctcagcctatcggatgctaagtgcttcaagtttttgcatttcctttggtagcctggacttcatgcattaacagcatcaggtgagcccaaaccaagaacatccacatcctcacctttctccccatcccatctctttgactgaaggtcatcactgagtagccctataagctgcaatttccaggccttaaagggcctgggaaaggagacctacttccattctggactccctcactccccaccacacaaacttcagtcctacaggccacaggaattcatcttgacaccaggcacttcccatgagcccatgggtcagtctttgagcaagatcagatggcagcagctggccctgctcctggccgcctcctcccagttcgtccatttcacagagagcctgcctgtcagcagaggcaccctgctcccctctgccacactagagtgaggaagtaagaggatactccttttcttcatccccagctcacaatttaaacgctgaacctgcaggctataaagagacggaagttcccccatccagagactagacgaagatttgtggatgtttgagaaggcagagtggccactgcacccccggggctggtcctgcagcttcaaggtcctgaaccaataggacttcctgggccgtggggccagagatgcctcaggcactcccttgcattctctgtgcccaactatgctgagcgcagccgcgcaggttccctggatggaatggcaggaatgagcgcaccacattctccagggcttccctgccaggagcagcagtcacgagcacagggccctgccagccactccccggagtctgctccacgtcggctggtcacataccctgagcctctccagccctgccctaagtgaccagccttcagcagacacagggcctgggtgccctctggaaatctgtgtgtgccgagggtggccacatgctccccgaccagcggtgttgagggctctgtgggcaggagggtcccagggaactaacgacatgagggggtctgggggtgcaggctggggacctgctcagtgcaattctgtgatggttccttgcggttcaatctccctcactcccagttattccctcctagagtaaatggtggggtgggaaggagggggaagagccagcgctcgccatcagcatgccggggactgagtttcactctatgggaaatggcagcccagaggggctgtggagcaggatgggcctggggctgtctcagacaggtattttcttttgcttaacaggaagccccaaatctcagagatgaagggccccagaaaatcctgctggaaaaggagctgaattccaggtgaggtgaagcaaaactagcctaccacggcgggagggagggcttcctccaggagcagagcttaggagggagcccggcagtacctgcttcgccccggagcgccttctccacagccacgcccctttcctccagccgccgctgcctctcctccacctgctgcagctgccgctggatgatctatgacagacagcacagactgagcacccggctctccagccctgcttcaggaggacacacaactccacacccacacgaggggaaacacaggagttgccgctctggaaagggctctagtctgtgggcggtgcgctcagggtgtggcgtggagaccacctgcaccagaaccacctagcttgtgtagacgccaggctccgggccttgctagttagcatcaaagcgcgtggacgtgactcaagtagtgaccaccctcccaggagtgttgcagagacaggaagtggatgtaatctgtggcaggaggggcctgagtaccagaacctcagactgttctcacggcaagactgctagagtgctggagggggttcctgaagagtgcagtggaaatcccatctttacgataaaaatttaaaacagaaggccaggcacggtggctcatccgtgtaatcccaacactttgggaggctgaggtgggcggatcacaaggtcaagagatcaagaccctcctcgctagcatggtgaaaccctgtctctactaaaaatacaaaaattagctggatgtggtggcacaggcctgtaatcccagctactcgggaggctgaggcaggagaatcgcttgaaccagggaggcagaggttgcagtgagctcagcgccactgcgcgtccagcctggccacggagtgagactccgtctcaaacaaaacaaaacaaaacaaaacaatagaaatctacagtggtctagattcagggtctgtgcagcctgaaaacaagctggagaatgggaggagagctctgacctctgacctcttcccacaaaaatcccaggcctatcagaggctgaggggccacaaatggactcctggtgacagtcctcacaattgaatgaggtgacttacaatgattattctacaacaagggattcgggaaactcaatgcagggttcttcctttttttttttatttttatttttatgagatggaggctcgccctctcacccaggctggagtgcaatggtgcaatctaggctcactgaaatctccacctcctgggttcaagcgattctcgtgcctcagcctcccaaatagctgggattacaggggcccgccactatgcctggctattttttttttttttttttttttttttgagacagagtctctctgtgtcgcctaggctggggtgcagtggcacaatctcggctcactgcaagctccacttgctgggttcatgccattctcctgcctcagccacccgagtagctgggactacaggcacttgccaccacgcctggctaattttttgtatttttagtagagacgggggtttcaccgtgttagccaggatggtctcaatctcctgaccttgtgatccgcccgccttggcctcccaaagtgctgagattataggcatgagccaccgcacccagccaatttttgtttttttagtagagacggggttttgccatgttggccaggctggtctcgaactcctgacctgaagtgatccgcctgcctcagcctcccaaagtgctgggattacaggcattgagccaccacgcccagcctgctcttcccttttgactgacagctccaccaaggcagggcctctgtggctgcaccagccaaaggtgacctgggtggcagggaggcccgtctacctctgctctgctctgcactgtgcttgtgtggcagggagcagctgggtggatagggagatgctgcccaaccctcccatgcatgtgccctggtcccatcctccatggttttacctgggctcgatgcagccgcttaagctcctcctgcttggcctgtctccgagctgccttttgcacacgccgggtcagcttggcattcagttcctcctccgtgtaggttcttggctggagagaacaagagaaacttcctcagtcaggtgcacggaggcctgggacaggggtgggcagcaggccaacaggggcctggagaggtctgtcccccatgtcggagctggtacccgggcagataggacaagctgtcctctgtagagtagagtgctagcaggacgggggtgctgataggcagaaggcatgaggtctgcagagtccccagcctgcagcagccctcagtgccacgggcacacctaagatccacagagtgagacatttccccacctctgcacagggacaggaggctgagtggggaccgactgttaggcagttaaaacaataaagggacacacgctcctttatcactgagatcacctgcttcccaaataaggatgtctggtcattttaaaactttgtgggagtaaaaacattggtaggctgtttcaccaagcctcctgcttctaggaggcttacaggggaagcaaagagaaatcgggatccttttattttcctgtttggtatcaaaggtcactttcttcagaagagcagtatccatgagagtcttccaagaaatgacacccaagtagagagaacaaggatgtttctcttttaagtcaagtacagtctgaagaaggaattgtggaggtgaacctggactgactctggggtctgcagaggcagccgctggccgctaggaagaagagaggttgtggcctggccagggctgttgcgcctagcgccatcgagaacagaagaggcaatggcccaatccagtgcaagtccacggactggacagccacagccccctgcctacgtgggtgccaagggctcaagggagcatcagatgctttgaacaaaccatgggcaacaagaggggcaaagattggggatttgcctttattcataagaccctctttattgcctctaagaaaatgaaacaaggagactatataaaagttcttttttgagagagggtctcattgtcacccaggctggggggcagtgatacgatcatggctcactgcagcttcaaactcctggactcacgtgatcctcccgcctcagcctcccgagtagtcaggactataggcgtgtgccacctcgcccggacaattaaaacaatttttttttgcagagacgggatctcgttatattgcccaagctggtcttaatctcctgggcttaagtgattctcccacttcagcctcccaaaatgctgggattacaggtgtgagccaccatacctggccaacaagaaaacttttatagacttcaaagaagacaaacatgacttggggtctatactcataatcttcactcgaagagctcaaatgacagagggtcccctgaacagtcagtccctaagggtcatcagtggtgtttcagcgctgcaccttgctgatcagagctgagggctgctgaactgcccctctctggggtgcccagccccacagcggcagctgtgtcccgacccgaggaacctggaacaaaatgaccacatgcactccagccggtgaggagcaggtgtctcatcctccttcccactcatgacgtggctaacggaagtactgctgccagtgtgtgccacagccccatgcacgcacaaacacagttagtgaggatgtggctggagggccggggccggcgccgggtggttaatcacagacatgcatgcaacggtgaccagctgacaggaacgagacactacctttgatgcacatgatctcctgaatgccaaggcgtgtggtacataaattgacttttaagcggatggcatcagaaaacaaaacagaatagtaataataataatgattaacaaattaaaaattaagaacacagaaatggagcaaaataagttagaagttgaaaacaaacacacaagacttaaaacacgagattatttttcacgaagtcacacaggactgcctaggtaggaatctgggtgtgaagatcctagcggcggcgtctgagtggacctggttttgaatacggccggggttcactcttttattgggaagaaacagcttcttcctcaccacccccaaaactcgcctcatctcactgtcccttgtgtaaagttaaagccgttaaaatatgtgattctagatgcttttctccttgagtgaccatgtgcttgtggaaattcagcccacttcttcctgctgaatgctccgggggagtagaagtggggtgcgggaggaaagggggtcctgctctcagagacagacgcagcaaaactgggagggaaaccacccatctctcccaaaaggccctccgctggcagtgttcctgtgtgccacccagctgccatttcttgattgtgcccagtaaagggaattgaactaccatcagtaagtgctgttcaccaaaagcacgtcaggcagcagcaggagcctcttctcattccatcacaccttgtgcagagccgctctgagggtcaaggtgagtcacatctgctcttgtggtctcaccagccatattaaacggctgaaaggcattagggaaaccagggtgtgtggtggcgcacaagacagggaagtcctgagaattccaggcaggctgcaaccacagccgcgctccctgttgctccatccatcccatctgtggggcggccttgtgcggagctgtgcttcccaagcctacaggcgagggaagaataaatttgcctccttcaactttgagcacttgtgtcccgcctgcctcaggtggacccacctctcccacaaatcagagcaagagaatgttgttatgagaacaagccggttcagaaaaagagacagatgatttcccgaagcggctgcaaaaagcccacaggaactatggaccacaccctaaggaacagcactaacatcttcacctatggctgatgtcaatagcaatggggggcagtggctgccttcccacaatctacccattttctgggctgggaggggtgaagtcaccacccgtccctgtgtgcctgaggtggtggtcagccacaggagctgacattctgctgtgaatctggatgcggggtggcagggtacccaggccacaccctggtgggctgcagggctcaagaggcagctgcgttgcttgtatttaaagtcaaatgggagcaattagaaaagaggtaaacgcaagttctctcttgtaggtcgggctacaggtgactttttaaaagtctgaattatcctaaattttctataataaacattttaaataaaaaataagtattttgactggtttaaaagtttataacaaaacaaaacccaggctcttgtttcacagatgctgtgaggcgggaggaggcgtctgctgctggagtggccccaggatcctggcctggcagaaggggcttccttcttccgaggcaggtcaaaccccatcctcactttagagcccctgttccccacacttactttgaaagatttaaacccacaggaaagttgaaagaggaagacaatgaacacccacatgcctctcacctgtgtctgccaaaggttaccattttgccacacgcttcatctatatgtcatcttttatatgaccttttgtaatgaatcattggtagataccacgacccttcgtccctaaacgttttaggatggactttctaacaactcagacattttcctatataactttcctacataaaagtacattaacagtgcctttatcacttgcaaggaacttaacaatttgataatattacacatttatactatcatccagtcctcagttgaatttaattgttcccaaaatgtcctttatggctgtttttgtttggtttgttttcctctttagcatccatgtcttgaataggcacagcacccagccctcgctcaggctgactccataccatgcggaagtcaggtcagctgcccgtggctcggttgtctcccatgtcatctgtctcctaggttggccttcccctaggtcattcatcccctagcctggccgtcccgtaggtcatccatcccctagcttggccatcccataggtcatccatcccctagctcgactgtcccgtaggtcatccatcccctagccgggccgtcccgtaggtcatccatcccctagctcgactgtcccctaggtcatccatcccctagcttggccgtcccgtaggtcatccatcccctagctcgactgtcccctaggtcatccatcccctagcctggccgtcccgtaggtcatccatcccctagctcgaccgtctcctcgatcctcagccgtcctctaggtcggccatccgctagcctgtctgtcccccaggcttggctttggctttagtattccgtatgtgacgtctagcaaacggctttgcctctgtgggtgcccctagagcgtgaggccttagaggccgccctctggctctagggttccatgactggtgtccatggcttgttcctggggtcctgttcctgtttctcccttgctccttgtatctgctgggccctggggaggctcaccaagtaccagccttggcacagccaacccaggcagtaggtgcttcatggatggagaagcagtgggcatactacccaccacagcaacgtgagggaggtgggtggccaagctgacacaataggttgaatgtccacactgtcaccactgaggcagtgagcttgggaccacattctccattctttgctgaccccctaaagcagcacccatcaccagtattgggatgtgtttagggacccacatagaaacccaggggaattctcagctcagccccagtgcaactgggaaagctcgactggaagccttgatgaaggcacactctccctgtccctgagaaggcgcagatcccaaccctaactcagttgctggcctggctggggcaccaggaagcctggctctgtagagggtggagcaggaggagaggcctggctctctagagtcttctaggagaggggccaaagagccggaaaggccaagggagacgaatgcaccaaggaggggatgcgaaataaagcgtctggtttgctgagttatttaaagaggaactggatcaggctgcaggagccatcttcaccaaatgggcacgtgacgggctcaggcgcaccaaggcccgccctgactgggctattggacggcaggagagggcagactcaagtccaagccctagaagccttgcaatgaaggcatgctacattctcgggaagcttttgacgcaaaagggaggcaggaagcaggagacagccgggttgcccccagccaggaggaggagcacaggccccagggctggacagtggaggtggggtgacatgatactccgcagagctccgcccaccctgtatgctgacaggtgcctgttagagtgtgctctgattcctctccctccaccttcactggatccacccaaagtcctgggctctggaaagtgaggggctgagtcagacctagcagccctgcaggtcagttcctggaccagtcctttaagacgacaaaccctccctaactatcaaacccaccaaacgggcaggaccaggcacaatgctctgtgcctaaggtcccagctccgccagcagccctggactgcgcagtgttctccaggccctggggctggtgggctgctccccgcgggatcacctatgaagaaagacaatgccaggctgcctcctccagagaaggggagtgtgacacaggaatggctccagtcttttcttcttcacaagaaatcagaagcccttgctgtggatgccaacggccctagctcccatgtagaaagcccagcgtgaccgcctcagtgcatagggctgggtcagcagtcagctggctatgcgccactagctgtccatccctggcttgcggtttgctctccctctcctctaccccaccaaagcccaacaatgaacagacagggccccaggccctgtgaagccccctgcctgactacccacctctcgccgggacttctgtgaggacttctcaaggacatcgtcgctggagaggtctgagtcctcggagaagctcagctggcgccggagctgcagctctgtggagagagggaggccacgtgaggacagcgccagacagcaggcgcagccctctcctgctcctatgctcccatgtgcagccaaggaggccgggtggggggctggattcattttagtttaagggatccatcccccatcctggggagccaggagctgggacaccaacctttgcctgggcagggcagagctgacgccaagcgggtggcacctaggcctgcccagcccctcctggtagcactgccctctgccctgtgcacgagtgggcccctctggggtcgtctgactttaggaagggcacaaacctccacagtcttcctggtccggtttcaagctggctttgagaattctgttactaagctggctatgccctgtgaacccatggttcagtcccttctccaggtcagcacggctcctgagaaccctcggcggggagcgtgtgagtgtggatcctgagagccccagtgaccccagcccctcccgcacccctcccgctctgcctgcacgcggacccggctgctgacgcacctgcccttacgacgggaagcaccctgtgctttccagagtccaccgtggccccgctggagggggtgctggggcaggacttgtcgtcggccttcttcttcttgtccttcttgtacccggagaagacggacttccacagggacttgggtttggcggcggcttcttctaggaggttggagctgggcttctccgggggccggccctcgcctttggacttcttctccttcttgtttctgcggggggagaagagtgacgacctcttcttgctcttcccactggagccctcggatgaagtgaaagagccatctgggccccctgagtccgacggcggggagaggacctcctcgctggtggcttcatgcttcagggtgggctcctcggagcccctgagagtggggcgtgtgggggagtcaggccggcgctccttgccctgggagggtgctgaggacgccttgcggggcctgggggcgcctgaggccagctccatctgctgcatcctgctcagctgcctggccatggcgtcccgcagcgcctggctcttcacggacttctccctggctcgcatgcgctcctcggccaactccttggcttccgcggacaccaagggcagccccctcttctgtggctgcagcgtcccctccagagcaggcagcctcccgttctccttggccaggggcgggtggcgaggcttctcggggcgcggccagcaggacgggggcgtgaagaatttctcctgcaggcttgagtcctca

SEQ ID NO: 282 - DNA, 24649 bp, Homo sapiens
tttcagccacacttttggaacatcctgcgtagatagagatcatttttggttttcagttccctttggtctctgaggatcacgctccaaggcgtcagggacaggaaagaggctcgcttattctcaggcatattttgaggctccactttcctgcctctctgggcagccacgtgcagcccttagcttaccagggtggactctctggactctcatttctcacacttgttttggcggtgatgccactatatttactgctaactatagtaccactataaataataacataaatattataatgataaatagtgttggagcaatgccttttttttttttttttttgagacagagtctccctctgtcacccaggctggagtgcagtggcgcgatctcggctcactgcaagctccgcctcccgggttcacgtcattctcctgcctcagcctcctgagtagctgggactacaggcgcccgccaccacacccggctaattttttgtatttttagtagagatggggtttcaccatgttagccaggatggtctcgatctcctgaccttgtgatctgcccgcctcggcctcccaaagtgctgggattacaggtgggagccaccgtgcccggccagagcaatgcctttttattgaactcctgtcggagacaccaaagagcttttgtcaccttttcctgggaaacacaaggggaattacctgtcatggctatgcccaactgactggattaaactttcagaaagcagccaagtgcggtggctcacacctgtaatcctagcatttgggatgccgagacaggtggatcacttgaggtctggagttcaagaccaggctggccaacatggtgaaaccccgtctctactaaaaacacaaaattagctgggtgtggtggcgcacgcctgtagtcccagctactcaggaggctgaggcaggagaattgcttgaacccgggaggtgggggttgcagtgagtggagatggcgccactgggtgggttccagcccgggtgacagagccagaccctgtctcaaaaactttcacaaagcaaagtgctcagggctggaattccttggcggctcaggtttacggagtggggccaccgtagattttccactctgccttgctcaggttatgcagcctgggaagtgtgagggaagactgaccaaatgtgttgctgactaagaaggcactcggctattctgagtccccaacccaggaagcctatttggtgggcaccaccaatgccatgctcctggcctggggcagccttggcactgcaaggctgaggtccagtctaaaacctcgggcgatgacaaacaccatggccctgacaggggtcccagctggctggtgtgcaatactgcagacatgcaagcagctgtcatgacagggtgaggctggtccggcaggcccagtctagcatacacatagtggggctgggagacacctggtgctacacagacttaatgcagagataaagctccaggttgggaggaaaagtgaaggcaaaaaaccaaacaaatgcatgtaagaattacaatctaaaacacacaaacacacacacacacgcgcgctgggaaacctcactctaaaacacacacacacacacacacacacacacacacacgcgttgggaaacctcgcaggttccaaagttcctaagcaaagcagaaccaagctgatggtggactggtcaggcaaaccaagaacctatcaacatgaaactcagagaagcagagagaacaggaagacggctgctcagaagggcaggggctggcgtccctgcacctccatctcacaacagcaagaggccacctccagtccttcatgttacatttctaaaccttttgtgttctttaaatttcctttgagacatataaatcaagagatgaggtccccgaaaactagaaattatgtgtgtgtattttcaatcagttttagaagaaatgtggttttcttctagatttccagtcatctgtctgttctagtgcaataaagcaggctgggccggcctgttcagggtcccagggcagaagaaagaaggggagtggccacctggggacccttcctctctggtccaagggttgttttgagtctttttaatgatttctttggaaatcacaaagtccagctatgtgaggaagggaaatcttcattctttatactctgtggctgaaaaaaggaactttcagagcctttaggtagttcactgagagccactgaaagagcctggagcgtgacacacagagcacagggcaggggtaggagtcggcccctctggacaggaggtggcattcccaatgctccgagggctgcttggagctttgctctgcccatgggagaaatgagacgggtgctatggcacagaaatggggcttcggggtggccttttggggatgcaggcacagaggggcaagggcaaccaggttttacatatgaggctccagatctcaaaagggtgattttccctccaattaacgaatattactaagtgctctaagaatgacacaagagcagaaacagaaaagaaacctaattctggcattgccgtcgtcctcacgggcgtggcgagaacagggcctaaagtccacaagagactccctgcagtggggaacgtccccttcaagcagcagcccccacgtggtgggcagaacccgagaagtcttgaatttacgcagcataatggtctgggaaaggggaagtgatgagctgatgagcccaccttcaaagggttatgagtgtcagtggtggggcactgtgtgattcacaaggcatcctgagtttcctttttcttttttttttttttttttttttgagacggagtctcgctctgtcgcccaggctggagtgcagtggcgggatctcggctcactgcaagctccgcctcccgggttcacgccattctcctgcctcagcctcccaagtagccgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcctcctgagtttcctttttctatttatttcatttccccctggaacttgctggaattctaaatccaaaaagctagtagctgcagtccgggaacccagaggagaaagcagctcactacctcttctcactcgagcaagggcgggtaaagaaagcaggagatgcgggctgggcgcggtggctcaggcctgtaatcccagcactttgggaggctgaggcgggcggatcacctgaagtcaggagttggagaccagcctggccaacatggtgaaaccccgtctctactaaaaacacaaaaattagctgggtggggtggtgggtacccgtaatcccagctactcgggaggctgaggcaggagaatcgcttgaacccgggaggcggagcttgcagtgagccaaaatcgcgccactgcattccagcctgggcgacagagcgagactccatctcaaaaaaaacaaacaaacaacaacaacaacaacaaaaaacccaaaaaacaaagaaagcaggagatgcgatggtgtgttaccggcatcttgaactgggagggaagtgtggatacaatcctaaagaaacgcgttctgacggccccttccaggagattctgaatgtaaacaatttttttttttttttttaagagacagggttttgctttgttgcccagactggagtgcagtgctgcgatcacagctcactgcagcctcaaactcctgggctcatgtgatcctcccaccttagcctccctagtagatggaactacaggcacgtgccactatgcccagctaatttttaaaatttctttatagagacggggtttcaccatcttgcccaggctagtttcaaactcctgggctcaaatgatacacctgccttggcctcccaaattgctgggataacaggtgtgaattttttcacacagtgaaattcacttagaatagacataaacactcccgaggtggtgttaggagaaggcaagaggcattagatgggaaaagcgtctgttaattggaatgtaagcaccggcccttctgcagcaccagtggtcgttgagtgtggaggtctctgaacacaccagaagccctgggacactgagggagtctccaagggcgtgggtccgtgggagcgtgggactggagaacacaggaagcacagacagcaacagtctctcttcccagggaggtgagagccccgccttggacgtggcactgtctgataggtggaatcacagaactatgacattggtttttaaatgaatgggccaagaagtgaccctcttaaaggaatggggtcagggtaaaacacgagacaattatctttgccattcttctgtttgaagaccacctctaggcatggagcctccacggggagatgaagggggtagactgccagatcaaggacacacggacagggaggaggagccacagtccccaggattcccctcaacagaatgacagctgcccaggagaaaagctgcctgaagcttagaaatgagacatgggggtcagccattcctctgaactaacacaaatggcaagatgccaaacatactgcaacctctaagctagtggttctcctgctctagagggcatcagaacccactggaaggtctgttacagcagataaccaggcctcaccccagagtttctgattctgcaggtctggggcagggcctgaggctgtgccttcctaacaggctcctaggtgatgttgctgctggtccagggaccacactttgagaaccacggcctggagcttttcctgtcttcactgaaaagaagtacaaagtgagccccaggacagagcaaggagggagggacgttgttatgggcacccgtcaacctggctttgagtttggtgactccgggcagaaatcactacagagaagcctttccctcgcactcagctcttctgggagaaacgagaccacgacccagtgaaaatggtcgggctgagatcttggcatgtttgcttctttgcgtaagtgtggcaggcagtgagctccctagcagatatgattcctacaagcagtgagggatgagattcagggcaaaagctgtgttggagtgtgtgtatttaggggaccaggacgcagatgcaaggctggtggagtcgggtgggcaaagttttattataaaaaattaaaaacgaccccaggcagcaaaagcaagctcagatcttcctctggagcacatgtgggcagcggggagatcagcacgctgctctgttttgagctggaaaagggtctgtgcttttgccatttggttattgggttgatttctccttgtttttgtgagcagggactgggaagcgtgggtggagaaagggcgtcagcggggttagtgtcagcacaggcgctgccatacataccacccagatgcaagtcgatgaggtcactgtaataagactctccccaatagtctacaacaaggaatcggtgaagagagagttattccatcaggtagtcctcctgtccccccatacccaatcaatgatatgatatggagcaatcaatgatatggagcgcaagaaacacagacacagcgaggcggcagaggaacggctggaaggcatgcgtgcctaagtgcatcacatactgcatgtccacacatgccgtatctgcatactgcgtggctgcgggaggagggcggtaactaaaactcactgtggggagtcaatggtcactatcaacatgatcccacgtacaccagggatcagccaggacagaggctttggctttgctgggaactcctgcccctgggactgaaccttctctaactaagagttaatagagcggggctgcctgcgtgtcagttgctgatactggaagccccaggctgagggcctggaggcaggaggcaaacgtcctacagaagctctgaaatccttaggtttcgtgcagtcagtgctctcccaggaattcccacgaccccactgctgactctatcaaatgccttgcagacccacttttgccgaatgggtttgagagaaaggggatcctgtttcgaggcttaggcctccaaattcagtcggccttcttaacaacaggaaacgagcagagactcatgcagagttcttcccccaggcactcggccgaaggctcctggaggtgtgctggcctggggcactcctagcctggtagttccacagctgtctggccaagagcgctatgtaatttccacgcctgagatgcagactgggcactgccgagaggctgggcttgagcaggcggtcctcatctccccagaatcataaagacacacagagcacagcactcggccgccatggtgttgccctctctccaaaccccgcattctgaatgcagatcctcacagcctccggtcccacctgagggcctccccttgagagtgacacagcagacacagtggtagaatgcggtcctgccccagtttttcaatgcatgctcaaggctgagtcagtgtttttgtaacaaaaaggcttcccaggtgccccaggactggaaattacctaagttgtggcctggccctaggatcaaaggtgctgaagctaatccttgcagcctggccatacgtcgtcataccttagacaaacggagaacgggatggcaggtccatgctagagcgcttctctggaaaggcagcttggctaacaaagtctgacgccctcagacggtgatggaagctggagacccccaagtgagatgatggcaggttccagccagtttactacagtccccagggaagggcagactgccatgatgagaagactccagattattatcatgcccagctgccactgccttcttcagggctcagccaggtgccacaagactaagaagaggaacgggacgcagaagcaggagagaaagcagcagcagcacgcacacctgggcttcagagacggcatcggccaaggaggggcagggccacggggaactgtgatgggagaccagcttggaagggatgtattcacgtaagagaaggaacatatttggaaattcttatattcttatggtaggaaccataattcctgaaaattccagagagtttctcaaatgcatcacaacgaaatatcccaacagagctactaaggcccatcttgaaaaacagaacagaaacatctttggatagagatatctgctgaagactcatctaaaggaaggagtttgcactacgacagtggttttcaagcctctgtggaaccctaaggttcttccaaaggcattccaaggggtctcccaaatacctgatgtacaaatacttgtagctctttcaagagcccttattaaaataagacacaccaccttcaaatgtttttgtttttgagacagagtttcgctcttgttgcccaggttggactgcaatggcgtgatctcggctcaccgcaacctccacctcccaggttcaagcgattctcctgcctcagcctcccgagtagctgggattacaggcatgtaccaccatgccaggctaattttttgtatttttagtagagacagggtttctccatgttggtcaggctggtctcaaactcccggcctcaggtgatccgcccacctcggcctcccaaagtgttgggattacaggcgtgagccaccgcgcccggcccaaatgttttatatgccaacttttcacccactggagaccatcaacccaataatttgtgctgccaggtgagcttgattttgtggagccctcaggatcaagtttccgcctctctctgtgtgtaagtggctgaactccctgtaaatgtgttagtgaagaggacattttattcatttgtttatttaaattctggcctgcagcatagtgctcacctgccaccgttcagggtctgtccgggagagctacagctcactgacagcacgcacgcctgtcagcgagtccctttatgtaggtgggtaacacgttttgctgcggtattacagcatggctgggtttttgtttactttgtttgggagcctcttgtttgagacttgcttgtcatgaggaataggaactgctgttagatttgctgtgatccaactgtggaaaaaaaaaaaaaaaagctcttgcctcattttaaacttctagtgtctacatcatttaaactgcagaaatcctgagatttccaagtaagctgttaaaaaaaccaaaaaccaaccaaataaaaaaaaccatgttgtcacttatagcaactacagttcttgtgtgtactggctggatgccggggcttggtcatgtccaccactctctgctataacctgtgttttcaaatctgtgttaattattaacatttgagagtaattctttttgattttaaacttgaacttatcatcttgtgaaaagaggtctgctgctagttttttgaaaaccactgacttagacggcatttgggttgtgtatgtttgaggaaatgtgattatctaatgactagaagaaataattctggcaaaaccctaacgccaatcttcagtggtatattattttccggccctttggcagaagcttgaataacagggcccgtgacaggggcgtcgaagcactgttttacactcagacttcacggaggccacaggcgctcaagtgctttacggaaaccaccaaccttgatggcaccaccacctcaacctcatgagtaaggagggcagggagctgtcttcttcctgaagggcttaaaccatgaaatgcggttattctgtctgtgtgttgagatctaatccactgctttccatcttggcagaagtgatttgtggagaagggcaagaaggaatgaagatgagcctaggctctctcctgatatcttctgcaagaagagaaatggcacgagggcagggccccataggcccggacgcagtcgggcacaggtgggctggggccaactccatctgggctcaggcttaactgaggaggccaaatcagagtgcgcagagcagggcaggggggcaggggcaccgcaggttcgctgggaaacctcagaccttcttaggtgaacccaaatctccttgctgtgcttgtctcacagtaacacatcccagtcgtctcagcctatcggatgctaagtgcttcaagtttttgcatttcctttggtagcctggacttcatgcattaacagcatcaggtgagcccaaaccaagaacatccacatcctcacctttctccccatcccatctctttgactgaaggtcatcactgagtagccctataagctgcaatttccaggccttaaagggcctgggaaaggagacctacttccattctggactccctcactccccaccacacaaacttcagtcctacaggccacaggaattcatcttgacaccaggcacttcccatgagcccatgggtcagtctttgagcaagatcagatggcagcagctggccctgctcctggccgcctcctcccagttcgtccatttcacagagagcctgcctgtcagcagaggcaccctgctcccctctgccacactagagtgaggaagtaagaggatactccttttcttcatccccagctcacaatttaaacgctgaacctgcaggctataaagagacggaagttcccccatccagagactagacgaagatttgtggatgtttgagaaggcagagtggccactgcacccccggggctggtcctgcagcttcaaggtcctgaaccaataggacttcctgggccgtggggccagagatgcctcaggcactcccttgcattctctgtgcccaactatgctgagcgcagccgcgcaggttccctggatggaatggcaggaatgagcgcaccacattctccagggcttccctgccaggagcagcagtcacgagcacagggccctgccagccactccccggagtctgctccacgtcggctggtcacataccctgagcctctccagccctgccctaagtgaccagccttcagcagacacagggcctgggtgccctctggaaatctgtgtgtgccgagggtggccacatgctccccgaccagcggtgttgagggctctgtgggcaggagggtcccagggaactaacgacatgagggggtctgggggtgcaggctggggacctgctcagtgcaattctgtgatggttccttgcggttcaatctccctcactcccagttattccctcctagagtaaatggtggggtgggaaggagggggaagagccagcgctcgccatcagcatgccggggactgagtttcactctatgggaaatggcagcccagaggggctgtggagcaggatgggcctggggctgtctcagacaggtattttcttttgcttaacaggaagccccaaatctcagagatgaagggccccagaaaatcctgctggaaaaggagctgaattccaggtgaggtgaagcaaaactagcctaccacggcgggagggagggcttcctccaggagcagagcttaggagggagcccggcagtacctgcttcgccccggagcgccttctccacagccacgcccctttcctccagccgccgctgcctctcctccacctgctgcagctgccgctggatgatctatgacagacagcacagactgagcacccggctctccagccctgcttcaggaggacacacaactccacacccacacgaggggaaacacaggagttgccgctctggaaagggctctagtctgtgggcggtgcgctcagggtgtggcgtggagaccacctgcaccagaaccacctagcttgtgtagacgccaggctccgggccttgctagttagcatcaaagcgcgtggacgtgactcaagtagtgaccaccctcccaggagtgttgcagagacaggaagtggatgtaatctgtggcaggaggggcctgagtaccagaacctcagactgttctcacggcaagactgctagagtgctggagggggttcctgaagagtgcagtggaaatcccatctttacgataaaaatttaaaacagaaggccaggcacggtggctcatccgtgtaatcccaacactttgggaggctgaggtgggcggatcacaaggtcaagagatcaagaccctcctcgctagcatggtgaaaccctgtctctactaaaaatacaaaaattagctggatgtggtggcacaggcctgtaatcccagctactcgggaggctgaggcaggagaatcgcttgaaccagggaggcagaggttgcagtgagctcagcgccactgcgcgtccagcctggccacggagtgagactccgtctcaaacaaaacaaaacaaaacaaaacaatagaaatctacagtggtctagattcagggtctgtgcagcctgaaaacaagctggagaatgggaggagagctctgacctctgacctcttcccacaaaaatcccaggcctatcagaggctgaggggccacaaatggactcctggtgacagtcctcacaattgaatgaggtgacttacaatgattattctacaacaagggattcgggaaactcaatgcagggttcttcctttttttttttatttttatttttatgagatggaggctcgccctctcacccaggctggagtgcaatggtgcaatctaggctcactgaaatctccacctcctgggttcaagcgattctcgtgcctcagcctcccaaatagctgggattacaggggcccgccactatgcctggctattttttttttttttttttttttttttgagacagagtctctctgtgtcgcctaggctggggtgcagtggcacaatctcggctcactgcaagctccacttgctgggttcatgccattctcctgcctcagccacccgagtagctgggactacaggcacttgccaccacgcctggctaattttttgtatttttagtagagacgggggtttcaccgtgttagccaggatggtctcaatctcctgaccttgtgatccgcccgccttggcctcccaaagtgctgagattataggcatgagccaccgcacccagccaatttttgtttttttagtagagacggggttttgccatgttggccaggctggtctcgaactcctgacctgaagtgatccgcctgcctcagcctcccaaagtgctgggattacaggcattgagccaccacgcccagcctgctcttcccttttgactgacagctccaccaaggcagggcctctgtggctgcaccagccaaaggtgacctgggtggcagggaggcccgtctacctctgctctgctctgcactgtgcttgtgtggcagggagcagctgggtggatagggagatgctgcccaaccctcccatgcatgtgccctggtcccatcctccatggttttacctgggctcgatgcagccgcttaagctcctcctgcttggcctgtctccgagctgccttttgcacacgccgggtcagcttggcattcagttcctcctccgtgtaggttcttggctggagagaacaagagaaacttcctcagtcaggtgcacggaggcctgggacaggggtgggcagcaggccaacaggggcctggagaggtctgtcccccatgtcggagctggtacccgggcagataggacaagctgtcctctgtagagtagagtgctagcaggacgggggtgctgataggcagaaggcatgaggtctgcagagtccccagcctgcagcagccctcagtgccacgggcacacctaagatccacagagtgagacatttccccacctctgcacagggacaggaggctgagtggggaccgactgttaggcagttaaaacaataaagggacacacgctcctttatcactgagatcacctgcttcccaaataaggatgtctggtcattttaaaactttgtgggagtaaaaacattggtaggctgtttcaccaagcctcctgcttctaggaggcttacaggggaagcaaagagaaatcgggatccttttattttcctgtttggtatcaaaggtcactttcttcagaagagcagtatccatgagagtcttccaagaaatgacacccaagtagagagaacaaggatgtttctcttttaagtcaagtacagtctgaagaaggaattgtggaggtgaacctggactgactctggggtctgcagaggcagccgctggccgctaggaagaagagaggttgtggcctggccagggctgttgcgcctagcgccatcgagaacagaagaggcaatggcccaatccagtgcaagtccacggactggacagccacagccccctgcctacgtgggtgccaagggctcaagggagcatcagatgctttgaacaaaccatgggcaacaagaggggcaaagattggggatttgcctttattcataagaccctctttattgcctctaagaaaatgaaacaaggagactatataaaagttcttttttgagagagggtctcattgtcacccaggctggggggcagtgatacgatcatggctcactgcagcttcaaactcctggactcacgtgatcctcccgcctcagcctcccgagtagtcaggactataggcgtgtgccacctcgcccggacaattaaaacaatttttttttgcagagacgggatctcgttatattgcccaagctggtcttaatctcctgggcttaagtgattctcccacttcagcctcccaaaatgctgggattacaggtgtgagccaccatacctggccaacaagaaaacttttatagacttcaaagaagacaaacatgacttggggtctatactcataatcttcactcgaagagctcaaatgacagagggtcccctgaacagtcagtccctaagggtcatcagtggtgtttcagcgctgcaccttgctgatcagagctgagggctgctgaactgcccctctctggggtgcccagccccacagcggcagctgtgtcccgacccgaggaacctggaacaaaatgaccacatgcactccagccggtgaggagcaggtgtctcatcctccttcccactcatgacgtggctaacggaagtactgctgccagtgtgtgccacagccccatgcacgcacaaacacagttagtgaggatgtggctggagggccggggccggcgccgggtggttaatcacagacatgcatgcaacggtgaccagctgacaggaacgagacactacctttgatgcacatgatctcctgaatgccaaggcgtgtggtacataaattgacttttaagcggatggcatcagaaaacaaaacagaatagtaataataataatgattaacaaattaaaaattaagaacacagaaatggagcaaaataagttagaagttgaaaacaaacacacaagacttaaaacacgagattatttttcacgaagtcacacaggactgcctaggtaggaatctgggtgtgaagatcctagcggcggcgtctgagtggacctggttttgaatacggccggggttcactcttttattgggaagaaacagcttcttcctcaccacccccaaaactcgcctcatctcactgtcccttgtgtaaagttaaagccgttaaaatatgtgattctagatgcttttctccttgagtgaccatgtgcttgtggaaattcagcccacttcttcctgctgaatgctccgggggagtagaagtggggtgcgggaggaaagggggtcctgctctcagagacagacgcagcaaaactgggagggaaaccacccatctctcccaaaaggccctccgctggcagtgttcctgtgtgccacccagctgccatttcttgattgtgcccagtaaagggaattgaactaccatcagtaagtgctgttcaccaaaagcacgtcaggcagcagcaggagcctcttctcattccatcacaccttgtgcagagccgctctgagggtcaaggtgagtcacatctgctcttgtggtctcaccagccatattaaacggctgaaaggcattagggaaaccagggtgtgtggtggcgcacaagacagggaagtcctgagaattccaggcaggctgcaaccacagccgcgctccctgttgctccatccatcccatctgtggggcggccttgtgcggagctgtgcttcccaagcctacaggcgagggaagaataaatttgcctccttcaactttgagcacttgtgtcccgcctgcctcaggtggacccacctctcccacaaatcagagcaagagaatgttgttatgagaacaagccggttcagaaaaagagacagatgatttcccgaagcggctgcaaaaagcccacaggaactatggaccacaccctaaggaacagcactaacatcttcacctatggctgatgtcaatagcaatggggggcagtggctgccttcccacaatctacccattttctgggctgggaggggtgaagtcaccacccgtccctgtgtgcctgaggtggtggtcagccacaggagctgacattctgctgtgaatctggatgcggggtggcagggtacccaggccacaccctggtgggctgcagggctcaagaggcagctgcgttgcttgtatttaaagtcaaatgggagcaattagaaaagaggtaaacgcaagttctctcttgtaggtcgggctacaggtgactttttaaaagtctgaattatcctaaattttctataataaacattttaaataaaaaataagtattttgactggtttaaaagtttataacaaaacaaaacccaggctcttgtttcacagatgctgtgaggcgggaggaggcgtctgctgctggagtggccccaggatcctggcctggcagaaggggcttccttcttccgaggcaggtcaaaccccatcctcactttagagcccctgttccccacacttactttgaaagatttaaacccacaggaaagttgaaagaggaagacaatgaacacccacatgcctctcacctgtgtctgccaaaggttaccattttgccacacgcttcatctatatgtcatcttttatatgaccttttgtaatgaatcattggtagataccacgacccttcgtccctaaacgttttaggatggactttctaacaactcagacattttcctatataactttcctacataaaagtacattaacagtgcctttatcacttgcaaggaacttaacaatttgataatattacacatttatactatcatccagtcctcagttgaatttaattgttcccaaaatgtcctttatggctgtttttgtttggtttgttttcctctttagcatccatgtcttgaataggcacagcacccagccctcgctcaggctgactccataccatgcggaagtcaggtcagctgcccgtggctcggttgtctcccatgtcatctgtctcctaggttggccttcccctaggtcattcatcccctagcctggccgtcccgtaggtcatccatcccctagcttggccatcccataggtcatccatcccctagctcgactgtcccgtaggtcatccatcccctagccgggccgtcccgtaggtcatccatcccctagctcgactgtcccctaggtcatccatcccctagcttggccgtcccgtaggtcatccatcccctagctcgactgtcccctaggtcatccatcccctagcctggccgtcccgtaggtcatccatcccctagctcgaccgtctcctcgatcctcagccgtcctctaggtcggccatccgctagcctgtctgtcccccaggcttggctttggctttagtattccgtatgtgacgtctagcaaacggctttgcctctgtgggtgcccctagagcgtgaggccttagaggccgccctctggctctagggttccatgactggtgtccatggcttgttcctggggtcctgttcctgtttctcccttgctccttgtatctgctgggccctggggaggctcaccaagtaccagccttggcacagccaacccaggcagtaggtgcttcatggatggagaagcagtgggcatactacccaccacagcaacgtgagggaggtgggtggccaagctgacacaataggttgaatgtccacactgtcaccactgaggcagtgagcttgggaccacattctccattctttgctgaccccctaaagcagcacccatcaccagtattgggatgtgtttagggacccacatagaaacccaggggaattctcagctcagccccagtgcaactgggaaagctcgactggaagccttgatgaaggcacactctccctgtccctgagaaggcgcagatcccaaccctaactcagttgctggcctggctggggcaccaggaagcctggctctgtagagggtggagcaggaggagaggcctggctctctagagtcttctaggagaggggccaaagagccggaaaggccaagggagacgaatgcaccaaggaggggatgcgaaataaagcgtctggtttgctgagttatttaaagaggaactggatcaggctgcaggagccatcttcaccaaatgggcacgtgacgggctcaggcgcaccaaggcccgccctgactgggctattggacggcaggagagggcagactcaagtccaagccctagaagccttgcaatgaaggcatgctacattctcgggaagcttttgacgcaaaagggaggcaggaagcaggagacagccgggttgcccccagccaggaggaggagcacaggccccagggctggacagtggaggtggggtgacatgatactccgcagagctccgcccaccctgtatgctgacaggtgcctgttagagtgtgctctgattcctctccctccaccttcactggatccacccaaagtcctgggctctggaaagtgaggggctgagtcagacctagcagccctgcaggtcagttcctggaccagtcctttaagacgacaaaccctccctaactatcaaacccaccaaacgggcaggaccaggcacaatgctctgtgcctaaggtcccagctccgccagcagccctggactgcgcagtgttctccaggccctggggctggtgggctgctccccgcgggatcacctatgaagaaagacaatgccaggctgcctcctccagagaaggggagtgtgacacaggaatggctccagtcttttcttcttcacaagaaatcagaagcccttgctgtggatgccaacggccctagctcccatgtagaaagcccagcgtgaccgcctcagtgcatagggctgggtcagcagtcagctggctatgcgccactagctgtccatccctggcttgcggtttgctctccctctcctctaccccaccaaagcccaacaatgaacagacagggccccaggccctgtgaagccccctgcctgactacccacctctcgccgggacttctgtgaggacttctcaaggacatcgtcgctggagaggtctgagtcctcggagaagctcagctggcgccggagctgcagctctgtggagagagggaggccacgtgaggacagcgccagacagcaggcgcagccctctcctgctcctatgctcccatgtgcagccaaggaggccgggtggggggctggattcattttagtttaagggatccatcccccatcctggggagccaggagctgggacaccaacctttgcctgggcagggcagagctgacgccaagcgggtggcacctaggcctgcccagcccctcctggtagcactgccctctgccctgtgcacgagtgggcccctctggggtcgtctgactttaggaagggcacaaacctccacagtcttcctggtccggtttcaagctggctttgagaattctgttactaagctggctatgccctgtgaacccatggttcagtcccttctccaggtcagcacggctcctgagaaccctcggcggggagcgtgtgagtgtggatcctgagagccccagtgaccccagcccctcccgcacccctcccgctctgcctgcacgcggacccggctgctgacgcacctgcccttacgacgggaagcaccctgtgctttccagagtccaccgtggccccgctggagggggtgctggggcaggacttgtcgtcggccttcttcttcttgtccttcttgtacccggagaagacggacttccacagggacttgggtttggcggcggcttcttctaggaggttggagctgggcttctccgggggccggccctcgcctttggacttcttctccttcttgtttctgcggggggagaagagtgacgacctcttcttgctcttcccactggagccctcggatgaagtgaaagagccatctgggccccctgagtccgacggcggggagaggacctcctcgctggtggcttcatgcttcagggtgggctcctcggagcccctgagagtggggcgtgtgggggagtcaggccggcgctccttgccctgggagggtgctgaggacgccttgcggggcctgggggcgcctgaggccagctccatctgctgcatcctgctcagctgcctggccatggcgtcccgcagcgcctggctcttcacggacttctccctggctcgcatgcgctcctcggccaactccttggcttccgcggacaccaagggcagccccctcttctgtggctgcagcgtcccctccagagcaggcagcctcccgttctccttggccaggggcgggtggcgaggcttctcggggcgcggccagcaggacgggggcgtgaagaatttctcctgcaggcttgagtcctcagtcttgtcgtcataggtgtcctccacatcatcagcaaagggaatctcctccacgctctccacaaacgacttccgcacctcctctctggggggctgagcaggctcccgggggggccgcatccaggtggcgggcaagggcggcgggaccaccgaggcattgggctcggcctccctgagcttcctccgcaaggtggcgggctcctcgcccgggggtggcggtgggggcgggctggaggggggcgtgagcatggcggagtccgaggtgttgaagctctggctgcccagtgtcttcatgttggaggagctcccgtgcaggcccaggccagagctgctggacagctccctgcgctcctcctgggcgctgcgtagctctctgtcggacggggaccggggggttggcagggacaacggctcgccttccggctttggcaggcccagccttttggggatggacagaggcttgagaaggtggagtccctcatcctggggggacttttcaacggaataggatttgagggacactggcctgaaggcaggcgtggggaagctgggctcgggccccttgctgcggtccacaggtgtgagcccgaggctgcggcggatctccgcactcttcatccagaactcctccaccaggtcgctccgtctgagggcctcatccacagcaagggggctgcccagtctgtccttggtgtcactttggctttggacagggagaggggccagtggggtggatgttttggccggggcaggctggaagcgtatgggggactgggtaggggatgggacagtggcctcggtggaaggctggggctgggagcagatggggagtgggctgggtgggggcgtggaggccgccacgggtggctggggctgcgggctccctggtgagacaggagtcctagcttctggcagggtcactggctgtgatcggatgggagagtgcacagctttcagatccgagggggcatcagctttgggcttctctttggggagcaaaggctcagggaaaaggcgctcctcaggtgatttctcctgggtggcggcagggacaggtgggagttggggcccctacagggaaggaagacagaagccgctgagaaggtgtgggctttcacgaccagcagcatcctcggggagccttctcactcaaagtgcctgcacctgtgcctgctgcaggacttccccgtccttccagctgttattagaacagctccaggaaaaccctttccactttctgctccaggtgttcagtgtttagaaccttagaaccactctgcttagtttagacaaactgggttttcaggatttggttcatctcaaatacatcctatattctttgtccactcacaggaacactggccaaaaggacatagaggaatgcagttctcaccctccaggaggccccagagcgccaagatccctgacgtacgtacagaggggccaggactgtaagaagacttaccacagctatttatcacggtgcattatgatcaaattgtcctccctaggaagctcaaagatgtgcagagattcctgcaccagcccttatatcaccccatccaagagcctcaaacaaagcctccccatttcacagacggctgagcgcagtggctcacacctgtaatcccagcactttgggaggacgaagtgggcagatcacgaggtcaggagatcgagaccatcctggctaacatggtgaaatcccgtctctactaaaaatacaaaaacaaaattaggcaggtgtggtggtgggtgcctacagtcccagctactcgggaggctgaggcagaagaatggcgtgaacccgggaggtggagcttgcagtgagccaagatcgcgccactgcatcctagcctgggtgacagtgagagactccatctcaaaaaaaaaaaaaaaaaaaaaaaaaaaatccaatcagtgaacaggctaggtacagtggctcatgctgtaatcccagcactttgggaggctgaggcaggaggattgcttgagccgaggagttgggaggctgcagtgagccatgatcatgccactgcactattgcccatgccagtctgggcaagagactgagaccctgtctcaaaaaaaaaaaaaaaaatcactgaatagttccatgcttcctagaatcccaaagactaaatcaagcagatgcaggccttatattccagctttctccctgatctgacctgcagacagtatttcccaaaccatgttccacaggacctgctgtcacagttggctttgcagcattctccatgtggttcacacaccacaggctgtctgcatggacgctgtaaatttctttttttttgagacggagtctcgctctgtcgcccaggctggagtgcagtggtgccatctcggctcactgcaagctccgccttccgggttcatgccattctcctgcctcagcctcctgagtagctgggactacaggcgcccgccaccacgcccggctaattttttgtattgttagtagagacaggctatcactgtgttaaccaggatggtctcgatctcctgacctcgtgatctgcctgccttggcctcccaaagtgctgggattacaggcgtgagccaccgcgcctggccagatgttgtaaatttcaatggttatacatttattttaacataatgttaaaaatgcatttgtcatatcaaaccaaccatcccatcgatattattgctttaatttaaacaaatttatttttaataaaatatcaaatgttttataccatttatcataaaaattatattatttttaatatattataaatttataaaaaataaatttgttctaataaattttaataaatttatatttataaacataaattttaataaatttatatttataaacataaattttaataaatttatgtttataaacataaattttaataaatttatatttataaacataaattttaataaatttatatttataaacaattttaatacacctatgtttattatacatttattaaatataataaattatttatttttaataaatttgtttaaattaaacatatggtgtgtggtatgtggacctaacacagtgacacggggtagaggactcaggtttgggatcagagtggggcagaggtagtaggtgccacccagacggcctcatccccaagagtactgagctggaactccaaggccactcctgtcatcaacagctccacttagtacaaggaggatgatagttttcagtcttcctcagaatgaggaggccagcaggctatgttagccccagtcttggtgggacccacaccatgggccctgaaacagagaagttaatatgtgtccttggggtcccattagttctctgtaccccacagcgagccccaaacccttacctctgttgaggggctgtggactggaatgaacagaagagctgattcctggggagaccggatggggctggtggcttgggagggacctgaaaagaatgaacacagggacttacaagaggaagcccccccatgtgccaggaaggcacccctatcagccagccccagagggtggaggggagggtagagggcgagtcgctgagtcggctcccagttctcctggaaagcacaggttctctcagaggccagggtcctggaaccgtcttcccggggctgcccggcactctctgcaggtgctcctgtcaacaccaggtcaggccgtgggcttcctccatgtgcagactctgcacacagagcttcaggacaaaccttctaccttctcccagacccaaactatgcaaggaaagggcctttggccaaagcaactgcagcagcctgtggcacagggagggtggacagaggaggaaaaggcaaggagctgcccacacctcggaggctggtgtgcaccatggctctgctctgaagcgcctggcccctgagccactcttgtgtgcatatggccctcgtaggaattctgaaagttgtttctcccatcaaagacaggctcacctctctcttggtgcttcggtgaggcgggcagcttctcctcatcttccgacaccctcagctccagctctgcttccccctcagctgggcacggcaaacgcagctctctgtcagcatccgacgggctgtcagaccagtgctgatctggcagagggaaggggcagaagtgggtgcacaccctaagtgaggccaactccttttccacctgagagcagccgcgccacttgctcatttgcaacacagctgctcaggtgcaggcctggaggcccttcttacgcagggacagacctgcctaccagaccacccccgctcctgaggggcccggccaagagcaccctcctgcctttgcaacgcggggccgcatcaaagcctgtggggctctgtttcttttaaaatacagcaacagtcacacatgatgggctgcgacagacaaagacagggtgtgcctgtggagggcaggcctggcctcacgggcccacttctatgcacctcctcctctcagtagccctgactgccaccccaactccacagctgaggcctgcgccccctcgcaagcttgggttcttctcattcttcccagcctcgtccctgaccccctcagccccccacaaccagactgcgatgcagaacccatctccaggtatgtagctttgggagccagtcagcagaattaaaggccttgtataaagccacaggttggctcaggcacccagctgcagctggatgactgcaggccaagtcgcctggtgctcgtgggtaggtggtggttgggtggaatgagatgcattccagccatggtggagccaagaaggaaccaggaggcccaacggcggcctcactgagcttgattttgctggaaagcatattgccttcatcttccctgagctcccaccacaggggcggggagggcggacccctaccatcatccagctcagcaccagtgtcccctgggtccccatcctctgctgcctccccttc

SEQ ID NO: 283 - DNA, 24860 bp, Homo sapiens
atgcctttcaacgacaatcttatcaccacaacagacttcaaatcagacaaacttaaaacacgcacactcagcaagacacgaggtagagaggtttgctttcagtggttgtttggaaaggggcccgagggcactggtgtagatcagtctttgtaaggacagtattccttgactctcccatccaaatcgctgcacgcaggcgggaggctcctcacctgcatgcctgcccctctatctgatggatctgagacttaaagccccagccacgaagggccagccaatgctgcagccctgaaggacccagacctggaggctctctggctttactctgcaccctggtcctccccatagacagtcaaagggatactgtacctttagaaactgccacagactcatgacattttgtaacaggactattgagggtcagagagaaagaaagagagagaggtaggtgggttctggctctgtgtttgactagtgttgctacaccccctccgaggcagtggggatggggttggcgaggttacgttaccttcctggacacagcaagggcagaaggagagaggtctacgtcgtggagtcccgccactgggctcaacttcaaaagggaccaagcaaggaagaggaggagacggagaaagacaaaaaaggaagaggaggagaggagcaggaatttggaagtggagagggacagggagaaggtggaataaaaacaagcagaggacaaaaagcataaaaagtgagaaaggaacaacaggaggaaaagaaaataatacaagaaatggagaagcagaaacaagggaaacaaagtctacaaatgaattaagtccttttttcagcacggaactgaacgagagcagatccagctctggcagcatcacagagggggcggggggccagagccacagtgtggattcctccaagagggatgatgtgttccctacacaatgatggcagcactcgggccacagggccctcctgcctctactccttatcaggagggcagtggcatctgggttgtcataccggggcctttggggccttgggccccctcctcaaagcccctggataggtctgcctggctctgagacagactgcattcaataagtggccaacatggcttccaggcttgcaggtgacaacctggggtcacctcccagacccacgtggaatcctctaagatgtcaccacaggtatgtgcctgaggcaaagctggccttgacaagtgcagggcaaggaggggcctctgagtctgtgggggcagcacgccatccggtgacgggcctccaggacgctcacacctgcgctccttcaaattctgagccaggacaattttggggaaatgtacaaacacagaggtgacttccacccgtccgtgtcactgtcccctctctcccccaggaacagggagagccaaccaccccctttccttctggcccttctatggctgtgcagggaccccatgctgcagctgggggctgtcacactctggattgtgagaccaaaggggtgagctgacaggacacgccaaaacttacaggaacgatgctgggaggagtgctgacggggcatcgagagacagtgtgcagagagacatctctagatctggggtctgatggctactcaaggacgagggagaggagtttggcaagggaccatcacagaaccacagagcacacacagggacaacagagcccaggaagacacggggcctcggcccgcggggagggcagtgtgtggtttacagagagaacagggttgaagaaatggccttgttttactcaacagaaggccaacaagacaaagagctggctgagaggccgctcagcggtgcagctgcatgaatacaggtgttttctgtctttgaacccttccagcgtggcgtaccttgggcacactgaatctgctattgggtacaacttcaaaaccaaagccagggacagtgtgcatgcgtgtgaaatgctgagtgtacccaatgtgctaagcacacacggcacagccggccgaatgcatgggtacgagggaggatttctttcctcaacaatacactctgccttacagccgacctacagtcaacctcggcttcaaagtgtagtctgtcttcaggcttggaacacctggatgaatcccatcaaatacgtcagtgaacagtccctgccacctcctgggactggtgtcacaggtgaataggccatgctgtggagcggaacagcgcccatgtgatacacaaccaaacacatccaaaaggaagaggcaggcgcctgcacgggtaataattacaacacgtgtttctgctttctggacagcacaaaatacagctttcagctgtttttatgtaggccacatcctcatacgcccttcccaacacagagaacaatataacagaatactgggaacagaattaggaaatgaaattagaaaaagggagcatcaggtaaagcaagcatttaaagaagccaaaaaggctttctcctagcaagaggcagaagcgcgtgtgagcggccggcgagtccgagctgcgctgcggggccgctaccttcggacttccctgtacgctccacacttccacaacgggcgaggctacttttataatcagaaaaaatgcccaatcaatacaattttcaaaagaagaagtggaagggaaaaaccaatccaacaaggggagttccacctgactggaacctgactgagcatgcatggggcgggggtggggggtttatagtaaatgctttgccttttagggggatgtaagaaatagaagacttggttcactggttctaagaacaaagatgctgtcaagcttctggcaaatggaagttttttggtttttctcaacatcagggtaacgggtttccatctgttgctaacaggtgctataatttaccacttctcaaagcactcctgcgtgccctgggcgctggccacccctcctgagctcccgagcagtgagcgggtcctggtcagaggacccctcctccctggagcactctgctgcgtctccaacactcgggggcacatctgctccatctttccctctgaagcagcacttcctttggacgtgtgacccaggggtggctctttagtgccactcgcttgacacctggcgggcaggcagtgcctgtcaccaaatttcaaaaagcaacagtacaccaccagggagtgaggcctgtccagagcagcgcatgagatgggcacggatggcactctccggcttcagggcgccctcgcatgcaccacccacgtgatcctcacaccggccaggtgtggctgccaggatgggcaaattcaaatgagggttctgaggctcaacggagttaagtgtggcagagcctggaaaagaagccaaatcttcttgcccactctgaactcagagctttccctcttcaacacaggctccaggcaaatgtaacaaatgctggcgtctcaggcagctcaaggaagagcagtcccacagaccctgatcagaatgtcacacctggaagggaggcccgatgtcccttcctgcctcgtcttctgaagaggccctgagagggtaagtagagtctgttttgtctgtgcctggggagacagtgaaggcaggacctgaatccaggcctggccttcctaagtcggggtaccccctacactaccacctggcccttggcgcacccgagcacctcactccaggccctgcctctcatgggcccaagacccagtgtggggtagaatggccaacagtgtgggggaaagagtggccagctgtagggcaggtccccttctctgtacttgtacttctatattcccaccttctctccaaccaagactcttcaccttggcacactgcatcaagaagacacccgggcagctggaaaaacaagcaagcagatgagcccacacactgaacctagatggtcatctggaaggcaggcagggcctaccttagtccttctggtactcgaaatccaagagccatagccctgagactggggagcagaggcttgagtgccttgctcacaaggattagtgaggatgcggtcagaaagctcggaggtacgggggctcacacctgtgatcccagcactttgggaggtgagggtgagatgactgctgaacccaggagttcgagaccagcctgggcaatgcagtgagaccccgtctctacaacaattagctgggtgtggtagtgtgagtatctatagtcccagctactcaggaggctacggtgggagggctgcttgagcccgggaggtcaaggctgcagagagccgtgactgcaccactgcactccagcctgggtgagtgagaccctatctctaaaaaataaataaataagtaataatagcccagaggggccaagacaaaggcccaactctgttcatagcccgacaaccaccagtgacaatctgtgtggcggtgggtgctggcttgatgctctgcatttccgactcaatcattcaattctgcctggttctatttgacccactggcttctacatggatgctgatatcaaaaacagcaatatcatacatgaatcatggcctgtggtaaggatgatgcgggagactactaatttatgccagaaatgtttactgagcaccccaaacgcaccggccaccaacgctaaccacgtggcagccagcagaggacgcagaggtgggcacagccacagcgggcaggcacgtcggcgggccgtcctccaggcctgctggacaactggccccggggacctgcctcatcttggtatccacctctgcccactagacaggctcccagctccccctggttggacaaaggcaccatcaccacagagctggggaggtccctaaagcagtgtccagcagaccaaaagagggccaatgagggagacttctagagcccagaggccccagcctggaatgctgcatttccccagggaacacgggttaggtcctggagtgtcaccagactagtaccacacacagaggtgtaatgaggaaaatgggctttttatgagccgagccaccatttacaactctatttccacgtgaaaatacagaatcccaaataatcagcttgcaagcgttttagaataccagactttcaagaggtggaggctggccccacaccctcccttctgatatgctgttgtgtgtttcacgcacacagaaactctgtagagccccaaggttaacgtcttcccctttcagccacacttttggaacatcctgcgtagatagagatcatttttggttttcagttccctttggtctctgaggatcacgctccaaggcgtcagggacaggaaagaggctcgcttattctcaggcatattttgaggctccactttcctgcctctctgggcagccacgtgcagcccttagcttaccagggtggactctctggactctcatttctcacacttgttttggcggtgatgccactatatttactgctaactatagtaccactataaataataacataaatattataatgataaatagtgttggagcaatgccttttttttttttttttttgagacagagtctccctctgtcacccaggctggagtgcagtggcgcgatctcggctcactgcaagctccgcctcccgggttcacgtcattctcctgcctcagcctcctgagtagctgggactacaggcgcccgccaccacacccggctaattttttgtatttttagtagagatggggtttcaccatgttagccaggatggtctcgatctcctgaccttgtgatctgcccgcctcggcctcccaaagtgctgggattacaggtgggagccaccgtgcccggccagagcaatgcctttttattgaactcctgtcggagacaccaaagagcttttgtcaccttttcctgggaaacacaaggggaattacctgtcatggctatgcccaactgactggattaaactttcagaaagcagccaagtgcggtggctcacacctgtaatcctagcatttgggatgccgagacaggtggatcacttgaggtctggagttcaagaccaggctggccaacatggtgaaaccccgtctctactaaaaacacaaaattagctgggtgtggtggcgcacgcctgtagtcccagctactcaggaggctgaggcaggagaattgcttgaacccgggaggtgggggttgcagtgagtggagatggcgccactgggtgggttccagcccgggtgacagagccagaccctgtctcaaaaactttcacaaagcaaagtgctcagggctggaattccttggcggctcaggtttacggagtggggccaccgtagattttccactctgccttgctcaggttatgcagcctgggaagtgtgagggaagactgaccaaatgtgttgctgactaagaaggcactcggctattctgagtccccaacccaggaagcctatttggtgggcaccaccaatgccatgctcctggcctggggcagccttggcactgcaaggctgaggtccagtctaaaacctcgggcgatgacaaacaccatggccctgacaggggtcccagctggctggtgtgcaatactgcagacatgcaagcagctgtcatgacagggtgaggctggtccggcaggcccagtctagcatacacatagtggggctgggagacacctggtgctacacagacttaatgcagagataaagctccaggttgggaggaaaagtgaaggcaaaaaaccaaacaaatgcatgtaagaattacaatctaaaacacacaaacacacacacacacgcgcgctgggaaacctcactctaaaacacacacacacacacacacacacacacacacacgcgttgggaaacctcgcaggttccaaagttcctaagcaaagcagaaccaagctgatggtggactggtcaggcaaaccaagaacctatcaacatgaaactcagagaagcagagagaacaggaagacggctgctcagaagggcaggggctggcgtccctgcacctccatctcacaacagcaagaggccacctccagtccttcatgttacatttctaaaccttttgtgttctttaaatttcctttgagacatataaatcaagagatgaggtccccgaaaactagaaattatgtgtgtgtattttcaatcagttttagaagaaatgtggttttcttctagatttccagtcatctgtctgttctagtgcaataaagcaggctgggccggcctgttcagggtcccagggcagaagaaagaaggggagtggccacctggggacccttcctctctggtccaagggttgttttgagtctttttaatgatttctttggaaatcacaaagtccagctatgtgaggaagggaaatcttcattctttatactctgtggctgaaaaaaggaactttcagagcctttaggtagttcactgagagccactgaaagagcctggagcgtgacacacagagcacagggcaggggtaggagtcggcccctctggacaggaggtggcattcccaatgctccgagggctgcttggagctttgctctgcccatgggagaaatgagacgggtgctatggcacagaaatggggcttcggggtggccttttggggatgcaggcacagaggggcaagggcaaccaggttttacatatgaggctccagatctcaaaagggtgattttccctccaattaacgaatattactaagtgctctaagaatgacacaagagcagaaacagaaaagaaacctaattctggcattgccgtcgtcctcacgggcgtggcgagaacagggcctaaagtccacaagagactccctgcagtggggaacgtccccttcaagcagcagcccccacgtggtgggcagaacccgagaagtcttgaatttacgcagcataatggtctgggaaaggggaagtgatgagctgatgagcccaccttcaaagggttatgagtgtcagtggtggggcactgtgtgattcacaaggcatcctgagtttcctttttcttttttttttttttttttttttgagacggagtctcgctctgtcgcccaggctggagtgcagtggcgggatctcggctcactgcaagctccgcctcccgggttcacgccattctcctgcctcagcctcccaagtagccgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcctcctgagtttcctttttctatttatttcatttccccctggaacttgctggaattctaaatccaaaaagctagtagctgcagtccgggaacccagaggagaaagcagctcactacctcttctcactcgagcaagggcgggtaaagaaagcaggagatgcgggctgggcgcggtggctcaggcctgtaatcccagcactttgggaggctgaggcgggcggatcacctgaagtcaggagttggagaccagcctggccaacatggtgaaaccccgtctctactaaaaacacaaaaattagctgggtggggtggtgggtacccgtaatcccagctactcgggaggctgaggcaggagaatcgcttgaacccgggaggcggagcttgcagtgagccaaaatcgcgccactgcattccagcctgggcgacagagcgagactccatctcaaaaaaaacaaacaaacaacaacaacaacaacaaaaaacccaaaaaacaaagaaagcaggagatgcgatggtgtgttaccggcatcttgaactgggagggaagtgtggatacaatcctaaagaaacgcgttctgacggccccttccaggagattctgaatgtaaacaatttttttttttttttttaagagacagggttttgctttgttgcccagactggagtgcagtgctgcgatcacagctcactgcagcctcaaactcctgggctcatgtgatcctcccaccttagcctccctagtagatggaactacaggcacgtgccactatgcccagctaatttttaaaatttctttatagagacggggtttcaccatcttgcccaggctagtttcaaactcctgggctcaaatgatacacctgccttggcctcccaaattgctgggataacaggtgtgaattttttcacacagtgaaattcacttagaatagacataaacactcccgaggtggtgttaggagaaggcaagaggcattagatgggaaaagcgtctgttaattggaatgtaagcaccggcccttctgcagcaccagtggtcgttgagtgtggaggtctctgaacacaccagaagccctgggacactgagggagtctccaagggcgtgggtccgtgggagcgtgggactggagaacacaggaagcacagacagcaacagtctctcttcccagggaggtgagagccccgccttggacgtggcactgtctgataggtggaatcacagaactatgacattggtttttaaatgaatgggccaagaagtgaccctcttaaaggaatggggtcagggtaaaacacgagacaattatctttgccattcttctgtttgaagaccacctctaggcatggagcctccacggggagatgaagggggtagactgccagatcaaggacacacggacagggaggaggagccacagtccccaggattcccctcaacagaatgacagctgcccaggagaaaagctgcctgaagcttagaaatgagacatgggggtcagccattcctctgaactaacacaaatggcaagatgccaaacatactgcaacctctaagctagtggttctcctgctctagagggcatcagaacccactggaaggtctgttacagcagataaccaggcctcaccccagagtttctgattctgcaggtctggggcagggcctgaggctgtgccttcctaacaggctcctaggtgatgttgctgctggtccagggaccacactttgagaaccacggcctggagcttttcctgtcttcactgaaaagaagtacaaagtgagccccaggacagagcaaggagggagggacgttgttatgggcacccgtcaacctggctttgagtttggtgactccgggcagaaatcactacagagaagcctttccctcgcactcagctcttctgggagaaacgagaccacgacccagtgaaaatggtcgggctgagatcttggcatgtttgcttctttgcgtaagtgtggcaggcagtgagctccctagcagatatgattcctacaagcagtgagggatgagattcagggcaaaagctgtgttggagtgtgtgtatttaggggaccaggacgcagatgcaaggctggtggagtcgggtgggcaaagttttattataaaaaattaaaaacgaccccaggcagcaaaagcaagctcagatcttcctctggagcacatgtgggcagcggggagatcagcacgctgctctgttttgagctggaaaagggtctgtgcttttgccatttggttattgggttgatttctccttgtttttgtgagcagggactgggaagcgtgggtggagaaagggcgtcagcggggttagtgtcagcacaggcgctgccatacataccacccagatgcaagtcgatgaggtcactgtaataagactctccccaatagtctacaacaaggaatcggtgaagagagagttattccatcaggtagtcctcctgtccccccatacccaatcaatgatatgatatggagcaatcaatgatatggagcgcaagaaacacagacacagcgaggcggcagaggaacggctggaaggcatgcgtgcctaagtgcatcacatactgcatgtccacacatgccgtatctgcatactgcgtggctgcgggaggagggcggtaactaaaactcactgtggggagtcaatggtcactatcaacatgatcccacgtacaccagggatcagccaggacagaggctttggctttgctgggaactcctgcccctgggactgaaccttctctaactaagagttaatagagcggggctgcctgcgtgtcagttgctgatactggaagccccaggctgagggcctggaggcaggaggcaaacgtcctacagaagctctgaaatccttaggtttcgtgcagtcagtgctctcccaggaattcccacgaccccactgctgactctatcaaatgccttgcagacccacttttgccgaatgggtttgagagaaaggggatcctgtttcgaggcttaggcctccaaattcagtcggccttcttaacaacaggaaacgagcagagactcatgcagagttcttcccccaggcactcggccgaaggctcctggaggtgtgctggcctggggcactcctagcctggtagttccacagctgtctggccaagagcgctatgtaatttccacgcctgagatgcagactgggcactgccgagaggctgggcttgagcaggcggtcctcatctccccagaatcataaagacacacagagcacagcactcggccgccatggtgttgccctctctccaaaccccgcattctgaatgcagatcctcacagcctccggtcccacctgagggcctccccttgagagtgacacagcagacacagtggtagaatgcggtcctgccccagtttttcaatgcatgctcaaggctgagtcagtgtttttgtaacaaaaaggcttcccaggtgccccaggactggaaattacctaagttgtggcctggccctaggatcaaaggtgctgaagctaatccttgcagcctggccatacgtcgtcataccttagacaaacggagaacgggatggcaggtccatgctagagcgcttctctggaaaggcagcttggctaacaaagtctgacgccctcagacggtgatggaagctggagacccccaagtgagatgatggcaggttccagccagtttactacagtccccagggaagggcagactgccatgatgagaagactccagattattatcatgcccagctgccactgccttcttcagggctcagccaggtgccacaagactaagaagaggaacgggacgcagaagcaggagagaaagcagcagcagcacgcacacctgggcttcagagacggcatcggccaaggaggggcagggccacggggaactgtgatgggagaccagcttggaagggatgtattcacgtaagagaaggaacatatttggaaattcttatattcttatggtaggaaccataattcctgaaaattccagagagtttctcaaatgcatcacaacgaaatatcccaacagagctactaaggcccatcttgaaaaacagaacagaaacatctttggatagagatatctgctgaagactcatctaaaggaaggagtttgcactacgacagtggttttcaagcctctgtggaaccctaaggttcttccaaaggcattccaaggggtctcccaaatacctgatgtacaaatacttgtagctctttcaagagcccttattaaaataagacacaccaccttcaaatgtttttgtttttgagacagagtttcgctcttgttgcccaggttggactgcaatggcgtgatctcggctcaccgcaacctccacctcccaggttcaagcgattctcctgcctcagcctcccgagtagctgggattacaggcatgtaccaccatgccaggctaattttttgtatttttagtagagacagggtttctccatgttggtcaggctggtctcaaactcccggcctcaggtgatccgcccacctcggcctcccaaagtgttgggattacaggcgtgagccaccgcgcccggcccaaatgttttatatgccaacttttcacccactggagaccatcaacccaataatttgtgctgccaggtgagcttgattttgtggagccctcaggatcaagtttccgcctctctctgtgtgtaagtggctgaactccctgtaaatgtgttagtgaagaggacattttattcatttgtttatttaaattctggcctgcagcatagtgctcacctgccaccgttcagggtctgtccgggagagctacagctcactgacagcacgcacgcctgtcagcgagtccctttatgtaggtgggtaacacgttttgctgcggtattacagcatggctgggtttttgtttactttgtttgggagcctcttgtttgagacttgcttgtcatgaggaataggaactgctgttagatttgctgtgatccaactgtggaaaaaaaaaaaaaaaagctcttgcctcattttaaacttctagtgtctacatcatttaaactgcagaaatcctgagatttccaagtaagctgttaaaaaaaccaaaaaccaaccaaataaaaaaaaccatgttgtcacttatagcaactacagttcttgtgtgtactggctggatgccggggcttggtcatgtccaccactctctgctataacctgtgttttcaaatctgtgttaattattaacatttgagagtaattctttttgattttaaacttgaacttatcatcttgtgaaaagaggtctgctgctagttttttgaaaaccactgacttagacggcatttgggttgtgtatgtttgaggaaatgtgattatctaatgactagaagaaataattctggcaaaaccctaacgccaatcttcagtggtatattattttccggccctttggcagaagcttgaataacagggcccgtgacaggggcgtcgaagcactgttttacactcagacttcacggaggccacaggcgctcaagtgctttacggaaaccaccaaccttgatggcaccaccacctcaacctcatgagtaaggagggcagggagctgtcttcttcctgaagggcttaaaccatgaaatgcggttattctgtctgtgtgttgagatctaatccactgctttccatcttggcagaagtgatttgtggagaagggcaagaaggaatgaagatgagcctaggctctctcctgatatcttctgcaagaagagaaatggcacgagggcagggccccataggcccggacgcagtcgggcacaggtgggctggggccaactccatctgggctcaggcttaactgaggaggccaaatcagagtgcgcagagcagggcaggggggcaggggcaccgcaggttcgctgggaaacctcagaccttcttaggtgaacccaaatctccttgctgtgcttgtctcacagtaacacatcccagtcgtctcagcctatcggatgctaagtgcttcaagtttttgcatttcctttggtagcctggacttcatgcattaacagcatcaggtgagcccaaaccaagaacatccacatcctcacctttctccccatcccatctctttgactgaaggtcatcactgagtagccctataagctgcaatttccaggccttaaagggcctgggaaaggagacctacttccattctggactccctcactccccaccacacaaacttcagtcctacaggccacaggaattcatcttgacaccaggcacttcccatgagcccatgggtcagtctttgagcaagatcagatggcagcagctggccctgctcctggccgcctcctcccagttcgtccatttcacagagagcctgcctgtcagcagaggcaccctgctcccctctgccacactagagtgaggaagtaagaggatactccttttcttcatccccagctcacaatttaaacgctgaacctgcaggctataaagagacggaagttcccccatccagagactagacgaagatttgtggatgtttgagaaggcagagtggccactgcacccccggggctggtcctgcagcttcaaggtcctgaaccaataggacttcctgggccgtggggccagagatgcctcaggcactcccttgcattctctgtgcccaactatgctgagcgcagccgcgcaggttccctggatggaatggcaggaatgagcgcaccacattctccagggcttccctgccaggagcagcagtcacgagcacagggccctgccagccactccccggagtctgctccacgtcggctggtcacataccctgagcctctccagccctgccctaagtgaccagccttcagcagacacagggcctgggtgccctctggaaatctgtgtgtgccgagggtggccacatgctccccgaccagcggtgttgagggctctgtgggcaggagggtcccagggaactaacgacatgagggggtctgggggtgcaggctggggacctgctcagtgcaattctgtgatggttccttgcggttcaatctccctcactcccagttattccctcctagagtaaatggtggggtgggaaggagggggaagagccagcgctcgccatcagcatgccggggactgagtttcactctatgggaaatggcagcccagaggggctgtggagcaggatgggcctggggctgtctcagacaggtattttcttttgcttaacaggaagccccaaatctcagagatgaagggccccagaaaatcctgctggaaaaggagctgaattccaggtgaggtgaagcaaaactagcctaccacggcgggagggagggcttcctccaggagcagagcttaggagggagcccggcagtacctgcttcgccccggagcgccttctccacagccacgcccctttcctccagccgccgctgcctctcctccacctgctgcagctgccgctggatgatctatgacagacagcacagactgagcacccggctctccagccctgcttcaggaggacacacaactccacacccacacgaggggaaacacaggagttgccgctctggaaagggctctagtctgtgggcggtgcgctcagggtgtggcgtggagaccacctgcaccagaaccacctagcttgtgtagacgccaggctccgggccttgctagttagcatcaaagcgcgtggacgtgactcaagtagtgaccaccctcccaggagtgttgcagagacaggaagtggatgtaatctgtggcaggaggggcctgagtaccagaacctcagactgttctcacggcaagactgctagagtgctggagggggttcctgaagagtgcagtggaaatcccatctttacgataaaaatttaaaacagaaggccaggcacggtggctcatccgtgtaatcccaacactttgggaggctgaggtgggcggatcacaaggtcaagagatcaagaccctcctcgctagcatggtgaaaccctgtctctactaaaaatacaaaaattagctggatgtggtggcacaggcctgtaatcccagctactcgggaggctgaggcaggagaatcgcttgaaccagggaggcagaggttgcagtgagctcagcgccactgcgcgtccagcctggccacggagtgagactccgtctcaaacaaaacaaaacaaaacaaaacaatagaaatctacagtggtctagattcagggtctgtgcagcctgaaaacaagctggagaatgggaggagagctctgacctctgacctcttcccacaaaaatcccaggcctatcagaggctgaggggccacaaatggactcctggtgacagtcctcacaattgaatgaggtgacttacaatgattattctacaacaagggattcgggaaactcaatgcagggttcttcctttttttttttatttttatttttatgagatggaggctcgccctctcacccaggctggagtgcaatggtgcaatctaggctcactgaaatctccacctcctgggttcaagcgattctcgtgcctcagcctcccaaatagctgggattacaggggcccgccactatgcctggctattttttttttttttttttttttttttgagacagagtctctctgtgtcgcctaggctggggtgcagtggcacaatctcggctcactgcaagctccacttgctgggttcatgccattctcctgcctcagccacccgagtagctgggactacaggcacttgccaccacgcctggctaattttttgtatttttagtagagacgggggtttcaccgtgttagccaggatggtctcaatctcctgaccttgtgatccgcccgccttggcctcccaaagtgctgagattataggcatgagccaccgcacccagccaatttttgtttttttagtagagacggggttttgccatgttggccaggctggtctcgaactcctgacctgaagtgatccgcctgcctcagcctcccaaagtgctgggattacaggcattgagccaccacgcccagcctgctcttcccttttgactgacagctccaccaaggcagggcctctgtggctgcaccagccaaaggtgacctgggtggcagggaggcccgtctacctctgctctgctctgcactgtgcttgtgtggcagggagcagctgggtggatagggagatgctgcccaaccctcccatgcatgtgccctggtcccatcctccatggttttacctgggctcgatgcagccgcttaagctcctcctgcttggcctgtctccgagctgccttttgcacacgccgggtcagcttggcattcagttcctcctccgtgtaggttcttggctggagagaacaagagaaacttcctcagtcaggtgcacggaggcctgggacaggggtgggcagcaggccaacaggggcctggagaggtctgtcccccatgtcggagctggtacccgggcagataggacaagctgtcctctgtagagtagagtgctagcaggacgggggtgctgataggcagaaggcatgaggtctgcagagtccccagcctgcagcagccctcagtgccacgggcacacctaagatccacagagtgagacatttccccacctctgcacagggacaggaggctgagtggggaccgactgttaggcagttaaaacaataaagggacacacgctcctttatcactgagatcacctgcttcccaaataaggatgtctggtcattttaaaactttgtgggagtaaaaacattggtaggctgtttcaccaagcctcctgcttctaggaggcttacaggggaagcaaagagaaatcgggatccttttattttcctgtttggtatcaaaggtcactttcttcagaagagcagtatccatgagagtcttccaagaaatgacacccaagtagagagaacaaggatgtttctcttttaagtcaagtacagtctgaagaaggaattgtggaggtgaacctggactgactctggggtctgcagaggcagccgctggccgctaggaagaagagaggttgtggcctggccagggctgttgcgcctagcgccatcgagaacagaagaggcaatggcccaatccagtgcaagtccacggactggacagccacagccccctgcctacgtgggtgccaagggctcaagggagcatcagatgctttgaacaaaccatgggcaacaagaggggcaaagattggggatttgcctttattcataagaccctctttattgcctctaagaaaatgaaacaaggagactatataaaagttcttttttgagagagggtctcattgtcacccaggctggggggcagtgatacgatcatggctcactgcagcttcaaactcctggactcacgtgatcctcccgcctcagcctcccgagtagtcaggactataggcgtgtgccacctcgcccggacaattaaaacaatttttttttgcagagacgggatctcgttatattgcccaagctggtcttaatctcctgggcttaagtgattctcccacttcagcctcccaaaatgctgggattacaggtgtgagccaccatacctggccaacaagaaaacttttatagacttcaaagaagacaaacatgacttggggtctatactcataatcttcactcgaagagctcaaatgacagagggtcccctgaacagtcagtccctaagggtcatcagtggtgtttcagcgctgcaccttgctgatcagagctgagggctgctgaactgcccctctctggggtgcccagccccacagcggcagctgtgtcccgacccgaggaacctggaacaaaatgaccacatgcactccagccggtgaggagcaggtgtctcatcctccttcccactcatgacgtggctaacggaagtactgctgccagtgtgtgccacagccccatgcacgcacaaacacagttagtgaggatgtggctggagggccggggccggcgccgggtggttaatcacagacatgcatgcaacggtgaccagctgacaggaacgagacactacctttgatgcacatgatctcctgaatgccaaggcgtgtggtacataaattgacttttaagcggatggcatcagaaaacaaaacagaatagtaataataataatgattaacaaattaaaaattaagaacacagaaatggagcaaaataagttagaagttgaaaacaaacacacaagacttaaaacacgagattatttttcacgaagtcacacaggactgcctaggtaggaatctgggtgtgaagatcctagcggcggcgtctgagtggacctggttttgaatacggccggggttcactcttttattgggaagaaacagcttcttcctcaccacccccaaaactcgcctcatctcactgtcccttgtgtaaagttaaagccgttaaaatatgtgattctagatgcttttctccttgagtgaccatgtgcttgtggaaattcagcccacttcttcctgctgaatgctccgggggagtagaagtggggtgcgggaggaaagggggtcctgctctcagagacagacgcagcaaaactgggagggaaaccacccatctctcccaaaaggccctccgctggcagtgttcctgtgtgccacccagctgccatttcttgattgtgcccagtaaagggaattgaactaccatcagtaagtgctgttcaccaaaagcacgtcaggcagcagcaggagcctcttctcattccatcacaccttgtgcagagccgctctgagggtcaaggtgagtcacatctgctcttgtggtctcaccagccatattaaacggctgaaaggcattagggaaaccagggtgtgtggtggcgcacaagacagggaagtcctgagaattccaggcaggctgcaaccacagccgcgctccctgttgctccatccatcccatctgtggggcggccttgtgcggagctgtgcttcccaagcctacaggcgagggaagaataaatttgcctccttcaactttgagcacttgtgtcccgcctgcctcaggtggacccacctctcccacaaatcagagcaagagaatgttgttatgagaacaagccggttcagaaaaagagacagatgatttcccgaagcggctgcaaaaagcccacaggaactatggaccacaccctaaggaacagcactaacatcttcacctatggctgatgtcaatagcaatggggggcagtggctgccttcccacaatctacccattttctgggctgggaggggtgaagtcaccacccgtccctgtgtgcctgaggtggtggtcagccacaggagctgacattctgctgtgaatctggatgcggggtggcagggtacccaggccacaccctggtgggctgcagggctcaagaggcagctgcgttgcttgtatttaaagtcaaatgggagcaattagaaaagaggtaaacgcaagttctctcttgtaggtcgggctacaggtgactttttaaaagtctgaattatcctaaattttctataataaacattttaaataaaaaataagtattttgactggtttaaaagtttataacaaaacaaaacccaggctcttgtttcacagatgctgtgaggcgggaggaggcgtctgctgctggagtggccccaggatcctggcctggcagaaggggcttccttcttccgaggcaggtcaaaccccatcctcactttagagcccctgttccccacacttactttgaaagatttaaacccacaggaaagttgaaagaggaagacaatgaacacccacatgcctctcacctgtgtctgccaaaggttaccattttgccacacgcttcatctatatgtcatcttttatatgaccttttgtaatgaatcattggtagataccacgacccttcgtccctaaacgttttaggatggactttctaacaactcagacattttcctatataactttcctacataaaagtacattaacagtgcctttatcacttgcaaggaacttaacaatttgataatattacacatttatactatcatccagtcctcagttgaatttaattgttcccaaaatgtcctttatggctgtttttgtttggtttgttttcctctttagcatccatgtcttgaataggcacagcacccagccctcgctcaggctgactccataccatgcggaagtcaggtcagctgcccgtggctcggttgtctcccatgtcatctgtctcctaggttggccttcccctaggtcattcatcccctagcctggccgtcccgtaggtcatccatcccctagcttggccatcccataggtcatccatcccctagctcgactgtcccgtaggtcatccatcccctagccgggccgtcccgtaggtcatccatcccctagctcgactgtcccctaggtcatccatcccctagcttggccgtcccgtaggtcatccatcccctagctcgactgtcccctaggtcatccatcccctagcctggccgtcccgtaggtcatccatcccctagctcgaccgtctcctcgatcctcagccgtcctctaggtcggccatccgctagcctgtctgtcccccaggcttggctttggctttagtattccgtatgtgacgtctagcaaacggctttgcctctgtgggtgcccctagagcgtgaggccttagaggccgccctctggctctagggttccatgactggtgtccatggcttgttcctggggtcctgttcctgtttctcccttgctccttgtatctgctgggccctggggaggctcaccaagtaccagccttggcacagccaacccaggcagtaggtgcttcatggatggagaagcagtgggcatactacccaccacagcaacgtgagggaggtgggtggccaagctgacacaataggttgaatgtccacactgtcaccactgaggcagtgagcttgggaccacattctccattctttgctgaccccctaaagcagcacccatcaccagtattgggatgtgtttagggacccacatagaaacccaggggaattctcagctcagccccagtgcaactgggaaagctcgactggaagccttgatgaaggcacactctccctgtccctgagaaggcgcagatcccaaccctaactcagttgctggcctggctggggcaccaggaagcctggctctgtagagggtggagcaggaggagaggcctggctctctagagtcttctaggagaggggccaaagagccggaaaggccaagggagacgaatgcaccaaggaggggatgcgaaataaagcgtctggtttgctgagttatttaaagaggaactggatcaggctgcaggagccatcttcaccaaatgggcacgtgacgggctcaggcgcaccaaggcccgccctgactgggctattggacggcaggagagggcagactcaagtccaagccctagaagccttgcaatgaaggcatgctacattctcgggaagcttttgacgcaaaagggaggcaggaagcaggagacagccgggttgcccccagccaggaggaggagcacaggccccagggctggacagtggaggtggggtgacatgatactccgcagagctccgcccaccctgtatgctgacaggtgcctgttagagtgtgctctgattcctctccctccaccttcactggatccacccaaagtcctgggctctggaaagtgaggggctgagtcagacctagcagccctgcaggtcagttcctggaccagtcctttaagacgacaaaccctccctaactatcaaacccaccaaacgggcaggaccaggcacaatgctctgtgcctaaggtcccagctccgccagcagccctggactgcgcagtgttctccaggccctggggctggtgggctgctccccgcgggatcacctatgaagaaagacaatgccaggctgcctcctccagagaaggggagtgtgacacaggaatggctccagtcttttcttcttcacaagaaatcagaagcccttgctgtggatgccaacggccctagctcccatgtagaaagcccagcgtgaccgcctcagtgcatagggctgggtcagcagtcagctggctatgcgccactagctgtccatccctggcttgcggtttgctctccctctcctctaccccaccaaagcccaacaatgaacagacagggccccaggccctgtgaagccccctgcctgactacccacctctcgccgggacttctgtgaggacttctcaaggacatcgtcgctggagaggtctgagtcctcggagaagctcagctggcgccggagctgcagctctgtggagagagggaggccacgtgaggacagcgccagacagcaggcgcagccctctcctgctcctatgctcccatgtgcagccaaggaggccgggtggggggctggattcattttagtttaagggatccatcccccatcctggggagccaggagctgggacaccaacctttgcctgggcagggcagagctgacgccaagcgggtggcacctaggcctgcccagcccctcctggtagcactgccctctgccctgtgcacgagtgggcccctctggggtcgtctgactttaggaagggcacaaacctccacagtcttcctggtccggtttcaagctggctttgagaattctgttactaagctggctatgccctgtgaacccatggttcagtcccttctccaggtcagcacggctcctgagaaccctcggcggggagcgtgtgagtgtggatcctgagagccccagtgaccccagcccctcccgcacccctcccgctctgcctgcacgcggacccggctgctgacgcacctgcccttacgacgggaagcaccctgtgctttccagagtccaccgtggccccgctggagggggtgctggggcaggacttgtcgtcggccttcttcttcttgtccttcttgtacccggagaagacggacttccacagggacttgggtttggcggcggcttcttctaggaggttggagctgggcttctccgggggccggccctcgcctttggacttcttctccttcttgtttctgcggggggagaagagtgacgacctcttcttgctcttcccactggagccctcggatgaagtgaaagagccatctgggccccctgagtccgacggcggggagaggacctcctcgctggtggcttcatgcttcagggtgggctcctcggagcccctgagagtggggcgtgtgggggagtcaggccggcgctccttgccctgggagggtgctgaggacgccttgcggggcctgggggcgcctgaggccagctccatctgctgcatcctgctcagctgcctggccatggcgtcccgcagcgcctggctcttcacggacttctccctggctcgcatgcgctcctcggccaactccttggcttccgcggacaccaagggcagccccctcttctgtggctgcagcgtcccctccagagcaggcagcctcccgttctccttggccaggggcgggtggcgaggcttctcggggcgcggccagcaggacgggggcgtgaagaatttctcctgcaggcttgagtcctca

SEQ ID NO: 284 - DNA, 29023 bp, Homo sapiens
tttgaccttttcacattgctacctttctgtgagaggctacaggtttaaatagaatctgatggcagaatctctaagtgtaaacaagcatcttaggagtgagagatcaaggccacaaagtagccagagccctgagcacaactatagctacctggaaaatgtgatactagagtgttattgtccaaaagctagctaatcaggacaggagatccaggttctggagctccaccaggatagtttcattttctttttagaatcagcctgagtctctcctgctggcttattattggtccatcagcccagggtcactggaaatgctctcacaatcacccaggcatctgagacatttgagaatctccagaacaattgtgtcaggctgacaagagtggttaattttgcttctgtcttactgtaaaagaaatgaatcatctggtgtgtgttcctcccatcatacaagagatgtctttggttggtacccagatgagagtttctctggttccctggtacttgagtgaaaaacaaggaggaggtctggagactcaaacagataaattgattccatttcatatagtcattagaaaaatagatgaagcagtcatggtccctaccatgcaagaacttttagtcttgactatcaactggataaatgatttaattatgcatcatatggtgggtacaataaatagacatgtgcaaaaatatgggatatatttgcaccattttctttatattgttgagacttctgatgtctacacctgaacatatatttataaacaagagttattatttgcattttttagcttgctaagaacacttatttatcttctaaaaaactattttagaaaaccttaagagatttgttaaattgcttattagtatgtgatataaccttgagaggggagtggggtttaaaaagattaaaaattatacaaactctgagatttaattttttttttttttggtacacttaaaaaatgaaacagaactgaaaatactccccagtggcacaaaaaacagaattttacattagctctacaccctgtcccaaccctgatcagattcaccctttttgaagaccttatttaggtgtggccatactctggagtcttgtctcacagaactaactagaagagatcagagttttgggtgatgcatcctgttgcttttttagggttggtgctcatgattttctgaaacccaaaagcagataaatggaaaatataaaatatgatttatagggtcttaattaaaaaaattttttttaaaaccattgtttgcagagacattacatttagcaacttgttttctctccctgcagatatagttgttgattcacaaatcacaaaatagtaaatataaacacaacaaaaattcatctaaattatatgaaactctatctgtatccctctcatctgtctatatttatattctatacattttttaaaaaaaatcagtgacagccgggcgcggtggctcacgcctgtaatcccagcactttgggaggccgaggcgggcggatcacgaggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcaacagagcgagactccgtctcaaaaaaaaaaaaaaaaaaaaaaaaaaaaaaatcagtgacagataaacagaagaagaaataaaaatgctgggttcttattctaaatccttggaattattgaacacagtataaactcacagggttttatcagaattaaataatgggtcatcacagtgctctgtaacgtcttattgagaacacagtacctgcttaataaacattgcattagtacatgtgtacatgttgttttctaaatgcagacttactcagaaattgctgctttctgttttctctgtaaactttaaagagccaggaaataatatgatactttaagataaagaatggttgtcttcatttgtatcaaaagtatttgtgttgtgacaagactgctgaatataagggactctgtcctgtgcctcatttttctttttcttttttttctttttggagacgagtcttgctctgtcgcccaggctggagtgcggtggcgccatttcggctcactgcaagctccgcctcctgggttcacggcattctcctgcctcagcctcctgagtagctgggactacaggcaaccgccaccacacccggctaatttttgtatttttagtagagatggggtttcaccgtgttagccaggatggtctcgatctcctgacctcgtgatccacctgtctcggcctcccaaagtgctgtgattacaggcgtgagccaccgcgtccggcctgtgcctcatttttctaaacagtgctaataatgagcccagagagagcgacatcagcactgacaggggacttctttaaaacacccatttatggaccctttccaaacccacagaatcgtattacatagagtggggccaaatttacgaagtgatttataagctcattaaagcttgagtagcaatgcttaggtaagtggttataagcccagacttctaattagaatcacatggccaatttgcagaactctcttgtgcccttttcacagtttgcttaatgttctgggtgaaagcatctatttgttttaattaagtgtctcatgtgactctaatttgccagaatcaagtatgacgagttcaagatacatttatgagagttaagtgccgcctttgcactaaagaggggtccaggaacctgttctgtttgggtttgttaaggacaggacagtgtggccaatatttctattactgtagcagaaattgctagtgtctgtagcagaggagagaacctgaggaccaaaaaaataaaaagcacacacacacacacacacacacacacacacacacacacacactttttttctttttttttaagatggagtttcactcttgttgcccaggctggagtgcaatggtgcaatctcggctcactgcaacctccacctcccgcgttcaagcgattctcctcccccagcctcctgagtagctgggattacaggcatgtgccaccacgccctgctaattttctatttttagtagagatggggtttcttcatgttggtcaggctggtctcgaactccctacctcaagtgatccacccacctcagcctcccaaagtgcaggattacaggcatgagccaccttgcccagctgcagagaaacttatagttcctaaatcatttctgttataaaggacagaaatgggtagagtttttctgtcttgggctttctgcctttaggtgtggtggtaagagatgaacatgtggtgctcaaagtttttaaggcatattctcaagatgcaggtataattagtccagaaaatgtcatctgagaaataattctagaggaggaggagaaagagaaaaaatgactttttttcagctaaacatttctgacatcaagagctgtgtccgctgtgcctcctggattgccatgtgcttagtatgtgcaaatctttacttctaaacttgtgttttttctccctaatgagtttttcttaactacttttataaatgcttgtgatagtcaagggtctctgaaaaatatttcgtttctatatatcacagacttctctacatcacgacttcttatatgccgtgcagaattctcaccatgaattcgtgatctgcaatattaaaaatgttgtctttggctgttgaacatggataggtgtggattatctatctgtctgtctatctatctatctatctatctatctatctatccttctttctttctttttttttttttttgagacggaacctcactctgtcgtccccgctggagtgaagtggcatgatctcggctcactgcagcctccacatcccgggttcaagcaattctcctgcctcagcttcctgagtagctgggattacaagcatgcatcatcacactcagctaatttttgtatttttagtagagacggggttttaccatgttggtcaggctggtctcaaactcctgaccacatgatccacccgcctcagcctcccaaagtgctgggattataggcatgagccacagcatccagcaatgatactctagatttctatggggaaaacctgggattcttagtaaagatggagaacatgtaatgttgaggttccttctgtgttcttaatggcattacaccattaagaaaatgctcatttaaacagaatggcatttattacccaaaaagttctgaaaaaagtggctgggtgatgtggcttatgcctgtaatcccaaaactttgggagactgaggtggatggatcatgaagacaggagattgagaccatcctggctaccacggtgaaaccccatccctacaaaaaatacaaaaaattagccaggcatggtggcacgtgctagtagtcccagctactagggaagctgaggcaggaaaatcacttgaaccttgaaggcagaggttgcagtgagccaagatcgcaccattgcactccaacctgggtgacagagcgagactgagtctcaaaaaaaaaaaaaaaaaaaaaaaattaccaggagatacctgcttatttgggtgctaaagagagactacttaaagtcactattaaaaattgtagaacatggaaaatatctctatcttggactttccatataaccgatgttttcttatggttaaattgagactgtaatttactttagtggggggccatatctcagtagtgatgctgtgtccttctgggtgcatcagcacactatgaaaacttgttcgagtgcatttgatgttaataactcacttgcttaataaactctcttacagatttttgcactatagaggttttttttcctcttcatcattaagtatctttatgcagctgatgtccatacaccatcacatttaatctggcagctgccctgtttttgaggttttctttgtatttatctttctttggtaaatgaaagctctcatctttgtttacaggccagaaaaactgaaaaagacacaggctcttccacttactggatgtttgacaaaatgatattttggggccaaaacattggcattactggtaaacttggtagagattcagtaactcagactttatttcagatctcctgaaaaaataatctgcattaacatgatgtccagtttattgtacacattaaaatttgagtggtaccttctaagtcaacatgtctattttgtctgaaaaatgtaaagaactatgtctttttcatctgaaaaacatatataactcattctgtattatgtaaatatagtactcaaaaatgtgcatgttagtgtctatgccctcaattttatactttatcatccagacaagtatcatatatacactgatgttgtggatattatgccactctcttttctcagagttagagaatacattagaaaaggtttgtgtgttgacaattattttattggataatttcagtcactcttataagtcagaaccagttttttttactctctcattttgccttgagtcaaatggaaaattctgccaatggccactttgtacatatgtgtgtttgtgtgtcttttccagggactcttgacgtttaggtatgtggccatagaattctctctggaggagtagcagtgcctggacactgcacagcagaatttatagaggaatgttatgaaaacctggccttcctgggtgaggataactttaatacaaaattccttatataaactaaaggtttcatttctcttttgtagaatgttttctggtaatttatgctttcaaatttctgttttcaagaaaatcctggggatttgtctgtttagaaaagaatttcttcaagatatttcatcttgacctgaactttccacattcctgagcggatctgtgtccttcactttagattattggtaatttcagaagtttagttgcataaaatattgttactcacaccttaaaatctaattatcatcaccagtttttgattcagtagtaccaggcagtgaaattaagaacctacaaaattaattttttttttttttggagatggagtcttgctctgtcacccaggctagagtacagtggcatgatctcggctcactgcaacttccgcctcccaggttcaagcgattctgcctcagcctactaagtagctgggattacaggcacccgccaccatgcccagctaatttttgtatttttagtagagacagggtttcaccatcttgggcaggctggtctcaaactcccgacctcgtgatcccagcctcccaaattgctgagattacaggcgtgagccactgcgcctgaccaataaaagtattttctaaatagttaaacatttctgttataaattagtatattgggataaatttattagaatattctattatatcctctttactgaacacattactaagttggtaattggagaatatgagcaagattcatgttagttatttttaataaaacaggtattactgtctctaagccagacctgatcacctatctggagcgagaaaaagagccctggaatatgaagtgacatgagatggtggatgaacccccaggtaggttagagtgaatacaacagacaacatggatgagaggcccaaatcaagaagaaagcaagtctttaaagtgatttgggaagctgtgttcaaaaggaaatagtttctggaaagcctgaaatttttaaaaattatactctcacgtaggggcatcttatgtcttatgtttataaaatttctaagaattctaatttcccttcagtgttcttccttcaaatttacagtgacagctaaagtactattcatgacatacaaaaagagtgcacaatctgacttttttcttgtttttgtggacagagagatatctccataattttgagatactctatgttaaactattttttaagttctctttttacatcacgtctgaaatgcacgagagtgacggtttctgtttcactggttttcttgttcattttttctgcacatttcatcctgttttcattaccatagttttgaaatatagtttgaaattataaagtatgatgtccttctgctttgttcttttttcttaagattgctttggctattcaaagtttattgtagtttcatctatgttttagggttgtgtttttcattactgtgaaaaaaaaacactggaattttgacagggagtttattgaatctagagatcactttggataatatggcagtttcacaatacttattctttcagtagaaataaaatatttttaaatttatttgtgtcctctaatttttttcattgatatatctttcacttaaaagatttacaagctccttgtttaaatttgttctaaaattaattatttcattgctattgtaaataagattttttttctctcttttatcagaccgtttgttttaagtgtatggaaccataacttatacttgtatgttaattttatatttttagtttaaacaagttttaatgtactgtttatgttttttttttatatataagattacatggtctaccaacagcaatgttttacttttggtcttcaatttcaatgactttaaatttttcttttgactatttcttcatccacatactttcagtgctatgttaaaatagaagcattgacaataagaaacaattgttttgcaatggggtctgtaaatttaaaggagcaaacacctcttcaagattttataaactggtttcagagagcaaaaataaatttttgtttggcccccccaatgtgatagaatgccctctgggtttgtggtgaagaagggttgtagcttggtcttaaggctgctgggtttgcacaagggttcacctttagttgtcttgttaaaaggggcttggataggctgggtgcggtggctcatgcctgtaatcccagcactgtgggaggccgaggcgggtggatcacgaggtcaggagatcaagaccatcctggctaactcggtgaaaccccgtctctactaaaaatacaaaaaaattagccgggcgtggtggcaggcgcctgtagtcccagctactcgggaggctgaggcaggagaatggcgtgaacctgggaggcagagcttgcagtgaaccgagatcgtgccactgcactccagcctgggtgacagagcgagactccctctccaaaaaaaaaaaaaaaaaaaaaaaaaagggaaaagggcttggatagttgtagttttcattttcatttaatttttggacagagtgaatatctttcaggactttgctgtgtattgcagacccaggggcaggtttctgcagtcgggtctgcatatggtgttctttatatcaggatgtgatgagagtggctttcactgagtacaagagagaattttcccaggtcactttgggtttctacataggcagaaccggccatgaactgtggctcagggagctggaaatgagtcatggaactgcctcagggaccacagtaaaggccaaggtctgcaggcctctcagcatagctataaatgggtgtcttcctctaggcctctggaagagcaggacctcccccagactgtgactgggaagagtttgggatggttacagagtaagttcagaattctcactggaaccaagttaggtggaacgttttcttgtctgtagccaacaacagtagtcctgtagtttgccacctgaatgagggcctgccttctaaacagaattatcttcaatattgggctttagcagagtttcacaactcccttcctggatctcagaactctcttaaaggcacttttttttttttttttttgagacggagtcttgctctgtcacacagactggagtgcagtggcgaatgcagtggcacgatcttgactcactgcaacctccggctcccaggttcaagtgattctcctgcctcagcctcccgagtagctgggattacaggtgcccgccaccacccagctaaattttgtgtttttagtagagattgggtttcaccaggttggctaggctggtcttgaacttttgacctcaggtgatccacccacctcagactcccaaattgttgggattacaggtgtaagccaatgtgcctggccaaaggcacttatttttgagatggggtcttgttacataacccaggcaagttttagtattttgactgtaagcaattctttaatgtatcatgtagctgtcattactggtgtaaaccatgatgcgtgattctcttaaaaaggcattttcatcaggaatgactgacaaattttcttgctgtcaggggataagcaaataggatgccttttttttttttatcttgttaatgtcactctccatataaatttttactttattttctactttaaatttgtctgcaattttagattcagacatttagggcaatatactagaatttacgtgttgtgcctgaattaaattaggtaattagtatgcaggcaggcaaaaaggaattataaaattttcaaccacttttgtcagcctatatctaaataataacatagtttatttcccaaatatttgttttatatatgaggctctaaccatattctgctaaatatatgtataatttagcaatgtaaggtattatttgcttctatatttggattagttttattttgttcaaaaatagcaaacatttaaaacaaaaaattgtcagtagtttcttttaaaagcttatccattaaaggtttctcattagcatctcctgtttatgattgtatttccttttctctgaaattttattgccatacaatagatatcagtaatttaaaatgcctgccttccgggaatgcacagttacagtcaaacattgcagttatctagacaaattatttgttaatgtacattgatgttgccaactagattttatgagtaaacatttattattgtcttgtagttctatattgtggttttttactataaatttcttaatatcagtttattgtgtttttggttttacttatgtattataattttagataattggcaattctgtttgtatactttaagttaatgtggggtttaattaaaagataaatgggccatatgtctatcacaatcagatatgtgtgtgtttatatctgcaaatgtgaccccaatttttgttgtagcttaccttgtatatattctttcttagctcattctctttttctctttttttttttttgtttatgtttttgagacggggttttgctcttgttgctgaggctggagtgtaatgcagtatctcggctcactgcaacctctgcctccagggttcaagcaattctcctgcctcagcctcccaagtagctgggattacaggcatgtgccaccaggcctggcaaattttgtatttttctttattagagacggggtttctccatgttggttaggctggtctcggattcctgacctcaggtgatctgcccacctcagcatctcaaagtgctgggattgcaggcattagccactgggcccgacctcttagctcattttcaatgttggttttatcttgtctaagtgagtagccttggaaatagtctcattttcgtcatgtgtttaatgatgaatatgtatttcctttgtgtgagacaaacactttgtgatttggaggtaatttttaaaaagatttataatttggtatttttttcagttttttaaaaagtaactgtaaaaacatgtaacatgtaatttagtttcttaaatctatttaaatatacatgtcacagccaggcatagtggtggctcacatctgtaaaaccaggattttgagaggccaggacagaaggattgcttgagcccaaaagattgagaccagcctgggcaaaatgtggagacaccctctctacaaacattttttttctaagaaatagccaggcagggttgtgtgtacctgtggtctcagctacttgagagaatgaggggcagggttacttgagcctgggactgtgaggctgcagtgagccataattgtgccacgcactcaagcttgggtgacagattgagaccctgtctcaaaaaaaaaaaaaaaaagttgtgtatttcaggtatgttaactatattcacattgttatgcaaaagacttctagaaattttatatcttgtaaaactaagactcaatatccattaaataacatttactcattttatgctctctccatcccttaacaaacacccttccactttctgtttttatgagtgtgactattttatatatcttacgtaagtgaaatcataatatctatgattttactactggctgatttcagttgacataatattttcaaagtgtatctttaaatgtgtcaagatttttaagattttttttaaggctgaataatattccattgtatcaaatatgtcttgaaggtcctatattgcatattttagatatagattaataaatggaattgctgtatttgataataattttatttttaattataagaagtacatttataacataaaataatggatgcctgcttgttttctactgacaatcaacacgggtttcttttttttttgagacagagtctcactctgttgcccaggctggagtgcagtggcatgatctcagctcactgcaacctctgcctcccaggttcaagcgattctcctgcctcagcctcctgagtagctgggattacaggcacgtgccaccacacccggctaatttttgtatttttagtagagatggggtttcaccatgttagtcaatctggtctggaactcctgaccttgtgatctgctcacctcggcctcccaacatgctgggattacaggcgtgagccaccgtgccagccagtccaacatgatgaaaccccatctctactaaaaatataaaaattggccaggcattgtggcaggcgcctgtaatcccagcttcttgggaagatgaggcaggagaattggttgaacctggaaggcggaggttgcagcaagctgagaccatgccactgcattccagcctgggcaacagagcaagactccatttcaaaataaaaaaaaaaaaaagaagttatcttctatgtctaattaaaagatttttcacttatggtttcaggaaataatcgaacttaattttatcagtattgatattcagtatggataattcagtatggatattcagttttaaaattatcttttttctattgtgtgctcatgtcaattttgtgggagattatttggccatattcagaagggttatttctgggctctctgttctttcatctgtttatctgtctttttgtcagtaccacattgtgtttgttattgctgcttttaatatgtttcaaaatcagaaattataatgcacctttgttctttttcatgggtgtttggctagaggtcataataaaattttaacattttaaacaatatttctttaaaaaactgctgttgggatttttatgaagattatattgaatttgtctaccactgtaagttgtattgacatctttgaaaaactattattttttgattcctgagcaaacatatgttgaagagtgtgttttattttcttatatttttggattttttttagttttaatttatagcttaattcagttttggtcagaaaacacagtgtataattttggtcttcttaaatatatttgttgttgttgttgtgtttgttgtttttgtttggagacaggatcttactctgtcaaccaggctggagtgtactgccatgattttgcctcactgcagcctcaacctaccaggttcaagtgatctttcctcctcagtgtctcatgtagttgggactacaaacataaagtaccatgtctgaataattctttgattatttgtagggatagagtctcactatgttgcccaggctggcctcaaacttttaactccaagtgatcctcctaccttgatctctaagtgttgggattataggcgtgagctacaccacccagctggcattcttaaatttaataaaacttagtatgtgtcctaacagaatacaccagatgcaaataagaatattgtatattctcttgcttttgactggaaagttttgtactcatgtgttaaacctagttggtctgtaacatggttttgatgttcatgttctccaaaccttattctgcagtgtaatccttaatgttggatgtgagacctggtgggaggtgtttgggtcatgggagcaaagtcttcataaatagctggtaatcaaaatgtttacactccattaattcaaatgtaagcaggtttattagaagaacctggctccttcacctcatacttgctctgtctgttattatgtgacatgtacagttactcttcgccttcaaccatgattgtaagcttgctgagacactcaccagaagcagatgctggcacacactttttgtacagtctgctggattgtgagccatataatctttatttctttataaattatccactcaggtactcctctatatgcaaaatgattaatacggtctgcaatgtcgtctaggctttgttttcttgttgattttttaatctgaattttctatttattattaaaaatggggtattgatgtctacaattatattctatgtatttcttgctttacttttgtcaatatttgctttatatattttggagaccttatgttatatatacatatacatacagataggtagatggatataatcattatagatttgtggtaaatcaacctattttatgagtatgtaatatcagtgtttgtctcatgttagcacttgacttaaaacatatctaatacacaattgtagttactattttcataaaatgtagttgttttttttttcgctctgtggttttcagcctatttgacttagtgctgaaatgattcccttgtaggcaacatactgtttgcttttttcttaagctagtaaagcattttattttttctttttataatttcatttatttacttgtttattcatttatttttgagatagggtctcactctgtcaaccaggctagtttgcagtgttgtgatcatggctcactgcagcctcaacttacaaactcagaagattctctcatttcagcctcttaggtagctgggttacaagtgtgtagcatcacgcctagccagttttttgtgtatttttggttgagacagagttttgccacactgtcaaggctgttctcaatcttctgagatccagtgatcagcccgccttaacctcccaaagtcctgagattacatttctttttattaagtaatttaatttatatttaaaactgcttcttaaaaatgaagttattggttttattgtaactgttttatgtgttcctgagtggtatgttttttcttattcactgttttattgccttaaattttattttaattgtgtagtgatgtgcttcaattatttttctaattttgttttgcacagtttctttaattattatctttataatcatgttgtctattcatgtgttttcatgctgctgataaaaacgtaccttaccctgggcaaattacagaagaaagaagtttattggacttacagtttcatgtgattgaagagacctcacaatcatggtggaaggtgaaaggcatgtctcacatggtggcagacagagagcttgtgcagaaaaactctgccttataaagccatcagatttcatgagacttattcactatcatgagactagtacagaagagacctgcccccatgattcaattaccttccaccacatccctcccacaacatgtgggaattaaagatgagacttgggttgggacacagccaaaccatattattttaaaaaatggagtttacattaaatatcttaaaattcaaacaatatactttaatgacaacttcaattgaatataaaattatacctctatgtttttcagtttgttattaacattaaaaatttttagactgggtgcagtggctcacgcctgtaatcccaacactttgggaggccgaggtgggcggataacctgaggtcaggagtttgaaaccagcctgaccaacatggagaaaccctgtctctactaaataatacaaaattagccaggcatggtggtgcatgcctgtaatcccagctactcgggaggctgaggcaggagaattgcctgaacccgggagggagaggttgcagtgagccaagattgtgccattgcactccagcctgggcaacaagtgcgatactccatctcaaaataaaataaataaatataaattattttgtgtatttattaacatatttatgcagattgtattctgttttaaatattttacagaggagctttaagggttttatgcatcattattatgatagtaaagacttctatatttgtatatttacatttaatatagacttttattttatatgtggttttgttagagaaaataggaggcaggagacacccagtaggtgaaactggaggattttattaaggtgcaccctggcacaatggattcgcatccaaaaagctgagccttggactaagacagggcttgtcttttatacatgcatgggccatctagtggcgcaaagctcgtggtgcaagtaagcaggctcacagaagcagaacagaggcagttaatcaaacagtgacaggttatgctgaccttgcagcttcactggaagggaaacatgaatttatcaaactaaagcaggccttgcagctggtacatgtcttactcaagctcgtcttgtaaccttgtcatgttatccagaacagagaaactggagttgttgtgaagtaaccttgagtttcactaaggaaggattactaaggggaggaggaagctaggagaggaggaaaaattgtttttcccatcattgctctatgggaggagaggggataaggactagttttctttacatcctctacttcatttccccctttgacgctttttataaatgacgtttaatagcatcactatgacttaatttttcatgaaaaggcaagttttcttcatttggcaaaggctgatatttagttagggtcattagttgtgtagtagtttgcctggttacaagagcctctgtggccatttagatgtttttgacaaggaggggtaagagacaagggagtatgaggcagactcctaatatggctagaactattcttactaaggttttaaattctgcaagggatgagaactaacccctgaagagggaatctggagaccatcctttctaagtcttgactggaatatgggctaatttttggattcttgcagctttttgtttgacgacctttccgttgtcatcgatttttagacagcaattagttaggctgaactttctacatactcctccctcttgggctaggaggtagtctaaagccagtctattttgataaacggcatttctcatttctgtagatttccgagccagcaaatttaaggctcttgcagtatcattcgtaatgatctccagtactgcctgcaaccatatgatgtgatttagcatgtaaataggggtgcggtatctccatgatccatctgcccatgtggctgggccatagtattgcattattctttcaggtggccattcattatctttaattctttatggttattccccttttatttcttttgacctgacatgaacctccaactaggttctaggtaaggactttgggtcataacatatataaggctggccacttcctgggttgcagattgagtaggttatctggttgtgcgtacaagttcctcaatgggtccctgcatacctataataagtggtagaacagggttctagtcatggtgcttcctgtctacgtattgtcagtgcagtgggggcatccttctaaggattctccctttaacgtggttaaagggaatagcaaaagtaatgaataacatgtttatacctagcatggagagaagaggtcctttcctagaggaggaggttgagcaaagcaacaggacaatagtaaaacaattaatattacaaggaaagtttccagacgtaagatttctaaccacttttactttcctgatgatgcctcgagctttggccgtacatagacgagtcagcttctggggtgactagaacagggctgttgtttcctcaagcttccaccgtgtgtagactggtcagcttctgaagtgaccagagcagggctgttgtagtcttcattggcacctcggtcccatcataggatcagctgggttggatggcctgggtccttctggctggtccacttgtcctgggctaccagtttcagccaactgtggtgaatccaaggcacgattcctgcaactttagcagcagtgagtagacaagattacaatatggggcccatcccatatgggtcccagtgttgttggattccattttttaaactaaacagagtccccgggtctaaagggataaattgggtctgtgaggcttatgggcattctttcccatacccagccatgaattttttgcatggctattcttaaagcctgcatctctctccttaaggctaattcctctagttcacagagatcacctttaaattggccgaacaagatctcataggtgaatacccagtttgtttggtgggggtgtacctcacttggaggaggaccatgggcaggacctgatcccaccttagatgagtttcttggcaaaatttttttagtagctgtttgagtgtctggttcatgtgttccactttttctgagctctgtggccagtaggctatgtgtaacttccactttattttcaataactgtgttagttcttgaactatcttggctatgaatgctggtccattgtctgacgctagagtcaggggcagtcgaaatccagggataatgtctcttaacagtactttagttacttctcgtgctttctcagtcctgatggggaaagccttgacccatcctgaaaaggtgcagacaagtactaacatgtttcaatatccccctgcttggggcaacccataagcagattttcacaaggtgtggcccctatttcctgcattcccagggtcctggtgggcccctgtattaggttgttctgggcacaagttaggcattgttcacaaatggctcatgtgatggcagtgagccgtggcacatagaagtggtgtcctaatagcgtctctagtgccgtttttcccatgtgagttccttggtggaattgcctcacaaatttggaggccaccatttcagggatggctagtctcacattagataatttccaccatcctccttcaatatgttctccagattcttgggcaaaccaggccctgtcacttagagagtaactccgggtctcctggaggggagattgcgggaggagaggcatggtcagggcttcttttctagagtgtggagcagtcaatgctgtctgtcttgcttctctgtctgcttttccatttcccttggcctcctgtgtccctgacttctggtgtcctttatagtgcataacagctaccttctctggggctcatacagcatctaagagctgtataatttcttctttgtatttatttctttgcccctggcagttaaaactcctccttatatatagcaatgtggcaaaagcatatttggaatcagtataaatattgatctttttgtcctttgctagcaaaagggctcttgttagagctatcagctctgctttttgggctgaagtttctgtgggcagagactgagcttccaccaccaagtgcaatgttactactgcatacccggcccattggactccttccagtacaaaactgcttctatctgtaaagtactcgatatctgggtccctgaggggttggtctgtaagatctctccagcttgagaatacctcatcaactgtgtctatacagcaatgaagagggcctcctggttctgattgaattgggagcaaaatagctgggtttagagtgttcacagtctctagagttacgtgaggatttttacatagaagcccttgataccaactcattattggatttgataaccaatggtgccctctctgatcgactaatgttataactcagtgcgatactcaggtggttagttgctgtcctagagttagtttgtcagcttcccatgccagtagggctgtggcagctaatgctttgaagcatgggggccatcccagcgccatggagtccaactgcctggataagtatgccaccaggcgatgccatgatcccgtgacctgagttaggactcctatagccattccctttcactcatgggcctatagaaagaaaggcttagttagacctggcagtcctaaggctggagccctagttaaggcttctttgatttgtttaaatgccttttcctggtctgcctcccagaggagggacttcttccctgcctcccccacttctaatgtgaccatgggctcctgggggcctagggagaaggaacccggttggtcctagtcctcatattcttaattctctgccagcccgatcaggtcggcatctggctccctcagggtgtggcagcccttggctgggggcctctttgtttcatagcctttgccattctcttcattgtcctctggacattcatttttctagtgtcccttctttttgcactgcacacattgacctccccttagcctcagccatctcttggctcgctgttcaacttggcctcttccatgcccacacccatgtgaacattcgcgtccctttacaatgttaattttcctttttgtgagggctgccgctaacaggttggcctttttcctaagcctctgctctgtttccttttttgcctcttggtcacagttaatgtacacctcggtggccacttctataagctgggtggcattcatgcctgcaaaaccctctagcttttgcagcttctctctgatgtcaccctgggcttgccttacaaatgctgcattcaccatgcactgattttcagcagcctcagggtcaaatggagtgtaaaactaaaatgcctcacagagtctctcataaaactggctagggctcccatcaattcgctggagtacttcagagaccttccttatattgattgccttttttccaccttccctcaatcattgcagctgtgcttcttagtacctttgcaggcgctgaagctgggttgcgtcatttgggtcccagttgggatctgtttctgggaattggccctgagcatatgcctggacattaagggtgccttcaggcacactggcttctagccagcagagagctgcctgggctatcctttgacactccttcgtgttaaacagcgttaggaggagattcctgcaatctggccaggttggattgtgcattaggaagatagactgcattagatctatgaggtcctgggggttctccgtgtaggagggggtatgatgtttccagtttaggagattagtggtagaaaaaggctggtaaataaaagtctgttgccccccttggacctggccctgttcatcataataaataggtccctgtgttttctggaggggcatctgcaaagctctggtgtgggcaaattgaaggtggcctgcttgatcatcttgacttccttcttcacctcctgggacaggggctcagatttgcccctttagggtgtagcctggggcatgataccatctgagttgggctgctcagtggccagccttggtaaaggtgggtagattggtgcatagggagggggggtttctatctcctccggtggttcctccaaaactggtttctcctgtctttcctgtggctttccctttgtctctgtagcttccagcaaagctgatttttttttggtggcttaggctcagcttgagcaaaaagctgccaggcaagtctgcaaccatgcaggtcgagtctgtactatatttaaccatgagtcaatacaagggaactggtctaggtgccctgactgtcctctgaccccagttaccaccttaaatacatagccaattgtttccttatctacatttccttcagctggccatctaacatcaaaagagggccattgtatttcacagagagttctcagcctctgggggtcaacttaattccatagtccccgaataacctttcttaaagttccttaacatacatgctaatcgggtgggttttggtgacttccctcccatttcctccccaatacagcacaacacattcattcttccttttgattcagaccaattaaaccatcccccttgcaggagttttcagacactgcttagctttggagtttgttaatcccctcacaattactaaattgtggggcacctccataagccgtatgtggattgccactagtcctggttggtcccacaattctctcagagcgcacagtctatactaagagacctgtagcccccacatgtcactgtctgcattggttcctcccaaaaccatctctttcacacacagtcacacaccgtcctactcccagttttctctcctaactgacttcgcgagccactcttatgccctagtcacttggggtgtaagtttccctgagtttgcaaaccattcttgcatcctgtgtcagtctactagttacaccttggaaggtgatcaggctccccttccatccttatgggacggttcctgccttgggccccaaaaccttaccgtggtcctgtagtgcactgttcctggaatcatcctgtagccccttagattctgttgtgctgtctgggaggggcattgggttgtgggatagctgatcccttcttcaggtttaagttctcctgagggcacctgaggtcatgggtctctcctggcttggggtctcacacctaaaggcaaagtagacagcaaacctgtcatctccatctcctggctggctcaccaaagtgttgcagaaaacaggaggcaggagaggccagtgggtgaaactagaggattttattaaggtgcacactggctcagtggattcacacacaaaaagctgagccctggacaagtacagggcttgtcttttatatgtgcatggtggccatctagtggcacaaggctcctggtgcaagcaagcaggctcacagaagcagaacaaaggcagttaattaaacagtgacaggttatgctgaccttgcagctgcattgggaggaaaacaggaagttaacaaactaaagctgaccttgcagctgcattgggaggaaaacaggaagttaacaaactaaagcaggccttgcagctggtatacgtcttactcaagctcgtcttgtgaccttgtcatgttgcccagaacagagaaactggagttgttgtgaagtaaccttgagtttcactaaggaaaaattactaaagagacagggaagctgggagaggaggaaaacttgtttttcacatccttgctctttgggagaagaggggctaaggactagttttctctacatcctctacttcagttttatgatggtgttcattattattttatttttaagcaaaattgactcattatagcatttctttttttttttttttttttgcagagtctcagaatgctcttaaactcttagtctctagtgttctgacagccttgacctcctaaaactaagattacaggcatgagccatggtgcctggtcaccatgtacctttttttgtagaactgtgctagtggtgatgaacatcttcaccttttattttggaaattctttattttcatcttctttttaaagggaagtaaatttaaatcaagtattattggttagaaatttttttttattacatcaaaatttgggaagttttcacccttttttatcttcaaataacctctgtattttttttcttcattttcttcttctaagatttcctaaatctagttgatggttatctaataagttgtttgttttgttttgtttttgtttttgtttttgttttttttgagatggagtctcgctctgtttcccaggctggagtgcagtggcacaatctcagctcatggcaaactctgtctcctgggttcatgccattctcttgcctcagcatcctgagtagctgggagtacaggtgcccgccaccacgcccagctatttttttatatttttgtagagactgggtttcaccatgttagccaggatgggcttgatctcctgacctcatgatctgcctgccttggcctcccaaggtatctaataagttttacattccatgttttaactttgttttgcaattatagatttttgtgttatatattttagggtatgccaccacacattcattaattgtgttttgattttttagtatttattataattatgcatgctaatttttaacatcttataatttaaggcagtgtggaagaaagtcaaatatgaatgagctatacgtctttttccaatagaattatctctgtgtttgttttcctgtatacaaaaataaatgttatccttgtattttttttctaacttgtatatttgttgtgtaggtttgttgtgaatggttttctaattctgcgtagatgagtcatcataaaattctctttttttttgagatggactcttgctcttcttgcccaggctggagtgtaatggcgcgatctcagctcactgcaacttctgcctcctgggttgaaatgattctagtgcctcagcctcctatgtagctgagattacaggcatgtgccaacatgcctggctaatatttttgtatttttagtagagacagggtttctccatgttggtcaggctggtcttgaactcccaacctcaggtgatctgcccgcctcagcttcccaatgtactgagattacaggtgtgagccaccatgctcagcccataaaatttttataatttcaacaacctatttatttgtaaatctatatgatttctgtgtgggagaaacacttttggatttgaatataatttaaaactatcataactctgtatctcttttagttattattgtttatttcttgtcaaaaaaaaacaaaatttaccacaaaatatttttaaatatttagtcatatcaattatcttgacattgtcatgcaacatattgctagaatgtttttatcttgcaaagctaaatcttaacacatattaaacaacaagtactaatttttaattttttctttttttcttttttctttttttttttgagctggagtcttactctgctactcaggctggagtgctgtggcatgattcacctcactgcaacttccacctcccgggttcaagcaattctcacgcctcagcctcctgaatagctggaattacaggtgcccatcaccatgcctggctaatttttgcatttttagtaaagatgcagtttcaccatgttggccagcgtggtttcaaactcctgaccttaggtaatctatctgcctcagcctttcaaagtgctgggattacaggtatgggccaccatgcctggccacaattttttctgttttatagcgttttgcaaacaccactctgttttttgtttttaacagtataactacttcatgtatgtcataaaatctgtgtctttttgtgattggctcatttcattttgcataatgccatcaagatttatatttatagttggtagaatatttcctgcttttgaatactgagtatattccagaatatatatatatattttttgagacagtcttgccctgtcacctaggctggagtgcagtggggcgatcttggctcactgcaacctctgcctcctgggttcaagcaattcttttgcctcagcctcccgagtagctgggattacaggcacgtgccaacacgtttggctaatttttgtattttttttttcagtaaggacagggttcaccattgttggtctggttgatctcgaactccttaccttgtgatctgcctgccttggcctcccaaagtgctgggattacaggtgtgaaccaccgtgcctgggaagaatttttatatttcaaattatatctactgaatgatttattgaaagatatttgcattgcttttacctatttgcttacagtaacaatgctgcagcttttccgcgctacctgcagaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacactacatctataaaaggaaaagtgatggcatctatatcataaatctcaagaggacctgggagaagcttctgctggcagctcgtgctattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttctgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctccctctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaaaaaaaaaaaaaaaaaatgctgcaataattatgagtctataaatgactacttatatgaccatatatgtgaaagtttatatatgtgctgcattctattttattagtctactttttcacctttatactcatatcaaattgtttaatttggtagctttgtaatgtgttttgaatcaggcactttaatgcctgcagcattctttctttctttttttttttttaatattgttgggtagtttgtttttcttttgagtctctgtatacttttgaggttggtgtttctatttcttcaaaaatgcaatgagaaatttgaaaaatattgcattaaatctgtagattgcattgagcaggatggactctgcaatattaagtatttcaacctttgtgtaagagcacactcaagagtgtgttgtttagtttctatatatttgtaaatttttcagttttttttttttgcttttatcgttgtatattctcattccattttggtcatagaatgtagttcatagaaatttacttttaaaaaatttgataagacttcctttttgtcctaagatgtggtctttcaagggaaatgttgtatgagctattgagaagggtgtgtattctgatgttgttgaggagtgttctccataactctgtttggaataattgttttatactgcctttaagtagtctgttcttttattaacattctttcttgttttagttttattacaaaaagtgtggtattaaaatatattgttctaattatattgctttctgtgtgtttcttccattctgtcaatatttgctttatatacttggaaccctaatgtgagacacacacacacacacacacacacacacacacaaatttgtcatagattccctgtgaatgaatctattattttttgatgtccttctttgtttctttggagtttcaatttcaagcacattttataaaatattatactttctgacttaagatgtagcttgtgtgatattattttgactctttctgctcttatttgattaatgtttgcatggaatgtctacttccatcctgccacttacagtcttttttaattattagacttactgttattttattatgcattttatttgattattgcatctttgtgtcttattctctttccatctttgtgtctttttgatgtttgcattgatatgctttcgcttatttatttatttatttgtttgagactgagttttactcttgttgtccatgctggagtgcaatggcattgatcttggctcaccgcaatctccgcctcctgggttcaagcaatttacctgcctcaacctcctgagtagctgagattacaggcaggtgccaccatgcctggctaattttgtatttttagtagatatgaggtttctccatgttggtcaggctagtcttgaactcctgacttcaggtgatccacccgcctcggcctcccaaagtgctggaattacaggcataagccaccatgcccaacctcttttgtgtatttatacaaatatttttgtggtaccttggggactacatataatgtctaaaagatacaacaatacattttaatctggtagaaaaacaggttgcatacaaaaattcttctttattacatcttccctcaaatttgtcattgatgttgctaattatatcttatgttgtatgttcattaactgatgtttataatgatttctattcttttattgttcaaatttcagagaataattaaaaatgttttctgcgtcactaggataatgctaataaattctacaaagtgaatttgcatattttttctagaaaataatgtatttttatataattatgtgtagctttttgaatcatgttattttcagtaaaaggaactgttgttagcaccttttatatgtagggcatatgcagttccaatatacttttttagaatttcattactttggaaggttttttttttttatttggcaggatagattcactgatggtataattctcacttaataggtattttttttaacaactttttcatgactccataacatagttctttttttgagactaaacgtctctctatcccccagccaggctggagcatagtggtatgacttcaactcactgcaacctccacttcccaggttcaagtggttctccagcctcagcctcctgagtagctggtattacaggcatgtgccaccacacccagctaatttttgtcgttttggtagagacagggtttcaccatcttgtccaggctggccttgaactcctgacctcaggtgatccgtccacctctgcctcccaaagtgcctggattacaggcaggagccaccatgcctggcctggcacatcacttttatcttgcagcttcaaagataatctttttgtctttgactagaaattgtggttatatacatgtttgttataaatatctttctgtgatactagtttgttgtacttctttatttttacatcatattttcttttaggatctattagttttttttaaatttttttacctccacaatttttgtttttttgaaatcttaaatatttttgttcttgtcctcatttttctgaatttccatagttgtctctgttcctattttaatcaatgagaactattcaatttattaccaattattaaaagtaatttatacctctgattttttttatgctttctttcagaaaaatttataatatttttgctgggatcatattgccctattttgtatattttatctttgattgtgatttggacattaaaaaaagctacctgtcaaaatctttataatgttgttctgtcctggcatagtctgaaaacaattgttttggctggtgattatgggagtttctcacacatattcttaggatatgtgctgtctgaaattttgtgtttaatttttaattaacagagtttactcttgttattttgtaggagtcagaaatcacttgctacacctgttccttttctgtggtactgctgtcagtctgctgctctaccacttttttttttggtctcagctgactcaaactctcatttcaaaatatgccaccatttctttcagcacttt

SEQ ID NO: 285 - DNA, 37906 bp, Homo sapiens
ttcacacctataaggtatatgcaggattcgaaacaattattatatctattgattgtcccatgtgatccctccatatatcccaggagagagttggctactctcatgcccaggatatggatagataaattgaggctgaacaaatgaactactgcccttcctccaccaatgaaaaaagctacctttagtcaatagtgtcaatcagaaattgagggcaggattcttggtcctcagggtttcagcccccacctcttccacaacaaacccatatcctcttgcagcttcttttccagctgccattaggccaggagctattcctgcctttcgctgcccagagacgcaccctccctggctggcagcaactccagagggagcagtgcctgtatctggatactgctcctccctaacaaatgtgcacctgccagagctctggtgcccacacaaatccctcctgcctgggcagctactgtggcccctggctcagtcaagagcagcctggcctccgagctgaggccccctgtccaccacccaccgccagctcatccccaagcccccacacagcaccatgcttctcttccaaagcagaaagaccatcttctatcccaggtcctcacctgccactcccaaatcaatctgaccctctgaccacccgaacatctagtctgcacaaagttccatgatggcatcaggaattcactggtccaagtgaacaaatgagatgcaaacctgcctccaagaactcagattaagaccagtatggtggctcacacctgtaatcccagcactttgggaggctgaggcaggtggatcacctcaggtcaggagtttgagaccagcctggccaatatggtgaagccccatctctactattaataataataataaaaattagctaggtgtggtggtgcatggctgtaatcccagttactcgggaggctgaggcaggagaattactggaacctgggaggcagaggttgcagtgagctgagattgtgccactgcactggaacgtgggtgacagactgagactctgttccccaccaaaaaaaagccaacaacaaaaattatctgggcacagtggcacactcctgtaatcccagccacttgggaggctgaggaaggagaattggttgaatccgggaggcggaggttgcagtaagccaagatcacaccaccactgccctccagcctgggcaacagagccagactccgtctcagaaaacaaagaactcagattagtcaccactggctgctgtctgcccccaccgatgtgagaccacaccccggactcctgctgtggaaggcttctgctgaagctgtgataagcactgctttttgcagtaattcaaggcactgccggagcctagcttcttactgactgtcccataaccatcagggcagtgacctaggaggcagcgccctgatctgccagaaacacatgaagctggaaacttccagaaaaatgggtctggacacaggtgtgccaaccaactactaagggctgaactgtgtgcaccacagattcccaagttaaatatgataggactgtggccttacaagaggaagagatttcaatctcctgatctctctctctctgctatgtgaggacacagaagacacccaactcccagtcagaacccaaccatgctggcacccttatctcagacttccagcctccagaactgaggaaacaattgtgtgtgtgtgtgtgtgtgtgtgtgtgtgtgtgtgtgtgtgtgttttagagacatggtccctctccgttgcccaggctggaatgcagtgttcaatcatagctcactgcacccttgaactcctggcctcaagcaatcctcccaccttggcctcccaaagtgctggcattacaggtgtgagccacaaggccagccaatgtctgttttttttttctttttttttgagacagagtttcgctcttgttgcccacgctgtagtgcagtggcgccatctcggctcactgcaacctccgcctcccgggttcaagcgattctcctgtctcagcctcctgagtagctgggattacaggcatgtgccaccacggccggctaattttttgtatttttagtagagacggagtttcaccatgttggccaggctggtctcaaactcctgacctcaggtgatctgcccgcctcagcctcctaaagtgctgggattacaggcgtgagccactgtgcccagtccatggctggtctccagctactggccatgtgtgggaacatgtacctgaggtcttggcttctctgtagtcctagctactggggaggctgaggcaggaggattgtgtgagcccagaagctcaaggttacagtgagctatgatcacatcattgcatgacacgacacgaaatcactatacaacagagcaagaccccatgtctttaaaaaataaaaaacgaaaacaaaaacaaaaagcggctgggagtggtggctcatgcctataatcctagcactttgggaggccgaggtgggaggatcatgtgagctcaggagttcaagaccagactgggccacatagggagaacctgtctctacaaaaaataaaaaataaaaaactagctgggcacggtggctcacacctgtggtcccagatactcaggaggctgaggtgtgagaatcacttgcgcccaggagggggaggctacagtgagccatgatagcaccactgtactccaggctgggcaacagagtaagaccttgtctcaaattaataaaaaaataaaagaatataaggggaaatgagactaagcactgtggtagaatgggccccaaaaggtgttaaaattctcatccccaaaacctgtgaataggttacaaggcaaaaggtgctgaagaaatggtttgctagactatttaacaaaatgaagaaaataattttaaaaaacctgtgattaaattaaggatatttaatcagctgtgattaaagatcttgcagtagggggttactgcaaattttcaagatgggtctaaagtaatcacaagtttctttgtgaggagacaggaggttgagtcagaaagatttgaagatgttacactgctggatttggagaagaggaggggaccatgggcctaggaatgcaagtggcctctagaagctggtaaagtcaaggaagcaaattcttcctagagcctctagaaggaacatagtcccgttgaaccttggttttagcccagagacatccaatttggacttttgaccaccagaagtaagaactataagatgataaaatcaatatagttttaagtagctcaatttggggaattgattacagtaacaatagcaaacttatacaaacattaagaatttattcattcatccatgaatatttatttatttatttatgagtctcactctgtcacccaggctggagtgcagtggcacgatctcagctcactgcaacctccgcctcctgggtgcaagagattctcgtgtctcagcctcctgagtagctgggattacaggcacaagccactacgccaagctaattttttttgcatttttagtagcaatggggttttgccatgttggccaggctggtctcgaactcctgacctcaggtgatctgcccacctaaccctcccaaagtgctggcattacaggcgtgagccactgtgcccagtccatctgtgaatatttacagagttcgttctatatgctggcaacattggtgaaaaaagtctaagatgcctgctctcaaagagcttatttctttaaggatgtattttcagagagatattgcagtgaaagagaacagatatagagaacataaacacaagcggtctgtaatggctggctccctagcctctaacctccacagcagagtcacctaactcccaaccaaggcctcaagaccaccctggccccaaatggcagcaatgcaaagaaactgagccaagtgggcagcatgaggctcagcactcagccctccttccagctggccccactttcatcttgtgttccagtgaatgactgggtcaacacagccagttcctctgaagctggggttctaggcagaccacatgggtcctcctggggattaagagtcttatgtggtccttcaactccgtgctgagctgccttgatactaatcattgcccatcagcctgcaactctacccattgtccaatgggagactcctctcttgccaaaccccacctccctgcctggaggtccaactgtcccctccactcctctctaacaagaggacatgcccactgaactaccaactgtagtcaaccacctctctcggatactgcctgcctgctcctccctggttcgtgggtgtgcccctggcctgccttacctcagtggtctctggatcctagcctgagcagactttgtcctgatcaggctttccatctattctccacgcaaagccagtaagtcaatgccactgggtaagggatttcttctcgggatgatgcaaatattctcaaattgattgtggcaacagttatacaactctctgaacacactaaaaaccactggactgtgtactttaaaaaaagtcaggattggccgggcatggtggcccacatctgtaatcccagcactttgggaggccaaggtgggtggatcatgaggtcaggagttcaagaccagcctggccaagatggtgaaaccctgtctctactaataatacaaaaattacccgggtgtggtggtgggtgcctataatcccagctactcgggaggctgaggcagagaattgctggaacccaggaggcggaggctgcagtgagctgagatcctgccactgcactccggcctgggtgacagagtgagactccatctcaaaaaaaaaaaaaaaaaaggccaggcgcagtggctcacacctgtaatcccaggactttgggaggccgagactggcggatcatgaggtcaggagattgagaccatcctggctaacaccgtgaaaccccatctctaataaaaatacaaaaaattaggcgggcgtggtggtgggcgcctgtagtcccagctactcaggaggctgaggcaggagaatggtgtgaacccgggaggcagaacttgcagtgagccgagatcgcgccactgcactctagcctgggcgacagagtaagactccatctcaaaaaaataaataaataaataaaaataaaagtcagaatcatctcatctctgctcaaaaccccccagtagagccctccaggacctgccctcccctcctcctctcccccttgcccacatagtccctccaggcaccctggccccctcaatgtttcttctgtaagctcctgtttcagggcctctgaatcggctgctccctggactggaacacttgctcttaccccaagagctgttggctcattcctcacttccttcggattttgactccaatatcatcaccatcgagggtctccccatcacccaacgacaaatggcactccaccccagctacacaggccctaccactttctgccctcaccctgacactcacgaccagctgttccagcccacaggttggttgttttctccctccctccattggaattaaagctccatgtgggaaagggctttgttttgttcaccatggcatcttgacctggtacctagagaaaaaaaaggggggcacacaattgacactcagtaaatgtttgttgagtgaataaatgagtggtccaaatctgacccagtcttgattccagcaatgacacaagaaaaatattattgggttgtactttaattatcacaagaccctctaggactttagtttagtgaaatctgtattatcacacaataaaatcaatcctgataccagaaaaagatctgccttccttgacattcagattcattaaaaatgacaaaagaaatctaaacaactggaataaggagggttgggcagatattgcgggtaaaaaaaatcaatccaaagcttcctggtagaaatgaatatttcagagcaatgattttgcaataacaagttggcataaactgcaaataaccttttctgtggggccaaaatattaactatgcttcaggaaagcaggctttggtgcctcaaacaagatcagacctcatgtacctaatacagccatcattccagctaaagacgggatgcgggttgatatggtctggctctgtgtccgcacacaaatctcatattgaattctattcccataattcccatgtgttgtgcaagggacctggtgggagataattgaatcatggcggcggttcctcccccatactgctctcgtggtagtacatctcaagaggtctgatggttttatcaggggtttctgattttgcattttcctcattctctcttcgcctgctgccatccacggaagacaggacttgctcctccttgccttccgcgatgaagattgtgaggcttccccagccgcatggaactgtaagtccaattaaacctctttcttttgtaagttgcccagtcttagggatgtctttaccagcagcatgaaaatggactaatacacaggttatgtatttaccaccaaattctcatctatttggggtcaagggccacgcctcctatctgcttatacctccaggtcagagcctgcacttggccaaatgtatacacattgaatgaatgatccgtggtatccaacaccttgaagttatatatccataaaaataatcttaaacttaagtacacaatgcagtttaaaattttcagaacaatttctgagatcaaaacaattctcatgcatacagatcctctactttggtacattaaaactatcatcctaaatccacttatctcaatcttttcttaatgaaataaaagtgaactaaaagccagaagagtcaacagaatattcagttccaaagtatcaccccatataggactgttaattaagagagggttcaggtacccttacaatggagagagctgacagacaccatcttcacgaaaggatcaaacttgtcaacaaaggtataaactgacatctcttaaggtgatccactgacaagtgtacatcacctatgaaggtggcattctgaacaaaaaatctgaatctaataatgaagaaaatcagaggaagctagattgtaaacattctatgaaacaattggcataggccaggcatggtggctcaagcctgtaatcccaacactttgaaaggccgaggtggctgggtcacttgagatcaggagttccagaccagcctagccaacatggtgaaaccctgtctctactaaaaaaaaaaaaaaaaaatagctgggcatggtgtgcatgcctgtaatcccagctactcgggaggctgaggcaggagaatggtgtgaacccaggaggtggagcttgcagtgagccgagatcgagctactgcactgcagcctgggagacagagcgagactccgcctcaaaaaaaaaaggctgggcgggcaggctcacacctgtaatcccaacactttgggaagccgaggcaggcagatcacctgaggttgggagttgacgaccaacgtgaccaacatggagaaaccccgtctctactaaaaatacaaaattagccaggcgtggtggtgcatgcctgtaatcccaggtactcgggagcctgtgacaggagaatcgcttgaatctaggagggggaggttgcagtgagccgagatcgcgccattgtactccagcctgggcaacaagagctaaactccgtctcaaaaataaataaataaggaaacaaaaacagattaatctggtcccagtagtgtctccagattgcacgaacatttcatttttcacacagggtcaccagaataccatcaattttttggtatcactgtcaaaagtgatcctagcaccttctgaaataacgtgagctgccagattctcatttcaggaatgaccacaagcgaacatctgcatctgaccccaacctgcctgatgaccttacccgctacttcacaatcccgtccaggaaaatccctgggcacataacactgcaagtcccaggtgtccgctgaagggcgcctggcagtcactgcccaggggatgagaaatcacaggtgccttgtttggaactagagtctggaatctcgtcctccttccctctgctctggtccctcattgtttatgaagacctcagtcccctctgctgggagccccacctcccctttcagggccacgggccccagtcttcttgcctttcaaggaccacacaaataactgtgcctcccctcaaagcttttctcctccttcccaggtgaagtcctctctcctccctccagctttcagggcacggagcgttctttctggcattggaattctgagcaaccctcctagcaggcccagctcaagccgcagcggggaggaagagttcaaaggaagctatgccaaagatctcgaaggcttagtgggagacccagcaacaggtggcaccaggtctgggaaagagactcctagaaagcggagcgggtctcggagggggtggatttggcccgaggtgcccgcgatcagcgaacgagcgcccgcacggaggagccgggctgcagctcccgggcaaggggagcgcgagctctgactcctcagccgggccgggccgggccgctccgaggcccctcgaaggaggccgggcgccgtggggcaacccaggcagggcgcggaccaccgcctcccgggctcgtggggtgcagctctgaacctgaggcgctcggaagctcaaggccaagacccgctcgggtggtggccgagcgccctccagccccgggtccacctgcggccgctccctgcacctcacgcccagcggggctccggggacctgcctcagggaccggcgaggaagtgacgggtaaaggggtccgggagagcaaagggacccccctccgggaggacagcgcccacccagcaggtcagcggcacaccggggacgccgcccggactcggggcgcccataacccggcccacccgccgctgctgtcgcttccctagagctccatccggtcgccattcaccactgagttaagggaccagctaccgaagggcagcagcggccagccaccagccccctcgccgcctcagcgtcactccacccgagaccctcttcctccaatcccaacggcgctgccaagtgaccgttccctcctccaatgagaaggcgctccagccggcgggggcagagccagagttgttcccgcccctgaggttgcgcagggctagcacagacccaccccctcggacgcgcgctatcctggagaagcggcccctgcccgcgaactgcgcgctctgctctgcccttctctgcagcgccccctgtaggaaagaagggaattgcatgcggcccccccgcccccggccagagctgtggatttaccagggatctggcaaagcagtgatcagaacagatttgtaacgttgtagtatctaggtctggaccccaatatttacgaagtcttcatgagtagaatacgaacattctcaggccgggtgcggtggctcacgcctgtactcccagcactctggggggaggccgaggcgggcggatcacttgaggtcaggagtttgagaccatcctggccaacatggtgacaccccgtctcttccaaaaatacaaaaattagccgggcgtggtggtgcgcgcctgtatcctagctagtcgggaggctgaggcaggagaatcgcttgaatccgggaggaggaggttgcagtgagccgagatcgggcccctgcactccagcctgggcgacagagtgagactctgtctcaaaaaacaaaaaaaaaaaaaaaaaaagagagaaaacaaaaaacaagcaaaaaaaaattctctatttaaaccggatagtaaaaagcctatttttttttttgagacggagtcttgctctgtcgcccaggctggagtgcagtggtgcgatctcggctcactgtaagctccgcctcccgggttcacgccgttctcctgcctcagcctcccaagtagctgggactactggcgcctgccaccaggcccggttaattttttgtatttttttttttttttttttttttagtagagacgggctttcaccatgttagccaggatggtctcgatctcctgaccttgtgatccgcccgcctcggcctcccaaagtgctgggattacaggcgtgagccaccgcgcccggccttgtaaaaaacctattaaaaggctggtgtgggaccggaatgggagggaggttggcctgtggatatatagtctctgtacagtgcaaagtagttgttttttgttgttgttttgagacagggtctagctctgtcgcccaggctggagtgcagtggcacgatcttggctcactgcagcctctgcctcaagcaattctcattcctcagcgtcctgagtagctgggattacaggcatgcaccaccatgaccagctaattctctaattctctctctcactgtctctctctctcatgtgtgtgtgtgtgtgtgtgtgtgtgtgtgtctaagaatggggtctcggctgggcgcagtggctcatacctgtaatcccagcactttgggaggccgaagctggtgtatcacttgaggtcaggagttcgagactagcctggcctacgtggtgaaatctcctctctactaaaaatacaaaaattagctgggcgtagtggtgcgcgcctgtagtcccagctactcaggaggctgaggcaggagaatcgcttgaacctgggaggtggaggttgcagttggccaaggtggcaccattgcactccagcctgggcaacagagcaaaactctgtctgataaaagaaaagaaaagaaaagaaattaaaaaaagaatggggtctcactgtgttaccccaagctgatctcgaacttgtgcctgaaacaatcctccctgcctgagcttctcaaagtgctgagattacaagcatgagccaccttgcccagctgctaccgagttttaaatacaataaaaatttaaagaccttctattcaatacaacaaaactggatcacacttttgactcacctcccttcagagatcccgttaaaatgtaggcagagaaattgtgaaaaggaataagcaaggtcaggtgtggtggctcaagcctgcaatcgcagcactttaggaggccagggcaggaggatcactggagcccaggagttcgagactagcctgggcaatatagcaagatcccatctctacaaaaaatagaaaaattagccagacgtggtggcatatgcctgcaatcccagttactcaggatgctaaggtaggatgattgcttgagcctgggaggcggagactgcagtgagcagagatggtgctccttaactccagcctgggcaagagagggaaaccctgtctcaaaaaaaatttttttttaagtaaactgggtaatttataaagaacagaaatttactttctcatggttctggaggctgggaggtccacgatataggcgcctgtaggttgcgtatctggaaagggcctgtgcctcactgctggcactacctatgggtcctcacatggaggaagaaagtgaacccattctctcaagcctcccccgaccttttttttttctttgagacagagtctcactctctggcccaggctagagtgtagtggcacgttctcggctcactgcaacctctacctcccgggttcaagcgattctcccgcctcagcctcccgagtagccaggactacaggcacctgccaccacgcccagctaatttttgtatttttagtagaggggggtttcaccatgttggccaggccagctttgaactcctggcctcaggtgatccacccgccttgggcttccgaagtgctgggattacaggcatgagccaacatgcccggcctattagtgttctctcttgaagcctctgtttaggaagcttccttatgcaggttccctaccactacaattgacgttttgtatcaaccaagaaacctaaataaaataaaaataggaagtataaaaaaggtcatgaaatactgacctttaaccatgctgtctttttggtacatttcctagactagcagagtctattagaagtggaagaaactgctgggcgtagtggctcatgcctgtaatcccagcactttgggaggctgaggcgggtggatcatttgaggtcaggagttcgagaccagccatggccaacatggtgaaaccctgtctctactaaatatacaaaaaaattagctgagcctggtggcatgcacctgtaatcccagctactcgggagactgaggcaggagaattacttgaacccgggaggtggaggttgcagtgacctgagatcgtgccattgcactccactgcacttcagcctgggtgaaaaagtgagacactgtctcaaaaaaaaacaaaaaacaaaaaaaaggccaggcatggtggctcactcctgtaatcccagtactttgggaggccaaggcaggtggatcacttgaggttaggagtttgagaccagcctggtcttgaaatacaaaaaaattagccaggtggtggcaggcacctgtaatcccagccactcaggaggctgaggcaggagaatcacttgagcctgggaggcagagtttgcagtcagccgaaatcgcgccactgcactccagtctgggcaatagagccagactcagtctcaaaaaaaaaaaaaaaaaaaaaaaaagccaggcacaatggctcacgcctgtaatcccagaactctgggaggctgaggcaggcggattgcctgaagtcaggagttcgagaccaccctggccaacatggtgaaaccccatctctactaaaaatataaaaattagccagacatggtggcgaacgcctgtatttccagctactcagcggggctgaggcaggagcatcccttgaacccgggaggcagacatcgcagtgagccaagatcgtgccactacactccagcctgggtgacagagtgaaactctgtcttaaaaaaaaaaattaacaactcacacccctaaacacacatacattcctaatcccctgatccctctccactttaatctttggcactttctaatatgctaaataatttagccatttatcaaacttctcattcactggctgtgtcccaccatcagaatgcaagttcctacagggcaggggtttttgctttttgtctatcttggtcctgctctatctccagctcctccaaaagcccgatgcctggttggtgctcaacccataatgtgtgttgaatgaatgagtggagttcatgaagactgggatcagaataacacaagacttgcaggacaggccaggttctctggtcttaccccaaagggagaaaatgtgatgcatgagatctttcagtagagggcgtggggagaactggctacctgaaaatacaaagataaccagccctggagctgggcacagtggctcacacctgtaatcccagcactttgggaggctgaggcgggcggatcacctgaggttgggacttcaagaccaacctaaccaacgtggagaaaccccttctctactaaaaatacaaaattagctgggcatggtggcgaatgtctgtaatcccagctactcaagaggctgaggcagtaaaatcgcttgaacctgggaggcagaggttgtatgagccaagatcgtaccattgcactccagcctaggcaacaagagcgaaactctgtctcaaaaaataaaattaaaaataaataaataaaataaaaacataaaaattacctggacatggtggtgggtgcctgtaatcccagctgcttgggaggctgagtcaggagaatcgtttgaaccagggaggtggaggttgcagtgagccgaaattgtgccgttgcactccagcctgggcaacagagcaagactgtccaaaaaaaattaaaaaggccgggcgcagtgcttcatgcctgtaatcccagcactttgggaggccaaggcgggtggatcacctgaggttaggagtttgagaccagcctgaccaacgtggtgaaaccctgtctctactaaaaatataaaaattagccaggcgtggtggtgggtgctaccaccacctatacatggctaaatctatcattttcacttttgcatagctgatgggttaaaaatgttacttgatgttgttttaacctacgtttctttaattccctgggcagctaagcatcttttcatgcttattaatcaacagccttcctttttctcctttttattatcattattattattattattttttgagacggagtcttgctctatcacccaggctggagtgcagtggagcaatatcggctcattgcaacctctgcctcccgggttcaagcaattctcctgcctcagcttctgaagtagctggggctacaggcgtgtgccactacacccggctaatttttgtatttttagtagagacgggtttttgccatgttggccaggctggtctcaaactcctgacctcaggtgatccacccacctcagcctcccaaagtgctgggattacaggcgtgagccactgcgcccggcctggccttcttttttctttgttaaagggctttgctcatttttctgttgactttccgcttcctcttggttttgctcttatttttatggcaaatggtttctgctagcttgtcatctgttttttaacctactttatggtattttcccccaatgcttctgtaaaaaaaagtattgagacataatttatataaaatatttatatgtaaggtataaaattagatgtatagacctgtgagatcagatcaccacgtcaccacaagcaaattccaaaaagttttgtcctatttattatattttgaaagtgaattctttcttcacagtttgtggattttgtgtcttgttcaaaagattgtgtcctcttcaagactacatagtcttcatatttgcttcttttttttttttgagacagagtctcactctattgcccaggctggagtgcaatgacaccatctagactcactgcaacctctgcctcccaggttcatgtgattctcctgcctcagcctcccaagtagctgggattacaggcgtctgccaccacgcccagctaatttttgtatttttagtagagatgggggtttcaccatgttggccaggctggtctggaactcctgacctcgtgatccacccgccttggcttcccaaagtgctgggattacaggtgtgagccaccgtgcccagccgcttcttcatttttttttttttttttttgagatgcagtctccctctgtcacccatgctagagtgcaatgtcatgatctcggctcactgcaacctccacctcccaggttcatgtgattctcctgcctcagtctcccaagtagctgggattacagatgcgcaccaccacgcctggttaatttttttttatttttagtagagctgaggttttgccatgttagccaggttggtttcaaactcctggcctcaagtgatccacctgccatggcctaccaaagtcctgggattacaggagtgagccactgcacctgcctctttttttttttttttttttcgagatggagtgtcgctcttcttgcccaggctagagtgcagtggcgcgatctcagctcatggcaacctccgcctcccaggttcaagcgattctcctgcctcagcctcccgagtagctgggattacaggcatgtgccaccacgctcggcttattttgtatcatccttttttctttctttccttctttttttttttttttttttttaaattagagatgatgtcttgctgtgtcgcacaggttggagtgtagtgggatgaatcacagctcactgtagctcactgcagcctcgaacttctaggctcaagcaacacccccgcctcagcctcccaagtagctaggactacagccgtgtaccaccatgcttgaccaacttttaaaaatgttttgtagacacagggtctgctttgatgcaggctcagagcccagcctgacagtgctatcccacaagattcatttgcctggctggtcttgaactcatgtcctcaagcaatcctcctgtcccagcctcccgaagtgctgggattacagttgtgtcactgcccccggctttgttttttcttagggcataattaaaacctataattgcatgtttaatctgtttgattatttgtttagtgtctgcaccccagacaagagcaagggctatgtgtactctgtctcttactgtgtccctggggcctggtactgggcctgactcattgaatcactcaactggctgccctcttaaaatgggaggaataatgcttcctaggaatcaagccatgagaaactaatgttaagaagtggccaacattatctgaaccatgtgtaaccaagaggagaagtgccaagagccctgagcacataccctgggctaggtaatgggagcccttgtaagtctctcttccatcttacacggtctgatagatgctagaaatttgaacgtgtaggatcaattgcaaagtcaaaacttctgctggctctttgggtttccaaaggatggaaatatgaagtagatgctgttctctagtagagcatcttagtcagatgcggatatagaaagatctcagggccagaagggtatacaaatgtaatgagaatgaggagtctgattggcattgtccaatatggagccactggccacgtgtggccacggaacatgtgtggctggtcctaaagtcttcaacttggccagcagtgctgggctcagctggtctcgctcgtatgtctttatagctactcctctcaagtggtggactcagtttccccacctctgaatctgggtgaaccctggactcactttggccagtagaagatagcagaagtggctgcgtgctgatcagctggggctcgtgaggggctggctggtctaggatggcctggattgggacacctgaactctccttctcacggtccctgcttgtccagcaggttggcctgggctttctccgtggcagaggtagaggtccaaagcaaaggagcagcacacaggttctcttcaggtggaggaaagcagaggcgtcatcccagattatgcctctttcacataaaaatgattttcagcttaaggcaattaagaagcagaaaatacaggaaaagttcaggtttccctcccctttctgcctaaaggcacaatataaactctccttcactggagacaacccttaactttgcccagccagcggcggtaccagaggcaccgcagagaaatcctgctgcatcggcttcctctcagatatttacctatgcacagtttctcacctttggaggcctaaaactttctttttcctgttatttctctacaaatttattgtgtcttttggaatctgctgtgtaaggcagtgttctgagccactgtgttgttacttttcatttaggtttgtcctgtgtgatatatgctgcatgtattaatgaactgttcttgggcaggcacagtggctcacacctgtaatcccagcacttcggaaggctgagcacaggagttacagatcagcgtgggctacatactgaaacacatgtagccccccaaaatacaaaaattagcctggcatagtgatgtgcctgtagtcccagctacttgggaggttaagatgggcgaatctcttgagtcagtgatgtgggggttgcagtgagccaagatggaaccactgcactccagcctgggccacaaagcaagacactatttcaaaacaaacaaacaaacaaacaaacttcttgtctgtgaatctttttgttaaggagcctattttagtcccttttgtgctgctgtaacagaataccagagaccgggtaattgataattacagggatgagccaccatgtctggcctgatatacctcttactgaagacacagggggatataaaggtcaatggctttgatggagtgtggtgccaggggcataaggggaacagagtccaggctgtgtgtgcatgtgagtgtgcatgtgagtgtgcatgtgagtgtgcatgtgagtgtgcatgtgagtgtgcatgtgagtgtgcatgtgtgtgtgtgggggggtgcacgtgtgtggcacatgtgggatgttcagaagcaatatcaccagattttgctccctgctgggcccggggcaccccttttcagctgcttcaggatgcattccaagagaggagagtctaggggaaagaaagagtttgggtagaggccaagtcatctgaactgttaatagaaaaacattagacaaattaagcagactttatttgagcaaagaaaatttatgaatcgggcagcaccctgaaccagtaaaggttcaaagtgctccacccagaaacactggcaggccgaattttttggaagtaacacagagaaacagtctgatggggtacagctcagcatttgccttatatggacttggtctgatcagttggcagcctgtgactggttaaagcacagctgctgtgacttgctgagattcaactatttgttacaagaatatagtctcagttgggaggcagtttacttaaatattaagttaggttgcagttcaacaggtatggcagcagctttgggccaaattctctttttttttttttggagacggagtcttgctctgtcaccaggctggagtgcagtgcacgatctcagctcactgcaacctctgcctcctgggttctagtgattcctctgcctcagcctcccgagtagctgggattataggcatgtgccaccatgcccggctaattttttgtattttagtagagatggggtttcaccatgttggccaagatggtctcgatctcctgacctcatgatccgcccaccttggcctcccaaagtgctgggaactttgggccaaatttaattgaatttaaacatttctgccttttggtcagcctctcaattttgagagattgaccaaaaccttgggccctgactccatttcctgtcaccatcataatggacttgttttgtttcagtattgacttcacaatttcaccttagttgaatgattctttatgctttcttcatgtttttgttactctaaccctaacagaccagttgatttataaagaatggctgcataggagtatgtaagacttcccaggggagtcaacacatcagagagactattattattattattttattattattattatttttgagagggagtctcgctctgttacccaggctggagtacagtggcgcaatcttggctcactgcaacctccacctcccaggttcaagcgattctcctgcctcaacctcttgagtggctgggattacaggcatgcacaaccacactggctaatttttgtattttagtagagacagggtttcaccatgttggctagactggtcttgaactcctgacctcaagtgatccacccgccttggccttccaaagtgccgggattacaggcttgagccactgtgcctggcctattattgttatttaagatggagtcttgctctgtcaccctggctggagtgcagtggtgcaatcttggctcactgcaacctccacctcctggattcaagagattctcctgcctcaacctcctgagtagctgggattacaggcatgcacaaccacactggctattttttgtatctttaacagagacagggtttcactatgttggccaggctggtctcgaacttctgagctcaagcgatctgcctgccttggcctcctaaagtgctgggattacaggcgtgagtcactgtgcccgaccagggagactattatgatggctatgagtggacaatgccaagaaactgaagtacactccttatcaggagtttcaacaaacaactagtcaaaatcaaataactcaaagtccatgcaataaagatagttcaatagcatttgagtccaattggtcagtctttgttcagggatgatggtgattaaaggccaaaccctccccattaaatgagagatctacattagagaggtttcagagacctccacccagcaacagtgggcaagcagcgtttataaacagaaaaaggaagtggcattggatataggctgattggttacagctcaacctttgtctaatttggacacatctggtcagtctgcagtctgcccctggctgaaggctggctgctatgattggagaagactcctttcttcttacaagaatatactgcctggtcaagttgtagtttgtttacataataaataaggttacatcccagtcaaatcctccctacaaagtatcccctattctgacctctatcaccatagactagtttttctgctttaaataaatggaatcatgcaattaaagaaaaaagagagaaaaaatgaggttacagttcactagattgcaggacttttgaacaaatttattacttatttttttgatagagtcttgctctgccacccaagctagggtgcagtggcatgatctcagcttactgcaacctccacctctggagtccaagtgattctcccacctcagcctcctaagtagctgggattacaggagtgtgccaccacgccggactaatttttgcatttttagtagagagggggtttcactatgttggccaggctggtttcgaactcctgacctcaggtgatccacccgcctcagcctctcaaaatgctgggattacaggcatgagccaccgcacccggcctggcacacatttaatttaatttagcagtaacttactccctgcgcccagaagaggtaggggcaagagttgctttccatgaagagtgcacctgatgagaaggcagctccagaagactcaaaggaaaaccgagaatcaggagagaaagaaacgtgcagtccttgcctacttcaggggaggaccccaaactcccggttgatagtagggacctgcttccccatgcgccccagctccctctccaccatgcagtcgcctcctgggcctggcgaccacagttcggggcctgctctaaggcccagagttctcagtcaggcgatgcccagctgaagtggtctgggcctcgtggcagcaccagatccagggtgaggtcacgctgctggtccgcagagtacacaggccggtagcccagcagctgcagcgcgccggcgcacacctcctgcacgcgcaggatcttagtgaagggcaacgcgtggcgccaggcctgggagacgttgcgcgcattcctagacgaagtatggaaggcctcgattggcttgccgatccccgacccgtgggtgatgttgtggatccaggcctcgagctgtggcgtgagggtcaggccggtgaaggcgtagagtgcgcggatctctgccagcggctcccgcgccaggtcctcgaagcgcaccaggcggtagcggccgcgcaggaagggtggcggcttgagtgtggcggcctcggcgatgcgcacgtggctgcggcacacctcgcgaatcaggcgcaggtgagggtcggcctccacccacttgccgttggtgcccagcacgatgccgttgtcgcgtgccagtatcgggcccgccgcctcccgggagcgcagcacggcccgcgggtcgcgcaccaggtgcacgatgcgcaggttgagcgcggggtcgctgagcagcgggtagagcacctgcaggttgaagaagcgcacctccttgagcaccacgtggctgtaggagcggcaggcctcccgggccaggctgaatggctgccgcgtgcacagtgtcttgcatacgtcctgcttgctgatggtgcctcggggaaaggcgctgcaggcgggcggcgagcacagcgcgcggctcgttgcccagttgaaaaaggcggacaggtttcggctctgtggcatgtaggcatcaaacacgtccatgtcgcacaaaaagatagagcgcatcaggtcgcgcacggccatgtgcagcgttgccgcgctgccctgcgacagggtggtccacacatgccacgcgggctccatcaggtagaagacgtcggggtgctggctgaagagctggcccaagaaggatgagcccgagcgccacgaggacagcaccagcacgtgcacacgatcctcgccgccggctggggatgagggccctggccgggagatgatgaagagcaggaggcaggtggtctgtgccaggaggagcactgtcactgtcttgctggagaaccgtggcagccacatgcgggcggctgggggccttcgggtggagtgggcaactttagggacccgggccctcatgcccatcccatgccccaattactgcccagtgccctcagggatcagccctcagattcggctaccctacccattggacttcccaagactcccaaggtctcagtcgagcactttcccaggaatacggagtcaagacataggccagaatatagtctgtgctcacagcagaagtccagttgcagaataatgtgggatatcatcaaactgtctacctacccacccacccacctacttacatacctacaggctatctatctgtagagagaaatactatgtttcaaagagaactcctgtcttttgcttcaggatacctcttagagagacccttttaggttgtggagctaaaagggcttgatgggggcttcggtggatgtcagagcaccaccaggctcgccgaggttgaatcctggctctgccacttcctagcctatgatcttgcttatgaagatcacttaaatctctctgtgacggatcactttacccgtgtgtgaaagagggataattccggtacctggctcacaggatctggggggattggggggttattataatgaagatgggggaagggaacacgcagtcatgcccataactgaggattgcaccttttacaaggtgtgcttctgtattatataatttttttaacaggcaggtataaaacttttgtcagccaggcgcggtggctcacgcctgtaatcccagcattatgggaggccgaggcgggcggatcacgaggtcaggagatcgagaccatcctggctaacacagtgagaccccatctctactaaaaatacaaaaaattagccaggcgtgatggtgggcgcctgtagtcccagctactcgggaggctgaggcaggagaatggcgtgaacctgggaggcagaggtggcagtgagctgagattgcgccactgcactgcagcctgagtgaagagtgagactccgtttcaaaaaaaaaaaaaaaaacaacaaaaaaaaaacttttgtcattaaagataaacaagtaaataaagtggacaaagaacagcaactgttgtcatcactggtggggagtgaagtgctgtaggcagcatgggctccagaaggagggtgtcctggagccctgtgggtttgcaagaagatcagttgatggggagctgggatggagcccaagaagcagagaggtgagagcagagtactgtcctggccagctgaggggactcaccaccgtccagggctgctgggagagctgcaacgctgatcacaaatccatgggagatgtctcgacatctggcaaagcaggaaggagaggagatcagagccctacagagagacagccctgtacatagaaagctccccagggtgggaacagagctgtcctgcctgccttttgcttcaggataactcgtagagagacccttttgggttgtggagctaaagggcttgatgacggtttaggcggatgtcacaccaccaccaggcttgctgaggttgaataagtctgagtagggcatttctccaaatggctgggaactggcggggtctcctgatggatggaagcgagagagctggctccaaatcccagcactgccaatggggagctatgagacctggggcaagtgacttaacttctctgaggctcaatttgcacctctgtagaatgggatttgcaatatttaacctcttagagctgttgtgatggatgctgctgcaaacacctatgaggggagggcctggggaagcattccttacacacatgcccctgttactgttactgtccctgtgctgagctacatctggagagaaagaaccccctccacctggtgagtctccccacagaggagacacccacaggccacctacccttccaatccctgtatctcccaggccatcctctggcgtccaaccaccctgagcctttagtggaccttaagaatgtcacgcatttctcacagggtggaaggaacactgagccagcctcccgcattccaaggtcctaaagtgttcttctgtttgcacctgttgcatctgcaatgatctcaaggctgggtgactttggaagggaggagcctggaagttttctccttgctcctgcatcctttgctccttgcctgcccccttcccctgtccacactgcccactgagagaagccagggtctaacttgtgagcagatctcacctctgctccttcgcctcaatgcggggacaggagtgagcggaggatgcccaacacctctgtcacctgctgactcccgagctgccttctggatccccacacccactcctggaaaacctggaagatgaggagagtagccccccacctccgctacaagtgcaactgtactttttccagtgctggctgatggatggtgagctcccttgccaacagagtgccagaaaggaagggaactcatatttgctgacttcaatgatcacaagtgctaggtgcttcgagtccactggataacttaactctgggccctgaggtgggcatgatgatgtcaatttttcaggtgaaagactcaaggcttagagagacagcaagaaagctgggactccaggactcctgttccgaagctcctggcacttctgatcccaggctgtgggcctctcccacctgtgattgccccctgcagagtgcaggaccctgctgctctggcccaaacacagttgtcctggccagcccagcccttccctgggtagggaggatcttgatcccaagctaaggtgtttgttacctgtgttccaggaaagccagaggtcttcttaaggtggttgaatcactctatgccacacagagtctccagaagaccagttcctcactgggagctttctgataaggagacttacattcagcacagtggacaattggccaagggtgcaaagttagggagaaccagtcagccaggccctgtgatatgcactttcatcttcatgattgaatgttatcctcccaagtcccttggaggtagaaataaccatccctatctgttttaattgaagcagtggggctcagagacattaatacccagtaagaaagaggcagggcaggggcttaagtccaagagccagactcccagtgcagggccctgtggtgggtcacactcctaagcctttgtccagtgaactcttccatcctggaaggactgtccccttcccctctaaattcttccgttttttgattcttttctgggggcacatatttattacatgtttaatttttagaaaaataatacaaacaggtcacacgaaattaaaaaagtagagatgagggcatcgcagacttggcctcccaaagtgttgggattacaggcgtgagccatagcgcctggccaaaatgcaattcttgactgccttgcctctgtgtaaaaggagagagaaaggaagtcaacatttgcatttgctagacattggacacagtggcttacgcccgtaatcccagcactttgggaggcctaggtgggtggtcaccagacgccaggagttcaagaccagcctggccaacaaggcaaaacctatctctactaaaaatacaaaaattaggccaggtctggtggcaggtgcctgtaatctcagctacttggaggctgaggcaggagagtagcttgaacccaggagacacaggttacagtggccgagattgtgccattgcactctagcctgggcaacaggagcaaaactccatatcaaaaaaaaaaaaaaaaaaaaaaaaattaggccaggtgcggtgactcatgcctgtaatcccagtgttttgggaggccaagatgggtagatcacctgaggtcaggagttcaagaccagcctggccaacatggtgaaaccccatcgctaaaattagctgggcagagtggctcatgcctataatcccagctactcgggaggctgaggcaggagaatcacttgaacccaggaggtggagattacagtgagccgagatggcacaattgcactccaggctctgtgacagagtgagaccccatctgaaaaaacaaaaacaaaaacaaaaatttgggcccagtgccatggctcacgcctgtgatcccagcactttgggagcctcagcggggcggatcacctgaggtcaggaattggacagcctggccaacatggtgaaacaccgtctctagtaaaaatacaaaaattagctgggtgtggtggcgggcgtctgtaatcccacctactccagaggctgaggcaggaaatcacctgagcccaggagacaggttgcagtgagccaagatcaggccactgcacttcagcctgggtgacagagcgagactccgtctcgaaacaaacaaacaaacaaacaaacaaaaaaacatttcctaggcacctgtactgtcctggggcccagagggcctttcctaaagcctaacatcaaggccctagaggcagtgaggcacgactccacttcccctgagtctggttgcaaattaactcaccaagctattttttctcaagaatttcatggagagcttttgaaagccacaccctttgagacccaagtatggaataagaacccgcaccccgacccctgccctgcgcagtgaggattcccgcgtgcagccgaagccccagcaagacacttccaaaccagcgctagcaggggagatgaactttccacgttgctgatggaaaagccacccccagctcttcccgccaacccaggtctctggtgcaggacagaggagcgtcacagctgggccactggcccggcccccagcccaaccgagtgtggggacacctccggtggagaatgaagaaccaaagtacctcaaagcttggcgtgtctgccagagctggagcagcagccagagggacgcctctccccctgggctcagcaaaagctcccagacgtcgtctcttccaagttccaccgcacagccagctctttctcttcactgggaggttccgcaggggctgacttgctccttaaggtcccaagactattaagggacacccagtgaggctgggaaaggggctctaagaggcatggacgaagagtcgggggtaaccaagccactggaagctcctggagactcgaggcagagcgaatctgggaacagggcaggagtcccagaatgggatgttgaggatgggggtgtcctggggctaccacagggaaggacccggcgcagagctccctccggagcccggcactgcggcccgcgccctctactccccgcgcgccggccaacaaccctcggcgctgccccgcaatcttcagcgctgcctggtgaggagctttcagacgtggctgcggtcccagggtggccggcgggagccagggaaatgggagaaggaaggaaggagcaggttttgcccccagctccctctccccacccccgaccgaggggccatgtctcggggaggggcgctggccgagggcagagcaggagggcccaggtgggctggggctctaagaggcgcaccttttagccggggatgtcaaaggacgctggcagagtcacttctcatctaactgaccacaaatgaacgttgtaacccttcctcacccccccaatcgccagagaacctgggagctcctgggaggacaaaggccctagtgaaggaagtcgaatcttaatcttggccctcctcgctcttgggggcatccttgcagccaagggacttggaatccaaacccttcccaaggccccaacctcagccctaagccaagacccaggcaccttgatgacacaggaatccgtgctgcctcccggtgcagtgtcccagctgggaggagttgaaagaccaggtggccttaggagctgtgccctccctgccctagcctccgcccagaggcgcaggcttgataacatgttccaatgaatacaggatatgtttcagtaaataaaagctccccacccaccccttacaaataacagctcagcctggcctggtggcatatgactgtaatcccggcactttgggaggcaaggcaggcagatcacttgaggtcaggagttcaagaccagcctggtcaacgtggcaaaaccccatctctactgaaaatacaaaatttagccgcgcatggtagcacatgcctgtaatcccagctactaggtaggctgagacaggagaatagcttgaaccccggaggtggaggctgcagtgagcggagatggggccattgcactccagactgggtgacaaagcgagactccatctcaaaaacaaagaaacaaacgggcagagtccagtaatctgaaaaggatagagcattgggaggtcctttaatccatggtggtatctgaaacgaggagtccctgctgctgggagtagaaattagcagtctttcctggctgtggtttggcaatgaattaagatccttaacaatggtcataagttttctgaatgtatcttaaggaaataaaccagcaacaatgatttctacacaaggtttataaaagtgttgtttgtgatactaaaaaggttacatacaacaaaaaagattagaaagatgtgtgccagaatgccaaccataataacttctgtgatcaaactgctgtgatcccagcactttgggtggccaaagcggatggatcacttgaggtcaggagttcgagaccagcctgaccaccagggtgaagccctgtctctactaaaaacacaaaaattagccgggcatggtggtgggcacccgtaatcccagctactcgggagggtaaggcaggagaatcacttgaacctgggaggtagaggctgcaatgagctgagatcatgctgctgcactccagcctgggtaacagagtgagactctgtctcaaaaaaaaaaaaaaaaaagaaaaagaaaaagaaaagaaaaaccacctactgggtactatgcttattacgtgggtgatgaaataatctgtacaccaaacccccaggttgtacaatttagctatatacgaaacccatacatataccccatgagtctacaataaaagttggaaggaaaaaaaaaaaagaaataattgctttattagccttacatgatggaatattaggggggcctcatctgacttaagccgaaactgtactaatcatttggcaaaatcaggagtctttctgcctccaaatattcagtaataacatcaaaccttaacttagctatgggtcggagctgagttaataaaatcctctatatttctttttttttttttttttgagacggagtctagctctgttgccaggctggagtgcagtggcgcaatctcggctcactgcaacctccgcctccagggttcaagcgattctcctgcctcagcctactaaatagttgggatgacaggcacgtgtcgccacacccagccaatttttgtatttttagtggagatggggtttcaccatgttggccaggatggtctcgatctcctgaccttgtgattcacccacctcggcctcccaaagtgctgggattacaggcgtgagccaccgctcccggcctcttgctttttatttacctcttgcagctatgctgtgattcagagtcagaaactatcaacatctggtctgtaaataatttcatattcaccagacacagtcataattatccaacacgtagatttcacatggcatgtgaatcccactgaaaactcatctacctggggaagaactaggggactttcaccaaagacctcatggaagttccaaggtcgttaggcagagccttgtaaagcatggctgtagatgagtaataaagacaggtgtgtgcaacctctgccctccctattctttgccattccaaaccctttccctcgaaaaaggtacatgtgatcttccattttgacttttttatttatttatttatttattttaacagatagggtctcactctgtcacccaggctacagtacagtggtgcaatcatagcacactgcagcctcaagctcctgggctcaagtgatcctcccaccttggcctcccaaagtgttgagattacaggaatgaaccaccatgctcggcctcattttgaacattttaattagaaagttacaaaacatcatgggttctttatacaagatttgcattagaataatttaataaaatgcaaaccaatgtttatacgtatcttgtcatctttccatatctcattgccttatgtgaatttaaacaagaaactatttttcgtttagatcttaagaaaaaaatttaggcatataaaacagcctgaatattaaaaaaagacaagggggtcagtgttagggaattcctctgcttgaatacttcaaaatagctttgtttccaaaactgttttagtaagcctaaaggagcactaaaaacgacaactgatctccaaagtaaactgaggcacacactgaggggtgtgtttctgggtgggcatgaagcatggatcaccggggccatgtccttccagtggcaatgacctgcttgggatcaggaagcagctccatgtgttcttggaggagactgcccacatcctcaggaggtgaatgggctgaacaagccatcttccgtgtgcagaggccccttccagccatctctgctcctgcagacacttgcttagccacgagggtaatccactggactgcttggtattctgctagtggccaggctggactggcctgcccaggccagcatcctctttacactcttactgcttcttgtgtccttcccaaagctgcccgccccactctgatgggcaccctgttccttagtcaagggaaacgccagccgctgggcttcccgctagccttccaaataaacttgtggttgtcaggcagcgggagccaatcccaacaccaacccctgtcgcccctgtcctttgcaggaagggggagggctgtcaaggaggaggagggccaagtgcccaggctgttgggtgagggccagaaagaacctgttgtgacaatgctttcttcccccagtgctgctgagggggctgagaatgaaacagcccctctgacttcagcctgccatccaggggcacagacagagggaaaaatagggcaaagagcccagtcacagtacggcaaagatccagggctgctcagctgagctgatgacagatgactgactgttgggctggggcaggtggacggtccaagtgtccttcagcggccctccctgattgcctgtgctaatgcggcccttgcccttgggccctgcccctccaggtctccagttaaaggcctcagctctggaaatcaaagctgtgaatgggaaatggagaagcccaggggtgcaaagtgctagtgattggcatgtttgtcacaagagagccctgaaaagagtaagagtggctcacaacagaaggtagaaatgcacagtgtgttcctcagttcaacagaggaaaagtctctgcttgaccagagatgggactctttccaagatgtctgaactgactgcaattttctcctgaaattcaacgctaaggcaaagaaggaaaacccaaaaagctaattatagcctccaggaactctcagacctttccacaaactagtccctgacaattctgcaggagctctgaagatacggaactgtgtagagcaaaaccggaaagaaccgttgtctctgagggaaaagcacacaagcccgcaggtgtccgctgggctctttcaaaaggtcctaagatgttcccagaagatgacaatgaggcagccacggtcctgctgagtcttcagaaatggcctttctaggataagtgctccttacacaagtctccccggggcgtcactgtcacaggaatggtggtcaccacctgattctgaaacacgaagatcttgattctttcaaacacccagaggaagataagcaggatgctgacatactgcacccaggcgaactttaccatctcccagaatcctggctgataagtatggacagttaaggagtgaagggccacatggtgttaagtatgaagagaaaatccaagatggaattggctgtggcagaggtatctcgaaaggaggcaggacctctgtcatgtacacacccagatggaagctgacctgaacttggccaaatggtaaaaccagccacatttgatttgagctatttatataccaagcctgatgaccaacctcctaaacagacaactatgccaaactagattgatcatggactagagatatcctgagctgttaaccagccatccatccatcttctaaaatcttccagttgtgtaaacttggaacacccttagcccctgcctaattgcacctgtacggaacacaatttagctgcttcctaggtttgtgtctctggaattgtaattcctaagaccccagttaaaatgccttctcttttgtttgcttctctgcagtgttggtgttggtttcattttccattagtcgacctaagtcaaaattaaaccaaagtttaggtcagacagggactggcaagaatgtttcacataaccttagcataaaagggatatcatatgattattaagacataaatatggatgattcttacctagaagaattgcttggaaacaaataggaccaagacatgaattatttgttcctatatgaatagcagacatacagtcattttctgagacatgtagcctaagatgtcaaagacgcagccatttttatgaggctataaccctgtcatgatttccaagagaaaacctcccacgtctgttactacttgagacaactaaggaatcattcctctttgaaaactgagctaccattgattttttttaaattgttgtttgctttaagaggcagggtctcactctgtcaccgaggctggagtacagtggcacaatcatcgctcactgcaagcttgaattcctggactcaagcaatcctcctgcctcggcatcccaagtaactgggactacacatgtacgccactatgcctggctaatttttttttttttttttttggtagagacagggactcactatcttggccaggctggttgtgaactcctgggttcaaatgatcctcccaccttggcctcccaaagtgctgaaattataggcaggagccaccacatccagccttaacatggactctttaacagaaaggatatgaaatgacttccacagggtatcggatgatagcattaatcacaaatggagcatctgcggccctgcccaccagccagatggggttgggatcattcaggacggtggtaactgcaatgcaatcattaaccattaaccacgatggctgtttgactctggcagttgaaggctataaagattatttgatacctggaaattatcctgtgcttcagaactgaaagaaatcattcggaaggaaagagaaattgcatgtgcaaagctgatcacacattatttgttaaaataatagtcaaaatacttttgttaaaatacataaaaaacttggaaagagtttcttctacatgtgctgaatggctaactgaaggaatactatactgccactaaaagtagtatcacagctttgtagctgtgtggggaagtatttatattccaagtttaaataaataaaagtaacttggatcccaatgtgtttctacactacaatggctgtataaaaagatctgcagaaggctaaagaatgaaaggaatgaaaaaatagttgatttgtagggcaatgttttctacttttgttttaaaattccctctattattgcaataatgccactagtatatgccataaaatcagtaagcaatactggatttgcagtcatcccccttgtgagacgtctgtgtatagtctccatgatgtctgcttgccaagtaacactgtagatgcttttagagaaaacctcagccaccgaccagacaaacgtgccgagtccacacatgccatggcctagagctctgtaaggaataagcacactgtgccttctggcaggaaacaggggcactcctgttctcctgctggactgctaatgtggggagagtcacccacgttctctgtttttctctgaaaagcatgaacagcaatttgtctttggcatctgttataggtgtggataggtgtggtatggggaacaactcaattaggcttatattttttaaaagagaaacccactaagccagtggtgggataatgatggcatttaaccatcactagcctgctggaccatgggatgctggaggggtgggggcggtcccaggtctgaagatcaggacgaaaaagacaaatcctggacagcatatttgctcccatcgttgagcattcacgggttttgacattttcatcacaagggttccagttctgcttgtctctgttgcccccactaaccttgaaagtcctgagcagcggctgaatgggctctacctgtgactcaccgttcctctcctggtaggcagcaacaatatgggtgaggtcgtagtcataggcaaaggggctggtcccgttgatcacggatatctgggacacgggaggaggatgtggtgtgagcacctgggagactcctccccttttccttctacccttctgcccacccaggctggtcccacagagcaccctcttgttcttggtggcctactgcagtatcaataatcttttcttcaaagatgaataaaacaggctgctgcccacccaggctggtcccacagagcaccctcttgttcttggtggcctactgcagtatcaataatcttctcttcaaagatgaataaactctcttgcaacaatttaagcccatttactctcagtctttctttctgtggatggaaataaggggtcagtgtccatgttttacaggttttaaagctatttttaaaatacccctctttatctcagcgggagaaagaattccttaaattattttaacagaccgtattttcgccaggtgtggtggctcatgcctacaatcccagtgacttgggaggctgaggcaggaggaccacttgaggccatgagttcaaggccgtagtcaatgatgatcatgccactcactacactccagtttaggaaacagagaaagacttcatctctcaaaaaaaaataaaaataaaaaaaaataaaaagccaggcatggaagctcacgcctctaatcccaacactttgggaagcccaggcagatggatcacttgagaccaggagttcgagaccagtctggccaacatggtgaaaccccatctctactacaaagaaaacaaaaattagccaggcgtggtggcatatggctgtaatcccagctattcaggaggctgaaatcagaggatctcttaagcctgggagacagaggttgcagtgagccgagatcatgccactccactgtagcctgggtgacagagcaagactctgtctcaaaaataaaaataaaatacaaataaaaacccctacacaaagacaaaaaaaagaaaccatacttccaactcctttgtcattttcttggtcttttctgggtgctaagttctttatcacttttaaatatagagatatagataaaatgcaaaccataagcatataatcccttaaaggaggaaataattgcttgctgttaatgtaatctgatatatagacattcaaacaaaaagtgccatattcatttcatatgttgcagcttcctattctttacaacttatattgattatagtcagagcaacagtaaaacccactatatatctacaagtctgggtttatggctgtaataaccgataacatccctttttcattttcagaagtacctcagctcaacttctatggtccccattgtgataaaataaaagtgaggaatgagtgattagatgcatgagttctgcacacagacaggctctgttatctttcaagatttgagcctttgggaaaattaatcactttaagccccagttacgtcttctgcaaaatgagttcattatttaaacaagtatctctgtgagcttaccatctgccaggcagtgtgctaggcacggatgtgatagtatttgagatgccactgctgtcaaggctgagggagacagcaaataaacacacaaacacatatcctgagtaggccaggcggcaggagggagagtctggctgaggaatggtggaaggaggggctgctactgtagaagcaggtcagagaaggactgggcttggggatatctgaacagggacctgaatggcatggtccgataagccacatggatgcctggcagaggaaatggcaaaagcaaaagccctgaggtggcagctgcttcttgggtttgaggaacagcaaaaaggccaggggggctggaagggagcaagcgggggcagtgatgggacaagtggctggagtgcggggaaaggacaatgcaggcagctcagaggttgccatgatgattaaaggagatgatataggtaaacgcctgcactcaggggtggcatatgttatgagttcagtaaactatggctagtaatatttctgaaatactttacatgaacattttacatcatcattttacagtgtccttcggagtacatcctgcgtgtgaccaagcgtgtgtatggaagacacaatgtgtgtgtgtgcacccacgtggacctaaaagcaataagcaatttagttcttcgacaaacacagattttgtttctcttcccttctaggtgtaactatgcgtgtaccttctctgtagtttgaaaaaattcatggcaagaattctacagagaccctctttggtgccacccacaaagaaatgatatttctacttttcttttctttttcttttttttttttttttttttttttgagacagagtcttgctctgttgcccaggctggagtgcagtggcgagatctcagctcactgtaacctccacctcctgggttcaagcaattctcctgcctcagtctcccaagtagctaggattacaggcacgcaccacacgcctggctaattttttgtatttttagtagagacagggtttcaccaggttggccagactggtttcaaactccggacctcaagtgatccatccgcacatctccgcctcccaaagtgctgggattacaggtatgagccactgcgcctggcctgacatttctacttttcattcccctctttaaagaacttaatgaacagtaacacagagaaacaaaggagctggacaatgagaagcgctcttacgttgtatcgggcatctaggccaccacagctcagcggctgcttctgctgcagcctcaggtctccgttcacgtataactgggatcccgggacaggaaaggaggactggagaaacgccatgctctgcatcacgagggtcgccatcctctgaaatcattagaaggaccaacaataccaaccgccatcagatctgaagggctctgggtgctaagagtcacctgtcttggctgaaacctaagaggccctcacatacctagcgtagccatgcaggaaacactgcctagaaccttctgagctattaatagcccatgtcagttaatatgactagtgaaaaccattccattggcctaagttaaatcccaaactacatggggaagagggcccgctagagtgcgggtcttctagaaatcagaagaaggactctggtctactaaaaagacacaagggagaggacagcctcccagcggactgactcacgtgtaatcgataggagaaagtcaggatgagctgcacaccgagaacgtgctccgtggactgcaggggaagctccagcttaaaatgtaacatgtccgtcttcccatcctggttcctgtcttcttctctagtctaggaaacccaaacaggcccagcagccctggtcactaatgagtctgggaggaatccacatcacttctgtaaatacacaatgacccactgtcttgctgtacacaacaggcattatctcctccactaaaagagaaaagcagatagatgtaagtgcattaatactggggagagacacaaagtgcatggtccctgaacttcatatctgggcctttcaaatgttcactggccaaaataaatgggcaataacaaaaaacat

SEQ ID NO: 286 - DNA, 47135 bp, Homo sapiens
aaattatgggcatgaaagtaaggaaaagaaacagagatctgtggtggaaaaaaagacaaattatagctcatgaagcatatgtaggcagtaaaaaaaaaattggtatccactcccaccatccagtctgacctcatagtgaccctaaaatgatcagcagaaaaagacggttactgaaaagtgatcactgctgacgtggtccctctgcacaactctggatctttttgctacaagtgatcctttcccaccgtaggttcccagaaggattctactatggtgtagcagcattccaatctggatcccccatctactgattcattttgattcccaccattaatattatgtgaggaaaataatttttgtacttttttgggctaataaagtcatttgagatgaagaaatctcagttttcagaaactttcaattatttatttcctttagacaataatgtccttattgtaggtcttgttttagagaaacctccctcccttttctcttggatacttcctctctgccctgtttcatcagcttcggggagggatatctgctacccgggctgacgatcaagttactgaggcaatgatggattagtcattatgggtaggatgaaaagagcctgccttgtcttcctgtggattttcttcaattgggatctgggtagacaatgttgtgtaactctctgtgacggatccacgccttccggatctttagggttggacaggaagtaaagatcacatttctcaacttgcaacagaggacagtggccaggagacaactgccagactccaatacactgtggggcgtggggagaaactcatttcatttgatctttacaataaatgttaagccccaggtaggcagaacaagtattttcccattacatagatgagaaaatcatgggtgagggaggttagggcatttatcagaggtacagcaagtaatggtgaagacagaatttcagatcaggtctttgacttcaaatgtggtatcctttccaggactaaaatatccagacttacttacttatttatttatttttgagccggagtctcactctgttgcccaggctggagtgcggtggcacggtctcagctcactgcaacctccgcctcctgggttcaagcaattctcctgcctcagtctcctgagtagctgggattacaggcacctgccacttcgcccagctaatttttttgtatatttagtagagatggggtttcaccatgttggccaggctggtctcgaactcctgacctcgtgatccgcccgccttggcctctcaaagtgctgggattacaggtgtgagccacgacacccggccagatttatttaaaaattcaaaaagaagacagtgggttggagaagtctttttgcaaaacggcagcaccaggcatcaaagtctgtatactcgcctgtgtgcataattccgctccacgctgagagagggcccagatgtggctcagcaccatcaatagtgtctacttgttaaattcactcattaatctgctatgaactttttgaggccctacaggcactatttcagatgatgagaatataatctaaacaaaacagacaaagtctccatcctaatggagcttatgttcccgaccaagaagacagaaaatagattcataaatatgcaacaatatcaaatagtgatgagtgccacagagaaaaacaaggcaggctaaaatgaaagaataatgaaggtagaatttaacagaaagttttacagaaaatattcaggatgacctgacttgttggagacctgaaggaagcgaggtgatgaggtgatgtggtgcagcaatgtctcagggaagaaagatctagattcaccaagtgcatgtgctctaggtgcccatggggccagcagagctggcagaatgggtgagagggagagcaggacggagacaggggacagagaagtgaagacacaaagggtgtgtctcccaaaaacaacctgtcactaagctagactctcacccctatgggctagcaaggtttggctctgttatcacttggacctctgaagaaatcaattagctaattccatttagttgaaagtaagcctaacgtatgtgcaacagctacaaaggcaggcattcaaaggctactaattcctcaacacaaactccaggtcactatctaacctcccactggtgcctggccaagagaattcacaaaggacacaaccacttcacacctataaggtatatgcaggattcgaaacaattattatatctattgattgtcccatgtgatccctccatatatcccaggagagagttggctactctcatgcccaggatatggatagataaattgaggctgaacaaatgaactactgcccttcctccaccaatgaaaaaagctacctttagtcaatagtgtcaatcagaaattgagggcaggattcttggtcctcagggtttcagcccccacctcttccacaacaaacccatatcctcttgcagcttcttttccagctgccattaggccaggagctattcctgcctttcgctgcccagagacgcaccctccctggctggcagcaactccagagggagcagtgcctgtatctggatactgctcctccctaacaaatgtgcacctgccagagctctggtgcccacacaaatccctcctgcctgggcagctactgtggcccctggctcagtcaagagcagcctggcctccgagctgaggccccctgtccaccacccaccgccagctcatccccaagcccccacacagcaccatgcttctcttccaaagcagaaagaccatcttctatcccaggtcctcacctgccactcccaaatcaatctgaccctctgaccacccgaacatctagtctgcacaaagttccatgatggcatcaggaattcactggtccaagtgaacaaatgagatgcaaacctgcctccaagaactcagattaagaccagtatggtggctcacacctgtaatcccagcactttgggaggctgaggcaggtggatcacctcaggtcaggagtttgagaccagcctggccaatatggtgaagccccatctctactattaataataataataaaaattagctaggtgtggtggtgcatggctgtaatcccagttactcgggaggctgaggcaggagaattactggaacctgggaggcagaggttgcagtgagctgagattgtgccactgcactggaacgtgggtgacagactgagactctgttccccaccaaaaaaaagccaacaacaaaaattatctgggcacagtggcacactcctgtaatcccagccacttgggaggctgaggaaggagaattggttgaatccgggaggcggaggttgcagtaagccaagatcacaccaccactgccctccagcctgggcaacagagccagactccgtctcagaaaacaaagaactcagattagtcaccactggctgctgtctgcccccaccgatgtgagaccacaccccggactcctgctgtggaaggcttctgctgaagctgtgataagcactgctttttgcagtaattcaaggcactgccggagcctagcttcttactgactgtcccataaccatcagggcagtgacctaggaggcagcgccctgatctgccagaaacacatgaagctggaaacttccagaaaaatgggtctggacacaggtgtgccaaccaactactaagggctgaactgtgtgcaccacagattcccaagttaaatatgataggactgtggccttacaagaggaagagatttcaatctcctgatctctctctctctgctatgtgaggacacagaagacacccaactcccagtcagaacccaaccatgctggcacccttatctcagacttccagcctccagaactgaggaaacaattgtgtgtgtgtgtgtgtgtgtgtgtgtgtgtgtgtgtgtgtgtgttttagagacatggtccctctccgttgcccaggctggaatgcagtgttcaatcatagctcactgcacccttgaactcctggcctcaagcaatcctcccaccttggcctcccaaagtgctggcattacaggtgtgagccacaaggccagccaatgtctgttttttttttctttttttttgagacagagtttcgctcttgttgcccacgctgtagtgcagtggcgccatctcggctcactgcaacctccgcctcccgggttcaagcgattctcctgtctcagcctcctgagtagctgggattacaggcatgtgccaccacggccggctaattttttgtatttttagtagagacggagtttcaccatgttggccaggctggtctcaaactcctgacctcaggtgatctgcccgcctcagcctcctaaagtgctgggattacaggcgtgagccactgtgcccagtccatggctggtctccagctactggccatgtgtgggaacatgtacctgaggtcttggcttctctgtagtcctagctactggggaggctgaggcaggaggattgtgtgagcccagaagctcaaggttacagtgagctatgatcacatcattgcatgacacgacacgaaatcactatacaacagagcaagaccccatgtctttaaaaaataaaaaacgaaaacaaaaacaaaaagcggctgggagtggtggctcatgcctataatcctagcactttgggaggccgaggtgggaggatcatgtgagctcaggagttcaagaccagactgggccacatagggagaacctgtctctacaaaaaataaaaaataaaaaactagctgggcacggtggctcacacctgtggtcccagatactcaggaggctgaggtgtgagaatcacttgcgcccaggagggggaggctacagtgagccatgatagcaccactgtactccaggctgggcaacagagtaagaccttgtctcaaattaataaaaaaataaaagaatataaggggaaatgagactaagcactgtggtagaatgggccccaaaaggtgttaaaattctcatccccaaaacctgtgaataggttacaaggcaaaaggtgctgaagaaatggtttgctagactatttaacaaaatgaagaaaataattttaaaaaacctgtgattaaattaaggatatttaatcagctgtgattaaagatcttgcagtagggggttactgcaaattttcaagatgggtctaaagtaatcacaagtttctttgtgaggagacaggaggttgagtcagaaagatttgaagatgttacactgctggatttggagaagaggaggggaccatgggcctaggaatgcaagtggcctctagaagctggtaaagtcaaggaagcaaattcttcctagagcctctagaaggaacatagtcccgttgaaccttggttttagcccagagacatccaatttggacttttgaccaccagaagtaagaactataagatgataaaatcaatatagttttaagtagctcaatttggggaattgattacagtaacaatagcaaacttatacaaacattaagaatttattcattcatccatgaatatttatttatttatttatgagtctcactctgtcacccaggctggagtgcagtggcacgatctcagctcactgcaacctccgcctcctgggtgcaagagattctcgtgtctcagcctcctgagtagctgggattacaggcacaagccactacgccaagctaattttttttgcatttttagtagcaatggggttttgccatgttggccaggctggtctcgaactcctgacctcaggtgatctgcccacctaaccctcccaaagtgctggcattacaggcgtgagccactgtgcccagtccatctgtgaatatttacagagttcgttctatatgctggcaacattggtgaaaaaagtctaagatgcctgctctcaaagagcttatttctttaaggatgtattttcagagagatattgcagtgaaagagaacagatatagagaacataaacacaagcggtctgtaatggctggctccctagcctctaacctccacagcagagtcacctaactcccaaccaaggcctcaagaccaccctggccccaaatggcagcaatgcaaagaaactgagccaagtgggcagcatgaggctcagcactcagccctccttccagctggccccactttcatcttgtgttccagtgaatgactgggtcaacacagccagttcctctgaagctggggttctaggcagaccacatgggtcctcctggggattaagagtcttatgtggtccttcaactccgtgctgagctgccttgatactaatcattgcccatcagcctgcaactctacccattgtccaatgggagactcctctcttgccaaaccccacctccctgcctggaggtccaactgtcccctccactcctctctaacaagaggacatgcccactgaactaccaactgtagtcaaccacctctctcggatactgcctgcctgctcctccctggttcgtgggtgtgcccctggcctgccttacctcagtggtctctggatcctagcctgagcagactttgtcctgatcaggctttccatctattctccacgcaaagccagtaagtcaatgccactgggtaagggatttcttctcgggatgatgcaaatattctcaaattgattgtggcaacagttatacaactctctgaacacactaaaaaccactggactgtgtactttaaaaaaagtcaggattggccgggcatggtggcccacatctgtaatcccagcactttgggaggccaaggtgggtggatcatgaggtcaggagttcaagaccagcctggccaagatggtgaaaccctgtctctactaataatacaaaaattacccgggtgtggtggtgggtgcctataatcccagctactcgggaggctgaggcagagaattgctggaacccaggaggcggaggctgcagtgagctgagatcctgccactgcactccggcctgggtgacagagtgagactccatctcaaaaaaaaaaaaaaaaaaggccaggcgcagtggctcacacctgtaatcccaggactttgggaggccgagactggcggatcatgaggtcaggagattgagaccatcctggctaacaccgtgaaaccccatctctaataaaaatacaaaaaattaggcgggcgtggtggtgggcgcctgtagtcccagctactcaggaggctgaggcaggagaatggtgtgaacccgggaggcagaacttgcagtgagccgagatcgcgccactgcactctagcctgggcgacagagtaagactccatctcaaaaaaataaataaataaataaaaataaaagtcagaatcatctcatctctgctcaaaaccccccagtagagccctccaggacctgccctcccctcctcctctcccccttgcccacatagtccctccaggcaccctggccccctcaatgtttcttctgtaagctcctgtttcagggcctctgaatcggctgctccctggactggaacacttgctcttaccccaagagctgttggctcattcctcacttccttcggattttgactccaatatcatcaccatcgagggtctccccatcacccaacgacaaatggcactccaccccagctacacaggccctaccactttctgccctcaccctgacactcacgaccagctgttccagcccacaggttggttgttttctccctccctccattggaattaaagctccatgtgggaaagggctttgttttgttcaccatggcatcttgacctggtacctagagaaaaaaaaggggggcacacaattgacactcagtaaatgtttgttgagtgaataaatgagtggtccaaatctgacccagtcttgattccagcaatgacacaagaaaaatattattgggttgtactttaattatcacaagaccctctaggactttagtttagtgaaatctgtattatcacacaataaaatcaatcctgataccagaaaaagatctgccttccttgacattcagattcattaaaaatgacaaaagaaatctaaacaactggaataaggagggttgggcagatattgcgggtaaaaaaaatcaatccaaagcttcctggtagaaatgaatatttcagagcaatgattttgcaataacaagttggcataaactgcaaataaccttttctgtggggccaaaatattaactatgcttcaggaaagcaggctttggtgcctcaaacaagatcagacctcatgtacctaatacagccatcattccagctaaagacgggatgcgggttgatatggtctggctctgtgtccgcacacaaatctcatattgaattctattcccataattcccatgtgttgtgcaagggacctggtgggagataattgaatcatggcggcggttcctcccccatactgctctcgtggtagtacatctcaagaggtctgatggttttatcaggggtttctgattttgcattttcctcattctctcttcgcctgctgccatccacggaagacaggacttgctcctccttgccttccgcgatgaagattgtgaggcttccccagccgcatggaactgtaagtccaattaaacctctttcttttgtaagttgcccagtcttagggatgtctttaccagcagcatgaaaatggactaatacacaggttatgtatttaccaccaaattctcatctatttggggtcaagggccacgcctcctatctgcttatacctccaggtcagagcctgcacttggccaaatgtatacacattgaatgaatgatccgtggtatccaacaccttgaagttatatatccataaaaataatcttaaacttaagtacacaatgcagtttaaaattttcagaacaatttctgagatcaaaacaattctcatgcatacagatcctctactttggtacattaaaactatcatcctaaatccacttatctcaatcttttcttaatgaaataaaagtgaactaaaagccagaagagtcaacagaatattcagttccaaagtatcaccccatataggactgttaattaagagagggttcaggtacccttacaatggagagagctgacagacaccatcttcacgaaaggatcaaacttgtcaacaaaggtataaactgacatctcttaaggtgatccactgacaagtgtacatcacctatgaaggtggcattctgaacaaaaaatctgaatctaataatgaagaaaatcagaggaagctagattgtaaacattctatgaaacaattggcataggccaggcatggtggctcaagcctgtaatcccaacactttgaaaggccgaggtggctgggtcacttgagatcaggagttccagaccagcctagccaacatggtgaaaccctgtctctactaaaaaaaaaaaaaaaaaatagctgggcatggtgtgcatgcctgtaatcccagctactcgggaggctgaggcaggagaatggtgtgaacccaggaggtggagcttgcagtgagccgagatcgagctactgcactgcagcctgggagacagagcgagactccgcctcaaaaaaaaaaggctgggcgggcaggctcacacctgtaatcccaacactttgggaagccgaggcaggcagatcacctgaggttgggagttgacgaccaacgtgaccaacatggagaaaccccgtctctactaaaaatacaaaattagccaggcgtggtggtgcatgcctgtaatcccaggtactcgggagcctgtgacaggagaatcgcttgaatctaggagggggaggttgcagtgagccgagatcgcgccattgtactccagcctgggcaacaagagctaaactccgtctcaaaaataaataaataaggaaacaaaaacagattaatctggtcccagtagtgtctccagattgcacgaacatttcatttttcacacagggtcaccagaataccatcaattttttggtatcactgtcaaaagtgatcctagcaccttctgaaataacgtgagctgccagattctcatttcaggaatgaccacaagcgaacatctgcatctgaccccaacctgcctgatgaccttacccgctacttcacaatcccgtccaggaaaatccctgggcacataacactgcaagtcccaggtgtccgctgaagggcgcctggcagtcactgcccaggggatgagaaatcacaggtgccttgtttggaactagagtctggaatctcgtcctccttccctctgctctggtccctcattgtttatgaagacctcagtcccctctgctgggagccccacctcccctttcagggccacgggccccagtcttcttgcctttcaaggaccacacaaataactgtgcctcccctcaaagcttttctcctccttcccaggtgaagtcctctctcctccctccagctttcagggcacggagcgttctttctggcattggaattctgagcaaccctcctagcaggcccagctcaagccgcagcggggaggaagagttcaaaggaagctatgccaaagatctcgaaggcttagtgggagacccagcaacaggtggcaccaggtctgggaaagagactcctagaaagcggagcgggtctcggagggggtggatttggcccgaggtgcccgcgatcagcgaacgagcgcccgcacggaggagccgggctgcagctcccgggcaaggggagcgcgagctctgactcctcagccgggccgggccgggccgctccgaggcccctcgaaggaggccgggcgccgtggggcaacccaggcagggcgcggaccaccgcctcccgggctcgtggggtgcagctctgaacctgaggcgctcggaagctcaaggccaagacccgctcgggtggtggccgagcgccctccagccccgggtccacctgcggccgctccctgcacctcacgcccagcggggctccggggacctgcctcagggaccggcgaggaagtgacgggtaaaggggtccgggagagcaaagggacccccctccgggaggacagcgcccacccagcaggtcagcggcacaccggggacgccgcccggactcggggcgcccataacccggcccacccgccgctgctgtcgcttccctagagctccatccggtcgccattcaccactgagttaagggaccagctaccgaagggcagcagcggccagccaccagccccctcgccgcctcagcgtcactccacccgagaccctcttcctccaatcccaacggcgctgccaagtgaccgttccctcctccaatgagaaggcgctccagccggcgggggcagagccagagttgttcccgcccctgaggttgcgcagggctagcacagacccaccccctcggacgcgcgctatcctggagaagcggcccctgcccgcgaactgcgcgctctgctctgcccttctctgcagcgccccctgtaggaaagaagggaattgcatgcggcccccccgcccccggccagagctgtggatttaccagggatctggcaaagcagtgatcagaacagatttgtaacgttgtagtatctaggtctggaccccaatatttacgaagtcttcatgagtagaatacgaacattctcaggccgggtgcggtggctcacgcctgtactcccagcactctggggggaggccgaggcgggcggatcacttgaggtcaggagtttgagaccatcctggccaacatggtgacaccccgtctcttccaaaaatacaaaaattagccgggcgtggtggtgcgcgcctgtatcctagctagtcgggaggctgaggcaggagaatcgcttgaatccgggaggaggaggttgcagtgagccgagatcgggcccctgcactccagcctgggcgacagagtgagactctgtctcaaaaaacaaaaaaaaaaaaaaaaaaagagagaaaacaaaaaacaagcaaaaaaaaattctctatttaaaccggatagtaaaaagcctatttttttttttgagacggagtcttgctctgtcgcccaggctggagtgcagtggtgcgatctcggctcactgtaagctccgcctcccgggttcacgccgttctcctgcctcagcctcccaagtagctgggactactggcgcctgccaccaggcccggttaattttttgtatttttttttttttttttttttttagtagagacgggctttcaccatgttagccaggatggtctcgatctcctgaccttgtgatccgcccgcctcggcctcccaaagtgctgggattacaggcgtgagccaccgcgcccggccttgtaaaaaacctattaaaaggctggtgtgggaccggaatgggagggaggttggcctgtggatatatagtctctgtacagtgcaaagtagttgttttttgttgttgttttgagacagggtctagctctgtcgcccaggctggagtgcagtggcacgatcttggctcactgcagcctctgcctcaagcaattctcattcctcagcgtcctgagtagctgggattacaggcatgcaccaccatgaccagctaattctctaattctctctctcactgtctctctctctcatgtgtgtgtgtgtgtgtgtgtgtgtgtgtgtctaagaatggggtctcggctgggcgcagtggctcatacctgtaatcccagcactttgggaggccgaagctggtgtatcacttgaggtcaggagttcgagactagcctggcctacgtggtgaaatctcctctctactaaaaatacaaaaattagctgggcgtagtggtgcgcgcctgtagtcccagctactcaggaggctgaggcaggagaatcgcttgaacctgggaggtggaggttgcagttggccaaggtggcaccattgcactccagcctgggcaacagagcaaaactctgtctgataaaagaaaagaaaagaaaagaaattaaaaaaagaatggggtctcactgtgttaccccaagctgatctcgaacttgtgcctgaaacaatcctccctgcctgagcttctcaaagtgctgagattacaagcatgagccaccttgcccagctgctaccgagttttaaatacaataaaaatttaaagaccttctattcaatacaacaaaactggatcacacttttgactcacctcccttcagagatcccgttaaaatgtaggcagagaaattgtgaaaaggaataagcaaggtcaggtgtggtggctcaagcctgcaatcgcagcactttaggaggccagggcaggaggatcactggagcccaggagttcgagactagcctgggcaatatagcaagatcccatctctacaaaaaatagaaaaattagccagacgtggtggcatatgcctgcaatcccagttactcaggatgctaaggtaggatgattgcttgagcctgggaggcggagactgcagtgagcagagatggtgctccttaactccagcctgggcaagagagggaaaccctgtctcaaaaaaaatttttttttaagtaaactgggtaatttataaagaacagaaatttactttctcatggttctggaggctgggaggtccacgatataggcgcctgtaggttgcgtatctggaaagggcctgtgcctcactgctggcactacctatgggtcctcacatggaggaagaaagtgaacccattctctcaagcctcccccgaccttttttttttctttgagacagagtctcactctctggcccaggctagagtgtagtggcacgttctcggctcactgcaacctctacctcccgggttcaagcgattctcccgcctcagcctcccgagtagccaggactacaggcacctgccaccacgcccagctaatttttgtatttttagtagaggggggtttcaccatgttggccaggccagctttgaactcctggcctcaggtgatccacccgccttgggcttccgaagtgctgggattacaggcatgagccaacatgcccggcctattagtgttctctcttgaagcctctgtttaggaagcttccttatgcaggttccctaccactacaattgacgttttgtatcaaccaagaaacctaaataaaataaaaataggaagtataaaaaaggtcatgaaatactgacctttaaccatgctgtctttttggtacatttcctagactagcagagtctattagaagtggaagaaactgctgggcgtagtggctcatgcctgtaatcccagcactttgggaggctgaggcgggtggatcatttgaggtcaggagttcgagaccagccatggccaacatggtgaaaccctgtctctactaaatatacaaaaaaattagctgagcctggtggcatgcacctgtaatcccagctactcgggagactgaggcaggagaattacttgaacccgggaggtggaggttgcagtgacctgagatcgtgccattgcactccactgcacttcagcctgggtgaaaaagtgagacactgtctcaaaaaaaaacaaaaaacaaaaaaaaggccaggcatggtggctcactcctgtaatcccagtactttgggaggccaaggcaggtggatcacttgaggttaggagtttgagaccagcctggtcttgaaatacaaaaaaattagccaggtggtggcaggcacctgtaatcccagccactcaggaggctgaggcaggagaatcacttgagcctgggaggcagagtttgcagtcagccgaaatcgcgccactgcactccagtctgggcaatagagccagactcagtctcaaaaaaaaaaaaaaaaaaaaaaaaagccaggcacaatggctcacgcctgtaatcccagaactctgggaggctgaggcaggcggattgcctgaagtcaggagttcgagaccaccctggccaacatggtgaaaccccatctctactaaaaatataaaaattagccagacatggtggcgaacgcctgtatttccagctactcagcggggctgaggcaggagcatcccttgaacccgggaggcagacatcgcagtgagccaagatcgtgccactacactccagcctgggtgacagagtgaaactctgtcttaaaaaaaaaaattaacaactcacacccctaaacacacatacattcctaatcccctgatccctctccactttaatctttggcactttctaatatgctaaataatttagccatttatcaaacttctcattcactggctgtgtcccaccatcagaatgcaagttcctacagggcaggggtttttgctttttgtctatcttggtcctgctctatctccagctcctccaaaagcccgatgcctggttggtgctcaacccataatgtgtgttgaatgaatgagtggagttcatgaagactgggatcagaataacacaagacttgcaggacaggccaggttctctggtcttaccccaaagggagaaaatgtgatgcatgagatctttcagtagagggcgtggggagaactggctacctgaaaatacaaagataaccagccctggagctgggcacagtggctcacacctgtaatcccagcactttgggaggctgaggcgggcggatcacctgaggttgggacttcaagaccaacctaaccaacgtggagaaaccccttctctactaaaaatacaaaattagctgggcatggtggcgaatgtctgtaatcccagctactcaagaggctgaggcagtaaaatcgcttgaacctgggaggcagaggttgtatgagccaagatcgtaccattgcactccagcctaggcaacaagagcgaaactctgtctcaaaaaataaaattaaaaataaataaataaaataaaaacataaaaattacctggacatggtggtgggtgcctgtaatcccagctgcttgggaggctgagtcaggagaatcgtttgaaccagggaggtggaggttgcagtgagccgaaattgtgccgttgcactccagcctgggcaacagagcaagactgtccaaaaaaaattaaaaaggccgggcgcagtgcttcatgcctgtaatcccagcactttgggaggccaaggcgggtggatcacctgaggttaggagtttgagaccagcctgaccaacgtggtgaaaccctgtctctactaaaaatataaaaattagccaggcgtggtggtgggtgctaccaccacctatacatggctaaatctatcattttcacttttgcatagctgatgggttaaaaatgttacttgatgttgttttaacctacgtttctttaattccctgggcagctaagcatcttttcatgcttattaatcaacagccttcctttttctcctttttattatcattattattattattattttttgagacggagtcttgctctatcacccaggctggagtgcagtggagcaatatcggctcattgcaacctctgcctcccgggttcaagcaattctcctgcctcagcttctgaagtagctggggctacaggcgtgtgccactacacccggctaatttttgtatttttagtagagacgggtttttgccatgttggccaggctggtctcaaactcctgacctcaggtgatccacccacctcagcctcccaaagtgctgggattacaggcgtgagccactgcgcccggcctggccttcttttttctttgttaaagggctttgctcatttttctgttgactttccgcttcctcttggttttgctcttatttttatggcaaatggtttctgctagcttgtcatctgttttttaacctactttatggtattttcccccaatgcttctgtaaaaaaaagtattgagacataatttatataaaatatttatatgtaaggtataaaattagatgtatagacctgtgagatcagatcaccacgtcaccacaagcaaattccaaaaagttttgtcctatttattatattttgaaagtgaattctttcttcacagtttgtggattttgtgtcttgttcaaaagattgtgtcctcttcaagactacatagtcttcatatttgcttcttttttttttttgagacagagtctcactctattgcccaggctggagtgcaatgacaccatctagactcactgcaacctctgcctcccaggttcatgtgattctcctgcctcagcctcccaagtagctgggattacaggcgtctgccaccacgcccagctaatttttgtatttttagtagagatgggggtttcaccatgttggccaggctggtctggaactcctgacctcgtgatccacccgccttggcttcccaaagtgctgggattacaggtgtgagccaccgtgcccagccgcttcttcatttttttttttttttttttgagatgcagtctccctctgtcacccatgctagagtgcaatgtcatgatctcggctcactgcaacctccacctcccaggttcatgtgattctcctgcctcagtctcccaagtagctgggattacagatgcgcaccaccacgcctggttaatttttttttatttttagtagagctgaggttttgccatgttagccaggttggtttcaaactcctggcctcaagtgatccacctgccatggcctaccaaagtcctgggattacaggagtgagccactgcacctgcctctttttttttttttttttttcgagatggagtgtcgctcttcttgcccaggctagagtgcagtggcgcgatctcagctcatggcaacctccgcctcccaggttcaagcgattctcctgcctcagcctcccgagtagctgggattacaggcatgtgccaccacgctcggcttattttgtatcatccttttttctttctttccttctttttttttttttttttttttaaattagagatgatgtcttgctgtgtcgcacaggttggagtgtagtgggatgaatcacagctcactgtagctcactgcagcctcgaacttctaggctcaagcaacacccccgcctcagcctcccaagtagctaggactacagccgtgtaccaccatgcttgaccaacttttaaaaatgttttgtagacacagggtctgctttgatgcaggctcagagcccagcctgacagtgctatcccacaagattcatttgcctggctggtcttgaactcatgtcctcaagcaatcctcctgtcccagcctcccgaagtgctgggattacagttgtgtcactgcccccggctttgttttttcttagggcataattaaaacctataattgcatgtttaatctgtttgattatttgtttagtgtctgcaccccagacaagagcaagggctatgtgtactctgtctcttactgtgtccctggggcctggtactgggcctgactcattgaatcactcaactggctgccctcttaaaatgggaggaataatgcttcctaggaatcaagccatgagaaactaatgttaagaagtggccaacattatctgaaccatgtgtaaccaagaggagaagtgccaagagccctgagcacataccctgggctaggtaatgggagcccttgtaagtctctcttccatcttacacggtctgatagatgctagaaatttgaacgtgtaggatcaattgcaaagtcaaaacttctgctggctctttgggtttccaaaggatggaaatatgaagtagatgctgttctctagtagagcatcttagtcagatgcggatatagaaagatctcagggccagaagggtatacaaatgtaatgagaatgaggagtctgattggcattgtccaatatggagccactggccacgtgtggccacggaacatgtgtggctggtcctaaagtcttcaacttggccagcagtgctgggctcagctggtctcgctcgtatgtctttatagctactcctctcaagtggtggactcagtttccccacctctgaatctgggtgaaccctggactcactttggccagtagaagatagcagaagtggctgcgtgctgatcagctggggctcgtgaggggctggctggtctaggatggcctggattgggacacctgaactctccttctcacggtccctgcttgtccagcaggttggcctgggctttctccgtggcagaggtagaggtccaaagcaaaggagcagcacacaggttctcttcaggtggaggaaagcagaggcgtcatcccagattatgcctctttcacataaaaatgattttcagcttaaggcaattaagaagcagaaaatacaggaaaagttcaggtttccctcccctttctgcctaaaggcacaatataaactctccttcactggagacaacccttaactttgcccagccagcggcggtaccagaggcaccgcagagaaatcctgctgcatcggcttcctctcagatatttacctatgcacagtttctcacctttggaggcctaaaactttctttttcctgttatttctctacaaatttattgtgtcttttggaatctgctgtgtaaggcagtgttctgagccactgtgttgttacttttcatttaggtttgtcctgtgtgatatatgctgcatgtattaatgaactgttcttgggcaggcacagtggctcacacctgtaatcccagcacttcggaaggctgagcacaggagttacagatcagcgtgggctacatactgaaacacatgtagccccccaaaatacaaaaattagcctggcatagtgatgtgcctgtagtcccagctacttgggaggttaagatgggcgaatctcttgagtcagtgatgtgggggttgcagtgagccaagatggaaccactgcactccagcctgggccacaaagcaagacactatttcaaaacaaacaaacaaacaaacaaacttcttgtctgtgaatctttttgttaaggagcctattttagtcccttttgtgctgctgtaacagaataccagagaccgggtaattgataattacagggatgagccaccatgtctggcctgatatacctcttactgaagacacagggggatataaaggtcaatggctttgatggagtgtggtgccaggggcataaggggaacagagtccaggctgtgtgtgcatgtgagtgtgcatgtgagtgtgcatgtgagtgtgcatgtgagtgtgcatgtgagtgtgcatgtgagtgtgcatgtgtgtgtgtgggggggtgcacgtgtgtggcacatgtgggatgttcagaagcaatatcaccagattttgctccctgctgggcccggggcaccccttttcagctgcttcaggatgcattccaagagaggagagtctaggggaaagaaagagtttgggtagaggccaagtcatctgaactgttaatagaaaaacattagacaaattaagcagactttatttgagcaaagaaaatttatgaatcgggcagcaccctgaaccagtaaaggttcaaagtgctccacccagaaacactggcaggccgaattttttggaagtaacacagagaaacagtctgatggggtacagctcagcatttgccttatatggacttggtctgatcagttggcagcctgtgactggttaaagcacagctgctgtgacttgctgagattcaactatttgttacaagaatatagtctcagttgggaggcagtttacttaaatattaagttaggttgcagttcaacaggtatggcagcagctttgggccaaattctctttttttttttttggagacggagtcttgctctgtcaccaggctggagtgcagtgcacgatctcagctcactgcaacctctgcctcctgggttctagtgattcctctgcctcagcctcccgagtagctgggattataggcatgtgccaccatgcccggctaattttttgtattttagtagagatggggtttcaccatgttggccaagatggtctcgatctcctgacctcatgatccgcccaccttggcctcccaaagtgctgggaactttgggccaaatttaattgaatttaaacatttctgccttttggtcagcctctcaattttgagagattgaccaaaaccttgggccctgactccatttcctgtcaccatcataatggacttgttttgtttcagtattgacttcacaatttcaccttagttgaatgattctttatgctttcttcatgtttttgttactctaaccctaacagaccagttgatttataaagaatggctgcataggagtatgtaagacttcccaggggagtcaacacatcagagagactattattattattattttattattattattatttttgagagggagtctcgctctgttacccaggctggagtacagtggcgcaatcttggctcactgcaacctccacctcccaggttcaagcgattctcctgcctcaacctcttgagtggctgggattacaggcatgcacaaccacactggctaatttttgtattttagtagagacagggtttcaccatgttggctagactggtcttgaactcctgacctcaagtgatccacccgccttggccttccaaagtgccgggattacaggcttgagccactgtgcctggcctattattgttatttaagatggagtcttgctctgtcaccctggctggagtgcagtggtgcaatcttggctcactgcaacctccacctcctggattcaagagattctcctgcctcaacctcctgagtagctgggattacaggcatgcacaaccacactggctattttttgtatctttaacagagacagggtttcactatgttggccaggctggtctcgaacttctgagctcaagcgatctgcctgccttggcctcctaaagtgctgggattacaggcgtgagtcactgtgcccgaccagggagactattatgatggctatgagtggacaatgccaagaaactgaagtacactccttatcaggagtttcaacaaacaactagtcaaaatcaaataactcaaagtccatgcaataaagatagttcaatagcatttgagtccaattggtcagtctttgttcagggatgatggtgattaaaggccaaaccctccccattaaatgagagatctacattagagaggtttcagagacctccacccagcaacagtgggcaagcagcgtttataaacagaaaaaggaagtggcattggatataggctgattggttacagctcaacctttgtctaatttggacacatctggtcagtctgcagtctgcccctggctgaaggctggctgctatgattggagaagactcctttcttcttacaagaatatactgcctggtcaagttgtagtttgtttacataataaataaggttacatcccagtcaaatcctccctacaaagtatcccctattctgacctctatcaccatagactagtttttctgctttaaataaatggaatcatgcaattaaagaaaaaagagagaaaaaatgaggttacagttcactagattgcaggacttttgaacaaatttattacttatttttttgatagagtcttgctctgccacccaagctagggtgcagtggcatgatctcagcttactgcaacctccacctctggagtccaagtgattctcccacctcagcctcctaagtagctgggattacaggagtgtgccaccacgccggactaatttttgcatttttagtagagagggggtttcactatgttggccaggctggtttcgaactcctgacctcaggtgatccacccgcctcagcctctcaaaatgctgggattacaggcatgagccaccgcacccggcctggcacacatttaatttaatttagcagtaacttactccctgcgcccagaagaggtaggggcaagagttgctttccatgaagagtgcacctgatgagaaggcagctccagaagactcaaaggaaaaccgagaatcaggagagaaagaaacgtgcagtccttgcctacttcaggggaggaccccaaactcccggttgatagtagggacctgcttccccatgcgccccagctccctctccaccatgcagtcgcctcctgggcctggcgaccacagttcggggcctgctctaaggcccagagttctcagtcaggcgatgcccagctgaagtggtctgggcctcgtggcagcaccagatccagggtgaggtcacgctgctggtccgcagagtacacaggccggtagcccagcagctgcagcgcgccggcgcacacctcctgcacgcgcaggatcttagtgaagggcaacgcgtggcgccaggcctgggagacgttgcgcgcattcctagacgaagtatggaaggcctcgattggcttgccgatccccgacccgtgggtgatgttgtggatccaggcctcgagctgtggcgtgagggtcaggccggtgaaggcgtagagtgcgcggatctctgccagcggctcccgcgccaggtcctcgaagcgcaccaggcggtagcggccgcgcaggaagggtggcggcttgagtgtggcggcctcggcgatgcgcacgtggctgcggcacacctcgcgaatcaggcgcaggtgagggtcggcctccacccacttgccgttggtgcccagcacgatgccgttgtcgcgtgccagtatcgggcccgccgcctcccgggagcgcagcacggcccgcgggtcgcgcaccaggtgcacgatgcgcaggttgagcgcggggtcgctgagcagcgggtagagcacctgcaggttgaagaagcgcacctccttgagcaccacgtggctgtaggagcggcaggcctcccgggccaggctgaatggctgccgcgtgcacagtgtcttgcatacgtcctgcttgctgatggtgcctcggggaaaggcgctgcaggcgggcggcgagcacagcgcgcggctcgttgcccagttgaaaaaggcggacaggtttcggctctgtggcatgtaggcatcaaacacgtccatgtcgcacaaaaagatagagcgcatcaggtcgcgcacggccatgtgcagcgttgccgcgctgccctgcgacagggtggtccacacatgccacgcgggctccatcaggtagaagacgtcggggtgctggctgaagagctggcccaagaaggatgagcccgagcgccacgaggacagcaccagcacgtgcacacgatcctcgccgccggctggggatgagggccctggccgggagatgatgaagagcaggaggcaggtggtctgtgccaggaggagcactgtcactgtcttgctggagaaccgtggcagccacatgcgggcggctgggggccttcgggtggagtgggcaactttagggacccgggccctcatgcccatcccatgccccaattactgcccagtgccctcagggatcagccctcagattcggctaccctacccattggacttcccaagactcccaaggtctcagtcgagcactttcccaggaatacggagtcaagacataggccagaatatagtctgtgctcacagcagaagtccagttgcagaataatgtgggatatcatcaaactgtctacctacccacccacccacctacttacatacctacaggctatctatctgtagagagaaatactatgtttcaaagagaactcctgtcttttgcttcaggatacctcttagagagacccttttaggttgtggagctaaaagggcttgatgggggcttcggtggatgtcagagcaccaccaggctcgccgaggttgaatcctggctctgccacttcctagcctatgatcttgcttatgaagatcacttaaatctctctgtgacggatcactttacccgtgtgtgaaagagggataattccggtacctggctcacaggatctggggggattggggggttattataatgaagatgggggaagggaacacgcagtcatgcccataactgaggattgcaccttttacaaggtgtgcttctgtattatataatttttttaacaggcaggtataaaacttttgtcagccaggcgcggtggctcacgcctgtaatcccagcattatgggaggccgaggcgggcggatcacgaggtcaggagatcgagaccatcctggctaacacagtgagaccccatctctactaaaaatacaaaaaattagccaggcgtgatggtgggcgcctgtagtcccagctactcgggaggctgaggcaggagaatggcgtgaacctgggaggcagaggtggcagtgagctgagattgcgccactgcactgcagcctgagtgaagagtgagactccgtttcaaaaaaaaaaaaaaaaacaacaaaaaaaaaacttttgtcattaaagataaacaagtaaataaagtggacaaagaacagcaactgttgtcatcactggtggggagtgaagtgctgtaggcagcatgggctccagaaggagggtgtcctggagccctgtgggtttgcaagaagatcagttgatggggagctgggatggagcccaagaagcagagaggtgagagcagagtactgtcctggccagctgaggggactcaccaccgtccagggctgctgggagagctgcaacgctgatcacaaatccatgggagatgtctcgacatctggcaaagcaggaaggagaggagatcagagccctacagagagacagccctgtacatagaaagctccccagggtgggaacagagctgtcctgcctgccttttgcttcaggataactcgtagagagacccttttgggttgtggagctaaagggcttgatgacggtttaggcggatgtcacaccaccaccaggcttgctgaggttgaataagtctgagtagggcatttctccaaatggctgggaactggcggggtctcctgatggatggaagcgagagagctggctccaaatcccagcactgccaatggggagctatgagacctggggcaagtgacttaacttctctgaggctcaatttgcacctctgtagaatgggatttgcaatatttaacctcttagagctgttgtgatggatgctgctgcaaacacctatgaggggagggcctggggaagcattccttacacacatgcccctgttactgttactgtccctgtgctgagctacatctggagagaaagaaccccctccacctggtgagtctccccacagaggagacacccacaggccacctacccttccaatccctgtatctcccaggccatcctctggcgtccaaccaccctgagcctttagtggaccttaagaatgtcacgcatttctcacagggtggaaggaacactgagccagcctcccgcattccaaggtcctaaagtgttcttctgtttgcacctgttgcatctgcaatgatctcaaggctgggtgactttggaagggaggagcctggaagttttctccttgctcctgcatcctttgctccttgcctgcccccttcccctgtccacactgcccactgagagaagccagggtctaacttgtgagcagatctcacctctgctccttcgcctcaatgcggggacaggagtgagcggaggatgcccaacacctctgtcacctgctgactcccgagctgccttctggatccccacacccactcctggaaaacctggaagatgaggagagtagccccccacctccgctacaagtgcaactgtactttttccagtgctggctgatggatggtgagctcccttgccaacagagtgccagaaaggaagggaactcatatttgctgacttcaatgatcacaagtgctaggtgcttcgagtccactggataacttaactctgggccctgaggtgggcatgatgatgtcaatttttcaggtgaaagactcaaggcttagagagacagcaagaaagctgggactccaggactcctgttccgaagctcctggcacttctgatcccaggctgtgggcctctcccacctgtgattgccccctgcagagtgcaggaccctgctgctctggcccaaacacagttgtcctggccagcccagcccttccctgggtagggaggatcttgatcccaagctaaggtgtttgttacctgtgttccaggaaagccagaggtcttcttaaggtggttgaatcactctatgccacacagagtctccagaagaccagttcctcactgggagctttctgataaggagacttacattcagcacagtggacaattggccaagggtgcaaagttagggagaaccagtcagccaggccctgtgatatgcactttcatcttcatgattgaatgttatcctcccaagtcccttggaggtagaaataaccatccctatctgttttaattgaagcagtggggctcagagacattaatacccagtaagaaagaggcagggcaggggcttaagtccaagagccagactcccagtgcagggccctgtggtgggtcacactcctaagcctttgtccagtgaactcttccatcctggaaggactgtccccttcccctctaaattcttccgttttttgattcttttctgggggcacatatttattacatgtttaatttttagaaaaataatacaaacaggtcacacgaaattaaaaaagtagagatgagggcatcgcagacttggcctcccaaagtgttgggattacaggcgtgagccatagcgcctggccaaaatgcaattcttgactgccttgcctctgtgtaaaaggagagagaaaggaagtcaacatttgcatttgctagacattggacacagtggcttacgcccgtaatcccagcactttgggaggcctaggtgggtggtcaccagacgccaggagttcaagaccagcctggccaacaaggcaaaacctatctctactaaaaatacaaaaattaggccaggtctggtggcaggtgcctgtaatctcagctacttggaggctgaggcaggagagtagcttgaacccaggagacacaggttacagtggccgagattgtgccattgcactctagcctgggcaacaggagcaaaactccatatcaaaaaaaaaaaaaaaaaaaaaaaaattaggccaggtgcggtgactcatgcctgtaatcccagtgttttgggaggccaagatgggtagatcacctgaggtcaggagttcaagaccagcctggccaacatggtgaaaccccatcgctaaaattagctgggcagagtggctcatgcctataatcccagctactcgggaggctgaggcaggagaatcacttgaacccaggaggtggagattacagtgagccgagatggcacaattgcactccaggctctgtgacagagtgagaccccatctgaaaaaacaaaaacaaaaacaaaaatttgggcccagtgccatggctcacgcctgtgatcccagcactttgggagcctcagcggggcggatcacctgaggtcaggaattggacagcctggccaacatggtgaaacaccgtctctagtaaaaatacaaaaattagctgggtgtggtggcgggcgtctgtaatcccacctactccagaggctgaggcaggaaatcacctgagcccaggagacaggttgcagtgagccaagatcaggccactgcacttcagcctgggtgacagagcgagactccgtctcgaaacaaacaaacaaacaaacaaacaaaaaaacatttcctaggcacctgtactgtcctggggcccagagggcctttcctaaagcctaacatcaaggccctagaggcagtgaggcacgactccacttcccctgagtctggttgcaaattaactcaccaagctattttttctcaagaatttcatggagagcttttgaaagccacaccctttgagacccaagtatggaataagaacccgcaccccgacccctgccctgcgcagtgaggattcccgcgtgcagccgaagccccagcaagacacttccaaaccagcgctagcaggggagatgaactttccacgttgctgatggaaaagccacccccagctcttcccgccaacccaggtctctggtgcaggacagaggagcgtcacagctgggccactggcccggcccccagcccaaccgagtgtggggacacctccggtggagaatgaagaaccaaagtacctcaaagcttggcgtgtctgccagagctggagcagcagccagagggacgcctctccccctgggctcagcaaaagctcccagacgtcgtctcttccaagttccaccgcacagccagctctttctcttcactgggaggttccgcaggggctgacttgctccttaaggtcccaagactattaagggacacccagtgaggctgggaaaggggctctaagaggcatggacgaagagtcgggggtaaccaagccactggaagctcctggagactcgaggcagagcgaatctgggaacagggcaggagtcccagaatgggatgttgaggatgggggtgtcctggggctaccacagggaaggacccggcgcagagctccctccggagcccggcactgcggcccgcgccctctactccccgcgcgccggccaacaaccctcggcgctgccccgcaatcttcagcgctgcctggtgaggagctttcagacgtggctgcggtcccagggtggccggcgggagccagggaaatgggagaaggaaggaaggagcaggttttgcccccagctccctctccccacccccgaccgaggggccatgtctcggggaggggcgctggccgagggcagagcaggagggcccaggtgggctggggctctaagaggcgcaccttttagccggggatgtcaaaggacgctggcagagtcacttctcatctaactgaccacaaatgaacgttgtaacccttcctcacccccccaatcgccagagaacctgggagctcctgggaggacaaaggccctagtgaaggaagtcgaatcttaatcttggccctcctcgctcttgggggcatccttgcagccaagggacttggaatccaaacccttcccaaggccccaacctcagccctaagccaagacccaggcaccttgatgacacaggaatccgtgctgcctcccggtgcagtgtcccagctgggaggagttgaaagaccaggtggccttaggagctgtgccctccctgccctagcctccgcccagaggcgcaggcttgataacatgttccaatgaatacaggatatgtttcagtaaataaaagctccccacccaccccttacaaataacagctcagcctggcctggtggcatatgactgtaatcccggcactttgggaggcaaggcaggcagatcacttgaggtcaggagttcaagaccagcctggtcaacgtggcaaaaccccatctctactgaaaatacaaaatttagccgcgcatggtagcacatgcctgtaatcccagctactaggtaggctgagacaggagaatagcttgaaccccggaggtggaggctgcagtgagcggagatggggccattgcactccagactgggtgacaaagcgagactccatctcaaaaacaaagaaacaaacgggcagagtccagtaatctgaaaaggatagagcattgggaggtcctttaatccatggtggtatctgaaacgaggagtccctgctgctgggagtagaaattagcagtctttcctggctgtggtttggcaatgaattaagatccttaacaatggtcataagttttctgaatgtatcttaaggaaataaaccagcaacaatgatttctacacaaggtttataaaagtgttgtttgtgatactaaaaaggttacatacaacaaaaaagattagaaagatgtgtgccagaatgccaaccataataacttctgtgatcaaactgctgtgatcccagcactttgggtggccaaagcggatggatcacttgaggtcaggagttcgagaccagcctgaccaccagggtgaagccctgtctctactaaaaacacaaaaattagccgggcatggtggtgggcacccgtaatcccagctactcgggagggtaaggcaggagaatcacttgaacctgggaggtagaggctgcaatgagctgagatcatgctgctgcactccagcctgggtaacagagtgagactctgtctcaaaaaaaaaaaaaaaaaagaaaaagaaaaagaaaagaaaaaccacctactgggtactatgcttattacgtgggtgatgaaataatctgtacaccaaacccccaggttgtacaatttagctatatacgaaacccatacatataccccatgagtctacaataaaagttggaaggaaaaaaaaaaaagaaataattgctttattagccttacatgatggaatattaggggggcctcatctgacttaagccgaaactgtactaatcatttggcaaaatcaggagtctttctgcctccaaatattcagtaataacatcaaaccttaacttagctatgggtcggagctgagttaataaaatcctctatatttctttttttttttttttttgagacggagtctagctctgttgccaggctggagtgcagtggcgcaatctcggctcactgcaacctccgcctccagggttcaagcgattctcctgcctcagcctactaaatagttgggatgacaggcacgtgtcgccacacccagccaatttttgtatttttagtggagatggggtttcaccatgttggccaggatggtctcgatctcctgaccttgtgattcacccacctcggcctcccaaagtgctgggattacaggcgtgagccaccgctcccggcctcttgctttttatttacctcttgcagctatgctgtgattcagagtcagaaactatcaacatctggtctgtaaataatttcatattcaccagacacagtcataattatccaacacgtagatttcacatggcatgtgaatcccactgaaaactcatctacctggggaagaactaggggactttcaccaaagacctcatggaagttccaaggtcgttaggcagagccttgtaaagcatggctgtagatgagtaataaagacaggtgtgtgcaacctctgccctccctattctttgccattccaaaccctttccctcgaaaaaggtacatgtgatcttccattttgacttttttatttatttatttatttattttaacagatagggtctcactctgtcacccaggctacagtacagtggtgcaatcatagcacactgcagcctcaagctcctgggctcaagtgatcctcccaccttggcctcccaaagtgttgagattacaggaatgaaccaccatgctcggcctcattttgaacattttaattagaaagttacaaaacatcatgggttctttatacaagatttgcattagaataatttaataaaatgcaaaccaatgtttatacgtatcttgtcatctttccatatctcattgccttatgtgaatttaaacaagaaactatttttcgtttagatcttaagaaaaaaatttaggcatataaaacagcctgaatattaaaaaaagacaagggggtcagtgttagggaattcctctgcttgaatacttcaaaatagctttgtttccaaaactgttttagtaagcctaaaggagcactaaaaacgacaactgatctccaaagtaaactgaggcacacactgaggggtgtgtttctgggtgggcatgaagcatggatcaccggggccatgtccttccagtggcaatgacctgcttgggatcaggaagcagctccatgtgttcttggaggagactgcccacatcctcaggaggtgaatgggctgaacaagccatcttccgtgtgcagaggccccttccagccatctctgctcctgcagacacttgcttagccacgagggtaatccactggactgcttggtattctgctagtggccaggctggactggcctgcccaggccagcatcctctttacactcttactgcttcttgtgtccttcccaaagctgcccgccccactctgatgggcaccctgttccttagtcaagggaaacgccagccgctgggcttcccgctagccttccaaataaacttgtggttgtcaggcagcgggagccaatcccaacaccaacccctgtcgcccctgtcctttgcaggaagggggagggctgtcaaggaggaggagggccaagtgcccaggctgttgggtgagggccagaaagaacctgttgtgacaatgctttcttcccccagtgctgctgagggggctgagaatgaaacagcccctctgacttcagcctgccatccaggggcacagacagagggaaaaatagggcaaagagcccagtcacagtacggcaaagatccagggctgctcagctgagctgatgacagatgactgactgttgggctggggcaggtggacggtccaagtgtccttcagcggccctccctgattgcctgtgctaatgcggcccttgcccttgggccctgcccctccaggtctccagttaaaggcctcagctctggaaatcaaagctgtgaatgggaaatggagaagcccaggggtgcaaagtgctagtgattggcatgtttgtcacaagagagccctgaaaagagtaagagtggctcacaacagaaggtagaaatgcacagtgtgttcctcagttcaacagaggaaaagtctctgcttgaccagagatgggactctttccaagatgtctgaactgactgcaattttctcctgaaattcaacgctaaggcaaagaaggaaaacccaaaaagctaattatagcctccaggaactctcagacctttccacaaactagtccctgacaattctgcaggagctctgaagatacggaactgtgtagagcaaaaccggaaagaaccgttgtctctgagggaaaagcacacaagcccgcaggtgtccgctgggctctttcaaaaggtcctaagatgttcccagaagatgacaatgaggcagccacggtcctgctgagtcttcagaaatggcctttctaggataagtgctccttacacaagtctccccggggcgtcactgtcacaggaatggtggtcaccacctgattctgaaacacgaagatcttgattctttcaaacacccagaggaagataagcaggatgctgacatactgcacccaggcgaactttaccatctcccagaatcctggctgataagtatggacagttaaggagtgaagggccacatggtgttaagtatgaagagaaaatccaagatggaattggctgtggcagaggtatctcgaaaggaggcaggacctctgtcatgtacacacccagatggaagctgacctgaacttggccaaatggtaaaaccagccacatttgatttgagctatttatataccaagcctgatgaccaacctcctaaacagacaactatgccaaactagattgatcatggactagagatatcctgagctgttaaccagccatccatccatcttctaaaatcttccagttgtgtaaacttggaacacccttagcccctgcctaattgcacctgtacggaacacaatttagctgcttcctaggtttgtgtctctggaattgtaattcctaagaccccagttaaaatgccttctcttttgtttgcttctctgcagtgttggtgttggtttcattttccattagtcgacctaagtcaaaattaaaccaaagtttaggtcagacagggactggcaagaatgtttcacataaccttagcataaaagggatatcatatgattattaagacataaatatggatgattcttacctagaagaattgcttggaaacaaataggaccaagacatgaattatttgttcctatatgaatagcagacatacagtcattttctgagacatgtagcctaagatgtcaaagacgcagccatttttatgaggctataaccctgtcatgatttccaagagaaaacctcccacgtctgttactacttgagacaactaaggaatcattcctctttgaaaactgagctaccattgattttttttaaattgttgtttgctttaagaggcagggtctcactctgtcaccgaggctggagtacagtggcacaatcatcgctcactgcaagcttgaattcctggactcaagcaatcctcctgcctcggcatcccaagtaactgggactacacatgtacgccactatgcctggctaatttttttttttttttttttggtagagacagggactcactatcttggccaggctggttgtgaactcctgggttcaaatgatcctcccaccttggcctcccaaagtgctgaaattataggcaggagccaccacatccagccttaacatggactctttaacagaaaggatatgaaatgacttccacagggtatcggatgatagcattaatcacaaatggagcatctgcggccctgcccaccagccagatggggttgggatcattcaggacggtggtaactgcaatgcaatcattaaccattaaccacgatggctgtttgactctggcagttgaaggctataaagattatttgatacctggaaattatcctgtgcttcagaactgaaagaaatcattcggaaggaaagagaaattgcatgtgcaaagctgatcacacattatttgttaaaataatagtcaaaatacttttgttaaaatacataaaaaacttggaaagagtttcttctacatgtgctgaatggctaactgaaggaatactatactgccactaaaagtagtatcacagctttgtagctgtgtggggaagtatttatattccaagtttaaataaataaaagtaacttggatcccaatgtgtttctacactacaatggctgtataaaaagatctgcagaaggctaaagaatgaaaggaatgaaaaaatagttgatttgtagggcaatgttttctacttttgttttaaaattccctctattattgcaataatgccactagtatatgccataaaatcagtaagcaatactggatttgcagtcatcccccttgtgagacgtctgtgtatagtctccatgatgtctgcttgccaagtaacactgtagatgcttttagagaaaacctcagccaccgaccagacaaacgtgccgagtccacacatgccatggcctagagctctgtaaggaataagcacactgtgccttctggcaggaaacaggggcactcctgttctcctgctggactgctaatgtggggagagtcacccacgttctctgtttttctctgaaaagcatgaacagcaatttgtctttggcatctgttataggtgtggataggtgtggtatggggaacaactcaattaggcttatattttttaaaagagaaacccactaagccagtggtgggataatgatggcatttaaccatcactagcctgctggaccatgggatgctggaggggtgggggcggtcccaggtctgaagatcaggacgaaaaagacaaatcctggacagcatatttgctcccatcgttgagcattcacgggttttgacattttcatcacaagggttccagttctgcttgtctctgttgcccccactaaccttgaaagtcctgagcagcggctgaatgggctctacctgtgactcaccgttcctctcctggtaggcagcaacaatatgggtgaggtcgtagtcataggcaaaggggctggtcccgttgatcacggatatctgggacacgggaggaggatgtggtgtgagcacctgggagactcctccccttttccttctacccttctgcccacccaggctggtcccacagagcaccctcttgttcttggtggcctactgcagtatcaataatcttttcttcaaagatgaataaaacaggctgctgcccacccaggctggtcccacagagcaccctcttgttcttggtggcctactgcagtatcaataatcttctcttcaaagatgaataaactctcttgcaacaatttaagcccatttactctcagtctttctttctgtggatggaaataaggggtcagtgtccatgttttacaggttttaaagctatttttaaaatacccctctttatctcagcgggagaaagaattccttaaattattttaacagaccgtattttcgccaggtgtggtggctcatgcctacaatcccagtgacttgggaggctgaggcaggaggaccacttgaggccatgagttcaaggccgtagtcaatgatgatcatgccactcactacactccagtttaggaaacagagaaagacttcatctctcaaaaaaaaataaaaataaaaaaaaataaaaagccaggcatggaagctcacgcctctaatcccaacactttgggaagcccaggcagatggatcacttgagaccaggagttcgagaccagtctggccaacatggtgaaaccccatctctactacaaagaaaacaaaaattagccaggcgtggtggcatatggctgtaatcccagctattcaggaggctgaaatcagaggatctcttaagcctgggagacagaggttgcagtgagccgagatcatgccactccactgtagcctgggtgacagagcaagactctgtctcaaaaataaaaataaaatacaaataaaaacccctacacaaagacaaaaaaaagaaaccatacttccaactcctttgtcattttcttggtcttttctgggtgctaagttctttatcacttttaaatatagagatatagataaaatgcaaaccataagcatataatcccttaaaggaggaaataattgcttgctgttaatgtaatctgatatatagacattcaaacaaaaagtgccatattcatttcatatgttgcagcttcctattctttacaacttatattgattatagtcagagcaacagtaaaacccactatatatctacaagtctgggtttatggctgtaataaccgataacatccctttttcattttcagaagtacctcagctcaacttctatggtccccattgtgataaaataaaagtgaggaatgagtgattagatgcatgagttctgcacacagacaggctctgttatctttcaagatttgagcctttgggaaaattaatcactttaagccccagttacgtcttctgcaaaatgagttcattatttaaacaagtatctctgtgagcttaccatctgccaggcagtgtgctaggcacggatgtgatagtatttgagatgccactgctgtcaaggctgagggagacagcaaataaacacacaaacacatatcctgagtaggccaggcggcaggagggagagtctggctgaggaatggtggaaggaggggctgctactgtagaagcaggtcagagaaggactgggcttggggatatctgaacagggacctgaatggcatggtccgataagccacatggatgcctggcagaggaaatggcaaaagcaaaagccctgaggtggcagctgcttcttgggtttgaggaacagcaaaaaggccaggggggctggaagggagcaagcgggggcagtgatgggacaagtggctggagtgcggggaaaggacaatgcaggcagctcagaggttgccatgatgattaaaggagatgatataggtaaacgcctgcactcaggggtggcatatgttatgagttcagtaaactatggctagtaatatttctgaaatactttacatgaacattttacatcatcattttacagtgtccttcggagtacatcctgcgtgtgaccaagcgtgtgtatggaagacacaatgtgtgtgtgtgcacccacgtggacctaaaagcaataagcaatttagttcttcgacaaacacagattttgtttctcttcccttctaggtgtaactatgcgtgtaccttctctgtagtttgaaaaaattcatggcaagaattctacagagaccctctttggtgccacccacaaagaaatgatatttctacttttcttttctttttcttttttttttttttttttttttttgagacagagtcttgctctgttgcccaggctggagtgcagtggcgagatctcagctcactgtaacctccacctcctgggttcaagcaattctcctgcctcagtctcccaagtagctaggattacaggcacgcaccacacgcctggctaattttttgtatttttagtagagacagggtttcaccaggttggccagactggtttcaaactccggacctcaagtgatccatccgcacatctccgcctcccaaagtgctgggattacaggtatgagccactgcgcctggcctgacatttctacttttcattcccctctttaaagaacttaatgaacagtaacacagagaaacaaaggagctggacaatgagaagcgctcttacgttgtatcgggcatctaggccaccacagctcagcggctgcttctgctgcagcctcaggtctccgttcacgtataactgggatcccgggacaggaaaggaggactggagaaacgccatgctctgcatcacgagggtcgccatcctctgaaatcattagaaggaccaacaataccaaccgccatcagatctgaagggctctgggtgctaagagtcacctgtcttggctgaaacctaagaggccctcacatacctagcgtagccatgcaggaaacactgcctagaaccttctgagctattaatagcccatgtcagttaatatgactagtgaaaaccattccattggcctaagttaaatcccaaactacatggggaagagggcccgctagagtgcgggtcttctagaaatcagaagaaggactctggtctactaaaaagacacaagggagaggacagcctcccagcggactgactcacgtgtaatcgataggagaaagtcaggatgagctgcacaccgagaacgtgctccgtggactgcaggggaagctccagcttaaaatgtaacatgtccgtcttcccatcctggttcctgtcttcttctctagtctaggaaacccaaacaggcccagcagccctggtcactaatgagtctgggaggaatccacatcacttctgtaaatacacaatgacccactgtcttgctgtacacaacaggcattatctcctccactaaaagagaaaagcagatagatgtaagtgcattaatactggggagagacacaaagtgcatggtccctgaacttcatatctgggcctttcaaatgttcactggccaaaataaatgggcaataacaaaaaacatctggatagtatttgtgcctttcagttgtctcatgtgatcttgcttattttgcactgatatttttttcttttttacaaatatgcctgaatttgtatggaaattttaagtagcatgtcagaatagtcttctatgtctctagaagtcaacttgttaaaatagaaaaacacctaatcctaatcattatgcattcctccaacaaactcaaactcaacagaaaatcaccaagctctatttttttttgtttttttttgagccggggtctaactctatcgcccaggctggagtgcagtgacgcaatcacggctcactacaacctccgcctcccagggtcaaggaattgtcctgcctcagcctcctgaggagctgggattacaagtgcccaccaccatgcccagctaatttttttatttttagtagagactgggtctcaccatgttggccaggctgatcttgaactcctgacctcgggtgatccgcccacctcaggctcccaaagtgctaggattataggcgtgagccaccgcacccggccttaccaaactctgtttatagattctgaaaccacgagtgtctttgcttcagattcttgatgttggatcttatctcatcattcgtgtgaggacctgaaagccttgtgcatcttttagtagcaatcaatgaaatgaaaaaggaagctatgtcaaatcagcaaagtattaaaaccatatctatttgataaattacgggcatgaaaggaaagaagacagaggtctgtagaggaaaaaagacaaaatacagcttatgaagcatatgtaggcagtgaaaaaaaactggtatccactcctaccatccacagtcttgccaaacagtgatgctaaaatgatgatcaggaaagcacggttactgaaaagtgatcactgctgacatggtccctctgcacaactctggatctttttgctacaactgatcctttcccactgtggattcccagaacaattctactatcgtgtagcagcattcccatctggatccaccatctatggattcattttgattcccaccattactattacgtaaggaagagattttttgtgtgtgtgctttttcaggctaataataaggtcatttgaaatgaagaaatctcaattttcagaaactttcaattatttctttctttctagacaataatgttccttctcttaggtcttgttttagagaaacctccctcccttttctcttggatacttcctctctgccctgtttcatcagcttcggggagggatatctgctaccagggctgatgatcaagttactgaggcaatgatggactagtcattataggtaggatgaaaagagcctgccttgcggatcatgaggtcagaagatcgagaccatcctggccaacatggtgaaaccccgtctctactaaaaatacaaaaattagctgggagtggtggcacgtgcctgtaatcccagctactcaggaggctgaggcaggagaatcgcttgaaccagggagttggaggttgcagtgagccaagatcttgccactgcactccagcctggtgacagagcgagactccatctcaaaaaaataaaataaaaaataaataaaagagcctgccttgtctcctgtggattttcttcaattgggatctgggtagaaaatcttatgtaactctctgtgatggatccacaccttctagatctttagggttggacaggaagaaaagagcacatttctcaacttgcaacagaggatagtggccaggagacaactgccagaagaatccagactccaacacactgtgggagggggaaaagctcatttcctttgatctttacaataaatgtaaagccccaggcaggcagaacaggtattttcccattacacagatgacaaaatcaaggatgagtgagattagggcatttatcagaggtacagcaagtaatggtgaagacaggatttgagatcaggtgacttcaaatctggtcctctttttaggaccaaaatgtctaaaattattttaaaaattccaaatgaagacagcaggttggacaaatcttcctgaaaaacagcagcaccaggcatctacgtctgtatacttgcctgtgcacatccttccattccaagttcgcgggggacagatttggcacaacaccatcaatagtgtctacttgttaaattcactcattgatctgttacgtactttttggaaacacgccaggcactatttcaaataatgagactataatggtaaacaaaatagacaaagtccccatcctaatggggcatacattcccgatggacaatgtagaaaacagtgacaagtgccgctgacagaaatgaagcaggctaaaattagagaataatgaaggtaaaatttaacagaaattggccaggcgtggtggcttatgcctataatcccagcactttgggaggcccaggtgggtggattgcttgggctcaggagttcgagagcagcctgggcaacatggcgataccctgcctctattaaaaatacaaaaattagctaggcatggtggcgtgcacctgtaatcccagctactagggaggctgaggcaggagaatcgcttgaacccagaaggtggaggttgcagtgagccgagatcgtgcctctgcactccagcctggtgacagagcaagactctatctcaaacaaacaacaaaaaaacccaaaaagaatttaacagaaatttttaaatattcaggatgacccaacttgttggagtcctgaaggaagtgaagtgatggggtgcaggaacatctcagagaggagggatccaggctaatcaggtacatgtgctctgggtacccgtgggatcaatgcatctggcagagtgggtgagaaggagagcagggtggagagaggggggagagaagtttcgatggaaaggatgtgtctcccacaaatgacctgtcaccaagctggactctcaccctcctggggctggcgaagtttggctgtgctcctctgttatcacttggaccactgaataaatcaattatttaattccatttagttgaaagtaagtttaacatatgtgcaatagctaacaaaggcaggcattcaaaggctactacttctttaacacaaattctaggtcgctatctaacctccaactggtacttagccaagagaattcacatatcacaccaccaccttatatctacaacgtatatacaggctttggaacaatttttatatccattcattgtcccacgtgattcctctgcatatcccaggagagatgtgggtactctcatgccctgtatatggatagataaattgagggtgaggttatgaaacccagtgacagaattgggactaggaccttgtgggacaaggatcttggtttgctgactcctgattcagggctcttctataatagctcataagaactctaactgaaaagatttctcatggttaaaggaggataaccctttagagatacacatgaaatccacacgcatgtactgagcagagtcagagggaatttttttgttttttttttgagacgaagtcttactctgttgcccaggctggagtgcagtggcacaatcgccactcaccgcaacctccacctcccaggttcgagtgattctcctgcctcagcttcctgactagctgggattacaggtgtgcgccactacgcccagctgatttttgcatttttagtagagatggggtttcaccgtgttggccaggctattctcaaactcctgaccttgggtgatctgcccgcctcagcctcccaaagtgctgggattacaggcatgagccaccgcacctggccagagggaatttaacatagggaataaatagtcccataggtattagaggactgaagacgtaaaaaggggatatcccagcaacacagagatagtagctgcagggaacatttcccacacctaggactagagaagaaggggaagcgggtgggactgatagaacttagaggttcagggaagaggcctcgaagagctgagcctcagacttcaagaagggaccgcggcccagatggggccaggacctctgagcttggaggaagcatgcactagagggaaccttgaagccggtaggagaggcgtcctgctccttcctgtttgctggttgtccctgtttgtggcatccacagtggttcttcaccctggcagtggtgactggtttcatttctttttttctgcactcccagaacaaggctcatcatgcctcctactggcagaacctaacaggaagctgcaggggaagaaggtggtttccagcatctcagcaggaacctggaagctgagcgtaggagggtgggtttggagctgagacaatacctcataaccagcacaccacctgactgcaggaattgccagaaattcaagtgccattgtttccagagtatcctgatgtgtgacttttttccccgtcaggaattcccagcatctgacggtttgttggaattttgtttggtttctgttttgtttgcgtacatttcattcatttaagtcgtattcttttttttttttttttgagatgcagtctggctctgttgcccaggttggagtatgggtggtgcaatctcagctcactgcaatctccgcctcccgggttcaagcaattctcgtgcctcagcctcccaaacagctgggattacaggaacctgccatcacacccggctaatttttgtgtttttagtagagacggggtttcaccatgttggccaggctggtctagaactccctacctcaggtgatccatccgcctcggcctcccaaagtgctgggattacaggcgtgagccactgcgcccggcccatattcttttattaaaggttaatttcctagtttataccagtgtctatttcaccatatacttgtcatcaccgggtgctcctttctttttaagctaaaaatactctttggcaccagttgtgggtctctagcaaagcagaaactgccacttcgtggttcctttccacctttctacctgtatttctttttttttctatttctttttttcttgatacagggtcaaaaaaggctagagtgcagtggcacgatcacagctcattgcagccttgacctctcaggctcaagtgatcctcccacctcagcctcctgagtagctgggactataggcattcaccactacccctggctaatttttaaattttttatagtagggcctcactatgttgcctaggcggtctggaactcctgagctcaaggggctagcctcccaaagtgctgagattataggcatgagccacagtgctcagccttgtatttcaatctaagataccattacttataaaatgaaccattattttatataccactgataaaagaaaaacatttccaattaaactatgacacttttctaatcacttactttttaaaaagttactaaaagagcttttagatttagacatatttacacagatatgtttatttacttagaaaaatataagcaaaataggtcggggcagtggctcacgcctgtaatcccagcactttgggaagccgaggtgggtggatcacctgaggtcaggagttcgagaccagcctgaccaacatgatgaaatcccgtctctactaaaaatacaaaaatcagccggccgtggtggtgcctgcctgtaatcccagctactcatgaggctgaggcaggagaatcgcttgaacccaggaggcggaggttgcagtgagaagagattgcgccactgcactccagcctgggcaacagagtgagacttcatctcaaaaaaaaaaaagaaaagaaaagaaagaaaaatataggcaaaataaattgattcagggattcctaaaacttctttacatcctcatccttttgagtaacactttaactcagtcaacaacccatacttttctatgcaactttgtcctttgtgccatcaaacatgttggtgatacagcattaaaagaaaaacaaaaacaaaaaacaaaaattcagctgggcatggtggctcatgcctatagtcccagcactttgggaggccgaggcaggcagatcacttgagctcaggagttcgagaccagcctggccaacatggtaaaacctcatctatactaaaaatacaaaaatgagccaggcgtagtggcaggagcctgtaatccagctccttcggaggctgaggcaggagaatctcttgaacctggggggcggaggctgcagtgagccaagattgcgccactgaactccagtctgggtgacagagtgagaccctgtctcaaaacaaacaaacaaacaaacaaacaattcataaaagaaactaaaagccattggtctgggcccttaagcagactttgaaattatggagagctttcctgtttttaaaagcctctcaaactttcccttacttgctctccattcaattcaggggttaaaaaaatgttctactactgtctctggggtttcctctgaggttgctgatgccccttctttttaattgcatttttatttttctaacacctacctcttacacagaaatgatgccccttctgcatgttttgatgccggcacaggtgtaagcaatgagaactatgccatacctgcctccttgccaacagttgataaccacagacaggaagacactgatttcagggatgagaagaaacaggtgtcttagaaacacggtactctccactcatcctctggaatccttctataaccttcagtccctgtattctctgggtccacacatgccttcaagagctatgtcagcctccttgaggcttgagggggaaaaagtcactctgcttttctcttctctcattaaaaacaacaaaaactagacttccaaagcattaaacatgtagggagcttagagacgctgtccaggatgagctgaccaaagcagaagcaaggctgtttgtgacttcagcatttcccccaattagccactgcaaagccacctcccagcacttggtccaaccttaatcaacaaccactgtttcctttgccttctggacagtttcctggatagactgacgtcagtctggctctatgttcaaagttagaaaata

SEQ ID NO: 287 - DNA, 48958 bp, Homo sapiens
aaattatgggcatgaaagtaaggaaaagaaacagagatctgtggtggaaaaaaagacaaattatagctcatgaagcatatgtaggcagtaaaaaaaaaattggtatccactcccaccatccagtctgacctcatagtgaccctaaaatgatcagcagaaaaagacggttactgaaaagtgatcactgctgacgtggtccctctgcacaactctggatctttttgctacaagtgatcctttcccaccgtaggttcccagaaggattctactatggtgtagcagcattccaatctggatcccccatctactgattcattttgattcccaccattaatattatgtgaggaaaataatttttgtacttttttgggctaataaagtcatttgagatgaagaaatctcagttttcagaaactttcaattatttatttcctttagacaataatgtccttattgtaggtcttgttttagagaaacctccctcccttttctcttggatacttcctctctgccctgtttcatcagcttcggggagggatatctgctacccgggctgacgatcaagttactgaggcaatgatggattagtcattatgggtaggatgaaaagagcctgccttgtcttcctgtggattttcttcaattgggatctgggtagacaatgttgtgtaactctctgtgacggatccacgccttccggatctttagggttggacaggaagtaaagatcacatttctcaacttgcaacagaggacagtggccaggagacaactgccagactccaatacactgtggggcgtggggagaaactcatttcatttgatctttacaataaatgttaagccccaggtaggcagaacaagtattttcccattacatagatgagaaaatcatgggtgagggaggttagggcatttatcagaggtacagcaagtaatggtgaagacagaatttcagatcaggtctttgacttcaaatgtggtatcctttccaggactaaaatatccagacttacttacttatttatttatttttgagccggagtctcactctgttgcccaggctggagtgcggtggcacggtctcagctcactgcaacctccgcctcctgggttcaagcaattctcctgcctcagtctcctgagtagctgggattacaggcacctgccacttcgcccagctaatttttttgtatatttagtagagatggggtttcaccatgttggccaggctggtctcgaactcctgacctcgtgatccgcccgccttggcctctcaaagtgctgggattacaggtgtgagccacgacacccggccagatttatttaaaaattcaaaaagaagacagtgggttggagaagtctttttgcaaaacggcagcaccaggcatcaaagtctgtatactcgcctgtgtgcataattccgctccacgctgagagagggcccagatgtggctcagcaccatcaatagtgtctacttgttaaattcactcattaatctgctatgaactttttgaggccctacaggcactatttcagatgatgagaatataatctaaacaaaacagacaaagtctccatcctaatggagcttatgttcccgaccaagaagacagaaaatagattcataaatatgcaacaatatcaaatagtgatgagtgccacagagaaaaacaaggcaggctaaaatgaaagaataatgaaggtagaatttaacagaaagttttacagaaaatattcaggatgacctgacttgttggagacctgaaggaagcgaggtgatgaggtgatgtggtgcagcaatgtctcagggaagaaagatctagattcaccaagtgcatgtgctctaggtgcccatggggccagcagagctggcagaatgggtgagagggagagcaggacggagacaggggacagagaagtgaagacacaaagggtgtgtctcccaaaaacaacctgtcactaagctagactctcacccctatgggctagcaaggtttggctctgttatcacttggacctctgaagaaatcaattagctaattccatttagttgaaagtaagcctaacgtatgtgcaacagctacaaaggcaggcattcaaaggctactaattcctcaacacaaactccaggtcactatctaacctcccactggtgcctggccaagagaattcacaaaggacacaaccacttcacacctataaggtatatgcaggattcgaaacaattattatatctattgattgtcccatgtgatccctccatatatcccaggagagagttggctactctcatgcccaggatatggatagataaattgaggctgaacaaatgaactactgcccttcctccaccaatgaaaaaagctacctttagtcaatagtgtcaatcagaaattgagggcaggattcttggtcctcagggtttcagcccccacctcttccacaacaaacccatatcctcttgcagcttcttttccagctgccattaggccaggagctattcctgcctttcgctgcccagagacgcaccctccctggctggcagcaactccagagggagcagtgcctgtatctggatactgctcctccctaacaaatgtgcacctgccagagctctggtgcccacacaaatccctcctgcctgggcagctactgtggcccctggctcagtcaagagcagcctggcctccgagctgaggccccctgtccaccacccaccgccagctcatccccaagcccccacacagcaccatgcttctcttccaaagcagaaagaccatcttctatcccaggtcctcacctgccactcccaaatcaatctgaccctctgaccacccgaacatctagtctgcacaaagttccatgatggcatcaggaattcactggtccaagtgaacaaatgagatgcaaacctgcctccaagaactcagattaagaccagtatggtggctcacacctgtaatcccagcactttgggaggctgaggcaggtggatcacctcaggtcaggagtttgagaccagcctggccaatatggtgaagccccatctctactattaataataataataaaaattagctaggtgtggtggtgcatggctgtaatcccagttactcgggaggctgaggcaggagaattactggaacctgggaggcagaggttgcagtgagctgagattgtgccactgcactggaacgtgggtgacagactgagactctgttccccaccaaaaaaaagccaacaacaaaaattatctgggcacagtggcacactcctgtaatcccagccacttgggaggctgaggaaggagaattggttgaatccgggaggcggaggttgcagtaagccaagatcacaccaccactgccctccagcctgggcaacagagccagactccgtctcagaaaacaaagaactcagattagtcaccactggctgctgtctgcccccaccgatgtgagaccacaccccggactcctgctgtggaaggcttctgctgaagctgtgataagcactgctttttgcagtaattcaaggcactgccggagcctagcttcttactgactgtcccataaccatcagggcagtgacctaggaggcagcgccctgatctgccagaaacacatgaagctggaaacttccagaaaaatgggtctggacacaggtgtgccaaccaactactaagggctgaactgtgtgcaccacagattcccaagttaaatatgataggactgtggccttacaagaggaagagatttcaatctcctgatctctctctctctgctatgtgaggacacagaagacacccaactcccagtcagaacccaaccatgctggcacccttatctcagacttccagcctccagaactgaggaaacaattgtgtgtgtgtgtgtgtgtgtgtgtgtgtgtgtgtgtgtgtgtgttttagagacatggtccctctccgttgcccaggctggaatgcagtgttcaatcatagctcactgcacccttgaactcctggcctcaagcaatcctcccaccttggcctcccaaagtgctggcattacaggtgtgagccacaaggccagccaatgtctgttttttttttctttttttttgagacagagtttcgctcttgttgcccacgctgtagtgcagtggcgccatctcggctcactgcaacctccgcctcccgggttcaagcgattctcctgtctcagcctcctgagtagctgggattacaggcatgtgccaccacggccggctaattttttgtatttttagtagagacggagtttcaccatgttggccaggctggtctcaaactcctgacctcaggtgatctgcccgcctcagcctcctaaagtgctgggattacaggcgtgagccactgtgcccagtccatggctggtctccagctactggccatgtgtgggaacatgtacctgaggtcttggcttctctgtagtcctagctactggggaggctgaggcaggaggattgtgtgagcccagaagctcaaggttacagtgagctatgatcacatcattgcatgacacgacacgaaatcactatacaacagagcaagaccccatgtctttaaaaaataaaaaacgaaaacaaaaacaaaaagcggctgggagtggtggctcatgcctataatcctagcactttgggaggccgaggtgggaggatcatgtgagctcaggagttcaagaccagactgggccacatagggagaacctgtctctacaaaaaataaaaaataaaaaactagctgggcacggtggctcacacctgtggtcccagatactcaggaggctgaggtgtgagaatcacttgcgcccaggagggggaggctacagtgagccatgatagcaccactgtactccaggctgggcaacagagtaagaccttgtctcaaattaataaaaaaataaaagaatataaggggaaatgagactaagcactgtggtagaatgggccccaaaaggtgttaaaattctcatccccaaaacctgtgaataggttacaaggcaaaaggtgctgaagaaatggtttgctagactatttaacaaaatgaagaaaataattttaaaaaacctgtgattaaattaaggatatttaatcagctgtgattaaagatcttgcagtagggggttactgcaaattttcaagatgggtctaaagtaatcacaagtttctttgtgaggagacaggaggttgagtcagaaagatttgaagatgttacactgctggatttggagaagaggaggggaccatgggcctaggaatgcaagtggcctctagaagctggtaaagtcaaggaagcaaattcttcctagagcctctagaaggaacatagtcccgttgaaccttggttttagcccagagacatccaatttggacttttgaccaccagaagtaagaactataagatgataaaatcaatatagttttaagtagctcaatttggggaattgattacagtaacaatagcaaacttatacaaacattaagaatttattcattcatccatgaatatttatttatttatttatgagtctcactctgtcacccaggctggagtgcagtggcacgatctcagctcactgcaacctccgcctcctgggtgcaagagattctcgtgtctcagcctcctgagtagctgggattacaggcacaagccactacgccaagctaattttttttgcatttttagtagcaatggggttttgccatgttggccaggctggtctcgaactcctgacctcaggtgatctgcccacctaaccctcccaaagtgctggcattacaggcgtgagccactgtgcccagtccatctgtgaatatttacagagttcgttctatatgctggcaacattggtgaaaaaagtctaagatgcctgctctcaaagagcttatttctttaaggatgtattttcagagagatattgcagtgaaagagaacagatatagagaacataaacacaagcggtctgtaatggctggctccctagcctctaacctccacagcagagtcacctaactcccaaccaaggcctcaagaccaccctggccccaaatggcagcaatgcaaagaaactgagccaagtgggcagcatgaggctcagcactcagccctccttccagctggccccactttcatcttgtgttccagtgaatgactgggtcaacacagccagttcctctgaagctggggttctaggcagaccacatgggtcctcctggggattaagagtcttatgtggtccttcaactccgtgctgagctgccttgatactaatcattgcccatcagcctgcaactctacccattgtccaatgggagactcctctcttgccaaaccccacctccctgcctggaggtccaactgtcccctccactcctctctaacaagaggacatgcccactgaactaccaactgtagtcaaccacctctctcggatactgcctgcctgctcctccctggttcgtgggtgtgcccctggcctgccttacctcagtggtctctggatcctagcctgagcagactttgtcctgatcaggctttccatctattctccacgcaaagccagtaagtcaatgccactgggtaagggatttcttctcgggatgatgcaaatattctcaaattgattgtggcaacagttatacaactctctgaacacactaaaaaccactggactgtgtactttaaaaaaagtcaggattggccgggcatggtggcccacatctgtaatcccagcactttgggaggccaaggtgggtggatcatgaggtcaggagttcaagaccagcctggccaagatggtgaaaccctgtctctactaataatacaaaaattacccgggtgtggtggtgggtgcctataatcccagctactcgggaggctgaggcagagaattgctggaacccaggaggcggaggctgcagtgagctgagatcctgccactgcactccggcctgggtgacagagtgagactccatctcaaaaaaaaaaaaaaaaaaggccaggcgcagtggctcacacctgtaatcccaggactttgggaggccgagactggcggatcatgaggtcaggagattgagaccatcctggctaacaccgtgaaaccccatctctaataaaaatacaaaaaattaggcgggcgtggtggtgggcgcctgtagtcccagctactcaggaggctgaggcaggagaatggtgtgaacccgggaggcagaacttgcagtgagccgagatcgcgccactgcactctagcctgggcgacagagtaagactccatctcaaaaaaataaataaataaataaaaataaaagtcagaatcatctcatctctgctcaaaaccccccagtagagccctccaggacctgccctcccctcctcctctcccccttgcccacatagtccctccaggcaccctggccccctcaatgtttcttctgtaagctcctgtttcagggcctctgaatcggctgctccctggactggaacacttgctcttaccccaagagctgttggctcattcctcacttccttcggattttgactccaatatcatcaccatcgagggtctccccatcacccaacgacaaatggcactccaccccagctacacaggccctaccactttctgccctcaccctgacactcacgaccagctgttccagcccacaggttggttgttttctccctccctccattggaattaaagctccatgtgggaaagggctttgttttgttcaccatggcatcttgacctggtacctagagaaaaaaaaggggggcacacaattgacactcagtaaatgtttgttgagtgaataaatgagtggtccaaatctgacccagtcttgattccagcaatgacacaagaaaaatattattgggttgtactttaattatcacaagaccctctaggactttagtttagtgaaatctgtattatcacacaataaaatcaatcctgataccagaaaaagatctgccttccttgacattcagattcattaaaaatgacaaaagaaatctaaacaactggaataaggagggttgggcagatattgcgggtaaaaaaaatcaatccaaagcttcctggtagaaatgaatatttcagagcaatgattttgcaataacaagttggcataaactgcaaataaccttttctgtggggccaaaatattaactatgcttcaggaaagcaggctttggtgcctcaaacaagatcagacctcatgtacctaatacagccatcattccagctaaagacgggatgcgggttgatatggtctggctctgtgtccgcacacaaatctcatattgaattctattcccataattcccatgtgttgtgcaagggacctggtgggagataattgaatcatggcggcggttcctcccccatactgctctcgtggtagtacatctcaagaggtctgatggttttatcaggggtttctgattttgcattttcctcattctctcttcgcctgctgccatccacggaagacaggacttgctcctccttgccttccgcgatgaagattgtgaggcttccccagccgcatggaactgtaagtccaattaaacctctttcttttgtaagttgcccagtcttagggatgtctttaccagcagcatgaaaatggactaatacacaggttatgtatttaccaccaaattctcatctatttggggtcaagggccacgcctcctatctgcttatacctccaggtcagagcctgcacttggccaaatgtatacacattgaatgaatgatccgtggtatccaacaccttgaagttatatatccataaaaataatcttaaacttaagtacacaatgcagtttaaaattttcagaacaatttctgagatcaaaacaattctcatgcatacagatcctctactttggtacattaaaactatcatcctaaatccacttatctcaatcttttcttaatgaaataaaagtgaactaaaagccagaagagtcaacagaatattcagttccaaagtatcaccccatataggactgttaattaagagagggttcaggtacccttacaatggagagagctgacagacaccatcttcacgaaaggatcaaacttgtcaacaaaggtataaactgacatctcttaaggtgatccactgacaagtgtacatcacctatgaaggtggcattctgaacaaaaaatctgaatctaataatgaagaaaatcagaggaagctagattgtaaacattctatgaaacaattggcataggccaggcatggtggctcaagcctgtaatcccaacactttgaaaggccgaggtggctgggtcacttgagatcaggagttccagaccagcctagccaacatggtgaaaccctgtctctactaaaaaaaaaaaaaaaaaatagctgggcatggtgtgcatgcctgtaatcccagctactcgggaggctgaggcaggagaatggtgtgaacccaggaggtggagcttgcagtgagccgagatcgagctactgcactgcagcctgggagacagagcgagactccgcctcaaaaaaaaaaggctgggcgggcaggctcacacctgtaatcccaacactttgggaagccgaggcaggcagatcacctgaggttgggagttgacgaccaacgtgaccaacatggagaaaccccgtctctactaaaaatacaaaattagccaggcgtggtggtgcatgcctgtaatcccaggtactcgggagcctgtgacaggagaatcgcttgaatctaggagggggaggttgcagtgagccgagatcgcgccattgtactccagcctgggcaacaagagctaaactccgtctcaaaaataaataaataaggaaacaaaaacagattaatctggtcccagtagtgtctccagattgcacgaacatttcatttttcacacagggtcaccagaataccatcaattttttggtatcactgtcaaaagtgatcctagcaccttctgaaataacgtgagctgccagattctcatttcaggaatgaccacaagcgaacatctgcatctgaccccaacctgcctgatgaccttacccgctacttcacaatcccgtccaggaaaatccctgggcacataacactgcaagtcccaggtgtccgctgaagggcgcctggcagtcactgcccaggggatgagaaatcacaggtgccttgtttggaactagagtctggaatctcgtcctccttccctctgctctggtccctcattgtttatgaagacctcagtcccctctgctgggagccccacctcccctttcagggccacgggccccagtcttcttgcctttcaaggaccacacaaataactgtgcctcccctcaaagcttttctcctccttcccaggtgaagtcctctctcctccctccagctttcagggcacggagcgttctttctggcattggaattctgagcaaccctcctagcaggcccagctcaagccgcagcggggaggaagagttcaaaggaagctatgccaaagatctcgaaggcttagtgggagacccagcaacaggtggcaccaggtctgggaaagagactcctagaaagcggagcgggtctcggagggggtggatttggcccgaggtgcccgcgatcagcgaacgagcgcccgcacggaggagccgggctgcagctcccgggcaaggggagcgcgagctctgactcctcagccgggccgggccgggccgctccgaggcccctcgaaggaggccgggcgccgtggggcaacccaggcagggcgcggaccaccgcctcccgggctcgtggggtgcagctctgaacctgaggcgctcggaagctcaaggccaagacccgctcgggtggtggccgagcgccctccagccccgggtccacctgcggccgctccctgcacctcacgcccagcggggctccggggacctgcctcagggaccggcgaggaagtgacgggtaaaggggtccgggagagcaaagggacccccctccgggaggacagcgcccacccagcaggtcagcggcacaccggggacgccgcccggactcggggcgcccataacccggcccacccgccgctgctgtcgcttccctagagctccatccggtcgccattcaccactgagttaagggaccagctaccgaagggcagcagcggccagccaccagccccctcgccgcctcagcgtcactccacccgagaccctcttcctccaatcccaacggcgctgccaagtgaccgttccctcctccaatgagaaggcgctccagccggcgggggcagagccagagttgttcccgcccctgaggttgcgcagggctagcacagacccaccccctcggacgcgcgctatcctggagaagcggcccctgcccgcgaactgcgcgctctgctctgcccttctctgcagcgccccctgtaggaaagaagggaattgcatgcggcccccccgcccccggccagagctgtggatttaccagggatctggcaaagcagtgatcagaacagatttgtaacgttgtagtatctaggtctggaccccaatatttacgaagtcttcatgagtagaatacgaacattctcaggccgggtgcggtggctcacgcctgtactcccagcactctggggggaggccgaggcgggcggatcacttgaggtcaggagtttgagaccatcctggccaacatggtgacaccccgtctcttccaaaaatacaaaaattagccgggcgtggtggtgcgcgcctgtatcctagctagtcgggaggctgaggcaggagaatcgcttgaatccgggaggaggaggttgcagtgagccgagatcgggcccctgcactccagcctgggcgacagagtgagactctgtctcaaaaaacaaaaaaaaaaaaaaaaaaagagagaaaacaaaaaacaagcaaaaaaaaattctctatttaaaccggatagtaaaaagcctatttttttttttgagacggagtcttgctctgtcgcccaggctggagtgcagtggtgcgatctcggctcactgtaagctccgcctcccgggttcacgccgttctcctgcctcagcctcccaagtagctgggactactggcgcctgccaccaggcccggttaattttttgtatttttttttttttttttttttttagtagagacgggctttcaccatgttagccaggatggtctcgatctcctgaccttgtgatccgcccgcctcggcctcccaaagtgctgggattacaggcgtgagccaccgcgcccggccttgtaaaaaacctattaaaaggctggtgtgggaccggaatgggagggaggttggcctgtggatatatagtctctgtacagtgcaaagtagttgttttttgttgttgttttgagacagggtctagctctgtcgcccaggctggagtgcagtggcacgatcttggctcactgcagcctctgcctcaagcaattctcattcctcagcgtcctgagtagctgggattacaggcatgcaccaccatgaccagctaattctctaattctctctctcactgtctctctctctcatgtgtgtgtgtgtgtgtgtgtgtgtgtgtgtctaagaatggggtctcggctgggcgcagtggctcatacctgtaatcccagcactttgggaggccgaagctggtgtatcacttgaggtcaggagttcgagactagcctggcctacgtggtgaaatctcctctctactaaaaatacaaaaattagctgggcgtagtggtgcgcgcctgtagtcccagctactcaggaggctgaggcaggagaatcgcttgaacctgggaggtggaggttgcagttggccaaggtggcaccattgcactccagcctgggcaacagagcaaaactctgtctgataaaagaaaagaaaagaaaagaaattaaaaaaagaatggggtctcactgtgttaccccaagctgatctcgaacttgtgcctgaaacaatcctccctgcctgagcttctcaaagtgctgagattacaagcatgagccaccttgcccagctgctaccgagttttaaatacaataaaaatttaaagaccttctattcaatacaacaaaactggatcacacttttgactcacctcccttcagagatcccgttaaaatgtaggcagagaaattgtgaaaaggaataagcaaggtcaggtgtggtggctcaagcctgcaatcgcagcactttaggaggccagggcaggaggatcactggagcccaggagttcgagactagcctgggcaatatagcaagatcccatctctacaaaaaatagaaaaattagccagacgtggtggcatatgcctgcaatcccagttactcaggatgctaaggtaggatgattgcttgagcctgggaggcggagactgcagtgagcagagatggtgctccttaactccagcctgggcaagagagggaaaccctgtctcaaaaaaaatttttttttaagtaaactgggtaatttataaagaacagaaatttactttctcatggttctggaggctgggaggtccacgatataggcgcctgtaggttgcgtatctggaaagggcctgtgcctcactgctggcactacctatgggtcctcacatggaggaagaaagtgaacccattctctcaagcctcccccgaccttttttttttctttgagacagagtctcactctctggcccaggctagagtgtagtggcacgttctcggctcactgcaacctctacctcccgggttcaagcgattctcccgcctcagcctcccgagtagccaggactacaggcacctgccaccacgcccagctaatttttgtatttttagtagaggggggtttcaccatgttggccaggccagctttgaactcctggcctcaggtgatccacccgccttgggcttccgaagtgctgggattacaggcatgagccaacatgcccggcctattagtgttctctcttgaagcctctgtttaggaagcttccttatgcaggttccctaccactacaattgacgttttgtatcaaccaagaaacctaaataaaataaaaataggaagtataaaaaaggtcatgaaatactgacctttaaccatgctgtctttttggtacatttcctagactagcagagtctattagaagtggaagaaactgctgggcgtagtggctcatgcctgtaatcccagcactttgggaggctgaggcgggtggatcatttgaggtcaggagttcgagaccagccatggccaacatggtgaaaccctgtctctactaaatatacaaaaaaattagctgagcctggtggcatgcacctgtaatcccagctactcgggagactgaggcaggagaattacttgaacccgggaggtggaggttgcagtgacctgagatcgtgccattgcactccactgcacttcagcctgggtgaaaaagtgagacactgtctcaaaaaaaaacaaaaaacaaaaaaaaggccaggcatggtggctcactcctgtaatcccagtactttgggaggccaaggcaggtggatcacttgaggttaggagtttgagaccagcctggtcttgaaatacaaaaaaattagccaggtggtggcaggcacctgtaatcccagccactcaggaggctgaggcaggagaatcacttgagcctgggaggcagagtttgcagtcagccgaaatcgcgccactgcactccagtctgggcaatagagccagactcagtctcaaaaaaaaaaaaaaaaaaaaaaaaagccaggcacaatggctcacgcctgtaatcccagaactctgggaggctgaggcaggcggattgcctgaagtcaggagttcgagaccaccctggccaacatggtgaaaccccatctctactaaaaatataaaaattagccagacatggtggcgaacgcctgtatttccagctactcagcggggctgaggcaggagcatcccttgaacccgggaggcagacatcgcagtgagccaagatcgtgccactacactccagcctgggtgacagagtgaaactctgtcttaaaaaaaaaaattaacaactcacacccctaaacacacatacattcctaatcccctgatccctctccactttaatctttggcactttctaatatgctaaataatttagccatttatcaaacttctcattcactggctgtgtcccaccatcagaatgcaagttcctacagggcaggggtttttgctttttgtctatcttggtcctgctctatctccagctcctccaaaagcccgatgcctggttggtgctcaacccataatgtgtgttgaatgaatgagtggagttcatgaagactgggatcagaataacacaagacttgcaggacaggccaggttctctggtcttaccccaaagggagaaaatgtgatgcatgagatctttcagtagagggcgtggggagaactggctacctgaaaatacaaagataaccagccctggagctgggcacagtggctcacacctgtaatcccagcactttgggaggctgaggcgggcggatcacctgaggttgggacttcaagaccaacctaaccaacgtggagaaaccccttctctactaaaaatacaaaattagctgggcatggtggcgaatgtctgtaatcccagctactcaagaggctgaggcagtaaaatcgcttgaacctgggaggcagaggttgtatgagccaagatcgtaccattgcactccagcctaggcaacaagagcgaaactctgtctcaaaaaataaaattaaaaataaataaataaaataaaaacataaaaattacctggacatggtggtgggtgcctgtaatcccagctgcttgggaggctgagtcaggagaatcgtttgaaccagggaggtggaggttgcagtgagccgaaattgtgccgttgcactccagcctgggcaacagagcaagactgtccaaaaaaaattaaaaaggccgggcgcagtgcttcatgcctgtaatcccagcactttgggaggccaaggcgggtggatcacctgaggttaggagtttgagaccagcctgaccaacgtggtgaaaccctgtctctactaaaaatataaaaattagccaggcgtggtggtgggtgctaccaccacctatacatggctaaatctatcattttcacttttgcatagctgatgggttaaaaatgttacttgatgttgttttaacctacgtttctttaattccctgggcagctaagcatcttttcatgcttattaatcaacagccttcctttttctcctttttattatcattattattattattattttttgagacggagtcttgctctatcacccaggctggagtgcagtggagcaatatcggctcattgcaacctctgcctcccgggttcaagcaattctcctgcctcagcttctgaagtagctggggctacaggcgtgtgccactacacccggctaatttttgtatttttagtagagacgggtttttgccatgttggccaggctggtctcaaactcctgacctcaggtgatccacccacctcagcctcccaaagtgctgggattacaggcgtgagccactgcgcccggcctggccttcttttttctttgttaaagggctttgctcatttttctgttgactttccgcttcctcttggttttgctcttatttttatggcaaatggtttctgctagcttgtcatctgttttttaacctactttatggtattttcccccaatgcttctgtaaaaaaaagtattgagacataatttatataaaatatttatatgtaaggtataaaattagatgtatagacctgtgagatcagatcaccacgtcaccacaagcaaattccaaaaagttttgtcctatttattatattttgaaagtgaattctttcttcacagtttgtggattttgtgtcttgttcaaaagattgtgtcctcttcaagactacatagtcttcatatttgcttcttttttttttttgagacagagtctcactctattgcccaggctggagtgcaatgacaccatctagactcactgcaacctctgcctcccaggttcatgtgattctcctgcctcagcctcccaagtagctgggattacaggcgtctgccaccacgcccagctaatttttgtatttttagtagagatgggggtttcaccatgttggccaggctggtctggaactcctgacctcgtgatccacccgccttggcttcccaaagtgctgggattacaggtgtgagccaccgtgcccagccgcttcttcatttttttttttttttttttgagatgcagtctccctctgtcacccatgctagagtgcaatgtcatgatctcggctcactgcaacctccacctcccaggttcatgtgattctcctgcctcagtctcccaagtagctgggattacagatgcgcaccaccacgcctggttaatttttttttatttttagtagagctgaggttttgccatgttagccaggttggtttcaaactcctggcctcaagtgatccacctgccatggcctaccaaagtcctgggattacaggagtgagccactgcacctgcctctttttttttttttttttttcgagatggagtgtcgctcttcttgcccaggctagagtgcagtggcgcgatctcagctcatggcaacctccgcctcccaggttcaagcgattctcctgcctcagcctcccgagtagctgggattacaggcatgtgccaccacgctcggcttattttgtatcatccttttttctttctttccttctttttttttttttttttttttaaattagagatgatgtcttgctgtgtcgcacaggttggagtgtagtgggatgaatcacagctcactgtagctcactgcagcctcgaacttctaggctcaagcaacacccccgcctcagcctcccaagtagctaggactacagccgtgtaccaccatgcttgaccaacttttaaaaatgttttgtagacacagggtctgctttgatgcaggctcagagcccagcctgacagtgctatcccacaagattcatttgcctggctggtcttgaactcatgtcctcaagcaatcctcctgtcccagcctcccgaagtgctgggattacagttgtgtcactgcccccggctttgttttttcttagggcataattaaaacctataattgcatgtttaatctgtttgattatttgtttagtgtctgcaccccagacaagagcaagggctatgtgtactctgtctcttactgtgtccctggggcctggtactgggcctgactcattgaatcactcaactggctgccctcttaaaatgggaggaataatgcttcctaggaatcaagccatgagaaactaatgttaagaagtggccaacattatctgaaccatgtgtaaccaagaggagaagtgccaagagccctgagcacataccctgggctaggtaatgggagcccttgtaagtctctcttccatcttacacggtctgatagatgctagaaatttgaacgtgtaggatcaattgcaaagtcaaaacttctgctggctctttgggtttccaaaggatggaaatatgaagtagatgctgttctctagtagagcatcttagtcagatgcggatatagaaagatctcagggccagaagggtatacaaatgtaatgagaatgaggagtctgattggcattgtccaatatggagccactggccacgtgtggccacggaacatgtgtggctggtcctaaagtcttcaacttggccagcagtgctgggctcagctggtctcgctcgtatgtctttatagctactcctctcaagtggtggactcagtttccccacctctgaatctgggtgaaccctggactcactttggccagtagaagatagcagaagtggctgcgtgctgatcagctggggctcgtgaggggctggctggtctaggatggcctggattgggacacctgaactctccttctcacggtccctgcttgtccagcaggttggcctgggctttctccgtggcagaggtagaggtccaaagcaaaggagcagcacacaggttctcttcaggtggaggaaagcagaggcgtcatcccagattatgcctctttcacataaaaatgattttcagcttaaggcaattaagaagcagaaaatacaggaaaagttcaggtttccctcccctttctgcctaaaggcacaatataaactctccttcactggagacaacccttaactttgcccagccagcggcggtaccagaggcaccgcagagaaatcctgctgcatcggcttcctctcagatatttacctatgcacagtttctcacctttggaggcctaaaactttctttttcctgttatttctctacaaatttattgtgtcttttggaatctgctgtgtaaggcagtgttctgagccactgtgttgttacttttcatttaggtttgtcctgtgtgatatatgctgcatgtattaatgaactgttcttgggcaggcacagtggctcacacctgtaatcccagcacttcggaaggctgagcacaggagttacagatcagcgtgggctacatactgaaacacatgtagccccccaaaatacaaaaattagcctggcatagtgatgtgcctgtagtcccagctacttgggaggttaagatgggcgaatctcttgagtcagtgatgtgggggttgcagtgagccaagatggaaccactgcactccagcctgggccacaaagcaagacactatttcaaaacaaacaaacaaacaaacaaacttcttgtctgtgaatctttttgttaaggagcctattttagtcccttttgtgctgctgtaacagaataccagagaccgggtaattgataattacagggatgagccaccatgtctggcctgatatacctcttactgaagacacagggggatataaaggtcaatggctttgatggagtgtggtgccaggggcataaggggaacagagtccaggctgtgtgtgcatgtgagtgtgcatgtgagtgtgcatgtgagtgtgcatgtgagtgtgcatgtgagtgtgcatgtgagtgtgcatgtgtgtgtgtgggggggtgcacgtgtgtggcacatgtgggatgttcagaagcaatatcaccagattttgctccctgctgggcccggggcaccccttttcagctgcttcaggatgcattccaagagaggagagtctaggggaaagaaagagtttgggtagaggccaagtcatctgaactgttaatagaaaaacattagacaaattaagcagactttatttgagcaaagaaaatttatgaatcgggcagcaccctgaaccagtaaaggttcaaagtgctccacccagaaacactggcaggccgaattttttggaagtaacacagagaaacagtctgatggggtacagctcagcatttgccttatatggacttggtctgatcagttggcagcctgtgactggttaaagcacagctgctgtgacttgctgagattcaactatttgttacaagaatatagtctcagttgggaggcagtttacttaaatattaagttaggttgcagttcaacaggtatggcagcagctttgggccaaattctctttttttttttttggagacggagtcttgctctgtcaccaggctggagtgcagtgcacgatctcagctcactgcaacctctgcctcctgggttctagtgattcctctgcctcagcctcccgagtagctgggattataggcatgtgccaccatgcccggctaattttttgtattttagtagagatggggtttcaccatgttggccaagatggtctcgatctcctgacctcatgatccgcccaccttggcctcccaaagtgctgggaactttgggccaaatttaattgaatttaaacatttctgccttttggtcagcctctcaattttgagagattgaccaaaaccttgggccctgactccatttcctgtcaccatcataatggacttgttttgtttcagtattgacttcacaatttcaccttagttgaatgattctttatgctttcttcatgtttttgttactctaaccctaacagaccagttgatttataaagaatggctgcataggagtatgtaagacttcccaggggagtcaacacatcagagagactattattattattattttattattattattatttttgagagggagtctcgctctgttacccaggctggagtacagtggcgcaatcttggctcactgcaacctccacctcccaggttcaagcgattctcctgcctcaacctcttgagtggctgggattacaggcatgcacaaccacactggctaatttttgtattttagtagagacagggtttcaccatgttggctagactggtcttgaactcctgacctcaagtgatccacccgccttggccttccaaagtgccgggattacaggcttgagccactgtgcctggcctattattgttatttaagatggagtcttgctctgtcaccctggctggagtgcagtggtgcaatcttggctcactgcaacctccacctcctggattcaagagattctcctgcctcaacctcctgagtagctgggattacaggcatgcacaaccacactggctattttttgtatctttaacagagacagggtttcactatgttggccaggctggtctcgaacttctgagctcaagcgatctgcctgccttggcctcctaaagtgctgggattacaggcgtgagtcactgtgcccgaccagggagactattatgatggctatgagtggacaatgccaagaaactgaagtacactccttatcaggagtttcaacaaacaactagtcaaaatcaaataactcaaagtccatgcaataaagatagttcaatagcatttgagtccaattggtcagtctttgttcagggatgatggtgattaaaggccaaaccctccccattaaatgagagatctacattagagaggtttcagagacctccacccagcaacagtgggcaagcagcgtttataaacagaaaaaggaagtggcattggatataggctgattggttacagctcaacctttgtctaatttggacacatctggtcagtctgcagtctgcccctggctgaaggctggctgctatgattggagaagactcctttcttcttacaagaatatactgcctggtcaagttgtagtttgtttacataataaataaggttacatcccagtcaaatcctccctacaaagtatcccctattctgacctctatcaccatagactagtttttctgctttaaataaatggaatcatgcaattaaagaaaaaagagagaaaaaatgaggttacagttcactagattgcaggacttttgaacaaatttattacttatttttttgatagagtcttgctctgccacccaagctagggtgcagtggcatgatctcagcttactgcaacctccacctctggagtccaagtgattctcccacctcagcctcctaagtagctgggattacaggagtgtgccaccacgccggactaatttttgcatttttagtagagagggggtttcactatgttggccaggctggtttcgaactcctgacctcaggtgatccacccgcctcagcctctcaaaatgctgggattacaggcatgagccaccgcacccggcctggcacacatttaatttaatttagcagtaacttactccctgcgcccagaagaggtaggggcaagagttgctttccatgaagagtgcacctgatgagaaggcagctccagaagactcaaaggaaaaccgagaatcaggagagaaagaaacgtgcagtccttgcctacttcaggggaggaccccaaactcccggttgatagtagggacctgcttccccatgcgccccagctccctctccaccatgcagtcgcctcctgggcctggcgaccacagttcggggcctgctctaaggcccagagttctcagtcaggcgatgcccagctgaagtggtctgggcctcgtggcagcaccagatccagggtgaggtcacgctgctggtccgcagagtacacaggccggtagcccagcagctgcagcgcgccggcgcacacctcctgcacgcgcaggatcttagtgaagggcaacgcgtggcgccaggcctgggagacgttgcgcgcattcctagacgaagtatggaaggcctcgattggcttgccgatccccgacccgtgggtgatgttgtggatccaggcctcgagctgtggcgtgagggtcaggccggtgaaggcgtagagtgcgcggatctctgccagcggctcccgcgccaggtcctcgaagcgcaccaggcggtagcggccgcgcaggaagggtggcggcttgagtgtggcggcctcggcgatgcgcacgtggctgcggcacacctcgcgaatcaggcgcaggtgagggtcggcctccacccacttgccgttggtgcccagcacgatgccgttgtcgcgtgccagtatcgggcccgccgcctcccgggagcgcagcacggcccgcgggtcgcgcaccaggtgcacgatgcgcaggttgagcgcggggtcgctgagcagcgggtagagcacctgcaggttgaagaagcgcacctccttgagcaccacgtggctgtaggagcggcaggcctcccgggccaggctgaatggctgccgcgtgcacagtgtcttgcatacgtcctgcttgctgatggtgcctcggggaaaggcgctgcaggcgggcggcgagcacagcgcgcggctcgttgcccagttgaaaaaggcggacaggtttcggctctgtggcatgtaggcatcaaacacgtccatgtcgcacaaaaagatagagcgcatcaggtcgcgcacggccatgtgcagcgttgccgcgctgccctgcgacagggtggtccacacatgccacgcgggctccatcaggtagaagacgtcggggtgctggctgaagagctggcccaagaaggatgagcccgagcgccacgaggacagcaccagcacgtgcacacgatcctcgccgccggctggggatgagggccctggccgggagatgatgaagagcaggaggcaggtggtctgtgccaggaggagcactgtcactgtcttgctggagaaccgtggcagccacatgcgggcggctgggggccttcgggtggagtgggcaactttagggacccgggccctcatgcccatcccatgccccaattactgcccagtgccctcagggatcagccctcagattcggctaccctacccattggacttcccaagactcccaaggtctcagtcgagcactttcccaggaatacggagtcaagacataggccagaatatagtctgtgctcacagcagaagtccagttgcagaataatgtgggatatcatcaaactgtctacctacccacccacccacctacttacatacctacaggctatctatctgtagagagaaatactatgtttcaaagagaactcctgtcttttgcttcaggatacctcttagagagacccttttaggttgtggagctaaaagggcttgatgggggcttcggtggatgtcagagcaccaccaggctcgccgaggttgaatcctggctctgccacttcctagcctatgatcttgcttatgaagatcacttaaatctctctgtgacggatcactttacccgtgtgtgaaagagggataattccggtacctggctcacaggatctggggggattggggggttattataatgaagatgggggaagggaacacgcagtcatgcccataactgaggattgcaccttttacaaggtgtgcttctgtattatataatttttttaacaggcaggtataaaacttttgtcagccaggcgcggtggctcacgcctgtaatcccagcattatgggaggccgaggcgggcggatcacgaggtcaggagatcgagaccatcctggctaacacagtgagaccccatctctactaaaaatacaaaaaattagccaggcgtgatggtgggcgcctgtagtcccagctactcgggaggctgaggcaggagaatggcgtgaacctgggaggcagaggtggcagtgagctgagattgcgccactgcactgcagcctgagtgaagagtgagactccgtttcaaaaaaaaaaaaaaaaacaacaaaaaaaaaacttttgtcattaaagataaacaagtaaataaagtggacaaagaacagcaactgttgtcatcactggtggggagtgaagtgctgtaggcagcatgggctccagaaggagggtgtcctggagccctgtgggtttgcaagaagatcagttgatggggagctgggatggagcccaagaagcagagaggtgagagcagagtactgtcctggccagctgaggggactcaccaccgtccagggctgctgggagagctgcaacgctgatcacaaatccatgggagatgtctcgacatctggcaaagcaggaaggagaggagatcagagccctacagagagacagccctgtacatagaaagctccccagggtgggaacagagctgtcctgcctgccttttgcttcaggataactcgtagagagacccttttgggttgtggagctaaagggcttgatgacggtttaggcggatgtcacaccaccaccaggcttgctgaggttgaataagtctgagtagggcatttctccaaatggctgggaactggcggggtctcctgatggatggaagcgagagagctggctccaaatcccagcactgccaatggggagctatgagacctggggcaagtgacttaacttctctgaggctcaatttgcacctctgtagaatgggatttgcaatatttaacctcttagagctgttgtgatggatgctgctgcaaacacctatgaggggagggcctggggaagcattccttacacacatgcccctgttactgttactgtccctgtgctgagctacatctggagagaaagaaccccctccacctggtgagtctccccacagaggagacacccacaggccacctacccttccaatccctgtatctcccaggccatcctctggcgtccaaccaccctgagcctttagtggaccttaagaatgtcacgcatttctcacagggtggaaggaacactgagccagcctcccgcattccaaggtcctaaagtgttcttctgtttgcacctgttgcatctgcaatgatctcaaggctgggtgactttggaagggaggagcctggaagttttctccttgctcctgcatcctttgctccttgcctgcccccttcccctgtccacactgcccactgagagaagccagggtctaacttgtgagcagatctcacctctgctccttcgcctcaatgcggggacaggagtgagcggaggatgcccaacacctctgtcacctgctgactcccgagctgccttctggatccccacacccactcctggaaaacctggaagatgaggagagtagccccccacctccgctacaagtgcaactgtactttttccagtgctggctgatggatggtgagctcccttgccaacagagtgccagaaaggaagggaactcatatttgctgacttcaatgatcacaagtgctaggtgcttcgagtccactggataacttaactctgggccctgaggtgggcatgatgatgtcaatttttcaggtgaaagactcaaggcttagagagacagcaagaaagctgggactccaggactcctgttccgaagctcctggcacttctgatcccaggctgtgggcctctcccacctgtgattgccccctgcagagtgcaggaccctgctgctctggcccaaacacagttgtcctggccagcccagcccttccctgggtagggaggatcttgatcccaagctaaggtgtttgttacctgtgttccaggaaagccagaggtcttcttaaggtggttgaatcactctatgccacacagagtctccagaagaccagttcctcactgggagctttctgataaggagacttacattcagcacagtggacaattggccaagggtgcaaagttagggagaaccagtcagccaggccctgtgatatgcactttcatcttcatgattgaatgttatcctcccaagtcccttggaggtagaaataaccatccctatctgttttaattgaagcagtggggctcagagacattaatacccagtaagaaagaggcagggcaggggcttaagtccaagagccagactcccagtgcagggccctgtggtgggtcacactcctaagcctttgtccagtgaactcttccatcctggaaggactgtccccttcccctctaaattcttccgttttttgattcttttctgggggcacatatttattacatgtttaatttttagaaaaataatacaaacaggtcacacgaaattaaaaaagtagagatgagggcatcgcagacttggcctcccaaagtgttgggattacaggcgtgagccatagcgcctggccaaaatgcaattcttgactgccttgcctctgtgtaaaaggagagagaaaggaagtcaacatttgcatttgctagacattggacacagtggcttacgcccgtaatcccagcactttgggaggcctaggtgggtggtcaccagacgccaggagttcaagaccagcctggccaacaaggcaaaacctatctctactaaaaatacaaaaattaggccaggtctggtggcaggtgcctgtaatctcagctacttggaggctgaggcaggagagtagcttgaacccaggagacacaggttacagtggccgagattgtgccattgcactctagcctgggcaacaggagcaaaactccatatcaaaaaaaaaaaaaaaaaaaaaaaaattaggccaggtgcggtgactcatgcctgtaatcccagtgttttgggaggccaagatgggtagatcacctgaggtcaggagttcaagaccagcctggccaacatggtgaaaccccatcgctaaaattagctgggcagagtggctcatgcctataatcccagctactcgggaggctgaggcaggagaatcacttgaacccaggaggtggagattacagtgagccgagatggcacaattgcactccaggctctgtgacagagtgagaccccatctgaaaaaacaaaaacaaaaacaaaaatttgggcccagtgccatggctcacgcctgtgatcccagcactttgggagcctcagcggggcggatcacctgaggtcaggaattggacagcctggccaacatggtgaaacaccgtctctagtaaaaatacaaaaattagctgggtgtggtggcgggcgtctgtaatcccacctactccagaggctgaggcaggaaatcacctgagcccaggagacaggttgcagtgagccaagatcaggccactgcacttcagcctgggtgacagagcgagactccgtctcgaaacaaacaaacaaacaaacaaacaaaaaaacatttcctaggcacctgtactgtcctggggcccagagggcctttcctaaagcctaacatcaaggccctagaggcagtgaggcacgactccacttcccctgagtctggttgcaaattaactcaccaagctattttttctcaagaatttcatggagagcttttgaaagccacaccctttgagacccaagtatggaataagaacccgcaccccgacccctgccctgcgcagtgaggattcccgcgtgcagccgaagccccagcaagacacttccaaaccagcgctagcaggggagatgaactttccacgttgctgatggaaaagccacccccagctcttcccgccaacccaggtctctggtgcaggacagaggagcgtcacagctgggccactggcccggcccccagcccaaccgagtgtggggacacctccggtggagaatgaagaaccaaagtacctcaaagcttggcgtgtctgccagagctggagcagcagccagagggacgcctctccccctgggctcagcaaaagctcccagacgtcgtctcttccaagttccaccgcacagccagctctttctcttcactgggaggttccgcaggggctgacttgctccttaaggtcccaagactattaagggacacccagtgaggctgggaaaggggctctaagaggcatggacgaagagtcgggggtaaccaagccactggaagctcctggagactcgaggcagagcgaatctgggaacagggcaggagtcccagaatgggatgttgaggatgggggtgtcctggggctaccacagggaaggacccggcgcagagctccctccggagcccggcactgcggcccgcgccctctactccccgcgcgccggccaacaaccctcggcgctgccccgcaatcttcagcgctgcctggtgaggagctttcagacgtggctgcggtcccagggtggccggcgggagccagggaaatgggagaaggaaggaaggagcaggttttgcccccagctccctctccccacccccgaccgaggggccatgtctcggggaggggcgctggccgagggcagagcaggagggcccaggtgggctggggctctaagaggcgcaccttttagccggggatgtcaaaggacgctggcagagtcacttctcatctaactgaccacaaatgaacgttgtaacccttcctcacccccccaatcgccagagaacctgggagctcctgggaggacaaaggccctagtgaaggaagtcgaatcttaatcttggccctcctcgctcttgggggcatccttgcagccaagggacttggaatccaaacccttcccaaggccccaacctcagccctaagccaagacccaggcaccttgatgacacaggaatccgtgctgcctcccggtgcagtgtcccagctgggaggagttgaaagaccaggtggccttaggagctgtgccctccctgccctagcctccgcccagaggcgcaggcttgataacatgttccaatgaatacaggatatgtttcagtaaataaaagctccccacccaccccttacaaataacagctcagcctggcctggtggcatatgactgtaatcccggcactttgggaggcaaggcaggcagatcacttgaggtcaggagttcaagaccagcctggtcaacgtggcaaaaccccatctctactgaaaatacaaaatttagccgcgcatggtagcacatgcctgtaatcccagctactaggtaggctgagacaggagaatagcttgaaccccggaggtggaggctgcagtgagcggagatggggccattgcactccagactgggtgacaaagcgagactccatctcaaaaacaaagaaacaaacgggcagagtccagtaatctgaaaaggatagagcattgggaggtcctttaatccatggtggtatctgaaacgaggagtccctgctgctgggagtagaaattagcagtctttcctggctgtggtttggcaatgaattaagatccttaacaatggtcataagttttctgaatgtatcttaaggaaataaaccagcaacaatgatttctacacaaggtttataaaagtgttgtttgtgatactaaaaaggttacatacaacaaaaaagattagaaagatgtgtgccagaatgccaaccataataacttctgtgatcaaactgctgtgatcccagcactttgggtggccaaagcggatggatcacttgaggtcaggagttcgagaccagcctgaccaccagggtgaagccctgtctctactaaaaacacaaaaattagccgggcatggtggtgggcacccgtaatcccagctactcgggagggtaaggcaggagaatcacttgaacctgggaggtagaggctgcaatgagctgagatcatgctgctgcactccagcctgggtaacagagtgagactctgtctcaaaaaaaaaaaaaaaaaagaaaaagaaaaagaaaagaaaaaccacctactgggtactatgcttattacgtgggtgatgaaataatctgtacaccaaacccccaggttgtacaatttagctatatacgaaacccatacatataccccatgagtctacaataaaagttggaaggaaaaaaaaaaaagaaataattgctttattagccttacatgatggaatattaggggggcctcatctgacttaagccgaaactgtactaatcatttggcaaaatcaggagtctttctgcctccaaatattcagtaataacatcaaaccttaacttagctatgggtcggagctgagttaataaaatcctctatatttctttttttttttttttttgagacggagtctagctctgttgccaggctggagtgcagtggcgcaatctcggctcactgcaacctccgcctccagggttcaagcgattctcctgcctcagcctactaaatagttgggatgacaggcacgtgtcgccacacccagccaatttttgtatttttagtggagatggggtttcaccatgttggccaggatggtctcgatctcctgaccttgtgattcacccacctcggcctcccaaagtgctgggattacaggcgtgagccaccgctcccggcctcttgctttttatttacctcttgcagctatgctgtgattcagagtcagaaactatcaacatctggtctgtaaataatttcatattcaccagacacagtcataattatccaacacgtagatttcacatggcatgtgaatcccactgaaaactcatctacctggggaagaactaggggactttcaccaaagacctcatggaagttccaaggtcgttaggcagagccttgtaaagcatggctgtagatgagtaataaagacaggtgtgtgcaacctctgccctccctattctttgccattccaaaccctttccctcgaaaaaggtacatgtgatcttccattttgacttttttatttatttatttatttattttaacagatagggtctcactctgtcacccaggctacagtacagtggtgcaatcatagcacactgcagcctcaagctcctgggctcaagtgatcctcccaccttggcctcccaaagtgttgagattacaggaatgaaccaccatgctcggcctcattttgaacattttaattagaaagttacaaaacatcatgggttctttatacaagatttgcattagaataatttaataaaatgcaaaccaatgtttatacgtatcttgtcatctttccatatctcattgccttatgtgaatttaaacaagaaactatttttcgtttagatcttaagaaaaaaatttaggcatataaaacagcctgaatattaaaaaaagacaagggggtcagtgttagggaattcctctgcttgaatacttcaaaatagctttgtttccaaaactgttttagtaagcctaaaggagcactaaaaacgacaactgatctccaaagtaaactgaggcacacactgaggggtgtgtttctgggtgggcatgaagcatggatcaccggggccatgtccttccagtggcaatgacctgcttgggatcaggaagcagctccatgtgttcttggaggagactgcccacatcctcaggaggtgaatgggctgaacaagccatcttccgtgtgcagaggccccttccagccatctctgctcctgcagacacttgcttagccacgagggtaatccactggactgcttggtattctgctagtggccaggctggactggcctgcccaggccagcatcctctttacactcttactgcttcttgtgtccttcccaaagctgcccgccccactctgatgggcaccctgttccttagtcaagggaaacgccagccgctgggcttcccgctagccttccaaataaacttgtggttgtcaggcagcgggagccaatcccaacaccaacccctgtcgcccctgtcctttgcaggaagggggagggctgtcaaggaggaggagggccaagtgcccaggctgttgggtgagggccagaaagaacctgttgtgacaatgctttcttcccccagtgctgctgagggggctgagaatgaaacagcccctctgacttcagcctgccatccaggggcacagacagagggaaaaatagggcaaagagcccagtcacagtacggcaaagatccagggctgctcagctgagctgatgacagatgactgactgttgggctggggcaggtggacggtccaagtgtccttcagcggccctccctgattgcctgtgctaatgcggcccttgcccttgggccctgcccctccaggtctccagttaaaggcctcagctctggaaatcaaagctgtgaatgggaaatggagaagcccaggggtgcaaagtgctagtgattggcatgtttgtcacaagagagccctgaaaagagtaagagtggctcacaacagaaggtagaaatgcacagtgtgttcctcagttcaacagaggaaaagtctctgcttgaccagagatgggactctttccaagatgtctgaactgactgcaattttctcctgaaattcaacgctaaggcaaagaaggaaaacccaaaaagctaattatagcctccaggaactctcagacctttccacaaactagtccctgacaattctgcaggagctctgaagatacggaactgtgtagagcaaaaccggaaagaaccgttgtctctgagggaaaagcacacaagcccgcaggtgtccgctgggctctttcaaaaggtcctaagatgttcccagaagatgacaatgaggcagccacggtcctgctgagtcttcagaaatggcctttctaggataagtgctccttacacaagtctccccggggcgtcactgtcacaggaatggtggtcaccacctgattctgaaacacgaagatcttgattctttcaaacacccagaggaagataagcaggatgctgacatactgcacccaggcgaactttaccatctcccagaatcctggctgataagtatggacagttaaggagtgaagggccacatggtgttaagtatgaagagaaaatccaagatggaattggctgtggcagaggtatctcgaaaggaggcaggacctctgtcatgtacacacccagatggaagctgacctgaacttggccaaatggtaaaaccagccacatttgatttgagctatttatataccaagcctgatgaccaacctcctaaacagacaactatgccaaactagattgatcatggactagagatatcctgagctgttaaccagccatccatccatcttctaaaatcttccagttgtgtaaacttggaacacccttagcccctgcctaattgcacctgtacggaacacaatttagctgcttcctaggtttgtgtctctggaattgtaattcctaagaccccagttaaaatgccttctcttttgtttgcttctctgcagtgttggtgttggtttcattttccattagtcgacctaagtcaaaattaaaccaaagtttaggtcagacagggactggcaagaatgtttcacataaccttagcataaaagggatatcatatgattattaagacataaatatggatgattcttacctagaagaattgcttggaaacaaataggaccaagacatgaattatttgttcctatatgaatagcagacatacagtcattttctgagacatgtagcctaagatgtcaaagacgcagccatttttatgaggctataaccctgtcatgatttccaagagaaaacctcccacgtctgttactacttgagacaactaaggaatcattcctctttgaaaactgagctaccattgattttttttaaattgttgtttgctttaagaggcagggtctcactctgtcaccgaggctggagtacagtggcacaatcatcgctcactgcaagcttgaattcctggactcaagcaatcctcctgcctcggcatcccaagtaactgggactacacatgtacgccactatgcctggctaatttttttttttttttttttggtagagacagggactcactatcttggccaggctggttgtgaactcctgggttcaaatgatcctcccaccttggcctcccaaagtgctgaaattataggcaggagccaccacatccagccttaacatggactctttaacagaaaggatatgaaatgacttccacagggtatcggatgatagcattaatcacaaatggagcatctgcggccctgcccaccagccagatggggttgggatcattcaggacggtggtaactgcaatgcaatcattaaccattaaccacgatggctgtttgactctggcagttgaaggctataaagattatttgatacctggaaattatcctgtgcttcagaactgaaagaaatcattcggaaggaaagagaaattgcatgtgcaaagctgatcacacattatttgttaaaataatagtcaaaatacttttgttaaaatacataaaaaacttggaaagagtttcttctacatgtgctgaatggctaactgaaggaatactatactgccactaaaagtagtatcacagctttgtagctgtgtggggaagtatttatattccaagtttaaataaataaaagtaacttggatcccaatgtgtttctacactacaatggctgtataaaaagatctgcagaaggctaaagaatgaaaggaatgaaaaaatagttgatttgtagggcaatgttttctacttttgttttaaaattccctctattattgcaataatgccactagtatatgccataaaatcagtaagcaatactggatttgcagtcatcccccttgtgagacgtctgtgtatagtctccatgatgtctgcttgccaagtaacactgtagatgcttttagagaaaacctcagccaccgaccagacaaacgtgccgagtccacacatgccatggcctagagctctgtaaggaataagcacactgtgccttctggcaggaaacaggggcactcctgttctcctgctggactgctaatgtggggagagtcacccacgttctctgtttttctctgaaaagcatgaacagcaatttgtctttggcatctgttataggtgtggataggtgtggtatggggaacaactcaattaggcttatattttttaaaagagaaacccactaagccagtggtgggataatgatggcatttaaccatcactagcctgctggaccatgggatgctggaggggtgggggcggtcccaggtctgaagatcaggacgaaaaagacaaatcctggacagcatatttgctcccatcgttgagcattcacgggttttgacattttcatcacaagggttccagttctgcttgtctctgttgcccccactaaccttgaaagtcctgagcagcggctgaatgggctctacctgtgactcaccgttcctctcctggtaggcagcaacaatatgggtgaggtcgtagtcataggcaaaggggctggtcccgttgatcacggatatctgggacacgggaggaggatgtggtgtgagcacctgggagactcctccccttttccttctacccttctgcccacccaggctggtcccacagagcaccctcttgttcttggtggcctactgcagtatcaataatcttttcttcaaagatgaataaaacaggctgctgcccacccaggctggtcccacagagcaccctcttgttcttggtggcctactgcagtatcaataatcttctcttcaaagatgaataaactctcttgcaacaatttaagcccatttactctcagtctttctttctgtggatggaaataaggggtcagtgtccatgttttacaggttttaaagctatttttaaaatacccctctttatctcagcgggagaaagaattccttaaattattttaacagaccgtattttcgccaggtgtggtggctcatgcctacaatcccagtgacttgggaggctgaggcaggaggaccacttgaggccatgagttcaaggccgtagtcaatgatgatcatgccactcactacactccagtttaggaaacagagaaagacttcatctctcaaaaaaaaataaaaataaaaaaaaataaaaagccaggcatggaagctcacgcctctaatcccaacactttgggaagcccaggcagatggatcacttgagaccaggagttcgagaccagtctggccaacatggtgaaaccccatctctactacaaagaaaacaaaaattagccaggcgtggtggcatatggctgtaatcccagctattcaggaggctgaaatcagaggatctcttaagcctgggagacagaggttgcagtgagccgagatcatgccactccactgtagcctgggtgacagagcaagactctgtctcaaaaataaaaataaaatacaaataaaaacccctacacaaagacaaaaaaaagaaaccatacttccaactcctttgtcattttcttggtcttttctgggtgctaagttctttatcacttttaaatatagagatatagataaaatgcaaaccataagcatataatcccttaaaggaggaaataattgcttgctgttaatgtaatctgatatatagacattcaaacaaaaagtgccatattcatttcatatgttgcagcttcctattctttacaacttatattgattatagtcagagcaacagtaaaacccactatatatctacaagtctgggtttatggctgtaataaccgataacatccctttttcattttcagaagtacctcagctcaacttctatggtccccattgtgataaaataaaagtgaggaatgagtgattagatgcatgagttctgcacacagacaggctctgttatctttcaagatttgagcctttgggaaaattaatcactttaagccccagttacgtcttctgcaaaatgagttcattatttaaacaagtatctctgtgagcttaccatctgccaggcagtgtgctaggcacggatgtgatagtatttgagatgccactgctgtcaaggctgagggagacagcaaataaacacacaaacacatatcctgagtaggccaggcggcaggagggagagtctggctgaggaatggtggaaggaggggctgctactgtagaagcaggtcagagaaggactgggcttggggatatctgaacagggacctgaatggcatggtccgataagccacatggatgcctggcagaggaaatggcaaaagcaaaagccctgaggtggcagctgcttcttgggtttgaggaacagcaaaaaggccaggggggctggaagggagcaagcgggggcagtgatgggacaagtggctggagtgcggggaaaggacaatgcaggcagctcagaggttgccatgatgattaaaggagatgatataggtaaacgcctgcactcaggggtggcatatgttatgagttcagtaaactatggctagtaatatttctgaaatactttacatgaacattttacatcatcattttacagtgtccttcggagtacatcctgcgtgtgaccaagcgtgtgtatggaagacacaatgtgtgtgtgtgcacccacgtggacctaaaagcaataagcaatttagttcttcgacaaacacagattttgtttctcttcccttctaggtgtaactatgcgtgtaccttctctgtagtttgaaaaaattcatggcaagaattctacagagaccctctttggtgccacccacaaagaaatgatatttctacttttcttttctttttcttttttttttttttttttttttttgagacagagtcttgctctgttgcccaggctggagtgcagtggcgagatctcagctcactgtaacctccacctcctgggttcaagcaattctcctgcctcagtctcccaagtagctaggattacaggcacgcaccacacgcctggctaattttttgtatttttagtagagacagggtttcaccaggttggccagactggtttcaaactccggacctcaagtgatccatccgcacatctccgcctcccaaagtgctgggattacaggtatgagccactgcgcctggcctgacatttctacttttcattcccctctttaaagaacttaatgaacagtaacacagagaaacaaaggagctggacaatgagaagcgctcttacgttgtatcgggcatctaggccaccacagctcagcggctgcttctgctgcagcctcaggtctccgttcacgtataactgggatcccgggacaggaaaggaggactggagaaacgccatgctctgcatcacgagggtcgccatcctctgaaatcattagaaggaccaacaataccaaccgccatcagatctgaagggctctgggtgctaagagtcacctgtcttggctgaaacctaagaggccctcacatacctagcgtagccatgcaggaaacactgcctagaaccttctgagctattaatagcccatgtcagttaatatgactagtgaaaaccattccattggcctaagttaaatcccaaactacatggggaagagggcccgctagagtgcgggtcttctagaaatcagaagaaggactctggtctactaaaaagacacaagggagaggacagcctcccagcggactgactcacgtgtaatcgataggagaaagtcaggatgagctgcacaccgagaacgtgctccgtggactgcaggggaagctccagcttaaaatgtaacatgtccgtcttcccatcctggttcctgtcttcttctctagtctaggaaacccaaacaggcccagcagccctggtcactaatgagtctgggaggaatccacatcacttctgtaaatacacaatgacccactgtcttgctgtacacaacaggcattatctcctccactaaaagagaaaagcagatagatgtaagtgcattaatactggggagagacacaaagtgcatggtccctgaacttcatatctgggcctttcaaatgttcactggccaaaataaatgggcaataacaaaaaacatctggatagtatttgtgcctttcagttgtctcatgtgatcttgcttattttgcactgatatttttttcttttttacaaatatgcctgaatttgtatggaaattttaagtagcatgtcagaatagtcttctatgtctctagaagtcaacttgttaaaatagaaaaacacctaatcctaatcattatgcattcctccaacaaactcaaactcaacagaaaatcaccaagctctatttttttttgtttttttttgagccggggtctaactctatcgcccaggctggagtgcagtgacgcaatcacggctcactacaacctccgcctcccagggtcaaggaattgtcctgcctcagcctcctgaggagctgggattacaagtgcccaccaccatgcccagctaatttttttatttttagtagagactgggtctcaccatgttggccaggctgatcttgaactcctgacctcgggtgatccgcccacctcaggctcccaaagtgctaggattataggcgtgagccaccgcacccggccttaccaaactctgtttatagattctgaaaccacgagtgtctttgcttcagattcttgatgttggatcttatctcatcattcgtgtgaggacctgaaagccttgtgcatcttttagtagcaatcaatgaaatgaaaaaggaagctatgtcaaatcagcaaagtattaaaaccatatctatttgataaattacgggcatgaaaggaaagaagacagaggtctgtagaggaaaaaagacaaaatacagcttatgaagcatatgtaggcagtgaaaaaaaactggtatccactcctaccatccacagtcttgccaaacagtgatgctaaaatgatgatcaggaaagcacggttactgaaaagtgatcactgctgacatggtccctctgcacaactctggatctttttgctacaactgatcctttcccactgtggattcccagaacaattctactatcgtgtagcagcattcccatctggatccaccatctatggattcattttgattcccaccattactattacgtaaggaagagattttttgtgtgtgtgctttttcaggctaataataaggtcatttgaaatgaagaaatctcaattttcagaaactttcaattatttctttctttctagacaataatgttccttctcttaggtcttgttttagagaaacctccctcccttttctcttggatacttcctctctgccctgtttcatcagcttcggggagggatatctgctaccagggctgatgatcaagttactgaggcaatgatggactagtcattataggtaggatgaaaagagcctgccttgcggatcatgaggtcagaagatcgagaccatcctggccaacatggtgaaaccccgtctctactaaaaatacaaaaattagctgggagtggtggcacgtgcctgtaatcccagctactcaggaggctgaggcaggagaatcgcttgaaccagggagttggaggttgcagtgagccaagatcttgccactgcactccagcctggtgacagagcgagactccatctcaaaaaaataaaataaaaaataaataaaagagcctgccttgtctcctgtggattttcttcaattgggatctgggtagaaaatcttatgtaactctctgtgatggatccacaccttctagatctttagggttggacaggaagaaaagagcacatttctcaacttgcaacagaggatagtggccaggagacaactgccagaagaatccagactccaacacactgtgggagggggaaaagctcatttcctttgatctttacaataaatgtaaagccccaggcaggcagaacaggtattttcccattacacagatgacaaaatcaaggatgagtgagattagggcatttatcagaggtacagcaagtaatggtgaagacaggatttgagatcaggtgacttcaaatctggtcctctttttaggaccaaaatgtctaaaattattttaaaaattccaaatgaagacagcaggttggacaaatcttcctgaaaaacagcagcaccaggcatctacgtctgtatacttgcctgtgcacatccttccattccaagttcgcgggggacagatttggcacaacaccatcaatagtgtctacttgttaaattcactcattgatctgttacgtactttttggaaacacgccaggcactatttcaaataatgagactataatggtaaacaaaatagacaaagtccccatcctaatggggcatacattcccgatggacaatgtagaaaacagtgacaagtgccgctgacagaaatgaagcaggctaaaattagagaataatgaaggtaaaatttaacagaaattggccaggcgtggtggcttatgcctataatcccagcactttgggaggcccaggtgggtggattgcttgggctcaggagttcgagagcagcctgggcaacatggcgataccctgcctctattaaaaatacaaaaattagctaggcatggtggcgtgcacctgtaatcccagctactagggaggctgaggcaggagaatcgcttgaacccagaaggtggaggttgcagtgagccgagatcgtgcctctgcactccagcctggtgacagagcaagactctatctcaaacaaacaacaaaaaaacccaaaaagaatttaacagaaatttttaaatattcaggatgacccaacttgttggagtcctgaaggaagtgaagtgatggggtgcaggaacatctcagagaggagggatccaggctaatcaggtacatgtgctctgggtacccgtgggatcaatgcatctggcagagtgggtgagaaggagagcagggtggagagaggggggagagaagtttcgatggaaaggatgtgtctcccacaaatgacctgtcaccaagctggactctcaccctcctggggctggcgaagtttggctgtgctcctctgttatcacttggaccactgaataaatcaattatttaattccatttagttgaaagtaagtttaacatatgtgcaatagctaacaaaggcaggcattcaaaggctactacttctttaacacaaattctaggtcgctatctaacctccaactggtacttagccaagagaattcacatatcacaccaccaccttatatctacaacgtatatacaggctttggaacaatttttatatccattcattgtcccacgtgattcctctgcatatcccaggagagatgtgggtactctcatgccctgtatatggatagataaattgagggtgaggttatgaaacccagtgacagaattgggactaggaccttgtgggacaaggatcttggtttgctgactcctgattcagggctcttctataatagctcataagaactctaactgaaaagatttctcatggttaaaggaggataaccctttagagatacacatgaaatccacacgcatgtactgagcagagtcagagggaatttttttgttttttttttgagacgaagtcttactctgttgcccaggctggagtgcagtggcacaatcgccactcaccgcaacctccacctcccaggttcgagtgattctcctgcctcagcttcctgactagctgggattacaggtgtgcgccactacgcccagctgatttttgcatttttagtagagatggggtttcaccgtgttggccaggctattctcaaactcctgaccttgggtgatctgcccgcctcagcctcccaaagtgctgggattacaggcatgagccaccgcacctggccagagggaatttaacatagggaataaatagtcccataggtattagaggactgaagacgtaaaaaggggatatcccagcaacacagagatagtagctgcagggaacatttcccacacctaggactagagaagaaggggaagcgggtgggactgatagaacttagaggttcagggaagaggcctcgaagagctgagcctcagacttcaagaagggaccgcggcccagatggggccaggacctctgagcttggaggaagcatgcactagagggaaccttgaagccggtaggagaggcgtcctgctccttcctgtttgctggttgtccctgtttgtggcatccacagtggttcttcaccctggcagtggtgactggtttcatttctttttttctgcactcccagaacaaggctcatcatgcctcctactggcagaacctaacaggaagctgcaggggaagaaggtggtttccagcatctcagcaggaacctggaagctgagcgtaggagggtgggtttggagctgagacaatacctcataaccagcacaccacctgactgcaggaattgccagaaattcaagtgccattgtttccagagtatcctgatgtgtgacttttttccccgtcaggaattcccagcatctgacggtttgttggaattttgtttggtttctgttttgtttgcgtacatttcattcatttaagtcgtattcttttttttttttttttgagatgcagtctggctctgttgcccaggttggagtatgggtggtgcaatctcagctcactgcaatctccgcctcccgggttcaagcaattctcgtgcctcagcctcccaaacagctgggattacaggaacctgccatcacacccggctaatttttgtgtttttagtagagacggggtttcaccatgttggccaggctggtctagaactccctacctcaggtgatccatccgcctcggcctcccaaagtgctgggattacaggcgtgagccactgcgcccggcccatattcttttattaaaggttaatttcctagtttataccagtgtctatttcaccatatacttgtcatcaccgggtgctcctttctttttaagctaaaaatactctttggcaccagttgtgggtctctagcaaagcagaaactgccacttcgtggttcctttccacctttctacctgtatttctttttttttctatttctttttttcttgatacagggtcaaaaaaggctagagtgcagtggcacgatcacagctcattgcagccttgacctctcaggctcaagtgatcctcccacctcagcctcctgagtagctgggactataggcattcaccactacccctggctaatttttaaattttttatagtagggcctcactatgttgcctaggcggtctggaactcctgagctcaaggggctagcctcccaaagtgctgagattataggcatgagccacagtgctcagccttgtatttcaatctaagataccattacttataaaatgaaccattattttatataccactgataaaagaaaaacatttccaattaaactatgacacttttctaatcacttactttttaaaaagttactaaaagagcttttagatttagacatatttacacagatatgtttatttacttagaaaaatataagcaaaataggtcggggcagtggctcacgcctgtaatcccagcactttgggaagccgaggtgggtggatcacctgaggtcaggagttcgagaccagcctgaccaacatgatgaaatcccgtctctactaaaaatacaaaaatcagccggccgtggtggtgcctgcctgtaatcccagctactcatgaggctgaggcaggagaatcgcttgaacccaggaggcggaggttgcagtgagaagagattgcgccactgcactccagcctgggcaacagagtgagacttcatctcaaaaaaaaaaaagaaaagaaaagaaagaaaaatataggcaaaataaattgattcagggattcctaaaacttctttacatcctcatccttttgagtaacactttaactcagtcaacaacccatacttttctatgcaactttgtcctttgtgccatcaaacatgttggtgatacagcattaaaagaaaaacaaaaacaaaaaacaaaaattcagctgggcatggtggctcatgcctatagtcccagcactttgggaggccgaggcaggcagatcacttgagctcaggagttcgagaccagcctggccaacatggtaaaacctcatctatactaaaaatacaaaaatgagccaggcgtagtggcaggagcctgtaatccagctccttcggaggctgaggcaggagaatctcttgaacctggggggcggaggctgcagtgagccaagattgcgccactgaactccagtctgggtgacagagtgagaccctgtctcaaaacaaacaaacaaacaaacaaacaattcataaaagaaactaaaagccattggtctgggcccttaagcagactttgaaattatggagagctttcctgtttttaaaagcctctcaaactttcccttacttgctctccattcaattcaggggttaaaaaaatgttctactactgtctctggggtttcctctgaggttgctgatgccccttctttttaattgcatttttatttttctaacacctacctcttacacagaaatgatgccccttctgcatgttttgatgccggcacaggtgtaagcaatgagaactatgccatacctgcctccttgccaacagttgataaccacagacaggaagacactgatttcagggatgagaagaaacaggtgtcttagaaacacggtactctccactcatcctctggaatccttctataaccttcagtccctgtattctctgggtccacacatgccttcaagagctatgtcagcctccttgaggcttgagggggaaaaagtcactctgcttttctcttctctcattaaaaacaacaaaaactagacttccaaagcattaaacatgtagggagcttagagacgctgtccaggatgagctgaccaaagcagaagcaaggctgtttgtgacttcagcatttcccccaattagccactgcaaagccacctcccagcacttggtccaaccttaatcaacaaccactgtttcctttgccttctggacagtttcctggatagactgacgtcagtctggctctatgttcaaagttagaaaataaaagtagtttgttgcaataagggctaagattttaagatatagcataagaaatactgagttccagtccagactctgttcacttcaaagcagtggctcacacctgtaatcacacctgtaatcccagctctttgaaaggctgaggtgagtgtattaccagagttgaggagttctagaccagcctggccaacatggtgaaaccctgtttccactaaaaaacacaaaaaagttagcccggagtggtggtgcatgcctgcagtcccagctacttggaaggctgaggcgagaggattgcttgaacccagaaggcagaggttgcagtgagctgagattgtgccactgcattccagcctggctgacagagtgaaactctgttgcaaaaaaaaaaaaaaaaaagaaaagaagaaaagctagggcaaattgtaccacttctctatttctttttaattttttatttttttgaaatgtggggtcttgctatgttgcccacactggccttgaactcctgggctcaagcaatcctcctgcctcagccttccaaagtgctaggattacaggtgtgagctatcatttctggcggcaaatatttttatctcatttacctgatcatttagaaatgtatctccaggtcttgagataacatttgcattgaaaattctcagtttctcagttttaggcattctctattgagttcccacaaggaaagatgatttagcttcttctctcccccaattcctcccaccatcccctatcacatacccaatacctttctcattacccccaatagagttaaaatctctttttagtaaacattcagtgttcatataattaagactatgtcaatcctattcacaactctgataacattttggttctcagttttccttacttttcatttccctgcagttaataattatttgcttagttttctatgtacttataccatttcatcaaagagctgctattccaattcctcaaaatttgatgtttaaaggcataagatttagtcaaaaccttgttcattgaaatattgtccctaggccgggcacagtggctgacacctatgatcccagcagtttgggagaccaaggcgggtggatcacctgaggtcaggagttcgagaccagcctggccaacatagtgaaaccccttctctactaaaaatccaaaaattagcctgtaatcccagctactcgggaggctaaggcacgagaattgcttgaacccaggaggcagagttgcagtgagcagagaattgcagcactgcactccagcctgggcaacagaacaagactgtgtctcaaaaaaaaaaaaaaaaaagaaaagaaaagaaaaaagaaaagaaaaaaagaaatgttgtccctaatagtgaaaaagtcaaagcaaacctcaaaaagaatacagctgattaataagtattgatacatatacaaaactgagccttcaatttctgtcattatatctacctgtaactctatcatattttagaatgagcatgcacttttgtaatcagaatataagaacatttataaagtaataggagaaaagtaacctgaatcatattaggttggtgcaaaagtaattccggttttttgtcattacttttaatggcaaaagccgcaatgacttttgcatcaacctattactattttttttgcagttatttatacgaccaatcggatttttaaaaacaattttatttagttgctgggaacaagtctgattttcttttctcctcagctatacaaggttggcttgtagggcaatcatcttagatatgtctgaagagattcgaatttgaaagaaggaaaaccagaagtttcata

SEQ ID NO: 288 - DNA, 842890 bp, Homo sapiens
agagtctagactccacctaggctagaaatcgaggtttagaaatgaacaggatacacgtggaaggtgattgaagctgtgggcacagaggtatttagccagggagggtggatgagcagagaaagagggtctgaacccaagctccacggaatgcctgccacccaagaactaggcagcgtgtgacgtagcaacagaagcaattgtgagaccccaagtcatgtgattattgtgggctcaagtgagcggtcctgtgtgtatgaacacttagtgctgaggctgatgagagggctggggtgcgggagggctggggccagccagggcaggtgcgtgatgagctagcgggagccggagccccagccaggggagaggatcttgcagccagcaaccctggggcagccataccagagaagtggcaaaggggcaggagaaatgcccgatttttctctcatttcacttccagtttcctgcctttggccaaacacacaggaagccagtgggcaaagtcagcatcctgagcacagggcaggtcagagaagggtggagaatagaaagtgggtcgaaggagtagagaataaccaacacatgccatataaatgctagctatttattatttctttattctttttcttcttttttcaatatttatttatttatttattttttaagagacagggtctcaccctgtcacccatgctggagtgcagtgacgtgatcatagctcactgcaacctcgaattcctgggctcaagtgatcctcccacctcagcctctcaagtagctgggacaataggcatgtgccaccatgcctggctaatttttaaaaaaaaatttagtagaggcgggggtggggggtctcactatgttgcccaggctggtctcaagcaatccttgcctcagcctcccaaagtgttgggattacaggcatgagccactgtgcctggccatcttattatttctgataaaaactgttgcttgaggagcacgactggttgtggatctgcaggatgaagtgaggaggccctgcaagtcagtagccggctgcagtcattcctactcaggtttgcagagcctgccctttgctccctgcaagcccagctcactactgcagtttctctccaggagtgcctgtcatccctcttctgaagggacatttgctctccctgttcacctcctgtgttgactctgcttcataaaccacattggcctcagttccatgcctccctcctccctccctctctgatccaaggttcttctttgctaactcgctctgtgccttgggcctcattggggtcggtttcatttgctccttcctgctgtggagcttcctcactcccagcatctttaactacatgtatttgcatcttctgtttttgtttttttcagactgggagactagacctgaaatgaaagagttggatccaaagaatgacatttcggaagacaagctctccgttgttggggaggccacggggggacccacgaggaatggtgccaggggtcctggctcagaaggagtgtgggaaccaggcagctggccagagaggccgcggggagatgcaggtgcagagtgggagccattgggaattccccaggggaacaaactcttagggggctcagtacccgcatgtcatgaactgaaggcatttgccaaccaaggctgtgtcctggtcccaccacggctggacgaccccacagaaaagggggcctgtccacccgtaaggcgtggcaagaacttctccagcacttcagacctcagtaagccccccatgccctgcgaggagaagaaaacctacgactgcagcgagtgtggcaaggcctttagccgaagctcgtccctgataaagcaccaaaggatccacacgggagaaaagccgtttgagtgtgacacctgtgggaagcacttcatcgagcgctcgtccctcaccatccaccagcgggtgcacacgggcgagaagccctatgcctgcggggactgcggcaaggccttcagccagcgcatgaacctcactgtgcaccagcgcacgcacacgggcgagaagccgtatgtgtgcgacgtgtgtggcaaggccttccggaagacttcctctctcacccagcacgagcggatccacacgggggagaagccctacgcgtgcggggactgcggcaaggccttcagccagaacatgcacctcatcgtgcaccagcgcacgcacaccggggagaagccgtacgtgtgccccgagtgcgggcgagccttcagccagaacatgcacctgaccgagcaccagcgcacgcacaccggggagaagccgtacgcctgcaaggagtgcggcaaggccttcaacaagagctcctcgctcaccctgcaccagaggaaccacaccggcgagaagccctacgtgtgcggcgagtgcggcaaggccttcagccagagctcctacctcatccagcaccagcgcttccacatcggcgtgaagccgttcgagtgcagcgagtgcggcaaggccttcagcaagaactcctcgctcacgcagcaccagcgcatccacaccggcgagaagccctacgagtgctacatctgcaagaagcacttcacggggcgctcgtccctcatcgtgcaccagatcgtgcacaccggggagaagccctacgtgtgcggcgagtgcggcaaggccttcagccagagcgcctacctcatcgagcaccagcggatccacaccggcgagaagccgtacaggtgcggccagtgcgggaagtccttcatcaagaactcctccctcactgtgcaccagcggatccacacgggcgagaagccctaccgatgcggcgagtgcgggaagaccttcagccgcaacacgaacctgacgcgccacctgcggattcacacctgagcgcctctgtgcagggctctcactggcggtgcccaggacggacgccagatggctgcgcgctttgtcagcagtgctgtgagaagttctcccctggggtggggactcggggtcaggggagctcaggaatgtggggttgtggaggggctggctgatcacacatgccccctccttactgagcctcagaaagcaagcccctcggtgtctgacgtatctggggacacttcaaggttcactgtagctgagccatggccgctggtaacagacatcagggttccagactagccctcttgagtaactgtcctagagctgggacaggtcacgcctgcctccacatctctgtttcttcagcgggaaagtggagctggtggaggggagggaggagacatctccctctttgtcagatacatcctggagtccagatgcagcttgtcaccatctgcattttctccgtgggttgggagcgtgagggccttcctatccctccacccaccgtttccctgcagtgcacgctggcagccaccaagctaggaagtggcaggagtttgccggttgtttgtgaggggaaaaatttttttttcagagttagcaaataacagtaactactgctttgaatgccaaagtttcttagagtggtctgttacgttttttaaaaataaaacttttaattaagggagactatgttattttaaacagtcttctgttttggccagttgtctggtcaaaatcggcttcagtgattgtgggaggggcaagaaggaaaagaaacagcagcaggtttgatattcagaaagaaatatgcatggattcaataagtatatacatctgagcacagattatttttatagtgatttttgcagctaaatgtgaaggcaactgtcttaagtcccttcctgctgctgtaacaaaagaccttagactgggtaatttataaacaatagaaatttgtcactcatggttctggatgctgggaagtccaagatcaaggctctggcagatttggtgtctgatggggtatgttcttcataggtagtgcttgtgtcttgatgtgtgtcttcacgtggttgtaaacggcagacttcctcaggccccttataagggtgctaatcccagtcacaagggccctgacctcatgacctcccaaaggtcctccctcttcatactgttacattggggatcaagtttccaatatgtgaatacagggaagcaccaacagaccatatcagtaacttcgagtgagtttcctaaggccgactgaagctctgtttacacataagagtgttccccaaagtgcactttctctggggccttttaggccatacttttaattttgttatttgatactactggttgctaatgttctggcatttccagttgttccacactccctgacactggtgtacacaaataaataatacagaaaaaaaattatatcagcaagcacattctgcaaataagaaaaacagccactcgggcacgtataaacaaggtggaccgtttttcaaattctggcagtcaagtgggcctcagggtgggtttgattcaggctctcatcattggagccatagctgtggttctctgtgatgctctggctctcccttcatacttcttaacatcatcctcaggctggcttcccacgtgggattgtggtggtttccagcagcgagtcttgatcagacattgctttagttgcatctgttgtgggaataaatgagaatatgtatgcactgcagagaatggagtgttaaaacagtcaacaaatgttagctaatatgtacacaagattttactactctttagcagcaaaatggaggggaagaccttctaaggccctttggagagatgaaatggctcatttaaccctcacaagatcctcgaggtagggattcatgtgcatgtcgtatagataaggaatctgaggttcagtgaggcaaggtaagcttcctgagggcacacaacatggaagtggaggggacagggtgtgagctggggtccacctgggctccgaggtccgtgctccttgcctacactggactacttctagagatggacatattgaatttctcaggacttgactcctggccttggtttcctggactccccagtgtgtgaagcagagatgggatcgaggctgcaccaccaccatccccctctcccatccagagaaccagccgggccacctctcaggtccctcctgtttcttttctctgcaacccaagctgatgtggagggcattgaggctcctctggggggatgctgtggtaccaggtgggtctcacatccctggtctcccgcctcctgggcaagctccccactcagggctccacgtttccccaagaggaaccctgaggtggctggaataatggccacattgacggagtcacttgtccaactctgagggggcgctctcatcacccccactctacagatggggaaacaggctcgcagaggttcaggcacctgcccaaggtcacacagctgctggattcaaacccattctgactccagaagctggactgcagtccacggcaccactccacccaccagttcctcagtcaggtacttactgaagccaaattaaatttacccccctgaaaatgtgggtttggcagggatcaagcaggtcaggaacctgctttttaacaagtcttctatcccatacatctgtccaaggcactatttggggttatgtgctggccttcgagttcaccctcactgggccctgtgtccctgtgtccctgtgtccccaggcctgacccaagcctggccttgaggtagaggtcatgggtgctgggtggggtctgaatgacccctttatcacttggagtaaatgccaaactcctcacaaacccctgtgtgacgcagcctctcccagctcccgtcccgctccccctgctcactctgcttcagccacactgtgctttcgttcagtcccagcgctggcccagcccactcccaccgcaggggcctctcccttcctggcccagcacccacgctgagcttcctcaggtccctgatgctcagtttcacgtgtcggcctggctgggctccagtgcccagcaggcccatcgcagtgagtcccggtggtgctgagaagacactttatagatgtggatgtcacccatgtcagctgactttaagtaaacgattattatctgcaatgtgtgtgggcctcatctaatcagttgaaggccttaagagcaaaaccagtttcttggagagtaaaaaactctgcctcaggattacagtgccaactccggcctgagtttccagcctaccagcctaccttatggatttgggacttgccagctcccacagtagcatgacccggttatttaaattaaatctatttatatataaaagtatacatatgccatatgtataacaagaaatatgaggtatataaaaggatatgtataagatatatatagggtagggcatggtgacccacacctgtaatcccagcactttgggaggccaaggtgggaggattacttgagaccaggagtttgagaccagcctaggcaacatagcaagacctcatctttacaaaacgttagaaaaattagccaggtgtggtggcgtgtgcctgtggtcccagctactcaagagacggaggtgggaggattgcccgagtccaggaattagaggttgcagtgaggtatgatcatgccattgcactccagcctgggtgacaagggaagactctctcttaaaaaaaaaaaaaggtcagtcagtcaaggtggctcatgcctgtaattccagcactttggtaggccgaggcaggcagatcacctgaggtcaggagtttgagaccagcgtggccaacatggtgaaaccccatctctactaaaaatacaaaattagccgggcatggtggcatgtgtctgtaatctcagctgcttgggagactgagacaggagaatcacttgaacccaggagacggaggttgcagtgagctgagatcatgccactgcactccagcctggccgatggtatgagactctgtctcaaaaaaaaaaaatctatatgagatatataatgtatatataataaatgcataatatatataatagcatatatatgatatatctatatgggatatatatgatctaaataaggcaatctatatgataggacatatataactatattaagttgtatcactactgcctctctggagaaccctaactgataacaaggccctccctgatcgcccttcttcccctgcttcgtattccccatcacacgcactgcagtctgtattgatacttgttttctttctttaccatccatctccatcacgggcattcaggtagagatctggatgttgctggttctgctcactgttgttttccccagcacttggcacggcacaggcacaggcagatagtaggtgctcagtaaatgtccgttgaatgaaagagttaatggtaggtgctcaataaatgcttcccggctgaatcacgaataagcaagtgagttttctgaggcagcagcccattccaccctggacctaacatagtccctggagacctggatctgacttggattcctcagccttttgtccactgcccctgtctgatttaaaatgtaggttttattcttattctgagaaggtgaggcccataggtcaggagacaccagggattgaaaagagagttgctacagttcctgagaggcgagggcagtgccaggccacacagggaagcccagggcaggtcaggaggtggaggggctgggggaagacgggggcaggagcttctctgtcgcttccacagcaaggagcaggattggcttctctgagtaatttagcggttctggggcacaggggctgcccttgttgtctggttctcagccctggatgagggcaggtgcacagagcccctgagtgtgggagcccagttggggaggtgctgggtgtgggctctggattgggtggtttgcttgtgaaaggcacgctctcaaggggattctttgccgtctctaggaatcacctggatctgggagtgacagtccctccaaggtcggcaaggcttcaaaatgtcaaagcatcagaaaataaaaggcattgttcatacaatctttgctctagccagagataatcccctgcatttggccttagcatgggcagccggagaaggctctgggcccagatcttggctgaggggcagcctcaggagacccaggctgcagagggaaggcccttctgctcctccctgcctggacaccatcttattgtaggaatcccagtcagtacccgggaacccagtgcgcctgccccagagcatgatgaaggggcctcctgggtggactgatgcccctggcagccgcagattcctgggctgagaatggtccaactgagaggctgggcctcagctcacagcctcagatatgggggagaggaggaaggtcttcctgcagaatcccagtgtggtggcagtttccaaattacatgagatgagctagggatcctctccaagatcacagacttttctatgacccctgacaggccaggcgtagggccatgaacatgagtgatttgagtcaagcaggtgcactatccaacacacaccttacagccctaataatattttattatacatactattatttattaatagaaagtttatatttgtaatagagtcttaaatatttatataaaagagctacatacattaacagggcttacatcattaatatagggtaatactattctcactttcaattgaggaaacaggctcagaacactaataattagttcgagatgatggagctgaaaagccagactttatatgcaatgtttctgatttctaaatggcaaaaatttacatatttgttaagaaacgctattttgggtcaggcgtggtgatgtgtgcctgtcctcccagccactctggaggccaaggtgggaggattacttgaggccagaagttggaggctgcagtgagccatgattgtaccactgcactccagtcggggcaggagagtgaaaggctgtctcaaaacaaacaaaaaatatatgctctttgggcctggactggacaggccacacaaaatacccctggggaagaaggagatttgactcctggcttgcagcctgtgtagggccaccaagtgatcaggtggggtctggggtcagggaatcctgggcccagctgctagttccatcacttacaagctggtgcttgctgagctcacttggtacctggggatggtcctagcatcttatgcacaggggttaggctccaggtgaggttgcagatcttgtgctggttggcatggactggatgcatcaacaagccccagagaccaggagatatcccacactggaaagtattcctcatgcatcaagtctgattctgctgctctccctcagcaggaggatctactccatggggtgactcagggatccaagctccctccaccgtaatttctcaagtagacatctaggcagcagacaggggagggcaaagccatttctggacacatagctctcctctccttccactggtgagcagtgttccttgcaccctcctgcacacaaagggtcatgggaagtgcagtctctggtagggggtcagccaatccccaggaccaactccacaccctggaagaaaggtgcaatggtctgaatttgtgtgtctccccaaaatttacatgttgaaaccctaacccctaaggtgatggtattaagagatagggcctttgggaggtgatgaggtcatgagggtggggcctcatccataggattagtgcccttatgaaagggaccccagagagctccctcactccttcctccatgtgtgggcacagcaagagggctccctctatgaactgggaatgggccttcaccacacactgactctgctggcaccttgacctcagccttaccaggctccagaactgtgagcaatgaatgtctgttgtgtataagccacccagtctgtgatattgttacagcagcccaaaaagaaaacaagagtttgagcggaggctgacccccctgctacccaaagcccagggtggtaccagcacatgtagacatcaggtacaggtataaaaggttaaattcccagtgtttgggggggcatttctgagccatgacagtaacagaataaattgccacccctgcctggtcccagcgatgctcaccccttgctgggatgattgcagaggtctccccgcctcactcttgctccatcctccctgccccgagcctgtttgccacgcagaagcccttcacgtccctcctctgaccataaccctccatggccaaattatattcaaagacatacagactgtgttggaataaattatattgaaagacatacagactgtgcctatttgaaccagatgaagttctaagggctggagaaacagctatgaacaagacttacaaaacccctgcccttgtggggttgatgttcttctgggaagtgacaattttttttaaagccgtggagaaaaaaatctcagaaagaggagggtactatgcagagggtcggggcaggttccagatttaagaaggtggagtggggagacccgctgaggaggagacaggaaagcagaaactcagaggcaggacaaggcgggtgaggatgtgggggaaagtgtttcaggaagaaggaacagccagggcagaggcctggggttttgcccacgcctgaggcagagtgacaagaggacagagaacagatgggggctggatcaggaggggcgctggccggcggggtgaagactgcagcttgatgggtgaggtaggagtcatggagggttatgggcagaggagggacatgatgggcttctgtgtggagaacaggctgggggcagggagaatggagcaggggtgaagcggggagacccctgcaattgtcccagtgaggggtgagcatggctgggaccaggcaggggtggcgagaacgtgatggattctgggtaggttttgaaggtaaatccgtgatacaatggactttggggactcggggggaagcgtgggatggggaggcgaggtttagataaaagacaacatacatggtgcagtgtgatgggtgcaccagaatctcacaaatcaccactaaagaacttattcgtgtaaccaaattccacctgtaccccaataacttatggaaaaataaaataataataataaaaagaaagttaagccaacaggatttatgatccaacacagcatccgactccactgtataaatcttgggtctccaataggaaagcacagctccgaaggggtctgggctggtgagcgttgcaggctgaattgtgccccccaccaaattgatgtcctaaccccagtacttcccaatacagtgactgtattgggagatggggcctttaaccaggtggtcaaggtcaaatgaggtcacaagagccagccctaatccaatctgctggtgtaattacaaggagattaggactcagacatgtacagagggtcgaccatccacaagccaaggagggaggcctccgggaaaccaaccctgccaacaaatgatggtgtgtcccttcggggctaaaccccaagaggcctctgtgctctctcttactctcaggtccctgctcagccatgtgcactggcttgagctagcttgctggaggttgacaggcccatgggggaagtcatcctggtcaaaggtattctaggccagccagcacaacccccagcccacagtccaagctgtggacagatacaggagcaagtccagccaagatcagccaaattcagatcagcagaactgtctagctggttcataacttcatgaactataataaataatggttgtttctgttttaagcttctaaatgttgccatggttggttatacagcaataactaactgatagaccttcccagagcaatgtctttattggtactcccaccaccaatgtataagaacacttatctcagttactccctgacccatcctgaggaataactgcaaacttctgattttttagatcttcaagggtccagggtgggtgtgtagagactgcttattgttccccaacatctggtctctccttcttccatagtactagaacccttacattttagctgcatttcccagtctcccttgctgctaggtgtggccatgtgactaggttccaaccaatgaggtataagtagcaacatcatattgccacttccaggagatggactactgcattcagattctggttttgccacttctctgttgaggaactttggaaaggtgacttagtttctctggtgcatcagtttcctcatctgtagagtggggataacgatagtatctgccttatagtgttgtcaagaagtgaagtaacacaatgatgcatttagaacatgcttatggctgaatgtggtggctaacagccagatgtggtggctaacgcttgcaatccgagcgctttgggaggccaaggtgggcagatcacttgaggtcaggagcttgagaccagcctgggcaacatggtgaaaccctgtttctactaaaaatacaaaaattagctgggtgtgctggtgcacacctgtagtccctgctgctcaggaggctgaggcatgagaatcacttgaacccagaagataaaggttgcagtgagccgatattgtgccactgcaatccagcctaagcagcagagtgagactctgtctcaaaaaaaaaaaaaaaaaaaaaaaagaacagtacttacacatgggaagttttgttatgtgttgttatcattatcagtataataatactttcattttattttttgagaatgggtcttgctgtatcccaaggctggagtgcaatggcgtgatcatggctcactgcagcctcaaccttctgggctcaagtgatcctcccacctcagcctcctcagtaggtgagactacaggtgtgtgccaccacatctggctatttttttttagagttttttgtagagatgggatctctctatgtttctgaggctggtctcaaactcctgggctcaagcaatcctcccacctcagcctcccaaagcattggggtaacaggtgttagccaccacacccagccaataatacttttattatcagctcctaaggttgatgtaaggtttaaatatgaccaagctccatgtctattatcagaacaagttttcctgatgcttatttgtctaccaagaccaggaagaaatattaggaattatatccatccatctactccctcctccccagcaccaccccatgaggctcagtagattttccatttccttcgtgatacgtactcatttgcccaataaatctttttcaaagcatgaaaattcatagggggatctttttggcccaaatttcttgtaagagatgcctacagggaggtaaatgttcatttatagcttatcacctgttttacagagaggttgagaggtggaaagaaatggagggaaggaagaggtaggagtgaagttggcatttttcattgttgatccaatgtagcacacagacgttggtgtgagcagatgcatgtggaaaggaggaggagaaatttgggtcaggaaggaacctgagctatttttttctctcagtggtgggtgagtagctgttttaaggaaaaagaaagtggaaaaaaggaaataagagagtgaatgcctaatatataaatactcagaacttctgcaccctctgataagtaggaaccccaagaaacaagaagctttgggggtgaacggggtgtcgttcattcaataaacatctgagcacctattctgtgccaggcactgttgcagggtctgggaaccgagcaatgaacaaaccaaagtcttttaccatatggaaccaccactcctaatttctgggcatgatcagagaatgggatgaaatggagagtgaaggggaggccgcctcaacttcagtggtcagagagggccactctaagaaggtaacatttgagcagagacccacttggcaaagagaagacagttacataggtatctaaggaaggcattctcctttcatcaaagtgttcactgatgctttgcttagaagaattgacaacacccaagagtccatccttagaagactggctgaatgtatcaggattcaactgggtgagaaatgagttgaatatttgaatatggtaggagttctgaattacagaattaaatgaaaacaaacagaacaatcgatgacagcatatatgtgtactctcatttgtgttttctttaagtgagggggcttcaggggctttcactcagcagctatttacctactttcacagaaacatttcaataagttagcaacctatatagaagtagtagtgctctgctaattatcagttgtgtatataaagcgtatcagtcagttttgctgtgtaacaaaccactccaaaacttagtgacttaaaataacaagcattattagctcatgaatgtggccacaggggctaagttaaactggatagttctggcctcagctgacttcatgtgttcaactgtggtcagctgtgggctgcctggtccagaataaccttgtccgagatgactcgcctctcctccttgggcatctcatcctccagcaagccagctcaagccagtgcacatgactgagcagggatttgagaggaaaagagagcatagaattcttttgaggtgtgtgtgtgtatgcattgatcctcagcctcacttctcccatacatagaatgaaccttgttattattactcattccataataacaatgccagatgcctatcagccgcaaactatgagatatgcactgttgttattggataagttgtgataagtaaatttttttttttttgagacagagttttgctgttgatgcccaggctggagtgcaatggcacaatcttggctcactgcaacctctgtctcccgggttcaagagattctcctgcctcagcctcccaagtagctggaattacaggcacccaccaccatgccagcttttttttgtgtgtgtgtgtttagtagagacggggttttgccatgttggccaggctgctctcgaacttctgaccttggctgatccgcccacctcggcctcccaaagtgttgggattacaggcttgagccaccgtgcccggccagtaaataatattttattgatgctgagttgttagttatttacattttaatatttctcacattgaaatatgtcttacaattgttcatatctttggcttttcttcttttttccttacaaagttcttaacttctttattttataagcaatacatctgaaaggaaaatcatcacattcatggcatatcatagtcaggaagaaaaattaggttgcatcctgaggttgaccaaacataccagattcaccctgttaagtcctggtccccaaataaaacattgagcacttcctgtaagccggactccttagcaaaaaaaaaaaaaaaaaaaaaaaaaaaaaaatatatatatatatatatataaaatgattaccacatccagaaagtttgtgaactctcttcaaatatcagcatggcaaaactcacatatatatatatataaaatatatataatatatattatatattatataaataatatatattatataatatataacataaatatatatataatataatataaatataaatatctatctatctatctatctgagttttgccatgctgagatttgaagagagttcacaaactttctggatgtggtaatcatttaatattattaccgctttttttttttatcatgaaagaacaaatgtaatgttggtaagcctggtaatcttgtgattttttttcttttaaataccttttgtgtttttaacttgagaagactttatagacatatctatgtgcccacagaaaatatcgacattgttttatgtgttgctgggttttcacgtcattcatgtcagactgcatctgtagatttgcaacttgcttcccccatcctcccatgaaatgatgtgtcttggagaccttttcatatccatccacgatgatctattttgttctgtaaaatgagtataataacaacactcaaccaacatgatcttggtgaggacacattaagctctcaataaatgttacttgatttataatgattctgtctttggaatcatttttctagcgagactgcagaaaagccctgtgggctggaagtggctaggagaacctgtttctctaagcagacttgacagctcgctgcccttgtatgatttaccccatacacccccaagtgattgtatccttctaggttttaaataacaaggtgagttttcccatttcaatcatacttcttccccttgcaatcccaccttaaataaatggaaaattttttagtagtagtgaaacaagaaggtctttggggacatatcgctctgggtttaatcctggatatgccatttacaagctgacctgccccagggtgtccgaggctcccaaatgatcacagtttggagatggccacgtacactagatacatccacacaatgtgattaattccctgcagttgccaaaaagcatgaaatagattcctctccttgtgggatggtccctactgataggattccctgcttggtgccacagaaccctgccttatgggccacagcagatgtaccagaggatagaacaacaggtcactggcccatgaagtggtcttatggcaaagtcttactcaacaggggtctgtgatcttggatgtctcgatctggcagatcatagacttcatcctgccaactgacgagcacagttcagttcaggtcacgtcactcattttccttttaatttaatgaattaccatcattaaaacattgagatagtttacatttacaaacaccgtttttcattcattcgactgtttcaaaacaacattcatgggccatctggtatgtgccaagacacgttccaggttctggaggctcagaggtaaattagaaacacacagcccctaccatcatgggtctgtaccattttagaaacaaggcagacagtaagcaaaaagaaatattcataaagtaatgagctccagcttattttgagaaattgaaatatcaaaactcactgggccagcaactccattagaggacataatagaaagatagtgaagagccatatcacagtggttctaggtaaacaaagagctcaaagtcagagcctcaaagctctctggcccttgaaaagttgtgaatatcatcctattaggcatacaggatatgcttcaggcatactgggtgtcacctgcaatgtccagcacgtagtgagtgctttatgaatgtctgtctcttgagtgattgtggaagctgtgccttttctggtgaccagatcattgggaagaacacttattcatccattcaacaattccagagagatttgattttgtgaaggactcactcttgcagagggtgtacaattcaaaacccacataattcaagactaaccctgacaaaaagatggtgggtgtgtctattcaccagctaaagcgacactaaaataacagtcacagtttacaatgtatgtgattggttgtatttggaagcatgagaaactgtagccatgctgcatttctgtaaatctacaataacatccctcttgtgaccccagcttgcaacataaaaaatagcgctttgccggctgggcgccgtggcttacgcctataatcccagcactttgggaggccgaggcgggcgcatcacgaggtcaggagatcgagaacatcctggctaagacggtgaaaacccgtctttactaaaaatacaaaaaagaaaaaaaaaattagccgggcgtggtggcgggtgcctgtagtcccagctactcgggaggctaaggaaggagaatggcgtgaacccgcgaggcggagtttgcagtgagccgagatcgcgccactgcactccagcctgggcgactgagcgagactccatctcaaaaaaaaaaaaaaaaaaaaaaaaaaaaaaaaaaaaacctagggctttgccaataactcgcatatatttatatagccctctcctccccactccactgcttctcccaacccagaataaccaacagcctgaatccggggcatacctttctctgaatttcctttctgtactttccccctcttcagagctttttgggaaacttcatgttaataatttcaatccggttcagccaggccctgctgtcctaagaacaaaagctgtcacttaaaaatgactttgcagttgttgccctcatctgttttcatcccatgatctctacagcccagagatctttgtttccaggaaacagcagggctttccccaggcggatgggttctttgaaggagggggaaaaaaaaaagtcttctccagctattctgtgtagagcgtcagcaccaccgaacgctaatgcttgaatggtttagaactgcggacagctcacgccagacagattcagcaccacggacagcccccaaggcagctcgtgatgtgaatggttcagcaccgcagacagctcaagcctcgccggacagccctgctggaagtggttcagcaccacggatagccccgctaatatccatcagaaccccgggcggctcaggccagaatggttcagcaccacaggcagccccccaggctcgcaggacagttccccccagcctcgcagggtagcctgtgctgggactcttccggtatcacgaagagccctgctggactggttctgcaacatggataggaacaagtgtcatttcgccatcacctgtgctagatgtagacgctcttctgagctgattcctgagccccctctgcaactttcacctctggagactctgatggggctatctgggtaatccaggctcttctggagttgacctcagaaatgcaggcatccaacagttaatatgcccaaaagggaactctggattttccccacaaaataaacttgatctcacttagggcacttcagggcactcagttgctcaggcccaaagcccagaagtctcccttgattcgtctctttctgtcacacctcgcactccacccattagtgagtcctctcagctccacctgtagagcaaatcctgaatctacccactgctctccatccccattgccactgccttactccaggccaccgtcgcttctcacctggtttactgcaagagcctcctaagtgatcctcctactttaccgccccttctagtgcattccccacacagcagtttcagtgagccttggaaaatgtaaaccagagtctatcataccattcctcagtacctgccactatctccaatacacctataataaaattcaaagatcttcctgtggctttcatgactctggatgcctatcttttttttttccttttgagatggagtctcactctgtcgcccaggctgggtacaatggcgtaatctcggctgcaacctccgcctcccgggttcaagcgattccccttcctcaggctcctgaatagctgggactacaggcgcgtgccaccacgcccatctaatttttgtatttttggtagagacggggtttcaccatgtcggtcaggatggtcttgatctcttgacctcgtgatctgcccacctcaacctcccaaagtgctgggattacaggagtgagccaccgcgcccgggcgcctctctatcttacatcccatgacactctcgctttcctggtcacactggccacaccacctccctgttggttcctcagggcctttgcctctggtgtgctctgtccatggtgctgaactcattcaagtgtggattcaactataactgtctcctttccaccatttggtccttagctcaaaatatgaccttttctaaaaggccttccctgaccatccccacctaaagtggcttcaaagttactatcacagtgatttatttcacagaatttagtacttcacagaatttagcacaaactatatttcattttgcatttattggtttacttgacactgtctgttttcatcattagaatgtaagctccattaggccacagacatcagttgccttagctacccggaacagcatcttcacatggcagttgtttaataaatattagttgtatgagtgaatgaatgaatgagtggatgaattctcagccctgcattaatttttcttttcctggctagtcatggagccccaaaaagatgtcaacagcacttacctcctggtaaaattgtggtccagggtttgtgttggggtccccaagatcatccgcaggtttgatgatttcctgggaggaggactcaagagagactcagcacatagtcatactcacggctatgatttactacagtgaaagtatacaaagcacaatcaacaaagggaaaaggcccatggggataacacatctgtactccagcccttggcttgctatgaggctatggcaagacagagaatgtgttatgttacagtaggataatgaagaattggaaccaataattcaatctaccacacgtagtggtggcatatagctataattttttaatcgtgattttatttcccttttaggttatggcacttgaaactggctttccacttataggagtgctgtaaagtttccatttaaaggtacttcttaaatggttttagaaaatgaattcattttaaataaaaatattaagtaaataggaatgcagggatgttatgtgtaaatgaaagcaatcatgaagatgttactcattgctgcagaaacagggcaaacattgaaaaagggtgtttgagaggttgaagtttgagaaacattaaagacataaaacaggattccagacactttcccttcattgttttcttctgtttagggaagaaatcacctctaaggggtcactcagtaacattcctttcggccaggcactgtggctcacgcctgtcatcccaacactttgggtggccgaggcaggtggacgacctgaggtcaggagaccagcctgaccaacatggagaaaccccatctctactaaaaatgcaaaaattagctgcgcatggtggtgcaagcctgtaatcccagctactcgggaggctgaggcaggagaatcgcttcaacccgagagacggaggttgcggtgagccgagattgtgccactgcactccagtgtggacaacaagaacaaaattccgtctcaaagaaaaaaaaatttgttccctcagaattctggggaagcccctcaaacttgagtccattttgaaacaaccataattcatctggactatcaggatcataactggagatttttaccccatattgaggacctgctgttcaataattataatgataataccagtgacatttactgagcactcaaaattaggaggcatatgtattaacctatatgatgttcacactaaccctatgaggtagaaaatattattgtccccattttgcaggtaaggaaactgagaccgagttaattcacttcccaaagttatacagctagtacattgttagatctgcatctggatgcccagttcctaaccctctcaagactctgtgacctggggcagctcacctggtctcctgcactaaatgtcttgttatcaaaggaggtgatgaggattggatgaaatgtctaattcttgacacttcatctctcttctctgcacactctgaactatctttggaatggcaggaaactcatcttctaaacatagaaatgaagaaagtttcccatcccaattacataacctatctgaaaactcgtaggcaaacccaatctcagtccttccataatcttactgtgtgtcctttgtacaactcatttaactcctttgtgcctcagttctcttctctgttaaatggggataataatactaccactttgggctgttggaattaaatgagataatattaacgagatggctttccttgtagtatttttttgataaatgacagttatttttgtttttctgaataaccagggtaattcaattttctatccattagggaaaggaggttaaatccttacctcataccattcaaaaaaattccagaaggttcaaacaaaataaatatataaaataagactgtaaaatataagattatacaggaaaatgtgtttatgagagtaaggggaggccaggagaagtgattcatgcctgtaatcctagcactttggaaggctgagctgggaagatcagttgaggccaggagtttgagaccagcctgggcaacatagtgagaccctgtttctacaaaaaatttaaaaattagccaggtgtggtggcacatgcctgcagtcccagctactcaagaggctgaggcaagagcatcacttgaggccaggagttcaaggctgctgtgagctatgatcacactactgcactccagcctgggtgacagagtaagaccttgtctcaaagagacaaggagggggaggaggggcggggaagagagggagagacaaggctgaggaagggcatcttaagaccctaaaagcaaaaaataaataaataaataaaaaggatatcttgtatttttattaaaattcaaaacttcaggcactgtgtaaacacaataaaaacataagggaggagccaggagaaaatatttgccacagatagagtaacaggcaaaggattaatgtgcagaatatagaaagaatgtctattaatcagtaagtaaaagctacataaacaaatagaacaatgcggagaggaggagataaacgggtaattcacagaagagagaataagcctgttcaaatacatgtgtttaattctcctcactagtaatcagggaaatgtagctaagatgatgcagggacgccgttttccccctacctatggctttgccgaaaattttaaaaatttaatgtagcctccatgagagcaacttggctgtagtcactgcattgtaaatttgaacaacaatggtcattgataataatagcagctattaggcactgttgtaagaactgtacgtgtattacttattattgttattattgttttactttcacagaaatcctgggacttggtaaccataattattcccacttaacagcatgggcaaccgaggcacggaaatgttaagtaacacacccgaggactcactagtaacaaatggcaaagccagccgctgccccaggcggtcgggcctcagggtccccgggctgccaccccctgccccagctccttctcccttccgcccaccccggactcccggtttgcagactggagaaccacggggggcgtacgcaaagccgctggccttggggcgtctgtcgcagggtacctcgaacataacctacgtgctcatcagctagagatggaccagctcggtaccacacccccctgcaaccacgccgcgggtaccccgcctctgcggctcatccactcccttccccacgcgcctccaggtgcaggcttcccgggggtggaggaggggaggaggacacccacgctccccaattcccccacctcccatctcccacctccccccacccccccgcagcctccgcgtctgcgcagccgcagtcagtgcggcgccagctctgcagagcccagacagggtccggttggggagggtgagtccttcgagggacccccgcgggcgggaaggaggcggagaaaaggggctgggggcgcgggcggcgatccggggatgcgcgcgcgagtatggatgcgcagagggtgtgtgtgcctgggcgagggtgaggggcagaaccgctccagggatagggtccggggagagggcgtctccaagcccgtccggtgggagaggaccggggtctgtcggggtcgggtctgtttctccgcagcggaggtctgtgtcctggcttgggggttgcaggtgaattccagcctcctcgtgaggaggggagcacagacctgtgtaccctcgtggggcggcacgggcacgtgcgctcgtctcgctggggcttggtgtcgatgttcgctccccctggggtgttcagcgcacctgcccgagtgtgcacctgtgcgtgttcgcgttgtgtgtccgcctgggcccctgtggaccaccctgcaacggtgggagcgcaggctctcagcaaacaggtgcagcagccccgcccccactcttctgagctgtgtggctttgatcaggggacttccctgtctgttaaatggaaacctaatagtatctgtagcgagaagtatggccacctttatgtgagaaaagggattcgcagggctcagcagggctgggcacaaggagagttctgggctccgggaaacactgccggtatttttattgcttttactgtggttgctggttgtcgttgttgtgactgcgtctccattctctcaggggatgacttgtttgctatttcaccatgaacactgaggctgtggggtgtgaatctcctccccccaccatacctctgtctcatcccctttccttcttcctcctccattcactgcggatccagcttctcctgaccttgacctgatggctgtcgtctttcccatctgtcaccccgcttgcctgcattttctcctttctcatgccttcccctcccctcaacctagatccatgattaattatgtctcatattaaaaacaaagccaagcaaaaccccaaagcaataaacaaatcagaactccctaatggtactctctaacactctttcccacgaaggtcccataggaattttcttgccctgaaaaatgtctaggcagcctcctctcctcactcccaacagactccccggcccacactgaggttgcaaatgggcaaccccagggtctaattcagccccacaacttgtgctatttgactaaaggtgtcttcctgttaaacactggaaataattattgacatcatgaaatgtagaaaatgccatctgaaaatatagatttccagtcttcttttgagaaatcacaggatgggcgacaccagtcccatgcgtttgctctgcagacattagctgagttgcatggtgcagcttcttcagacaggagacctgatctctcttgccccactccccactgcctccgtcgtctctccccatgccatatatccactgccatttgttcatgtgctccttacaatagagaagtatttctctggacctatatttaattttcatttgtagaaaagtgacagtaaaagagtcctcttgattgactcattgattgatttttgagagagtctttctctcttacccaggctggagtgcagtggcacgatcctagctcactgaagccttgaactcccaggttcaaaggatccttccaatatctgagactacaggctcgtgacaccacacctggctaatttttaaactcctgggctcaagcaaccctcccaccttggtctcccaaagtgctaggattacaggtgtgagccacctcgcctggctgatttatttattaattcatgtcgtttcctatcccatttgttatatacaaatgtgcagactggagaatcatgtgtggctgtaggtgtgtatatgagtatgtgagtgtgtatgtgtgtgagtatgaatgtgagtgtgtgtgactgtgagtgtgtatgagtgtgtgtgttagtctatgtgagtgtgtgtgaatgtggatgtgtgtgtgtttgtgtttgtgttagtgtgtgtgtatgtgactgtgtgtctgtgtgtgtgtatgtgtggatgtgtttatgtttgtatgtgtgtatatgggagtatgtgagtgtgtgtgtctgcatgtgcctgcccatgacaatcactccctttccagctttgtctccagagcaccctctagcgtttgacctgctgtgtgctttatttgttccctgcctgtctctttgtctccctactagaatgtaagccccaggagggcaggaatctccacttgattactgctgtatttctaatgcttacagtcgtgcctagcccctgctggccctctgtaatgattcactgaatgatgaaatgtccatcagtcctcaggttctgaatcttgtgcctggagaaccagagaggaccctggagcaggaggagaaagagaagcttgtctcagaagctccacctcctcctggggcaatgcagagtctcaggcctgagcagacacgggggctgctggagcctgagaggaccaagactctgctgcctcgggagagccgggcctgggagaagcctcctcatcccgcctgcaccaaagactgggaggctgtggaggttggggcctccagccatgacagtgatgagaaaggtgagaggcaggggtcctttgggaggtgagtgggtggagaggaaggaattggcagagcctagggaaagactaaacattcactccttcactcatccattcaacagctattcatggagcactgtgtcagtcagcttttgctgtgtaacaagtcatccccaaacttaggggcttaaagcaacaatcacttatcagctcatgattctgtgggtcagaagtttgacctggcttcaggggacacttttcctgcctgtgcttgtctgtgcagcctcagagagctggtgaggccactggtcgatctcagatggctttacccccatgtctgctggtgctggctgttggctggcttggtggtgctgaggacaggccatgtgtctccagcaggatttttcagggttatcctcatgggggtgcttgcagggttctcagggatggcaagagagggaattccccaattttcaagcactggaagatttgaagaggaaaaacacatgatctcatttgcatttcaaaaatattcctctaactcagtggatttcaactgggcgtggtcttataccccacttctcctccccggacgatttttggcagtgtctggaaacatttaggattatcctaactgtggagatgctgctgttatcttgtggggagaagccagtagtgatgctgataaacgtcctaccatgcacaggacggaccctccccccacagaaagaatggtgcagctccaaatgccgatagtgccaagtttgagaaaccctgagtctcactgcatgtgagaatggattgtagggctaggaagtcaagaatggaaggtgggaggccagttaggagattcctgcaactgtccaagacagaggtgaggtaagtggagagatttgggacatctttgggagaaggaatcagttcttgctgatggatgtggagaaggggaggaaacgagaggtatcatgatgacttttagggttttggcccaaacagatggataaaggatggtgccatttgccgacatctcaatgacaccccatagcagaaaggggctgaaccttataccaactactaggcactgtctttttcctcaggggatgagcagggctgggacagaaggagtggataacagaggccagctctgctagtgaggcttggagctcctggctggggctaaggtgcagaaagagtggaaaatgccaggatttgcccagtctattcagcttagggatgagaaggacactaaggttctgactatggggacatgtccccactagtgtctgttctttggaagctggggaagcctccatcatcctggtttacttctgtggctttttcttctgctccttcactcagtttctgctgggggcctgtagagaaggaactcttttatctactggacaggtaagggactgaagactcaagtggcagggcacatcaggtgacccagttgaagttttctaggtagttatagaacagaattcaggtctttcattctctcagccccatctgaatcatcacataggcatatgtgtgtttgtgtgtgtgtggggttgtgtgtttgtgtgtgtgtgagagagagagagagagaaggagggtgagagagagagagagagagagagagagagaggaggctattactagaaaagggacaagatgccagtgggaagagcccactcctgccatctggccactcactcatggctcctttttcctccactcccaccctcacccagacctgtcttctcaagagactgggctttcccaggagtggagctcggtggaggaagatgacgaatcagagggctcccaggtacactggggggtttgttctttttccacaaatgtcccactctgtagatctcagcactttgtcacatttgcattctcagcttggaatttacctgccccataaaaatctcaagagatctcttgtgtctgatctctatggtgatcagacacagactggagggtctccatgtggtgtgtgtaactcagttcacatgtaccctccaacacttccttcataaatccatctacccatgcatccacctctgtacttcatcttctgtccacttattcatcaaccctcccttccatccaccctcttacctttccaatcactcatccattcattcatccacctctcaaacatctactagccattcactcatctgtccactctttcatccacctaaacttttattcacctacttgcttgtatacccattccatccatccatccatccatccatccatccatccatccatccatccatccatccctatacttcatctgtttatccacttatccatccatccatccatccatccatccatccatccatccatccatccatgcatcaacccatccctatacctcagctgtctatccacttttccatccacccataaaccctcccttccacccaccctctcacctttccattcacctgtccattcattcatctacccattgaacatccaccaactattcatctgtccactcattcatttacccaacctttcatcccttatgcatccatatacccattccatccatccatccatccatccatccatccatccacccattcatccatccatatatccagttatccatatacatactcattcacccttttattcagatgccatcaatccatctgttcaatccacccacctacatatccatcccctatccactcaactgtccacccacctattcatccctctactacctgttggctgtggtgaggatatggctagtatgcatccacccatatgcccacacattcattcatccatctgtatctattcacacacccagtcataagaccacctaccaatccattcacccatccacccactattccatttatccatccactaatcatctactgagttttaatccagatactacaagtaaaaccaaagacaattatcaaacacatttctttcactcaaaaacctaatgttttcttttttgaggaataagatatcaatataagaaaaccagtggttctttcatttatacattcatctcatacatgagaaaaatcacataatcactctcagtgagcacatgagagtcccatccatctcccaatcatgtcaggaatgtaactctggctgcctcaagccagaaaatggatttattggctcgtggtgcagggatgagggcgagggaaacaaactggccaacaaaccatgatagtgcagaaataagtgctgggcacagtggagtggcccaaaggaagaagttaactgcatgccaggaggtttattcttggatatcccagagaggaggacacaccacacctggagttttcgggatagtaagaattccacaggcatagcagggaagggaacaacatgtgcacaggcaagttggtataacaaggtacgtttcagggacactgaagttaagggcagagcagtgggaggtttgggtgaaaatatggctgggatgacatcattcactcattgcacgtctatttcttgagcacctgctcagtgccaagcagtgttcaatgcacagagtgtacaatagtgagacagaagtggtccctgccttcatggagctcacagtcaccgaggtagacagacgacaattgaaataagcagctaaaatatgaattgggttgagtggtgataactgctatggagaaaaatgaagcaggaagggggtttgggagtaggagctggggctgggggttgctattttaagaagcttgtctaggaaagtccccactgagagggagctattgagtgaggacctgaaggaggtggggagtgagactggcagatgtctagggagagcgggctctatgcagaggacacagcaagtgcaaaggccctgaggtacagatgtgcctggtacatttggggaacaccaaggggcatggtggtcagtgtggctggagggtgggagggaggactaggaggtgaggtcatgggggcgatggggtggatgatgtagtgtctcatgggccatggtgaaatgtgagttttactctgagtgggtgggagccataggcgagttctggacagaggagggacatgttctgatttggcctttagcaggactcctctcactgctaagtcccacaccgaggaggttggatgtgttttgcaggcagtgggagccatcgaaggtgttcggggacttacagaatcactctgggagcccatgtggaaggaaggtgggttggatgtggctggggttagagtttagaggggcaaaggagcaagtcagaaatgtatagttagggaaaaaaggtagaaatgaaacagagaagagttgccactttccttgtgcatgttacaagcttcatgctattctttttattttttatttttttgagacggaatctcgctctgtcaccaggctggagtgcagtggcactatcttggcttactgctcactgcaacctccgcctcctctgttcaagtgattctcctgcctcagcctcctgagtagctaggactacaggcgcacaccaccatgcccagctaattcttgtatttttagtagaaatggggtttcaccatgttggccaagatggtcttgatctcttgacctcgtaatccgcccacctcggcctccgaaagtgctgggattacaggcatgagccacgacgcccagccagcttgatgctattctaagctcatcttattataacacatctagtaactgaacactcattaactctcataactcatgagccttgtgagattgttagcatggtttcctcctctacagatgaggaaactgaggcagagaggaaccaaatggcttgcttcaggtcccacaatgagtgggtagcagagctagcatagagtttgggcttggaggggaggataggagcgaatgggacccaggacctgatgacatttccagacctgtggaacgtaaaaggtgaaggaacagggacaagcccaggggcaacacgtgaattctgatgtggggacagggtagagggaggttctagcctccagcatagggatcaaggaggcagtttggaagaaatgacaaggtcgattttagacatgctgcttgggagaggcctctgtgacatcattcattcactcactcgtttgcccagttgtaattccttgagccagcattgatggagcacacaccagggggctgataggggagggcctctcattggcaggccctgggtcagttttctgcatggacagaccctccttcctgcagacaaccaccctctttcaaaaaagaaagaggagcgggctgtctggaaccagagacctttgatgacagttacagcctcattatgggccaggagctggactttgtgctctacttaccttaatttacttggtactcttatcagtccttgatgtaggacctgttatcccattttacagatgggaaaactaaggcacagagaggttatgtgactttcccttgtcatgcaacgtgtaaatggcagagctaggatttgtacccagcatgtctcttaaccactaggtgtcctgcctgtgcttggggcagagatgaaggcctctctctccctgttctcctagtcactatacctcctgtggagaggagtgagtgaagaagtggaagaaagaaaaagagttactttccgggagggcagaagttcccagtctgtgggcacagaagaaagcaagcaggggaaaatggtcccatcattaccgttccataaaatgcaagcatatgtaacacctgcaaatcttatctaagtgcatgagattttaaaaagatcaatgcccagaaataacccctggtaaaagttgctgtaacaggccaaattcatccatagtgtgagaagttggggtagtggttacctttgaggtggggggatttcggggttgataatgatctgcttcctgtttggggtgctagttacatggtgtgttcaccttctgaaggtgcctcaggctgtacacctaggatgtgtgcaacctcccctttctacattccacttcaacagaatgttttaagctggctgggcacagtggctcacgtctataatcgcagcactttgggaggcagagtcaggcggatcgcttaaggtcatgagttcgagatcagtctgcataacatggcaaaaccccatttctactaaaaatacaaaaattagctgggcatggtggcacatgcctgtaatcccagctactcaggagactgaggcaggagaatcgcttgaacctgggaggcagaggttacaatgagctgagattgtgccactgcactccagcctgggagacagagtgagactctgccaaaaaaaaaaaaaaaaaaaaaaaaaaagttgctgtatatatccttgtatatatcctgccaaacatgtttccctatatactgagactgaattgagatttgtgtgccagtgcttgattgagggttgtgctctcaggtgaagcccagcggggagtgagggaagctggagaggggaggagagggagccaggcaaatatactggtagaactgaaatccagtctccgtcttatcgcaagggaaccctggaatgtgaatagagagttgtcctcctctgggctgggcgcagtggctcacgcccgtaatcctagcactttgggaggccgaggtgggtggattacggggtcaggagttcaagaccagcctggccaagacggtgaaaccccgtctgtactaaaaatacgaaaattagctgggcatgggggcggatgcctgtaatcccagctactcgggaggctgaggcagagaattgcttgaacccaggaggcacaggttgcagtgagctgagattgcaccactgccctccagcctgggcgatacagcgagactctccttctcaaaaaaaagaaaaaaaaaagagagagagagagagagttatcctcctctgagtcagtggagtggccttttgtatcccatatgagttattgttggctgtggactgccctggagggcgaattaacctcctgggtaatcctctaggaaggaggatctcattagcaaagggcatttgtcagaagagaaggagcaactacaaactgtaaaccatacaagtagcggccaatacccctagcctccaggggagagctgcaccagcctgaaaaacagaaataaagagaaattaggtgaggcatccatgggtctattatgtgtgatgtgtgtaaaactattggatttcagattacctgtatttattacattttcttaactttatattctgcttttcaaaattgaagtataattatttccaataaaatgcactaaccagagagtgtttacacatgtacatccgtgtaaccaacaccccaatcaagatattgagtgctgtcataattctagaacattctcttattttcccttctggtccatctcactccccagccctggaagcaactacagttcttgatttccacttgcatggattagttttgcttgttgttgaattttatctaaatactgtcatgtagtaaactacatatatattttttaattccaaaaaaggaaattatggcaaaattgttattcctccagttggcattttcacttaatacgtgctggacagttttccatttaatatatattgattatcttcattgtatttcaaagttactttttcctgctgccaaatattctctagctcagttgtgtcagacccatttccttgggtgatgaattgctaggctcccattgctgtcactgttacagaagacaatgctacaatgagcgtttgttcagttggcccaattttacgcatggattatgaggaactttataaaaattcacattctctggttctcctcagatacactgaaccagaaaatccaaaggggatcccaagatattcaaaaacctctcccaacaacttttggtgctctaccaggtttgggaactgcttaagtgggtcattgtccctaggtatctggttgtaaaggaagatttgaaataaggtgtcatccagagggaatcagcaggctaaagggaggaatttgtttcaaagattataaatgtgaattccatcaatgatttataatatactttaataattcgtagtctgtgtccttccatttttcttttttcacaggatttttttcagtgttcaccattgcctaactttccagataatccattatgtcttgtacattcaccaaacttccttgatattttaatagcaattgcactaaattcatcattaatttggaaaattgtcatcgttaaacattttgtcttctcatctcttatcatggtatgttttttcatttatgaactcattcaacaaatatttacagagttcataccctgttccaggcactgggaatacagtagcaaacaaagcaaaggtttgccctcttggtgcttacagtgtcattggaggaagagacaataaacatacatagcatgtcaggtggtgataggagcatggagaaaaagacaaggggcatgcatagtgcagggttaagggtatctggaggaagggcattccaggaagaagaactcgtaactacaaaggcttggaagtgactgtggctggaacagagtgagaaaggcaaggaatgacgtcagcgttagaaggagcactctgactggcccatgggcaagaaattgggtgggattatcaagacaagaaacaaaattctgtatcaagagtacaagatagatgacagtggctttggccagggtggtggtagtgaagggaagggaaatggtcagattctgaatgttttgaagataaagccaacagtacttgctgatgtcttgaatgtgggtggtgtcagaaagagagtcaaggatacaacaattggaggtctggaggggcctgaaggggtaatgggaggaaaactgcatgaggagcttttttttgtgggggacattacaatatttgtttggggacatgtgaagtttaagatgtccatcagatatccaactggagatggcaaataggcagtgagatatatagttgggtcaacaaatacacatacatatgcaagcacacacatatctcttgagggggtggggtcattagagcatagatggtatgttaaaactgagatttaatataccagtgagattttgaaattgtcatcccattattcgaacatttcctctgagagagcatagttatgttacattcttttgtttatcttatatctactcagttgtaccgttttaaattcaaacagcttttctcttgatatgacatttcatttctgatcatataagtctattttcctgcaagtaacaatggtggccccttcctttccaatatttatccttttccttttttctgtttcagggctttgtggagtggtcaaaagctccacaacaaacaaccatagtcttggtagtgtgcgtgctttttttgttcctggttttaacggggatgcctatgatgtttcacatttaactataatggtggctgttgttttaaaagtttaatttaatgaaatagatgccctatgtcatgttaaggaattgtgctagttaaaaatcaggaataggtgttgaatattttcaaatgcctttcaaacatcctttgagatgatttttaaaaaatttttggtgtgagttttcacatactttatttccatgaaatgaagacatcattgattgtaaaacattattttgtataccacggagaaagaaaagtgctaattaatcattaagatgccaccaactggaagatatctcctgactttgagaagatgaaaaaatgtgcaactgaagatcaatgaaatctggtacatttcctaacatcaaaccaactttgcattcttaaggttttggtgcaccagtcttttcatacactagattatatttattgatattttatgtaggattcttgcctctatcttcacatgtgagattggtgctatctttgtgaagttttggtatcatggttaagcttgcatcatagaaagacttgggtaacttttaccttttctatgcttttcaatagtttctgtagcttaggaagtatcagtcccttgacaccttacatgaattcattgttataaccaggtcatagagtcatggagagaacgtttcagctaattcttgggcagctttcttagttctttacaatgttatcagtttattaatactttttacctcttgcatttattttggcgaattacagaggtttttgtttttttttttttttgagaccgagtctcactctgtcacccagtctggagtgcagtggcgccatctcggctcactgtaagcagagggttcatgccattctcctgcctcagcctcccaagtagctgggactacaggcgcccaccaccatgcccagctaattttttgtatttttagtagagacggggtttcaccgtgttagccaggatggtctcgatctcctgacctcgtgatccgcccgccttggcctcccaaagtgctgggattacagatgtgagccaccgtgcccagcccagagttcttttatcctctagaaaattcttcattccatagagctttttcatattattagcttaattatgcataatgttttataattaaaaatttctctttattttgttctatcccctgtttcctgtaaactgctgtttgtggtttactcgttattagatttgtcaaaggtttatctagcttactattgtttttccaaagaaccaacattaggattcatttatatccattatttcttttatttgtaatttgtttttctttgatatgtattgcatttattttttattgtttttcttctttgtctcagtttttatactgaatacttgatttatattctctttatattttctataatagcatacttattaacgcaaatgtacttctggatatagcgttggccacatcttaacatttgattattcatttttgtttatgttgtctaaaaattacattgtagtgtgtctaaatattacattgtagtgtttctaaagagtgctttgaaactcagtgatttggtttattttttgtttaaaaatagttttgttttcttgttttactgcactgtgaacacagaatgtggcctataacacatctgcttccaaaactttttaaaaagcttttagtgtggcctagaacatgtccattttttgtaattgtttcacgaacatttaagatgaagatatcttctctgtctgtagaactgaaaactttatgtgcctgttagttaactcagtatcgtcaattatattgttcagattcatgtgttatctaattttggcctattatattcattaaaaaccaataaggttatgtgaaactttgttagtacaattgtttttgctaataaatttttataatctttgctttatgtactcaacagctgtgtaattcgaggcatataagtgcagcattgttatgtccttgttaattaaataatatatgtaaaacaccatatgacaatggctggcagatagtaggcactcaataaatgttaattaaaacctgattctgaatcctttgttaaatataaaatgattgttttcagtcaatttaatcctttgccttaaattttaccttgtctaatactggttgatattatcatcctgcgctcttctgtctatgtatatgaggttctttagagaaattaacagggaaaagtatggattatctctccattcctctctcaggctgattgcctgcaacaagcaaccagcccttaagagaaaggaaaacaggccttaactattacattttttgagattctactggaaataagagaagctcaattcaaatgagcttaagcaaaataataataataattattattattattcgttcatgttacaccaaagtttaggataaaattggctttatttacagctggttctgggggacctaaaaatatcactggggcttttcctctcctcacctccctctcttccttctacatggctggagacagctatcatggaccctgtgatcatctcttccacacggcaaggtgggagacctggcagattcccatcacgcacacctgcaactcgcatccttgttctgccttggggacaagagtcctgaaattaggggagagagagcagcaactgcaaaggccctgagacataaaccgactgcccaagtaaaggatggagaatggactgcagcaggtcaaaggcggaagcagggagataagtgtggagactgtcttaggtgtccagtcaacaggggatgggccgggcatggtagctcatgcctgtaatcccaggagggaggccaaggcaggaagatcacttgaggttaggagtttgagaccagcctgggcaacacagtcagaccctgtctctacaaaaaataatagtaataaaaattgtcaggcatggtggcatgcacctgtagtcccagctactcagggaaactgaggcaagaggactgcttgagcccaggaggctgagactgcagacagccatgatcaggccactgcactccagcctgggtgaaagagtgagaccttgtctcaaaaaaaaaaaaaagcacccaaaaatgaaaaataggggatgatgttggggggctaactgggctctgattagctcagacagtgccacaggtcttgactgattttgtggaatattgaaaataatcatggccgggcatggtggctcacacctataatcccaacactttgggaagccaaggtgggcagctcacttgaggtcaggagtgcgagaccagcctggccagcatagtgaaaccctgtctctactaaaatacaaagaaattagctaggtgtggtgggcacctgtaatcccagctacttaggaggctgatgcagaagaatcacctgaacccgggaggtcgggaggtggaggttgcagtgagcagcagagattgtgccataccactgcactccagcctggtcaacagagcaagactgtctcaaaaaaaaaaaaaaaaaaaaaaagaagaaagaaagaaagaaagaaaaaagaaaaaagaaaagaaaagaaaaaagaatcatgatactatcagtaatataaatcacattagcaatggtcttctaattagctctacagtatgccagggacctaatttcattgacgacagaagtatccactcaagccactgacgttccattctctacccgacagctggatagatcccattaaaacataatcaaccagattgggcaacatagtgagaccctgtctctacaaaaataaaaataaaaatattagccaggcatggttgtgtgcccctgtagtcccagctactgtggaggctgaggcaaaagggtcgcttgggcccagaagttcgaggttactgtgagctacaactgtgtcactgcactccagtctgcacaacagagagagaccttgtttctaaaacaacaacaacaataataataataataataataacaataacacaattaggaccattcataatcctcccatttcaggtaaagccaaagtcttcacaatgccatccagccctattccaagtggcttctcttccctcctccttatcttgctccctcccacgcagccacactggcctccttgctgtttctcaaactcgcctatcatgcttacttcaggacttttgcactgttcctgctccgcggaatgctctttccccagaagctcccatggctccctcatctccttcaggtctcaaatgtcacttcctcacagaagccttccccgaccaccctcaagtagcacctctctccgcaggtcccgctctactcgtcttcacagattgtatcatgacctgacaagtaatgggtcaatgcagttccagtctagcgtcctcaatggccattcctgccccttgggtggttctccctggaggaactgtgaagatggaatggggggaggagagggctgtggagttcaggttgtgcctccccggaactcctcacacatccataccagcttgtggcacctccacacgaccccacccccatgctcttgaagctgctccgtctcttcctggctttttttttttttttttttttttgagacagcatctcgctctgtcgcccaggctggagtacagtggcgcgatctcggctcactgcaagctccgcctcctgggttctcgccattctcctgcctcagcctcctgagtagctgggactataggcacccgccaccacgcccggctaattttttgtatttttagtagacacggggtttcaccgtgttagccaggatgatctcgatctcctgaccttgtgatctgcccacctcggcctcccaaagtgctgggattataggcgtgagccaccgcgcctggccactctgtctcttcctttaacagggcaggttggaccagggtggtatttgaatatagtatctagggaacactgtgtagggggaaataagtactagaagttggtaaatacggcaaatctaaaatcacagggattaggccgggcgcagtggctcacgtctgtaatcccagaactttgggaggccgagacaggtggatcacctgaggtcaggtgttcgagaccagcctggccaacatggggaaaccccgtctctactaaaaatacaaaattagccgggcgtggtggcgtgtgcctgtaatgccagctactcgggaggctgaggcaggagaatcacttgaatccgggaggcagtgagctgagatcaagccagtgcactccagcctgggcaaaaagagtgaaacttcatctcaaataaataaataaaatgaagtaaaatcacagggattaagtggaccaccccttgggccagtcatgtggcctgtggttagtaattctcatagtgaaatagcccgattacccgcgagatggtttgggagggattaatgagaaggctgcacgctgccaccagagggcagcttcggcatccagtgctgtgagggttcacagaatcctaggtccatttcctctttaccttatctgtcaatccttacatttcagaagctcagaaatattttggataatttttcctccacggactcagaggactctaacctcccgggtgcttttctctttctacagcaggaggggttcatggcaaattctcatcacccctccctattgctgctctgccactgaacaggcgctcacggcagaccaatctgcccacacccaagacactttccagcggcgccgcccatgggcgtccctgctccgcgggaagctctcaccggcggatgcagcccgacgcctgcgcactggagaggcgccaagccccctgcacctgcgcactccgactgggcggggtctcctcgacgtcctggtggaagggttcggaggacggacgccgatcatgcccactaccacgcccccagccctgccagttccccacagagcgggtttgacccagctctttctgctgctctcttgggtgataaactgtgccccatgtctgtaaactagggtagcatttcacgcattcatcctttcacccggcactgtctgagcccgtactgtgtgtcgaggcctggactgggcgaagttcggctctctgtggtccctgattctgaatggctctagggctggtgtgggatgttcaacttactcattcggtcactcagcttttcttgaggacctactgtgtgctgagaccagggctgagcaaagtttgggtcacaggaagaaaccagaatgattggtccctgaacctgtgggctccagggctggtgctgaggatgttcacctgttcatccatttacttggcctctcctgaggacctactgtgtgcttggcctgggctgggggatgtcgggggtgagggggttaaggagaaactaaatgtgtggtccttgtccctgaatgactccggggctggtgctggggatgtataactcttcatactgtcactgacaattcttgaggacctactgtgtgctgaggcctgggtggtcagtcaggagccaagggaagaaccaactgcttggtccctggccctaaagagcctgggcaacagagcgagactccgtctcaaaaaaaaaaaaagaagaaaattctgcatatcatatgctaccatttgtgaagaaaggtgtactatatatctttccagaatattctatgcatataaatattcatatatatgcttacatatagtaagcatttgcttctagtgagggggacttggtagctgggagacacaggagtaagaacagtttttttttttaactttataaattgtggactacatgagtgtattcccccataaaataattttccaatgattatagtcatgtgaagttatgagattataactttaattcaacattgtagtaggtggattacgttcataactcctacttttcacccttccctgggaccacatgcttaggaaggctcttcctgtgctgatcctaggcttggctaggaggcttgctttggcctgtgggactagatgcaaatgtgacaatatcagagacttgaaagcatgcctgtgtgtccactccctctcagactcctgccacctccctgagaacacacccaggtgagatgtgagtcaggagaagaagatcaaattggcccagctgagccctcctggtccaggtccagaccaagcctggtccagaccaacagaaccagcagctgacctccagatgcatgagaaatagtaaatggataaatgagggctggatggtttgttacacagcaagagctgactgatacaagcattaaagtcaggtctttgagttagggggaaaaatggtggagatgggtaggtgtttcctcatactgaaaaaaagactaggcccactctaaaaatcttttgtagaggagaagcactcccttcttctagaataactttcagctctagatttctcctgctcattttctctaagcactatttctatcttagtgaatccagatttcttcttcagactctgctcctttagtaaatatgccaacttggccaaagaaaccaaaccttttattcactttaattcaattaaatttactgagcaagggcttactcaataaaatcaacaatgaaaaggccagctggccaggcaccgtagctcaggcctgtagtcccagcactttgggatgccaaggcaggcagatcgcctgatgttaggagttcgagacagcctggccaacatggtgaaaccctgcctctactaaaaatacaaaaattaggctgggcgcggtggctcatgcctgtaatcccagcactttgggaggccgaggcgggtggataacgaagtcaggagatcgagaccatcctagccaacatggtgaaaccccgcctctactaaaatacaaaaaaactagtccgggtgtggtggccgggcgcctgtagtcccagctactcgggaggctgaggtaggggaatcacttgaacccgggaggcggaggttgcagtgagccgagattgcatcactgcactccagcctgggcgacagagcaagactccgtctcagaaaaaaaaaaaaaaaaaaattagccagactcctgtaattttaactactcgggaggttgaggcaggagaatcacttgtacccgggaggcagaagtttcagtgagccgagatcgctccactgcactctagcctgggtgacagagagagacactgtctcaaagaaaaaaagaaagaaattaaaggccagccataggtgtttctgcaggtctacttgcccgtgccccatttataattttgcaccaggaagaccgcaggggagtctggcagatgtgaggtacagtcttagccctgtgtcttccccactgtgtgccctcaggcaagttaacaagcttctctgagcctcggtttcctcacaggaagcgtcggggataacacagtatctcccccatagcattgtgaggttggaaaggaggccctcagctcttaatcttctgctggtccacgcgggtttctgccagggcacccctgttgacaggtttctcctccctgtgagagcccaggtgttgagtcaggcgtgggagctgggcaaaggcgtcccgaactgtctgcatgcgtcctctggtgtcggatgagcgcggaggagaagctgaaggccttcccgcagccgctgcactcgtagggcttctccccggtgtgcacgatgtggtgctggatcaggtaggagcggttgctgaaggccttgccgcactcggggcaggtgtagggccgctcgcccgtgtgcgtgcgctggtgcagggcgagcgaggagccctggctgaaagctttgccgcactcgccgcacttgtagggccgctctccggtgtggatcttctggtgctctataagcgaggacacgtggctgaaggcggccccgcattgcaggcacctgtagggccgctcaccggtgtgcacgaggcggtgctggaggaggtgggagcggttgctgaagcgcttgccgcagtcgtggcaggggtaaggccgctctccggtgtgcgtgcgctggtgctgcgtcaggtgcgacacctgggtgaaggccttggcgcactggccgcacgcgtagggcttctcgcctgtgtggatgcgccggtgctcggccagagaggcgctctggctgaagagcgcgccgcagtcctggcacgtgtagggcttctcgcccgtgtgcacgcgccggtgctgggtcaggtgcgcgatctgcgcgaaggccttggcgcactggccgcagcggtagggcttctcctccgtgtggatgcgctggtggcggatgagcgctgaggagaagcggaaggccttggcgcacgcggagcactcgtagggcttctcaccggtgtggatgcgctggtgctctatcagggacgagcggttgcggaacgccttggcgcactgggcgcacgcgtagggccgctcgcccgtgtgcacgcgccggtgctgggtcaggtgcgtgacgcgcgtgaaggccttgccgcagtcggcgcagcggtgcggcttctcgcccgtgtgcgtgcgccagtgggacgccaggtacgagccctggctgaaggccttgccgcactcgtggcaggcgtagggcttctcgcccgtgtgcgtgcgctggtgcagggtcaggtgcacgctctggctgaaggccttgccgcactcggggcacgcaaatggcttctccccggtgtggattctctggtgtaagatgaacgctgaacagtagctgaaggccttcccgcagtccccgcatttccacggcttcttggggcctccacctctctcccgctggcggctgtcaggatgcctctccttcgggctctccccaggcgcgctgcacctccgggaactgctgtcgtcggggacactggcttgggtagcagcagggctcgatatggttcttgggattcggctgaattcatcgcgttcctgcatgctgtccccagcagggtctcccttgcaggccacggcctctggctctggacagctttcctggttttcctgcaggtcctcaacctggccctcgtgtttccagtttccttccaactctgcgccctggagggcgacgctcaagagtccctccatcctcgatccctgggctgctgtcttgatctcacatcttttctctgggtctgaaaagaaaaagatagaaaaaaaaattaaatgttgccacttgtcctgagctggaaaaatggctaacagctgaactggtaagaacttagcatggggtccctggacctctgtgccaatgacattttgggtccaataatttggtgtggtgggacccatcctgtgtgttgtgagatgttgagcagcgtccctggtctctccacactggctgccagggacactacccctcaacccctgagttgtaacaatgaaaaatgtctccaggccggacgtggtggctcatgcctgcaatcccagcactttgggaggccaaggcaggtggttgcttgagcccaggagtttgagaccagcaaactgtctgctgcctgggcaacacagcaagatctcatttctacaaatgaaaaaaaaaattagccaggcatgatgttgtgcacccgtggtcccagctactcaggaggctgaggcaagaggatcagctgagctcagaaggttgaagctgcagtgagtagtgatcacactactgcactctagcctgggtgacagtgtgagaccctgtctgaattttctttaaaaagtctccagacactgccaggtgtcccctcccctggggacaaaattgcccccagttgggaatcactgacttaatggaactaaaaacaaatttaaaagatccctgaaaaagaaaaaaaaagcatgaatctgtcagctcttaaaatatggccctgtaatctggtgctgtgaactgaattgtgccccctcaaaatttatacatggaagccctaactcccaaggtgatgctttgtggagatggagcctttgggaggtgattagctttagagggggtcatgagggtggggcccccacaatgggactgttttattttttttttgacatggagtcttgctctgttgcccaggctggagcacagtcttggctcactgcaacctccgcctcccgggttcaagcaattcttctgcctcagcctcctgagtagttgggactacaggtgcacgccaccatgcccggctaatttttgtatttttagtagagagggggtttcaccatattggccaggctggtctcaaactcctgacctcaggtgacccacccaccttggcctcccaaagtgctgggattacaggcgtgagccaccgcgcttggctgggactaatgttttgataagaagaggaagcgacaccagagctcgctgtctgtcaggtgaacacatggcaagaaggcagccgtctgcaagccaggaagtgagtcctcagtgtggtctgaccatgctggcactctgatctcagactcccagcctctagcactgtgaagaaataagtgtttattgcttcagccacctaatctgtgattttttttgtaagctggagctaagataactggaaagacagttttcttttctggggaaaaatcagttgaaactttaattcccagtgtgacagcgtttgatgtggggcctttggaggatgattaggtcatgagggcatcctccttaataggattagcgtccttataagaggagacaccagggggctcacttactctctgctctctctgtcctctctgcgtgtgaggacacagggagaaggcggccatctgtaaaccaggaagagagccctcaccagacagaatcagccaacagtgatcccagatttcacattatggggacactattcaactcactatgctccccttctacagggctccatcagtgaaggagctgcccagggtctcccaggctcagaggttcatgctggctcgtgggcccagggtcgttagagatggtgatctcaagctattgcaggttaccctgtctgctttgcacattttcagtggaaagcagggatctgtttttatatgagcccaggaagtcactgttttttagaaagccataacagaagccatacatatagttacttctagtggggctgtgatgctgaaggatttataccaattgcctggtgtacactggacctgcacgctggcgagaaactcaccactgacttctgatgctttagttctaacagaatgggaagacagatggacaaatgacctcctggtgctgagagagggaaggaggcagctgcctgtggatccactgtgctggggctagccccagaggagggggctcacactgctgggaggtcctttccaggctgtgtggctgcaggtaagtggctacctgctctgaggctctgcctggttttctctctctaaacagggctccagcctccccttctcccgagggacatggcaggtctctcagcaagcttggcctcatgttatgtgtgggctcagcccctcacacacaggcattccctgaaccaactagtaggctgtgtgcatacagcagagagtgctcggcctttggctcctccgggtacactcctgctgctgctggacaggctacgtctgaagcttgtcctccccacttcctgtgtgagatcctaaccctttgtggtggtgctaggaggtggggcctctgggaggtgatgatgacatgaggctggagccctcaggcgttggattcctgcccttataaaagaggacccagaaggctcccttgccccttcctccaaatgaagacacaacaagagggcccggtctatgaactaggaagcagccctcaccagacaccaaacctgccggcaccttgaccttggacttccagcccctagaactgtgtggaaataaatgctgtttctttctttctttctttttttgtttttttgtttgtttgttttgttttgtttttgagataagagtttcgctcttggtgcccaggctggagtgcagtggcacaatgttggctcactgcaaccttcaccttccgggttcaagcgattctcctgcctcagcctcctgcatagctgggattacaggcatgcgctaccatgttcagctaattttttgtatttagtagagatgaggtttcaccatattagtcaggctggtctcaaactcctgtcctcagatgatccacccaccttggcctcccaaagtgctgggattacaggcatgtgccactgtgcccggccaataaatgctgtttctaagccaccagagtatggcattccgtcacaccccaaaggacctaaaatagggctttttttttttttttttttgagacagggtcttgctctgttgctcaggctggagtgcagtgttgcaatcatagctcgctgcagcctgggaatcctggctcaagtgatcctctcacctcagcctcccaaagggcttggatcacaggcaggcaccaccaaccacacctggtcaagacagggcttttgtgtgggctattctttctgcctgacatgctcttcccgcagcgtgtgcctcagcaagaggacaagaggagaccctgagggagtgatgatgtttgtgttcagggtggagaacacagcaagtgcaaaggtcccagggcaggatggtgacaagggtggcagaggaaaggtaaagggggtggggctggacagagcaactgaggtgcaaggcaggggagatgcggtagagtggggtgggggtcagctcacacaggaagtcacgtgtgctggtaagaacttgctggtgggggccaggctgggtcggctcaggtgccacgtccaccggcatccccggagtgtgcaggggtacccacctcgtgtgtagggggagggcaggtgggttcacagcggggttgggtaaacctgggtgttgtgcacacacaaaggagcccaaggggagacacaggcttgcttgggggcagtagaagaaagctgtctactcccagcacttctgacacgtgggctttctccacaccaacaaccaagtctccaatctgctctgactgggaggcacaggcagctaccaaccataaaactgcctcaacccctccttgggtttggtgatttgctcacatagctcattgaactcagggacatgctttatttacggttactggtttccaataaaggatacaactcaggaacagccagatggaagacacacagggtaaggtataaggaggagctcagagcaccatgccctctctgggtgctcgacagccccagagctcggcaaaccctaagtttagggtggttatgggggttccatgacacgggcgtgactgacataggtgtgatgacactggccatcggtgatgaactcaacttccagccctctcccctcccaggaggtaggggctggctgaaggctggaatgctcatcagggctagctcccgtggcaaccagcccatcctaggggcctatcaggagtcctccattagcataaatgtacttgggggtctaccaggagtcctccattagcataaatgtacttgggggcctatcaggagtcctccattagcataaatgtacttgggggcctaccaggagtcctccattagcataaatgtacttgggggcctatcaggagtcctccattagcataaatgtacttgggggcctatcaggagtcctccattagcataaatgtacttgggggtctaccaggagtcctccattagcataaatgtacttgggggcctatcaggagtcctccattagcataaatgtacttgggggcctatcaggagtcctccattagcataaatgtacttgggggcctaccaggagtcctccattagcataaatgtacttgggggcctatcaggagtcctccattagcataaatgtacttgggggcctatcaggagtcctccattagcataaatgtacttgggggcctatcaggagtcctccattagcataaatgtacttgggggcctaccaggagtcctccattagcataaatgtacttgggggcctatcaggagtcctccattagcataaatgtacttgggggcctatcaggagtcctccattagcataaatgtacttgggggcctatcaggagtcctccattagcataaacacaggtgtggttgcagggggcttattaagagttgcagaagacactccttctacccctgtcactcaggaaattccaagggttttaggggctctggtaccaggagctggggataaagattaaacatatatttcttattatatcacaagatcacaggaagacacatgcattacatcacactctgacacacacagggtcatacacaatcatacctgcccagacacacacagacatgcagagacacccaaacccatatccagggacacacagtcgccctcctaacccccatgcaaggaggcaggtgggaagccatcacctgcagccacactcacacatgcacacagggtcccgggcacacgtagctacacacacacccagccccacacgtagctccctgtgtgaagaggtgcacagagacgcacaaggtcacacatgccacctgctccacacaggccggccattactgggacacacccacaggggatggctggacacatgtgcagtcacactcggtggatagagctccagcatagccaaagcccacatgtgcagcgtctccatcatgtgcagatgcacacacttcagacagcacggcactctacaggctcgcacagccaggtcacccatcattgtgctggcaggcacacgggccgagccagcctacacggcggcacacccagacatgcacacgtggggtcacacacctcacatccaggagaactttcagacttgcccaaaggcagccacacgtgtatgtgacatgctgtgatatgcagacaccgcttcacatgaacgagcacataacacaccgataaagtgttacatgcctttacctgcagtcacctgcctgggctggcaccactgagtgagcaggtgcagacacagtgacactcggggacgggctcacaggcagtcacacacctgcaaggcctggcaccgccgagtgagcaggtacagacacagtgatgggctggcaccgccaagtgagcaggggcagacgctgtgacactcagggacgggctcacaggcagtcacacacctgcacctgctggtaccgtcgagtgagcaggtgcagacgctgtgacactcagggacaggctcacagccagtcacacacctgcacggcctggcaccgccaagtgagcaggtacagacacagtgacgggctggcaccgccgagtaagcaggtgcagatgcagtgacaggctcacaggcagtcacacacctgcacctgctggtaccgtcgagtgaccaggtgcagacgctgtgttactcagggacgggctcacaggcagtcacacacctatacgggctgacaccgctaagtgaacaggtgcagacacaatggcactcggggacgggctcacacgcggtcacacacctgcaggaacacgcgcacactacacaccgttgctctcgcctcccggtatcaccttcgaacgcgctggccggccccctcctagcctggtgcagtcggctccgcttctactcagtctcgggtcctcctgggccaacgcagaccctggtgcctccttccttagacgagctaaggtcaagacttctgctgctgcggaggagcccgcgcaccaggccggggtggactgcgcctgcgcatcgggcccgcctggttcttaggaactacgactcccagggggcgctgcgcgctcgccggcaccgcgactaaagcttgcaaagcctgggtcatcgaaactacaactcccagaaggctaagcgtctgcacacgctaggtccgcagggcgctgacccctgggggcccgaggagcgccgggctgctgccccgagccccgcccactacagcctcagtgcatggcggtgggcgcttccagtaactcaggggtgggacttttttcttgctcaggggatgaggccgagcccacaggcttagaaagaaggaacttgagtccgggcacctgtcatcccagcgcttagggaggccgaggcgggtggatcacctgaggtcaggagttcgagaccagcctggccaatatggcgaaacccccgtctctactaaaaatacaaaaattagccgagcatggtggcatgcacttccagctacttggaaggctgaggcgggagaatggcttgaacctgggaggcgagggttgcagtgagctgagatcgcaccactgcactccagcctgggtgacagagcgagacttcgtctcaaaaaaaaagaagaagaaagaaggaagctgaggttcagacaggctaagtccctactgcaggctgcggaatctaaaaaggtaggtgccagggtttgcaacccacacttttattttggtctcaggtagctgatgtcattccagtctatggcaaagaaggtggcaaatccattaacatagatgaagaatttcattttactttttagttttatttatttatttatttttattatgtatcatgcttttaatacaaactttaaaaaatctggaacaatagaaactgtacagatttgatcaatctttttgttttgtttttaaactaaaatctctaaacacaccaatgtcctattccaaaatattgcacaacattctgaatacaaaacccttgattgtattcctccttcactgaagaaaaaacttcatgaccctgctccccgggctcctctccaggcttgcgtcaatgcccccttcccatccctagggagaaaactagagaatctataactcactgcattgagaaaaagacatcattctggactaacagtttccattcttcagaagataatccaccttttgatttgttcctgggaaacagggatagatagaggatggggaaaggggagaaaaggttttatttctcctcttttttttttaaagtttgtttttcctgaaaaaatatgtttctctcatctttttaagaaaaaatcttgaaaagaaaaaaattgtttttacgttagaaatatacatatattatatatacctcttacattttacaaatgtagcaaattattcaatacaaacggacaccaaaaaatgtaaaaaataaaaaaaagttttcctaagaaccaggtaaattagtgcagatttctgtttttgttttcttaaaaaaaataaaattgaagcaaaagtgcctagatttgagacaagacagactgaactgggcccaagagcccagcactggagtcatgctcctgaacacacatttttcttcgtatttcaaaagacacaaaggggttggtctccccccctctccctacatgtgagaaacaagcagacctggtgtgggtgggtgcctgtgtgtgtggatgggaggagggatagaaggggatgtaaggcagcatccaacctttcccagagagaagctatctgctgggcctgtcacctgtgtgggagccgaggatgagggaaagggtggcccagactgggctggcccctgagaagtctaggggaacagatggtgctgggctgagaagccaggacattgcctgccgggggaggtagagctggtgcctactgcagggagaggaggctggcagtgccggcctgggctggacccactgccatagcagttgcctacttggggtccctgggtaggatggagtgggtggggtgccaggggctttggtgctttctggtgatgggaccctgatgccaagtgcccactttgcaaagatgaaaaagttcatgaccctgctcccttggctcctgtccatgcttgcctggcctcctggggttggaggaacaagctctctcctggcagaggcaggagagagttttattttttagaaacagtttcgctttgttgcacaggctggagtgcagtggtacaatcacggctcactgcatcctcgacctccccaactctagtgatcctcccatcttagcctcctgagtagctgagattgcaggcatgtgccaccacactggctaacttttttttaacttttattttttgtagagatgaggtgtcgctatgttgccctggctagtcttgaactccaatccttccacctcggccttaaataattttaatagttgacatgcacatggcatttactattggccggcattattttaaggtgcctgctctgaaggaattctgttagccttcctaaattattcccttggccattggaaacataggcatgagatcatttttagataattggaaaagcagagaaatctgtgaagatagaatgggaaaaaaaatgcatttcactaaaccaacatgccattgattgtgagattccacattactttatgtagccccacggctgcccttaaaccatgacacatgctttatttacagttcatattttacttattcgtagacctcaagaggcattctgtgcttccctcttccttctggaagcttcatgagaagggacattttcctcaaaggatggacaacagaaacaactcaaatattcatttcctttaaatatggtttttaagacaattttctttagaaagccacatttacctgttgggggttgatttatgctcacccccctcccaaatatatgttggaatgctaaccccctattcctcagaatgtgactttatttggagacaggttctttacagaggtaataaagttaaaatgagtaaatagggtgggccataacccaaaatgacagctgtccttataaaaagggtgcatttgcacgcagagacacgcatagagagaacatgatatgtagaggcacagggagaaggccgccatctgcaaaccagggagagaggcctggagcaaattcttcttcatggctcttagaaggaaccatccctgcctacaccctgatttcagatttccagcctccagaagcgtgaggcgataaatgtctgttgctgcagccacaggttggcggtgctttgctgcagtagccttagcacctgatagatggtctctttacatgtcaagcacattgcagcgcacatttgacacacagggagatggaagctcctggaggataagtgttttgtctgtgattttgaaggttgcaagtggaggaactgggattcgaacccctctctgtgtgatgcctatgcctcctctgtgttaacatttatttttacttatttttattttttagtttttgtagagatgagggtctcactatattgcccaggctggtcttgaactcctgggcccaaacgatcctcctgccttggcctcctggtcttgggattacaagcataagccactgtgccaggcctacactttaaagcactttgcctctttaaagcactttgcctctttcatttcctagcctggagaaaatgtacttctgtggtcactaagaaaacaccttcacaatcaggcaaaaatgtccccagaaaatgctggcttgggctgctgaggaaatgcacaatcaaatcaggccacacaacgtttcagagaccctgaggcagggactccatgtcccagctatgtttgtcacacaccagtaggcagcctctacccaggggtggaagattctagacccagctataggctctggcaaccagggcaggcagctccttccaggaaccggtttctgtggttttctttggtcacttccattaagtcttaaacaccccctggaagaaaatgaaagtgtgacgttgaggaacgtgagatcagatggtggagtagttttctagagccaccataacaaagcatcacagaccagggtcttaaacaatggaaacttatttcttcacagttctcaagaatggaagttcacgatcaagttatggccaaggttggtttcccctgatgcctctctccttggctggcagacgaccatcttccccatgtcttcatatggtcttccctctgtgtgtgtctgtgtcctaatctctcccacactcttttttttttttttttttttttttttaagaatgtcagccatgggccgggtgtggtggcccacacttgtaatcccagcatcttaggaggctgaggcgggtggatcacctgaggtcaggagttccagaccagcctggtcaacatggcgaaacaccatctctactaaaaaaaatagaaaaattagccaggcgtggtggcaaatgcctgtagttccagctactcaggaggctgaggcagcagaatagcttgaacccgggaggtggaggttgcagtgagtggagatcacgccactgcactccagcctgggcgagagactgagactccatctcaaacaaaaaacaaacaaacaaacaaaacaaaaaacaatgtcagtcatattggacttgggacccatgctaatgacctcattttatcttaattccctttctccatctccaagtacagtcacattccaaggaatggggggttaggacgtcaacataaaatttggtggtggggcacaatttggctcatcacaatgggtaaaatggggcattaagctcacatcctgaatctaaaacccacaagaggctggagtactttgctttccctggttcatgatcaccgtgctaactggagtgtggtcaccttgaaattggcttagaggaagatttatgatatcctcccaagtcaagggctcaggctctaaacaccggcttaaataagagctgagtgaaagtccacaaatcttgttacatcaacttctgctggactttgttggacagatgctgaagtcctctgtggagaaacaccttagcaacttgtcaaagtagttcatttctagagatctcatgaccaatgagcaattattccagattccctgtgggttgaaatattctgaattttatgctgcattatcattataactgggtgatctctggcttagcatcacgtttgtgacctcctggcttctaaatgtttagtgcccacctggcctctaccaccaaaagatcctattattcccaccaagctcatggaatccaatttcctcgtggcattttctccatcctacaatggacagcagccacagggctcttcaccgatccagaagcctcttcaccttacagtgttggtgaggcaagtctcccatgggtcctctgggagtatgtttaagggtacctgggcagtttgcctgcatagaccgatgtctacattcacgtttccttaagcttccagactcccccctttaccgtgtactaggaaatggctgggattttgacctcaggggggttgccagtccattccagctgctatcacaagacagcataaacagggcagcttataacgagcagaacaggtgatgtatttatttatttaaacagagatgaggtctccctgtgttgcccattctggtcgcaaactcctgggctcaagtggtcctctttcctcggcatcccaaagcgctgggattacaggcatgagccactgtgcctggccttgaaaagaatcattctgaaggctagaaagcctaagatgaaagtgccaggagattcggtgtctggtgaggacccaattccttgttcgtagatggcaccttcttgctggctgtgtcctcacagggtggaagggagaaaagagctttcttgggcctcttagaattatgctaatcccattcatgagggctcagccttcgtaaccaaatcacctcctcaaaacctcacctcccaacaccatcaccttggtgattaactttcaacataaaagtttttggggggtgacacacacattcaggcctacagaggtggagtgatctgcagatgactgttgattcaggcgtcaccgctccaacactggagactctttttttttttttttttttttgagacagattctcgctgtctggagtacagtggcacgatctcagctcactgcaacctccacctcaagcagttctcctgcctcagcctcctgcgtagctgggactacaggtgtgtgctaccgcgcccggctaatttttgtatttttagtagagacagggtttcgccctgttggccaggctggtctcaaactcttgacctcaggtgatccaccctgctcagcctcccaaagtgctgggattacaggcctgagccactgcgtccggccctggtcccttgatctaggatttcagcctccagaactgggagagaataagtttctgttgtttaggtgaccgagtctgtggcactttgttatggcagcccaagctctctgatatagaggctaagcaactgccatgcttcatttacttaatcagctgtgggtcggcactgtgggttgggtttagtcaactagttcttctgtcttggctgggcccactcgttcatctgtgctgagctgggttgagcggcggctggcccatctgtagcctctcatcctctgccaggacagcctagggtcatttccatggcagcctggcagggttccgagagagttagtaggaaccgtcaagcccgttgagcacaaggctctgtactgacagctttgcacttccactgcaagctactggccaaagcaaaccacaggtgcagcccagatttgagggatgggaaaatggccacaggacaaacggcatgggttcaaggaggggtggaatactaggatgagttttgcaatctgtcatgtgcacatacacacatgtggtgagttggatacagcctggtgtgtgtaattacaaacacccctctaataaaaatgtgcaaagatctttcaattactcaagtgatgttatttccaaacctttcctatcagactcaaccccctttagatacgattattctcatgctggctgggcgtggtggctcacacgtgtaatcccagcactttgggaggctgaggtgggcagatcgcctgaggtcaggagtttgagaccagcctgatcaacatggagaaaccctgtctctactaaaaatacaaaattagctgggcatggtggctcatgcctgtaatcccagctactcaggaggctgaggcaggagaattgcttgaacccgggaggcggaggttgcagtgagccaagatggtgccactgcgctccagcctgggcaacaagagcgaaactccgtctcaaaacaacaacaaaaattatcctcatgctaaaatgtattcccaactatgacttgaatttctctatttattggtaaaagaaaaattcggccaagcgcggtggctcacacctgtaatcccagcaccctgggaggtcgaggcgagaggatcatgaggtcaggagatcgagaccatcctggctaacgtggtgaaaccctgtctctactaaaaatacaaaaaattagctgggcgtggtggcagccgcctgtagtcccagctgctggggaggctgaggcaggagaatggcgtgaacctgggaggcggagcttgcagtgagccgagattgcgccactgcactccagcctgggtgacagagcaagactccgtctcaaaaaaaaaaaaaaaaaagaaaggaaaagaaaagaaaaaaaaggaaaaattcagaggtggcatgtgcaaaacttgcaccatacatttatatagctgatactcaattgaagaacatgtatgtgattttcagattcttgctgtgataaatgatgtttctgtgaacatggtttttaccagtttttaaaaatgggtgatataataaatagaatgtgaagctgtatcagtcagggttcagaaacagaatcaataggagatactatgtacctatccacatatatattatagatgtatatattaatagacacaaattgatcacgtgagccaattccttaaaatctttctcttatctctctctgtgttgtctatatgtatacatatataatagagattctggtggaaggctctgagatcaagggggaagggaggcaggccatgaaaaagtcactccaagacagattggggtcctcagctctgcagacccaggaaattcagatatatgtgtgtatatatacctgtccctatctatctatctatctatctatctatctatctatctatctatctatctatctatctatctatctatccatctgtctatctatctgcctgcctgcctgcctgcctgcctgtctgtctgtctgtctgtctatcatctaatgtatgcagaggttgagatttattttaaggaattgtctcacacagttgtgggagttggtttgtagggccagccagcaggtgggaaactcaagcagacattgatgctgaaatcttgaggcaggatttcctcttctctgggaaaccctgagttttactcagaaggccttcaactgattggatgaagtccacttacattaccgagggcaaccttttcttaaaaaaaactggttgtagatgataaccacatctacaaaataaccttcacagccatgcctggattagcatgtgattggattaccaggcactggaccccaaccaggttggcccataaaactcaccgttagcaggagtgttgtggggagtgggcaggaaggggtatgtagaaagaaatgactgaggaagactgatgagataaatattggttctaagtacaattaggaaagatcaccaagtcctactttaccaaaaaaaaaaaaaaaaagaaagaagaaagtaggccaaatgtaaaccatgatacatgttattttgttatttattcatttttttttgagacggagtctcgctctgtcgcccaggctggagtgcagtggcgcgatctcggctcactgcaacctccacctcccgggttcacgccattctcctgcctcagcctcccaagtagctgggactacaggcgcccaccaccatgcccggctaattttgtctttgtatttttagtagagacggggtttcaccgtgttagtcaggatggtctcgatctcctgacctcgtgatctgcccgccttggcctcccaaagtgttgggattacaggcgtgcaccaccgcacccagcccactgctttccatttttaaggtctttatctagaattagaattgctggatcacatgacaattttatttttaattttttttggaaaccttcagaccattttccagaatgactgcatcataccacattcccatcagcagtgcagaagggttccaatttctccaaatcctgccaatatttcttacattgtgttttatggatagtagccatgttaatgaaagtgaggtggtttcttattgcaaagatgatgatcttttaaattttttcagtcgtaattgcttaataatagaatgtgtggctggacacggtggctcatgtctgtaatcccagcactttgggaggcccaggcgggcatatcatgaggtcaggagatcgagaccatcctggctagtacggtgaaaccccgtctctactaaaaatacaaaacaaagaaaaaaaaattagccaggcgtggtggcaggcgcctgtagtcccagctacttgggaggctgaggcaggagaatggtgtaacccgggaggttgagcttgcagtgagccgagatcgtgccactgtacttccagcctggaggacagagcgagactctgtctcaaaataaataaataaataaataaataaataaataataataataatagaatgtgtgtgcctgctgggcattctataccttctcaaacattggcatcagactggactatgccacccgcacttcctcatccttgttgattttcgtgggtttgattcacagcaaacactgccaacccagcatcacaaagcatgatgttatcaaaggaagtgtagagagatcttaggctgaaactgtggaaccctggaggtggaggttcatgtgtgtcagatgtctaatactgctacgcgtccctaaaattgaaagaatcagggtacctgggctgacagttgcagctgtggggatagagaggcagaaaagcaggaggtgttcattggagggggagagaacggaagagctcccctggtcgcctagcaacgcggagacgccccacaggggactctggtgagaacaggcagtggcagaggggctattctgcctcagccaaatgtagctgcagagactcaggaaagtaatgtagatgtagaaattagaaattaattaatttctttaattaataaccctcagttgtatattgagacggtctccactgattttttcatgtctaccgtttgcatagttttaggccagtaggtcccaaaatgtagtttaaggactcctgggggaatcaagaccctttctgggggtccataattcccaacattttcctaagaaaattaagaatttacttgcctaccgacttttcaatttatctgcatgatgtaatactgcaaatgtttaagtggcagatttgagaatctagctgtcttgtactaaggcgaacattaaagaaatttgcaaaaaaggccgggtgcagtggctcacgcctgtagtcccagcactttgggaggccgaggtgggcggatcacaaggtcaggagtttgagaccagcttggccaatatggtgaaaccccgtctctactaaaaatacaaaaattagctgggtgtggtggcgggcactcgtagtcccagctactcaggaggctgaggcaggagaatcgcttgaacccggcaggctgaggttgcagtgagctgagatcgcgccactgcactccagcctggcgacagagcgagacgccgtctcaaaaaaacaaaacacaacaaacaaaaaaacccaaaccctcagttgtatattcccaaacccatcctcagtggagacggtctccactgattttttcatgtctactgtttgcatatttttaggccagtagttcccaaaatgtagtttaaggactcctgagggaatcaagacctttttgggggtccataattcccagcattttcctaagaaaattaagaatttacttgcctaccgacttttcaatttacctgcatgatgtaatactgcaaatgtttgaattaagtggcagattggagaacctagctgtcttgtagtaaggtgaacattaaagaaatttgcaaacatgtaagacaatgctaattttcttactaattctttggaaaatactgtataattgcctataaaaattgtgaaatgttaatatataataagattattatttttaagttttaagtgtataattttctcagcttcaatatgtaattgtatgtaaatatagatcatacaaagaaaaaattttaggggttctcaatatatttaaaaaatataaaattggcctgagatgaaaaactttaagaattactttcttaggttaagtttttagatatcagctggctgggtggaaggaatgtgcatactcggtgcttttcatacacggtgtcaaattcccatgaagctatccagttgttccgtggctctaaattctcatgggaaatgtaacccagatctgtctcgctgttatcaatttttcacgctgcctaccataattaacccagtgaagaatttcagtgaaaggtagattgagctatttgtacccagccttccagagaattccctttatataggataagtttaaattctttttggggggccggcgggggtgggggtggtggtgtctggaaaggaggatcataggataagtttaacattcttagatgagaaagtcaaatgtagattcctgagttcacaaaccccagccccaacattcatgatgtgggtgatcctggggaagacatctgtccttctgagcccacctccttcacttagaaatgggcactgggggtggggaaggattggacctggtgccccccaagacattgtaagaatcaagaaatagtagctaggtgggggtttttgggcatttctaccataaatatgaaatataattttattttaataatgtgacaaataagataaagagtcatcttcttatttattattattattattttttgagatggagtcttgctcttgttgcccaggctggagtacagtggctcgatctcggctcactgcaacctctgcctcccaagttcaagcaattctcctgcctcagcttccccagtagctgggattacaggcgcccaccaccaaacctggctatttttttgtatttttagtaaagacggggtttcgccatgttggccaggctggtcttgaactcctgacctcaggtgatctacacgcctcggcctcccaaagtgctgggattacaggtgtgagccaccttgcctggccgagaatcatcttctttgtgaatttttccccaaccactgtatcgataatcgttaaaacaaattcctcctcaatgctgtcataagaggtatgctggttctcttgttccccatccctcatggggatataactgactgtttacctgtttcccccaccaggtcatgaactctgagagtttgagatgagcctctaaaagctgtatcaatagcaccttgcactgttgaagcaggtaagtgttttccttgttacttcttaagttcagttggaaacccaacatagcaaatcctctagaatgcagctgaagcagtactaaggctgggtgtggtggctcatgcctataatcctgtagggaggcaaaagcgggaggattgctggagcccaggagttcaagaccagcctgggcaacacggcaagacctggttctccacaaaaaggaaaaaaaaatgctaagaggcaagtatatagcaataaactcctacatcaaaaaagtagaaacatttcaaataagagattgggggcagtggctcatgcctgtaatcctagcacttttggaggccgaggtgggtagattgcttgagaccaggagttcgagaccagcatgggcaacatagcgagaccctgtctctacaaaaaatcagaaaattagccaggcgtggtggtgcaagcctgtagccccagctactcgggaggctagggtgggaggattgattgagcctttgaggtagaggttgcagtgagctgagattgtgccattgcattccagcctgggtgacagagctagaccctgtctcaaaaaaagaaagagagaaagaaagagaaataaataaagagagaaagaaagaaaagaaagaaaacaaacaaggaaggaagaaagaaaaagaaagagaaagaaagaaagaaaaagaaaaagaaagaaagaaagacttcaataacctaaggatgcacctcaagaatctaggaaagcgagaacaaaccaaacccaaaaattagtagaagaaagtaaataaagcgcagagcagaaacaaataagattgagaccaaaaaaatacataaaagatcaatgaaaaaaaaattgcttttacatcatggtcttgaccttgcagggatggcccctcccagttttagccaatttctcgagtgataaataacttgcttgagagcatgccttttatatataaaccaccaatccagagcccacatcccacccactctctaacagggcgctatactcaccccagggccaggtatcacaccactaagaacagcccttttccccagatcccactgaggttatccaaagtgaccagccctaacctatgaaatctgcctcacttcttcctttccacagaaactatagcaaagtcttgtccacacccacatttcactcacctccttctgactcctggcagatcctggcgctttccccatggggctgcctgagctgagacgggctctcttctcctggaaactgagtaacacaatttatttcaatgacagtcacttcctcatctgttggcctcagcgtacctccaattttccattacacaataaatggaaaataatataggccgggtgtggtggctcacgcctgtaatcccagcactttgggaggccgaggtgggtggatcacctgaggtcaggagtttgagaccagcctgaccagcatggcgaaaccccatctctactaaaaatagaaaaattagctgagcttcgtggctggagcctgtagtcccagatacttgggaggctgagccaggagaattgcttgaactcagaaggcagaggttgcagtgagccgagatcatgccgctgcactctagcctgggagacagagcgagactccatctcagaaaaaaaaaaaaaaaagaaaattgaattgggccagcccctccacacctgtgggtatttctcatcaggtgggacgagagactgagaaaagaaatgacacagagacgaagtatagagaaagaacagtgggcccaggggaccagcgctcagcatacagaggacccgcactggcgccagcccctgagttccctcagtatttattgatcattatttttactatcttaacaaggggagcgtagaaggacaacaggtggggagaaggtcagcagggaaacgtgcgcaaaggaatctgtatcatgaataagttcaaggaaaggtaccgtggctggatgtgcacgtagactagatttatgtttctctttacccaaacatctcagtgtagcaaagagtcacagagcagtattgctgccagcatatctcacctccagccacagggcggttttctcctatctcagaatagaacgaatgggaatgatcggctttacacccagatattccattcccagggacgagcaggagacagaagccttcctcttatctcaactgcaaagaggcctccctctttcactcctcctcctcagcacagaccctttaagggtgtcccgctgggggatataaggtctttcctttcccatgaggccatatctcaggctatctcagtgaggggaaaccttggacaatacccaggctttcttgggcagaggtccgtgtggctttccgcagtgcattgtgtccctggttaatcgagactggagaatggcgatgacttttaccaagcatactgcctgcaaacatattgttaacaaggcacatgctgtacagccctaaatccattaaaccttgattcaatacagcacatgtttctgtgagcacagggttggggctaaagttacaggttaacagcatctcaaagtagaaaccattttttttggtacagatcaaaatggagtttcttatgtcttccttttctacatagacacagtaacaatctgatctctctttcttttccctacagaaaataatatggagatgacagtgtcttgtacaactgtgtgatggcttgtctccccatgtctgtgtgattgtgtgtccttgagtgtgttggatggagtgtccttctgtgtgtgtgtgtctgtgtttctctctgactctgtgcggttgagggcgtgtggtctctcacgtatgattggatgtgactgcggatctccatgtgtgattatgagtcacgcttcaccggaaagtttctatctcagcctggatgagccacaggaatgtgtgtgttcaggtttgctgtgtgtctgtgtctgtttgacctgggctgttgtgtgtgcatcttagtctgctgtgttacatcatgtgccgttgtgtgtgactctctctaggacagcccgagtgtgactgtgatcatagaggggatgaagccccctgtgtgtgggtttgtgactgtgagtgtgtgctccagttaggagggttttgagcgctcatgtgagtgtgtgggaagattgtggattaatttgctatggctgctgtaacaaaacaccacagactgggtggcctgggtagactgggtggcttaacctaatactaatagaagcttattttctccctgtcctggagcctggagcccaagatcaaggtgtcgaaggagcctgtgttcaggaggcctctctccttggcttcttggcggccgtattctcttggcgtccacactaggtctttttttttgtatgcatccctggtgtcactgtgtgtgtctaactccctcctctataaggatgccagtcaaatgggagtagggccagtccaaaagcctcatttaatcccctcttaaaggccttgaccccagatagtcacatcctgaggttctggagtttagggaatcaccaaataagttttcaggagaaagcagtgagcccataacagtgtgtttgtgtgtggatgtgtggtcatgggagatgctgtgaaggttgccattgtgtccacatgactgtgcgtgaaacagtgattcatgcaattatgaaacccatgttgtgtgagttccacaagaccaaggcaccttttatccactaaatgtgcacatgtctgtgtgtgtgtgtgagtcccacaaaactcaggcatctttcatccactacctgtgcatgtgtgtgtgtgtgtgtgtgtgtgtgtcccacaagacccagacacctttcatccactacatgtgcatgtgtgtgtgtgtgagtcccacaagacccaggcacctttcatccactaaatgtgcatgtgtgtgtgtgtgtatgtgtgagtcccacaaaactcaggcacctttcatccactaaatgtgcgtgtgtgtgtgtgtgtgtgagtcccacaaaacccagacacctttcatccactaaatgtgtatgtgtgtgtgtttgtgtgtgtgtgtatgagttccacaagacccaggcacctttcatccactaaatgtgcatgtgtgtgtgtgtatgagttccacaagacccaggcacctttcatccactaaatgtgcatgtgtgtgtgtgtgtatgagttccacaagacccagacacctttcattgtgtgtgtgtgtgtgtgtgtgtgtgtgtgtgtgtgtgtgattgaaggagatactatttgtggataaataaattgaaacctcaggccactttcctgtcttatatcaaccttattagaatcctgcccaccccaaatgcgcaattccataggtagagcaagataggtcctaggatccatctgggaagtgcccaggatgcccttcctaggatgcttggagacaggattggagcaggtgatggaagcatgggctcagggccaggcagtctggagacctctcctctctgagcccagtgttgcctgtaaaatgcagacactcctaggacctcactcacagccaggggtgcgggagatggccgtgcatattgtactgtgcacttcggctcctgttcaaaaggatacgtgggatgtgaaacccagcctgcgctctctccacagctgtgtccatgccagggccagaattcccactggagtatgacattggtccatccaaagtcccagagcctaccatggccatgtgcaccgttgtcacttggggaaaaaatcttcttaaacagataaacaaacatgtgcaaatgcatatattttagagtatcatcttgtttttaagcctgggcaacatggtgagaccccttctctacaaaaaacaattagctcggcgtggtggtacaagcctgtattcccaactactcggggactgaggtgggaggatcgcttgagcctgggaggtcgaggctgcagtgagctgaggtcgtgccactgaacagagtgagaccctgtgtaaaaagaagaaacaggacaaaacaaaaaccaaaaaccaaatcttaacttttgtccgctaatttgaaggaacgcgtatgaaatcacgttgctgtcactagatggcacttttgcaccatgaaaaaaataggctctaattattatttttttttttacttttcaattttcaattgtggcaaaatacatattacacagaatttaccatcttaagcattttgtgactaatatgtgaaagatatattactaatatcataagcctgtgatatatgccttttttatttttttaaactatggtatttatcattttaaatatagtcatgaatcgacaacagggatacattctgagaattttgtggttaggcaattttgacattgtgtgaacatcttagagtgaacttacaaacacctagacggtgcagcctactacacacctaggctctgtggtatagtctgctgctcctaggacacaaacctgcgtggcacgttgctgtactaaatactgtaggtacctggaacacagtggtatttgtgtatctaaacatagaaaaggtacagtacaaatttggtactatgatcttatgggaccgctataatatatgagacctatcattgactgaaatgttactatgcacctcgtgactgtatttttttttttttttttgagatggagtcttgctctgtcacccaggctggagtgcagtggtgccatatcagctcactgcaagctccgcctcctgggttctcaccattcttctgcctcagcctcccgagtagctgggactacaggcgcccaccaccacgcccggctaattttttgtattttggtagagacggggtttcaccatgttggccaggatggtctcgagctcttgactttgtgatccaccctcctcggcctcccaaagtgctgggattacaggcgtgagccaccacgcccggccatgactgtattttgagtgtgcatcactattaagtacattcacttgttctgccacaatctgcaccattcctcttcagagcacctttcttcttggaaaacaagaactctgtgcctattaagcaataactctccatttctcctccttccagcctctggaaaccaccctttttatttttcattcaggaattctgactcttctaagtaccttgtatacctggaatcatacagtattttgtccggttgtgatgggcttatttcaatgaacattgttcctcaaagttcatccaagtcatagcatgggtcagaatttcctttctttttaggcccgaataatatgccattgtctgtatagaccccatcttgcttatccattcaccaatcgatggagacttgagttgcttccactttgactattatgaataatgctgccatgcacgcggttgcacaaacgtctctttgattctctgctttcaaaacttgtgagtaagattcagaggtaaattgctggttcatgggtaattttatttctgttttttcagaacagtcggatggtttcccaccacagctgcatcacatcacgatcgcaccaacggtgcaggtgtttcagcctctccaaatcctgtcagtgttgttatattctgtttaacggatagtgaccatggaaacggcaatgagttagttccttatttctttgccagggaaaatattgctttcatttttaatacttattacttaatcatggtatatgtctttggttataccgtggcaatggctactgaagagtatcctgacacatggatgggggtcaggtcttgacctctggggtgctttattgttagggctgttgttagagttggcagcagttggatgaataatggaatatgatgaggtggaagttgtaattgattttttttttttggaaacagagtcgttatctgtcacccaggctggagtgcagtggcatgatctcagctcactgcaatctctgcctgccaggttcaagcaattctcctgcctcagcctcccgagtagctgggactacaggcgcccgccaccatgcctgggtaatttttgtacttttagtggagatgtggtttcaccatgtttgccaggctggtctcgaactcctgacttcaggttatccacctgcctcggcctcccaaagtactgggattacaggcgtgagccaccacgcctgcccaactgatttttatattatggtatattatggaaaattgtgtaatttttgagggcgaggaggtaggattattgtgtgaagattctttaggtgaggcagccttgtatagttacagatgctgattggtggtggttgctggtcgatctgtatttgtgagcatttatcttgcaattgagcgtactcaggggaacaggttagataactaaaaatagagttagaagagacaggataaggaaagagaagaagtagagtttaattaggcctttttgggcggatatgaaagtggaggctgaagtttggatttggacaatgttttttggtattgatttctctagtcagattagtctaatagaagagacactaaacattgacttgtgtctagatttgtgtgcggggttgtatggtgtactgtgattggataaaaacctagtataggccgggtgtggtggctcatgcctgtaatcccagcactttgggaggccgaggagggtggatcacctgaggtcaggagtttgagaatcagcctgactaacatggagaaaccccatttctactaaaaatacaaaaattagctgcgcgtggtggtgcatgcctataatcccagctacttggggaggctgaggcaggagaatcgcatgaacccaggaggtggaggttgccgtgagccaagattgcgccactgcactccagcctcggtgacagagcgagactctgtctcaaaaacaacaaacaaacaaacaaacaacaacaacaacaacaaaaacctaatatatttgagaacttgaatgtttgtgatgggtattcaagtttaaagtcattggttatgagattaagatctgttgctaccgagaagcccgttgggaattgcacagcttctcaaaccttggacccagattggcccacgccaccctcactcctcatccatgttgatttcagttggttattgctgttcttcacggtgaccactgacactccagcaccacaaagatgtcagcaaaggaaatgtagaaggatctaaggtggagactgtgaacccctggagcctttagttcatgtggtgtcaggagatattgaatattgccgttcttcccttaaatttcaagcatagaggtaactctgcagacacttgcagctgtgaggatggagcagaaggaatgctgtacgtgttcattggagggggagagaatggaggcgctaatctggttgccaggcaatgctcagtgtccttggagatgactcatggtggaattagaatgagaacacgcagtgggggagggactcttctgaaccagcaaaatgcagctgtagagactaataaactgtatggaagtcccacagtcttccaaatggataatctgtcatttgtatattcagataatctccatttatattttcaggtctcttatttgtatatctcccaggccactagttctcaaaatattgttcaaaacctcatggcagaatcaagatcctttcaaaaggcacacaattccaaactattttcctaggaacattaagattttatttgccttttctcttcttagctttttctgcaagatataatgttccaggtgtttgaattcagaagatgattggaggggattaaagggagttgtaaaatgttagacaaggctgggtgtggtggctcatgcctgtaatcccagcactttgggaggctgaggcagacagatcacctgaggtcaggagttcaagaccagcctggtcaacatggtgaaaccacgtctctgcaaaaatacaaagaatacaataatagacaggcatgatggtgggtgcctgtaatcccagctactcgggaggctgaggcaagagagttgcttgaacctgggagatggaggagccgagatggcgccactgcattccagcctgggcgatggagcgagactccctctccaaaaaaaaaaaagaatcccacagccccaccattgacgatgacctgtccatggtgttgaaggacccattggatctatgaactcttacacaggtaagggaggtagttgatgcctactgacttatgcaatggcgacttcaaagtatatttctaaaataaattgaaaccaagattccttgtttgataaccaagaaaagaagaccccaattgggtcgtgttctgcccacatcttcacataaagactgattatgcatttatctcatcactcagcattagggtagtaagtgccatgtgttagcctcctcctgttgggatctgagggccacaaattatcttttcagtgacagctgttttctgattgattgacatcaccttacttcatattttctatgaaggatccatcttttacgtcaatgtggaggtgaaagtttcctgagcgacggtttgatagcccatctccctatgtctctgtgattgtgtgtccttgactgtgttaactgtgtgtccctctgtgagtgtgcgttaccttgtttgtggttgtatttctctatgattctgtgtggttgagaatgtcttgtcttgaatggatgattggatataactatgtgtatgtgtgtgtgtgtgtgtgtgtgtgtgtgtctgtatttgtatttgagttcaaataagcctgcagcacattgtgtgtttgtgtctttctgtgtgaatgtgtctatgtttgatcaggaaatgctggtgattcttcatcttgggtggttgtgttttatcgtctgtcattgtgtgtgactctaagaactgtccacatgtgattgtacttgcatgagggatgaagctccctgtgtgtgagttagtcacggagtttgtgcactggttaggaaagtttgcatcttgagcgtgtgtgaaagtgtatatactaatttgttagggctgccaaaacaaaacgccacatcccgggcagcttgaacaacagacatgtatctacttacctttctggaggctgaattttgagattaagatgtcagcagggctggtttctcttgaggctgcctctgtagattgtgaccaatgctttcttgccatctctaacagtctttcctgtgtgtgtccatctctgatgtctctttgtgtccatattgctgcttctataagaagaaattggattagagcccaccctaaggacctcatttaacttaatcatctctttaaaaaccatatcaccaaatacagccacaatatgaagtactgtgtttgggaagaggaggcagtattcagatcataacagtgtgtttgcgtgtggatgtgtgcatgcttaagaagtggtttgaagaccatttattctgcatggccttgcgtgaaaacatgtgattcatactattacaatctcctgcatataagctaggctagcttagtgtgtgtgtgtgtgtgtgtgtgtgtgtgtgtgtgtctgtgactttattggagttttggagaatacttcagggacatacaaattgggttctatttccactctccctgccttatacctacttcactaggaccctgcacacttcaaaagccccatccagaggttgaggaacagtttcagatctggactctcttctctgggaagtgcccagaatacctctccttagatgctcagagacaagatgggagcaagtgatggaggcatgggtccagggccagacagcctagagacctcccctctctgagcccagcgtcctccactgtaaaatgcagacgctcctaggaccttactcacagccagggctactggggatgatgggatgcctgtgcatattgtagactgcactgaggctctgatccaaggagatgacctggatgtgaactccagcctgtattctctccataaactgtgtccaagccggggcttcaggcttcctaccatagcgtagcattgatctctccaaagccaggaagcctaccatgcccatgtgtgcagttattgtcattttggggaaaaaccttattaaacagaaaagcagacttataaaaacatacccttagccgggcatggtggtatatgcctgtaatcccagctattctggaggctgaggcaggagaattgcttgaacccaggaggcggaggttgtggtgagccaagattgtgccattgcactccagcctgggcaacaagagcgaaactccatctcaaacaaacaaacaaacacaaacaaaaaaatacccattttggcagggcacggtagctcacgcctgtaatcccagcactttgggaggccgaggtgggtggatcacctgaggctgggagttggagaccagcctggccaacatggtgaaaccccctctctactaaaaatacaaagattaacaggcgtggtggcacacgcctgtaatcccaactacttgggagactgaggcaggagaatcgcttgaacccaggaggtggaggttgcagtgagctgagatcgtgaaactgcactccagcctgggtgacagagtgagactctgtctcaaaacaaaaaacagaaaacaaaaaacaaaacaaaaaaatactgtcttaataatatctttttgtttcctcctttcttcccatttgaaggaatgtctgggaaattttcaaatgcctttgcttacgctagatggcaatctggcatcatggtaaaattggcttttatttaacttttttatttttacttttcaatttttaattgtagcaaaatatatattacacaaataagccatcttaagcattttgttactaatatgttaataatatgttacccatagaataagcttattattttaatttttttttatattcttaaaccgtggtaaaatagtacaattgaatattcacctttttacctagagtcaggactcacctaagggcagagatgtgttctgaggattgtgtttttaggtgatattgtcattgtgtgaacatcctagagtgtacttacacaaaccttggtggtagagcctgctgctcctaagctacaagcctgttcaagatgctaccgtgctgaattccatgggggactttaacacaatggtaagcatttgtgtaactgaacatgtctaaacacagaaaagatacagtaaaaatttgctgctaaaatcttatgagaccactgttctgtatataatataatgtcattgaccgaaatgttggtatgtggctcataactgtatgtgtgtgtgtgtatatatatatatatatatatatatatatatatatatatatatatatatatactttttggagacagagtctcgctctatcccccaggctggagtgcagtggtgcgatcttggctcactgcagcctctgcctcctgggttcaagtgattctcatgcctcagcctcccgagtagctgggattacaggcgcgccaccacgcctggctaatttttgtatttttcgtagagatggggtttcgccatgttggccaggctggtctcgaactcctgacctcaggtgatccacctgccttggccacccaaagtgctggcattacagtagtgaggcaccgcactcagcatatatatatatgtgtatatatatgtgtatatatgtgtatatatgtgtgtatatatgtatatatgtgtatatatgtatatatgtgtatatatgtatatatgtatatatgtgtatacatatatgtatatatgtatacatatatgtatatacgtatacatatatgtatatatgtatatacgtatatatgtgtatatatgtatatacgtatatatgtgtatatatgtatatacgtatatatgtgtatatatgtatatacgtatatatgtgtatatatgtatatacgtatatatgtgtatatatgtatatacgtatatatgtgtatatatgtatatacatatatatgtgtgtatatatatatagtttgtttttatttgtttgtttttgagacagagtcttgctcttgtcacccaggctggagtgcagtggtgtgatcttggctcactgcaacctccgcctcccgggttcaagcgattctcctgcctcagcctcccgagtagctggaactacagcataactatatttttaagtgtaaagttcagcaattaagtacatttacttgttgtatcctaatctgtcccatacatcttcagaactcctttagtctgggaaaaccacgactctgtacccattaaggaataactctccacttcccttttccagcccctggcagtcaccattttattttctatttctatgaatttgactcttctaagtacctcgtatacctagaatcatatattatttgtccttttggtgtggatttatttcaattgacagcattcttcaggcttcatccagattgtagcacctgtcaggatttcctttacttttgttcaatttttattttggaatcatgggatacatgtgcaggtttgttgcaaaggcacgctgcctgatgctgaggtttagcatgtgactgaagccatcactcaggtagtaggcatggtgcctgataggtagtttttcaacctgtgtccttcttcctctctcccttggctgtccacagtacctgttgtttccatctttatgtccacgtacgcccaatatttagctcctgcttataagtgagaacatgtggtatttagttttctgttttgaggtaatttgcttaagaaaatggtctccagctgcatccatgttgctgcaaaagacatggtttcattccttttttttttttttgaggtggagtttcgctcttgttgcccaggctgcagtgcaatggcatgatcttggctcactgcaacctccacctcccgggttcaagtgattctcctgcctcagcctcccaagtagctgcgattacaggcgcatgccaccatgccaggctaattttgtatttttagtaagagatggggcttcttcatgttgatcaggctggtcttgaacccctgaccccatgtgatctgcccaccttggcctcccaaagtgctgggattacaggcatgagccaccgtgcctggctggttttattccttttatggctgcatagtattccacagtgtatgtgtgcaacactttctttatccaatccactgttgatgggtacataggttcattccatgtctttgttgttgtgaatagaatggtaatgagcatacaggttcatgtgactgtttagcagaatgattcattttcctttgggcatatacccagcaataggattgctgggttgaatagcagctcaacgcttagttctttgagaaatctccaaactgctctccacagtggctggactaatttacactaatttgcatttccaccagagtatgtaagcgtccccctttctctacagccttgctgatatgttattttttttgactttttaaccaaaacttggttaacgagcaacttgggttgcttccacttttttttttttttttttttttttttttgagatggagtctcgctctgtcgcccaggctggagtgctgtggtgccatctcggctcactgcaagcctgcctcccaggttcatgccattctcctgcctcagcctcccaagtagctgggactacaggcacccgccaccatgcccggctaatttttttgtatttttagtagagacggggtttcaccgtgttagccaggatggtctcgaactcctgacctcatgatccgcccgccttggcctcccaaagtgctgggatgcttccacttttgactctcatgactaatgctgctatgcccatgggtgtacaaatatctctttaattttctgcttccattacttctgggtaatatccagaggtagaaagataattttatttttattcttttcagaactgttgtaattttttttttcacagaatctgcatctcatcacaattgcaccgagagtgcagatgtgccaacttctccaagccctgtgggtggttgttatcttctgtcttatggatagtggccatgaacatgggaatgaagtggttcattatctctttgccaaagaaaaaaatatttctttcacttttcaatagtaattacttaataatgggatgtatttgttggttcctgcacaacttctcaaatgtaggaatcagactagactgtgtcaccctgatgtcctcatcctcattgattttcatgtggttattgtttttttcatagataccactgataacccagcatcacaaagatatgatgactgcaaaaaataaaaataaaaaaatgagagaaccaatgtagaaaacatgaatccctgcagcttatacttaatgacttaatgtggtgacagaagatatgaaatatcaccatacttcccttaaaactaaactgtagggttacctctttagacagatgtggctataaggttataatagcgggaatgcaatgcatgttcatcagatcagggagagaatggagaaggtgacctggttgccgagcaaccctcagtatccttggagatgagtcaccatggaaacagcaataactcttcatttccttttttccagccccgacaaccaccattttattttccattgctatgaatttgactcttctaagtacctcatgtaccaataatcaggtacctaagtacctcatattcctggacagttgtgggggacggcggggaagaagttcctcctcagccaagggagctgtggagactaaggaaagtgattggatgttccacagtttctttcatggacaacctcttgtttactcaaatgatctccacttataatctcctgtatatcatttgtatatctcttagatcactttttcccaaaaatgtagttccaggactccggggggattcaagatttggaatgcacaattccaaataattgtcctaaacacatgaaaagtttatttgcattttccctcattttctctggatgacataatattgcacatgtttgatttaagtggacaatttgatcatagccatctagtggtaaggaaaacattaaagatatttgcagaaatgaaaagcaacaccacctttattgcgaagtttgtttggaaaatgcaagcgtacatttttctgttgtgctttgtttcactgcgcttcacagatactgagtatttttgaatggaaggtttgtgcaagtctgcattggcaagtctgagagtgccattttcctaaagtatgtgctagagagaagtcagtgcctggcttcaaagcttcaaaggacaggccgactctcttcttaggaacgaatgcagctggtaatgttcagttagatccaatgctttttttactattccaaaagtcctaggactctttatttatttatttatttattttgtgaggcagagtcttgctctgttgcccaggctggagtgcagtggcacagtcttgcctcactgcaacctccacctcccgacttcaagtgattttcctgcctcagcctcctgagtagctgggattacaggttgcaccaccatgcccggataagttttgtatttttagtagagacagggttttgccttgttggccgggctggtctcaaactcctgaccgcaagtgattttgctggttttggcctcccaaagtgctgggatcacaggcgtgagccaccatgcgtgggctaaaaattctaggactcttcaggattgtgcaaaacctactctacctgtgctctataaatggaacaaagtcaaaatatcaacatcaataggagtttgaaagaagttgattccaactcctatttgatgactttgtggggttcaagagttcaacggaggaagtcactgcagatgtggtagaaagagcaagaaaactggaattagaattagagcctaaagatctgactggattctgtaatctcataagaaagttttagcagatgagttgaggagttgcttttttttttttttgagagacagagtctcgctctcactctgtcgcccaggctggagtgcagtggcacaatcttgcctcactgcaacctccacctcctgggttcaagcgattctcctgcctcagccttccgagtagctgggactacaggcacgtgtcactatgcctggctatttttttttttttttgtatttttagtagaaacagggtttcactgtgttagccaggatggtctgaatctcctgaccttgtgatccacccgcctcagcctcccaaagtgctgggattacaggaattgcttcttttgaacaagcaaagtaagtggtttcttgagatggaacctactccttgagaagatgctgtgaacattgtagaaatgacaacaaataatttagaatttagattatattctccagttcacaatatccccaccttaatgtaaaatatattattgctaaaaaattataagaatcacctgacccttcaatgagtcataaccatttttctggtggagggtcttgcctcaatgttgatggctgcagactgatcacggtggtggttgttcaaggttgaggtggccgtggcaatttcttaaaatatttcttaaaatatttctctgtagcatgtgatgctgtttggtagcattttacacacagaacttcttttaaaattgaaatccatcctgtcaaaacatgctgctgctttatcaattaattttacattttattttttatcttccagtttacaaaccccagccccaacattcattatgtgggtgatcatgaagaagctacctgtccgttctgatcctcacaatacattgtaaacaatcaataaataatagcttgttttttttgcatttctagtgtaaatatggaatacaattctattgtgatgatacagcaaaaaaagtgttagaaagaagagtcactttctttgtgagtttttccccaaccacagtatccacaattgttaaagcaatttcctcctcaatattgtcataaaagatgtgctagtttttttcttccccatctctcatggtgaaataacagatagtttacctgttttcccctccaggccatgaactctgagaatttgggctgcatttttaaagctgtatcactggcagtttgtactcaaaaagcaggtaaatatttccctggttactccttgattttagaaggaaacacaatacacctaaacctataggatagagcaaaagcagtactaagagagaggcttatagcaaaaaactcatacttagagaagtagagagactttcaaataaatacattaatcatccacctagaaaacctagaaatgcaagaacaaatcaaacctaaaattagtaaagaaaagaaataaggagcagggcagaaataaataaaattgaagccaaaaacaattaccaaagatcaatcagacaaaaagttcatttttggaaaagataaacaaaactgagaaatctttagcagactatgagaaaaagaagggaaaagatccaaataaataaatccgagacaaaaaggagacattaaactgctaccaaagaaatatgaaggattattagtggctattttgaacaactattttctaataaattggaaaatcttgattcttcctatccatgagcatggaatgttcttccatttgtttgtgtcctcttttatttcgttgagcagtggtttgtagttctccttgaagaggtccttcacatcccttgtaagttggattcctaggtatttcattctctttgaagcagttgtgaatgggagttcactcatgatttggttctctgtttgtctgttgttggtgtataagaatgcttgtgatttttgcacattgattttgtatcctgagactttgctgaagttgcttatcagcttaaggagattttgggctgagacggtggggttttctagatatacagtcatgtcatctgcaaacagggacaatttgacttcctcttttcctaattgaataccctttatttctttctcttgcctgattgccctggccagaacttccaacactatgttgaataggagtggtgagagagggcatccctgtcttgtgccagttttcaaagggaatgcttccagtttttgcccattcagtatgatattggctgtgggtttgtcataaataatcttgaaaaaaatgaataaattattgggcacattaaacctaccgagattgaaacatgaagaaataaaccactttaatagaccaataacaaatgactatatagaaacagttaaaaaaaagtgttccatgaaataagagcccaggacatgatggttttactgctaaattctagcaaacatttggatgagaactaacgccaaatctactcaaactcttccaaaatattgaagggaagagaatactttcaaactcattctatgagcacagaattatcctgatactaatgtcagaaaaagatacaacaaaaaaggaaaactatgagccaatattcctgatgaacatagaagcaaaaatcctcaagaaaatggtaggaaactgaattcaacacgtaaaaagatcattcatcatgatcaagtagaattcatcccagggatgccaaagaggtttaacatatgcaaataagtgaacacattagcaaaatcacagacaaaaaccatatcattgttttaatagatgctgaaaaagcatttaatacaactcaatatcccttcatgaaaaaaactgttaaacagggtatgaaaggaatgtgcccccagacagtaaaagccatgtgtgacaaacccactgctaacatcacaataaatggagaaaaataagaaggctttcctttaagatctagtataaaggaatgaggcccaatttcaccacttttattcagcacagttctagaaatcctagccaaagcagttagacaagagaaaaaagtaaagggcatccaaactggaaagaaagaagccaaattgtccttgtttgcagataacataatcttatatttagaaaacctaaatatcccaccaaagaagactgttaaaactgacgaatgaattcaagaaagttgtatgatacaaaatcaaaatgtaatagatagtagatttttatatgccatcagtaaacaatctgaaaaggaaatcaagaaagcaatcccatttgcaatagctacaaaaaattacctagaaataaatttaaataaagaagcgaaagatctctacaatgaaaactataaaacggtgatgaaaaatattaaagaagtcacagaaaaatggaaagatatcccattgtgatgggttgaaagaattaatattgttaaaattttcatactactgcagcaatctacagattcaatgcaatccctatcaaaacaccagtgacattttccacaaaaatagaaaaaaaatcctaaaatttgtatggaaccataaaagaccctgaatactgagcaaagagaacaaagctggagacattacactaccagacttcaaaatatgctgcaaagctatagtaacaaaaacaacatggtactggcattaaaaaacaggtacataggctgggcgcggtcattcacacctgtaatcccagcactttgggaggccaaggctggtgaatcacctgaggtcaggagttcgagaccagcctggccaacatggtgaaaccccatctctactaaaaatatgaaaaaacttagctgggtgtggtggcagatgtctgtaatcccagctactcaggaggctgagggaggagaatcacttgaaccctggaggcggaggttgcagtgagctgagatcacaccgttgcactccagtctgggtgacaagagtgaaactccatctcaaaaaaaaaaaaaaaaaaatcagaaaaaacaaaataaaacaaaaaacatgtaaatatatcaattaaacagagaataaagaaataaatccatgcattttcaaccaacccattttcaataaaggcaccaagaacatacaccagaaaaaggtggtctgttacataaataatgctgggaaaactggatattcttatgcagaaagaaactagacccctatctctgaccacataaaaaattgatcaaaatagattaaagagatagatgtgaaactatgcaactgctagaagaaagcatttgggaagtgcttcaggacattggtctgggcaaatacattttgagttgacctccaaaggacaggcaactaaagcaaaaatgggactacatcaagctaaaaagcttatacacagtagaggaaaaaatagcaaaattaagagaaatctacaaaagagatacctgcactgtcatgtgtattgcagcacaattgagaaaaagccaagttatggaatcaacctatgtgtccaccaatgaatgagtgtgaaaggaaatgtggtaaatatatatatatgtatatgtatgtatacatatatatatataatggaatattactcagccataaaaaagaatgaaatcctgttctatgtggcaaaataaatagaactggaggacgttatgttaagtgaaataaaccaggcacagaaagacaaatatgacatattctgactcatatgtgggggaaataaaattgatctcatggaggtagtgaatagaatgctggttaccagaggctgggaaggatagggggagggagggatgaagagagttcggataatgggctcaaaaatacaatgagataaaatgaataagatctagtgttcaataacacagtagggtaacaaaagttatcaagattatatagggtatttcaaacagctagaagagaaggtttggaatattcccacacaaataaatgaaaaatgtttgaggtgatgaacatcctagttaccctgacttgctcattattcattgtgtgcatgtattaatttatcacatgtatcccataaatattgcaaaaattatgtatcaattaaaaaatcaccaccgtggactaaggcctgtccatggtgctgaagtgcatgtcaggtctgtgaagagacctgatgctacctaatgtaggcaaggctgacctcaaagtatattaatagaataaatggcagccaagctttgtgtattataagtgaaaaaggagaccccaactgggtcatgccctgcccactgccccacataaggactggttatatatttattttatcactcaatcatctcttagcatatgacacatgttagggacaatgctggtaacagagaaaacagaactagtgcatatgtggtcatagcgttccacattcctcacagtctgtgggttttctgaaggtgcaaagctgacaattgctgtttatattttgtttccccaatggtttagagcagtgcctgaacataaaatgtattgattgctaaataaatgggatttctggagatcctggcaaaatcagagcatattgaaggatgaatcagaaaaaaaaagaagtaaggggaaaatatgggagaaaggcagaaaagattggaagaaggagggggagaacatcaaagagaggcagagtccattcacacagaaggagattctaggagagaaacagagaaaggcagacagtctggctccagccaccttggcgtttcaccttccctgtattgaataaagttcaggacctttgcaggtgcagctccctccacaccctgagtcttcatgtggctccatcttgtctccaaccagtgctctgaacagagttcaccacccaagggagccctctctgactgctgtcccccgagcacctgctttgttcccttcttgaggttggtgctttctttattcactttctgtttactgctttctctccattggaatataaattccttagagtatgataaaaaagatggacctaaagttgtgagtttttattggtcctaggtttcttactggaggttagataagtccaaaggacaacaataacaaccacttctcactttcctgtgtatcattattaaaagtattatcttcctgcttctactcttacttgggaaataataataaaatgataatggggtaagagagttggaggatacaggatagaaatgcagttatgcagtaggaattcatttgaagggagagaatgaaggaggtaattttccaggcactgctcagcatccttggagaggcatcatcatgaaattacagagagaacaggcagtggagaaggagctgtttctccccaaccacatgcatctgcaagagtgaggagtggaacaggcagagccagagaacagcagagttgaggttttccaaggaggtacatgcagcagaatatgcaagagattcgagtgtgtccagaggaatttatcctaacaattgaccatggaaggtgaccagatgggtgtgaaggtcagtgaaaaatggttaaataaagacagtgttggtctccaaagaataacgggatgtagtccttaggtgagaaagaggagtcacttggaaagtaggacgtgatgttggagatgggatgctagaactgaaggcttggagtgattttaggctaatgggagtggatggctatgggcatttggacaatagccatggaggagagagggtccctatatagctagtcaggagtgtcaggagaatcatctccattagggattatctaccctgacattattgaaaatatgatttagatagttatttgtgttgcagggaaggctgcattctgcattgtacattgttgtgtgtggaatatggtctagatagttatttgtgttgcagggagggctgctttgtgcattgtacattgttgtgtgtgaaatatggtctagatagttattggtgttgcagggagggctgctttgtgcattgtgcactgttgtgtgtgaaatatggtctagatagttatttgtgttgcggggagggctgctttgtgcattgtgcattgttgtgtgtgaaatatggtctagatagttatttgtgttttggggggagggctgctttgtgcattgtacattgttgtgtgtggagcagcactctcgcttctacccagaggatgtcagtaattctcctctacttgtgtccagacctcgccaactgtctcttgggggcaaagtcactcctagaataaaaatactaatattatatattagtatttaacattttcagctgttataatcttttaaaaatgtcaacctttgtttcagatacagagggtgcaagtgcaggtttgtgacaggagaatactgcacccagatattgggcatagtacccaataggtagtttttcaccccacaccaccatcccctgtctacgagtccccagtgtctattattcccaagtttatgttcatgtgtgctcagtgtttaactcttgcttataagtgagaacatgcggtatttgattttctattccggcattagtttgcttaggattatggcttctggctccacccatgttgctgcaaaggacatgattttattcttttttatggctgcataatattctatgatgtctatgtaccacattttctttctttctttccttctttcttttctttctttctttctttctttctttctttctttctttctttctttctttctttctttctttctttcctttctttctttcttttctttctttcttttctttctttctctttctttctttctttatctctctctctttctttctttctttctttctctctttctctctctctctctttctctctttcgatggagttttgctcttgttgcccaggctggagtgcaatggcgcaatctcggctcactgcaacctctgcctcccaggttcaagcaattttgcctcagcctcctgagtagctgggattacaggcacacgccaccacacctggctaatttttgtatttttagtagagatggggtttctccttgttggtcaggctggtcttgaactcccgacctcaggtgatccacccgccttggcctcccaaagtgctgggattacaggcatgagccaccacacctggctcacattttctttattgaatccaccattgatgggcacctaagctgattctatgtctttgctattgtgaataacatgacaatgaacatatgagttcatgtgtctttttggtatagtaacccattttcttttgggtatgtacccaataataggattgctgggttgaatggtagctccattttaagttcttttagaaatctcaatactgctttctacagtcactgaactaatttgtattcctctcaacagtgtataagtaagtgttcccttttctccgcagcctcaccagcatctattgttttttgacttttaatagtagacattctgactggtgtgagatggtatctcattgtggttttgatttgaatttctctgatgattaatgataaagagtgttttctcatgtttgttgaacgcttgtgtgtcttcttttaaggagtgtctgttcgtgtcctttgtccattttttcattgggttatttggtttttgcttgttaatttaagtttcttatagattctggatattagacctttgtcagatgcatagtttgcaaatattttctcccattctgtaggttgtttgctctattcagtttccctggctgcacagaagctctttagtctagtagggcccacttgtcacatttcctttttgtttcaagtagttaatatttattttctttcttttcagatagtgtcttgcaatgtcgcccaggctggagtgcagtggtgcccctcctgttgtgaatgtgagtaacaaaccatcttttcaatggcagtctcctgctgacctgtctacctgttgtgtgtgaagctgtgtgattcaaatcagcttgaattacatttttgtgagttctggaaaacccagacaccatctgttcttgtgtgcgagtgtgtgtgtgtgtgtccgtggttgaggaagtttggaagacaccccatggtcaaacaaggtggagtctagggccactttccctgccacatggctatcttattagaaccctgcctaccacaaatgcccaatcccaagggtaaggcaagacagcagccctggaatccctcctttggacggttccaggacccttctccttggatgctcagagatgggatgaagagcaggtaagggaggcgtgggctcagggccagaaagcctggtaacctccccttcctgagtcctgtgtcctcctctgtaaaatgcagacactcctgggatgtcactcacagccagggctgctgggcttattgtactctgcagttaggctcctgtctgaggagatgaaaggatgtgaaatccagcctgtaccatcttcacaagctgtatccatgcctgggctgcaggatttcaaccacagcatagcattgacctgtccaaaagccccaaagcctatcatggccatgtatgcagttattgctacttgggaaaaattcttattaaacagaaaacaagcataggtgaagatacccattttgaaacaatcttattttttatcttttaatttgaggtgatgctcattgtcttataaggggcctttgccatcactagatggcattcttgcatcatggaaaactacacaggagctcctttaaaaatcaattttgaactgtggcaaaatacacatcacataaaatttaccatgttaaaattgtacaaagtacaattttaaaacgaatattgaccatgaccataggtttataattttaaaaattatttatgttttcagttatttttcaactttttattttttaacttgcattttaagtccaagggtacaagtgcaggtttggtatataggtaaactggtgtcatgggggtttgttgtacagatgatttcattacccaggtattaagtctagtacacgttcgttggttttcacaatcctctccctcctcccacccttcaccctccaatgggccccagtgtgtgttgttcccctctgtgttttcatgtgttctcatcatttagctcccacttgtgggaaacaacaggttgtgtttggtttctgttcctgtgttagtttgccaaggataatggcctccagcttcatccatgtccctgcaaaggacatgatctccttctttttttatggctgcatagtattccgtggtgtacatgtaccacattttctttatccagtctatcttttatgggcatttaggttgatttgccttttcgaaatatgctaacaggcatataaggtaactgatcactataattatttttacttgtatagtccactggtgtgaagggcattcacattgttctgccacagtctccacaaactatgtcccatattttgttaatcttgcaatactgaaactctgtgtccattaaaccataactccccatttcccctcccctatcccctggcaacctccattccactttctgttcctgtgaatttgactattctacgtcgaatctattatacttctaatatacaagtgaaatcatacagtttctgtccttttgtgactggcttgtttcacttagtgtaatgtctcaaggttagctcatgttgtagcatgtgtcagaatttcctttctttttaaggctaatagttcgttgtatggacagaccacacttaatgtccctctttattctttgatagataccaggctttgctgccaccttgactattatgagtcatgttgctatgaacttgggcatgcaaatatctcttcaagaccctgcttttttttttttttttttttttttttttttttttttaagacggagtcttgctctgtcacacaggctggagtgcagtggcataatctcggctcactgcaacctccgcctcccgggttcaagcaattctcctgcctcaccctccccagtagctgggactataggcacatgccaccacgtctggctaattttttgtatttcagtagagacagggtttcactatgttgcccaggctggtcaccaactcctgagctcaggcagtccgcccacctcggcctcccaacgtgctgggattacaggcatgagccaccgcgcccggctgaagaccctgcttttaatgctttgggctcatatacccagaaacagagttgctagatcatatgggaattttatttttacttttttcagaaacttttatgtagttttccgtagtggctgccttatatcacaccctaacaacagcacaaaagttttccaatttctccaaaacctgccaatacttcttatgctctgtcttgtggatagtagccatattattgagagtaacgtgatttcttttctctttggaaaaaacatactatttatttcacttttcaatatagcttaataataggagctatgtgcctgttgggcactgcacgacttctcacactttggaatcagcctggaaaatgtcatcctcagttccttgtctttgctgacttttaggtggtacttgctgttcttcacagcgaccactgacaacccagcatcacaaatatgtgatgtgagcaaaaggaaatgtagagggatctaatgtggagactgtgagcctctggagctggtagtttgtgtgatgcatgatgatatagaatattgctgtggttcctttccatcgaaaatatagctattcctctgccgacatttgcagctgtgagaacagaacggcaggaatgcagtaggtgttcattggaggggtcgagtggaggagctcatctggttgccaggcattgctcagtgtccttggagatgagttgccatggaaacagtgaggggcagagaggaggggccgttcctttctagccaagtgagctgcagagacgaaggaaagtgaggcggacgtcccacaatgtcttaaaaatcctctcccattgacacattcagatggcctccatttataatttcatgtatatctgttctgcctgtggtttccaaaaagcagttcaaggcctgctaggggaatcaagaccctttcagtgttccaaactatgtttctaagatcagggaaattgtatttgcttttttccttcccatttcctctgcatgatgtaatattgcaggtgtttgaattaagtagtctatccggccagcagttttttcatggggaaaaaaaaccagaacagaattaaaaaatcagagcatgtggcttagagtaagtgccattcctttaaactttcacttcagttacacagacatttactcacagacacacacacttgcatgtgcactggatcaacatggagaaggtgtgggttcctggggcctgcagtgaccaatttttttttttttttttgagacagagttttgctcttgttgcccaggctggagagcaatggcgtgatcttggctcaccacaacctctgcctcccgggttcaagcaaatctcctgcctcagtctcccgagtagctgggattacaggcatcccagccactatgcctggctaattttgtatttttagtagagacggggtttctccatgttagtcaggctggtctcaaactcctgatcttaggcgatctatctgccttggcctcccaaagtgctgggattacaggcgtgagccaccacgcccggccttgcagtgaccaaagtttcagtggtgctggtgtgagccaagcttccaattttcacagacacggactcaggggtgatgctgcagctgcagtagttgatagctcagggcccataaccaaggggatcttttcctccctgctttttattatggaaattctcaaaaatgcacaaaagtagacagaataatgtatacccactgtgaaagcattcagctatcttctcctttttttccttctagtttaagtaaagtaaatcccagaaataatataattttacctacaaatacctcagtacatatgtctatcagatcataatttaacataatatattaaaggaatttgcaaaaatgtaaaataatgccacctgtattactattttttttgtttggaatatgcagtgtaattattgttcaaaaaagtgtgttatgataatacacaatagatttattgcaaaatttattattttattttattcatctattttgagatggaggcttgctctgtcacccaggctggagtgcattggcgtgatcttacctcactgcaacctccacctcccaggttcaaacgattctcctgcctcagcctcctgagtagctgggattacaggcacccgccaccatgcccagctaatttttgtatttttagtaaagatggggtttcactatgttggtcaggctggtctcgaactcctgacctcaagtgatctgcccgcttcagcctcccaaagtgctgggattacaggcgtgagccaccgtgccacaatttttataattttaaacttaatattttcaaatgtcaatgtataatatggcaaatatacatagatacaaattgtaaccaacaaaattaatcataattccttatttatcatttaatatctagtcctacatttctggggaactttataaccttttctaaaattttaagcaatgcaagtaaattacatcaatgcaaaaatatttaactttgttcaagttgaaatcacgggcacctagtggggcaacctgaggcagaggcagcagacgctgggatccacaactgagttaagaccacaaggcaacttcctcaggctgcaaatcccaacccgagccgacatgaaaatgctcacaactgagaatgatggtttccagcttcatccgtgtccctacaaaggacatacacatgtatacataggtaacaaacctgcacggtgtgcacatgtaccctagaacttaaagtataataaaaaaatacatatataaaataaaaataaaaataagggccgggcgcagtggctcactcctgtaatcccagcactttgggaggccgaggcgggcggatcacgaggtcaggagatcgagaccatcctggctaacacggtgaaaccccgtctctactaaaaatacaaaaaaaaaaaaaaattaggtgggcacagtggtgggcgcctgtagtcccagctacttgggaggctgaggcaggagaatggcgtgaagctgggaggtggggcttgcagtgagccgagatcgcgccactgcattccagcctgggcggccgagcgagactctgtctcaaaataaataaataaataaataaaacttttaaaaaaagcttgaaacctaaaaaaaaaattaaaaaaaaaaatgaagatatgctaacaccacccccccccccccccgccaaaaaatgctcacaactccatttaagcgtacatctgagtttcttacggaagggaattacatctcgaggggatagtggcacaatgcgggggactgggtctatttcgtaggtaggagccttattctccaaactccaaatcaggacttgcaggctgaaaactaccgtttactctgcagacatcagggcaggagagcagcccccagctgatcacctctacaccccaggcccccacctctgtcggccagtggacttctctgtcaatgtgctcattgcttcaggtgaaaccagcactgattcatgtccccgtcagctcctcaaggccctcagctcttcctcaatggaaaccaaaaactatgtgagtctggtctcaatcacttgagaagtttattggccgggcctggtggctcacgcctgtaatcccagcactttgggaggccgaggcgggtggatcacctgaggtcaggagttcaaggccagcctggccaggatacacactgccacattactacaatgctattgttctggctgagaaaacaatactccagaagcaacctcagacacaaacgtttttccttgaccatctcctatcctcctgtcattcagccccattcttcccttgggctagccatagaaactagaatccctcctttaaggtgggcgatagaaaccagaatgccttttccccaaagccagttataaaatccaaaaatattactttaattttccatccatccttctgttgaaaaactggccataaagaaacctggctgggcgccggtggctcatgcctgtaatctcaggattttgggaggccgaggcaggcagatcacttgaggccagcagtttgagaccaacctggtcaacatggtgaaaccccgtctctactaaaaatacaaaaattagccaggtgtggtggctcatgcctgtaaccccaactactcaggaggctgacacacgagaatcccttgagcctgggagacagaggttacagcaaatgctgagattgcgccactgtactccagcccaggagacagagcaagactcagtctcaaaaaaaataaaaataaaaaaataaaaataaaaaaaatgtctgatctaccttgtccgactgtaggttacaagaccctcattccagagagtgtccctgcacaaagaggccaaggagaatctaagcagacaaacctcatgggtttccccactcagtccactagcattaaaccagacccttagcatccagtatttctacgtggctctccacactttgtagaacctaagcataaaaatgggcaatttctcccgtatctttgggtgttcattcttaaagttcccatgcgtacatttgtttttttttttttttttttgaggcagggtctcgctctgttgcccaggctggagtgcagtggtgtgatctcagctcactgcaaactccacttcccgggttcaagagattctcctgcctcagcctcccaagtagctgggattacaggtgcacaccaccacacccatctaagttttgtatttttagtagagatggggttttagcatgttggccaggctggtctcaaactcctgacctcaggtgatctgcccaccttggcctcccaaagtgctgggattacaaggttgagccactgcgcccggcctccatatgtacgtgttaagtaagcttgttataccttttctcctattaaccaatctgctttatgtcactgattttcagtgaaccatcaggaggccaagggccttggcccctacaccatcccattgttcctatggctttgaattctcatgggaaatgtaatccaggcctgtctgattccttgatttgccaggctgcctaccctgattaacccagcgaaggaatttcaatggcaagtgtgcttggactccagtgacccgggcttgtcgagatcgcctctagcataggatcagtttagaattctcagaagagaaggtaacatgtagattcccaagattacaaatcctaactttcattatgtgggtgatcatgggctagacacctcccttttctgagcctcattttcttttttttcttttttctttgtttgttgttgatgttgttttgaggcagggtttcactctgtcacccaggctagactgtagtggtgtgatcatggctcactgcagtcttgacctcctgggctcaggtggtcctcccacctcagcctcctgagtagctgggactacaggtgagtgccaccatgccgagctaatttttgtattttcttgtagatagggggttttgctatgttgctcaggctggtcttgaactcctgggcccaagtgatctacccacctcagccttgcaaagggctgggattacaagtgtgagccaatgcgcccagaccctctgagcctcatttgtttttacctgtcaatgagtgatagacatgggtaaaattttgacacaatgcccaatacattgtaagcaattaataaatattagttgggtgtttttgtatttctaacataatataaaatacaattttaatttagtaatatgagccaatgagtgttagaaatggtaattaccttctttgtgatgttttctccatccgctgctttcacaattgttacaagctccacctcaacactgtcataataatagtgctagtaggccgggtgtggttggtcacgcctgtaatcccagcactttgggaggccaaggcgggtggatcacaaggtcaggagttcgagaccagcctggccaatatggtgaaaccccgtctgttctaaaaaaatatagaaattagccgggcgtggtggcaggcgtctgtagtcccagctactaaggaggctgaggcaggagaatcgcttgaacccgggaggtggaggttgcagtgagccgagattgtgccaccgcactccagcctgggtaacagaacgagactctgtctcataataataataataataataataatagtgctagtactcttgtccacatctctcatggtgatgtaactgactgcctgtttcccacaccactccatcagaatttgggctgtgtccctaaaacctgtattaccagcattttgcacttgtaaaccaggtaaatagttccctggttaagcacctgatttaaaaatcagcacagcccagccattgaccacgacctgtccatggttctgaaaggcacgtcgagtctatggactcaccaactggcaacggagattgttgatgctaacttgtgcaaaggtgacctcaaagtatatttctgtagggtccagccccacagggtcggtgggtctctccccatgtgtggagacgagagagtgtagaaataaagacacaagacaaagagataaaagaaaaggcagctgggccagggggaccactaccaccaagtcgtggagactggtagaggccctgaatgccaggctgcactgatagttattggatacaagacaaaggggcaggataaggagagtgagccatctccaatgataggtaaggccacgtgggtcacgtgtccactggacagggggcccttccctgcctggcagccaaggcagagaaagagaggagacaaagagaaagacagcttgcgccattatttctgcatatcagagacttttagtactttcactaatttactactgctatctagaaggcacagccaggtgtacaggatggaacatgaaggcggactaggagcgtgaccactgaagcacagcatcacagggagacggtcaggcctccggataactgtgggcgagcctgactgatgtcaggccctccacaagaggtggaggagcagagtcttctctaaactcccccggggaaagggagactccctttcccggtctgctaagtagcgggtgttttcctttgacacttacgctaccgctagaccacggtccgcctggcaacgggcgggcgtcttcccagacactggcattaccactagaccaaggagccctctggtggccctgtctgggcataacagaaggctcgcactcttgtcttctggtcacttcccactatgtcccctcagctcctatctctgtatggcctggtttttcctaggttatgataatagagcgaggattattataatattggaataaagagtaattgctacaaactgatgattaatgacattcatatataatcatatctaagatctatatctggtataactattcttgttttatattttattatactggaacggctggtgtccttggtctcttgcctcggcacctgggtggcttgccacccacgtatttcaggaataaataaaagccaaattttgttgtgttgtaaccaagaagagaaagccccaatttggtcatgtcctgcccacagccccacataaagatgagttaggtgtgtgtttctcacatcaacagccccttagcatgtgccatgtgttatggatactgctgggatggaggaaagatggcagaaatagtgcatatataatcctgcattcaaaactcctcacagtctgtgtgatagaaagaatgaatggcagggcgctgtagctcatgcctgtaatcccagcactttgggaggctgaggtgggggatcacttgaggtcaggagttcgagaccaacctggccaacatggtgaaaccccgtctctactaaaaatacaaaaattagccgggcttggtggtgggtgcctgtagtcccagctattcaggaggctgaggcaggagaatcgcttgaatccgagaggtgcaggttgcagtgaaccgagatggcgccactgcaatccagcctgggtgacagagcaagactctgtctcaaaagaaagaaaagaagagaaaaggaaaagaagaggaagaaaacaaaagaaaagaaaggaaagaaaaggaaaggaaagaaaaagaaaggaaagaaaagaaaaggaaagaaaaggaaggaaagaaaaggaaaggaaagaaaataacccaaaataatgggcttctgaggttccaggttgttaatggggattgaataggtccaaaaaacccaccaaaacaactatatcttctttcctgttgaacatttaaaaatattcttttaacatttctacttttgtatgggaaatagaaatctgatgacaatggggagagagtgttggaggcttcaggatagaaagcctgcagtggactatgtattcattggagaagagaatggaggagctggcctggttgccaagcaacgctcggtgcccctgagattggagatgactcaccaggaaattagagtgagcgcaggcagtgagggagaggctgttgtgccccatcaagagcagcttcaggacaaagaaaagtcatgtgaatgtcctgcagtttctctaaaaaaatagcctgtttgttgtacattcagatgatctccatttataactttatgtccattacttttatatatcttagcccactagttccaaaaatgtagtttaaaaacttctggtggggcgggggcgggaatcaacttccttttaaagggtccagaattccaaactattgtgctaagaacgttaagattttattttcctatttccatctcattttcttcatgatgtagtattgtgagtatttgacttactgaatttgagaatctgtcttgtattaaagggttttattgcaaaaatatgaagcaatgctacctatattactgtgttttgtttggaaaatataatcgttgttcataaaaaacatgtttgttaacaaataataggtttgttacattttagagttttaagtttagaattttctgagctccaatttataatatggtaactgggtaaaaaatacaaattatgcaaataaaaattatctgaggatccccagttactttgaaaaatataaaagtggactgagatttaaaagtttcataattgctctcttaggttaagtacctaggtatcatctgattgggtggagtaaagcacacctttaatgtttttgacacgtgaattctcgttgctgaagtgatagacagctgttcctctagctccaaattctcacgggaaatgtaatctaggtctgtctgactttaattaatttgtcaagttataaaatcaacctaagtgaccatcaacagatgaaaaacgtggtatatatatatgtgtgtatatatatatatatatatatatatatatatatatatacatacaatggtttattattcagccatgaaaagagtgaaatcttgtcatttgcagcagtgtggatggaactggaggacattatgttaagtgaaatgagccaggcacaggaaggcaaatatcgcatcttctcactcatacatgggcgctgaaaaagtagatctaatggaggtagaaagtagagtgatggtttccagagactgagaagcagggaagattgggcaatgggtaaaaatggttaaacagaaggaataatgtctagtgtttcatagcacagtagggtggctatagttccgaagtatttatagtatatttcaaaatacctagaagagaagatgtggaatgttcccaagaaaaataaatgagaaatgtttgggtgatggatagcctactcaccctgatttgatcgttacacattgtatgaatgtatcaaagtatcacatgtaccctatcaatatgtacaactattatgtgtcaatttaaaaaatcagtgcagtcccatcaccgataagacctgtccatggtgctaaaaggcaccttgagtcttgaactgatggcatatgccaagtgtttggaaccatactggatacagaggaatgaatgcctgtatgatccatgcatttaaacttttttacaatacatgagtattctgaaggtactaagctggctgttacaaggttcatattcttatttttccaatggtctagagaattacctgtacataacgtgctgattgctaattaaataggattctggagaccccaacaatattagactatgttgaaggaaggataaaacaaaaataagaaagagaggggaaaatagggagggagtaaaatggaagaaggatgaagataacatcaaagagacagagcagagtccatgcagacagaaggttttctaggagagaaatagggagaggtaaacagtttggctccagccacgtgggccactctcttttcttggaatgaatcatcctcaggacctttgcacatgcagttccttccatggctctgggtcttcatgtggctccttcctgtctccattcaggattctgagcagagttcaccacccaggggagtcctcactgattgccaccccgaagtacttgctttggttccattatgaggctgacacttcctttttaaaaaaaatacagtctcactctgtcacccaggctggagtgcagtggcacgatcatagctcactgcagcctcgaattcctgggctcaagcaatcctcctaagtaactgagaccacaggtgcacaccaccacacccagctgattttttctttaagacagagtctactcactctgatgcccaggctggagtgcaatgccacaatctcagctcactgcaacctctgcctcctgggttcaagtgattctcttgcttcagcctcccaagtagctgggattagaggcatgtgccatgaggcttggctaatttttgtattcttagtagagatggggttttgatatattgatcaaactgctctcgaactcctggccccaaatgatctgccttcctcggcctcccaaagtgctgggaattacaggcatgagccattgcactaagccccagctgattttttctatttttagagatggggttttgctatgttgcccaggctggtctcaaactcccgacctcaagcaatcctcctgtctcagcctcccaaagcatggggattacaggcataagccactgcacctaaactgatgcttcttttccttgcttactgtttgtgctcttccttgcctggaatgtaagctcagagtgtggtagaaaaatatacctaaagttgcaagtatctcaggttttaggtttgttactggagatagaagaggttcaaagggcaaaagtaagaattgtatctcatttccttttggacatcattaaaaatattatcttaatcttgttacttttgtttgggaaataggaataaggtggcaatgggaatgaaagagttgaagtcttaagatcagaaaagtctgccgggggcagtggctcacgcctgtaatctcagcactttgggaggctgaggcaggcagatcacttgaagtcagaagttcgagaccagcctggccaacacggtgaaaccctgcctccactaaaaatacaaaaaaattagccaggtgtggtggcgcgcacctgtaatcccagctactctggaggctgaggcaggagaatcccttgaacctggaaggtggaggctgcagtgagctgagatggtgccattgtactccagcctgtgtgacaagagtgaaaaactctgtaaaaaaaaaaagccattatgcagtggtcatgcattgaagtagtggtgtgcatagaggagctggtcctgcttccaggctgtgctcagaatccttggaggtgagtcaccatgaagtgagggtgagaacagcaacggggtagcagctgttcctttctagccaccaggagtgaggagtaagggggagggcaagggtagtcagagcccaacagggatggggttttccaagagaatcacatgaaacagactatgaaagtggagtgtgtgcagaaagaatccatttcacagattgaccctagaaggtgacttggatgtgggagtgaagttttgataaaaatggtggaatcaatggagcattggtccttaaaggataaaagaatgttggtatcaggagaggaggataagtcatctgttaggtaggatgtgatgttggagatgggaatgggatgctggaaatgaggggaatgaatgatcttggttattgataagtcatctgttaggtaggatgtgatgttggagatgggaatgggatgctggaaatgaggggattgagtgatcttggttattgataagtcatctgttaggcaggatgtgatgttggagatgggaatgagatactggaaatgaggggattgagtgatcttggttattgataaatcatctgttaggtaggatgtgatgttagagatgggaatgggatgctggaaatgaggggattgagcgatcttggttattgataatgacaaggcaggtaggagcgggtggcttagggagattgaacaaaagccttggaggagaggaggtcaatatggtgatggtcaaacatgttgggaggatcatctgtatcatgtattctcttccagggtaacactgaaaatttggtaggatattctttgttgtggcagggagggttgtgctaggcagtgtgggttgctcaggggcattcctggattctcagcagctctccactcctgtgatgactaaaaactccttcagacactgccaactatctcctaggggcacgagggctagcccaagcctgagggtggaacaacacagaagccctggaaaccctgctctaggaggtgccagacccctctccttggatgtcccgagacaggctggaggagcaggtgatgggggtgtgggctcaggaacaggcagcctggagacctcccatctctgagcccagtgctttctgtaaaacatggacactcctaggaacttgctcacagccaaggctgctggggatggttgtgtgtattttcccctgcagttagattcctgtccatagagctgaccagaatttgaaatccagcctgcactctctctacagttatgcccacaccctagctgaagaatctcaccagagccataccactgaaactgtctttgcaaaaattacaacagcaaaaattatgacagtgaaagagatctgatctaaccgatccccatcttgcctttaacctccaaagtgcctagatcagtgctgagtttaggccaagttaatctggggagaggttttaattcataatttaagtgatagtagcccttccccccaaaaaccaaaactgcctttgtaaagctaaagaaaggccaccaggttaggaggatgagcctgaattctgctcaggtgtagacttaaatggtaaccaggagtctggaggtcataagatttgccacttccacaattacctctgcagataacatcgctcttgtagaacctaagattggccttttgaaatgtcttttcaggtttttgcatttccgatggccagtggctccattcgaatctgtcaacccaccaactggtcctttagccccacccagaagtggagtccctggcccaccaaactagccttgaaaaaccctaacctttgaattttcaagaagattgatttgagtaataactgtctcccacgctgcgtggccagcctcatatcaataaactctttgttgtagtgtcatggcctcagtgaattgttttttgcttgtttgttttgttttttcgttttcatttttgtttttgagatggagtcttgctttgtcgccgaggctgaagtgcaatggtgcgattgcggctcactgcaacctccgcctcctgggttcaagcgattctcctgcctcagcctcttgagtagatgggattagaggcacccaccaccatgcctggctaagtttgtatttttagtagagatggggtttcaccacattggtcacctgctctcaaactcctgacctcaggtgatccgcctgcctcagcctcccaaagcgctgggattacaggcatgagccaccgtggctggtgtctcggtgaattgcttttttctgtgcagtcagcaggaagaaccagcccatcaggaggttacaccattgcagatcaatccaaagtcctacagccttccgcggccacgtgctcattaataaaatttggggcacaaattcttttcaaagaacaaacaagaaagtgacacagcaatttttagggtctcatttttttatctttcttctcatttgatgcaatgcgtatgattttatcaaatgctatcaagcccatttgccacagctagatggcactgtggaagcattcgaaagtaaataggcattcctagttaaaaatctggcaaactacacaggatataaaatttaccatatactccatattttgctaatattaattcataagcaaagactttcaagtttgttttaaatttttgaataaaaatgggttaaattattacataattcaatatttatattttaatcatttttaagtgtgtaattcagtgtcattaattgcattcacattattcacaaacatcaccaccttccatacccagagtagttttcatattgcaaaaccggaattctgtactcacgaaacactaactctccgttccttctctcttcgcccctgggaaccgccattgtactttctgtttttataaattagactagcttgggtaccttatggaagtggaatcatagagagttgtcgctttgggactggcttattccccttggcatcgtgctctaaagttcttccgtgtcgtagcatgtgccagggttttatttctttgtaaggctcagtaatattccatcgcatgcaaaaaccacagtttttttttttgacagagtcctgctcttgtcgcccaggcacgacctcagtgtggcatgatcattcagtggcacattctcagctcactgcaacctcgagatcgctcagtggcacgaactcggctcactgcagcctccgcctcccgggttcaaacgattctcctgcctcatcctcccgagtagctgggattacaggcgcccgccatcatgcccggctaatttttgtatttttagtagagacggggtttcaccgtgttggccaggctggtctcgaactcctgacctcaggtgatccacccccatcagcctcccgaagtgaaaaaccacagtttgtttacccattatccactcctcccttgatggacacttcagtttctctacttttgactattatgaataaagctgctataaacacgagagtacaaatatctctttaaaacactgttttcaatttttgggggtatatacccagatgaggacacaggtggatcatctggtaactttattaagaatttaacggaaaccatctcacttccaaagcccctgtaccacatcacattcccaacaacagggcggaaggcttcttatttttccatagcctgccaacacttgttatattctgttttatggataatagccatgttaataatgtgtggtggttccttctttctcttaaaatctattttttcgatttttcaacaatgacaattattgaataatgggatatgtgtgtctgctgggcaccgtgcaatttctcgaactttcgaatcagatggggccatgccaccctcactcctcattctcactgattttcactgggggattgcttttcttcacagcaagcactgacacctcagcttcacagagacattgtgtcagcccaggaaatgtagagagaccaaatgcagaatctgtgaaccattggagctggtagtttccgtggcctcggatgcggaatgttgctgttctcccctcaattttaatgtatccagggatcctctgcagacaattgcaggtatgaagatagaagagcaggaaggcagtaggtcttcattgcagggggagagaatggaggagctggtctggttgccaagcaatgctcagtgtctttggacatgagtcaccatggaaactgagtgacaactggcagtgggggaggggctgttctgccccagccaaatgcagctgcacagaatttaaaaagtgatgtggatatttcacagtttcttgaatcaataacgtctcatttgtacactctgatggtctccatttgtaatttcttgttcattattggtgtatctcttaggccagtaatttccaaatgtagtaaatcaagatctttgtaagggttccacaacttcaaactatttttctaaaaacattaattttattttattttattgatttttttgagacaaggtcttactctgttgcccaggcaggaatgcagtggtgccatcacagcttactgcaaccgcgatctcctaggctcaagtgatcctcccacttcagcttcctgagtagctgggactataggcacacacctccatgcccacctggtttttaattttttaatttttagtattttttatttttagtagaggtcttgctacattgcccaggctggtctcgaactcctgagctcaagcgatctgccctccttggcctcccaaagtgctgggattacaggtgtgagccactatgcccaaccagaacattaatattttatttggcttttttccttctcattttctctgcatgatataatttatgagtagattgaggaaatctatctctcttctatttaggaggaaattaaagggatttgcaaaaatgtaaaacaataccacctttacctttactaagattttatttgaaaaatattaatgttgttcataaaatgtgggttcttttaacatataatagatttgttgctgtttttaagtttaaaattgaacaatttctcttcttttatttataacatgactaatataggatatataaactgtagaaagaaacattcttcggggatttctcaataatatttaagagtattgggattctgtcgatgacacaaatggagggaaaatcattccatgctcaaggattggaagaatcaatatcattaaaatggctatacaacacaaagtaaactacagattcaacgttattcctatcaaatgaccaatgtaattcttcacataattggaaaaaacaatctgaagcagcaagaacaaagttggaggtatcacattacccaacttcaaactgtaagactacagtcgccaaaacagcagggtactggtacaaaaacacacgtagaccaatgaaacagagcagagaacccagaaataaagctactcacctacagccgtctaatctttgacaaagttgacaaaaaaaaaaaagcaatccaaaaggactctctattcaataaattgtgctgggatcactggctagccatatgcagaagaataaaactggacccctacatttcaccatatacaaaaattaactcaaggtggaataaagatttaaacgtaacacctcaagctatacaaatcctagaagaaaatctagaaaacaccattctgaacttgggccttgggaaataatttatgactaaattctcaaaagctattgcaacaaaaacaaaaattgacaagtgggacctaattaaactaaagagcttctgcgcaagaaaaaaactttcaacagagtaaacaggcaacctacagaatgggagaaaatattcacaaactgcatctgaaaaaggtctaatgtcaaaaaatctgtaaggaacttaaacaactaaacaaggaaaaaccaaataaccccattaaaaattggcaaaagatatgaacagacgcttctgaaaagatgatatataagcagccaacaaatatatgaaaaaatgtttataatcgctaatcatcagagtaatgcaagtcaaaaccacaatgagacatcatctcacacgaataagaatggctattaataaaaagtcaaaaaacagtaatcgctggtgatgctgtggagaaatggaaacacttacacactgttggcaggaatgtcaattagttcagtcactgtggagagcagtttagagatttctcaaagaacttcgaacagaactaccatttgacccagcaatcccattactgagtatatacccgggcatggtggctcacacctataatcccagcactgtggaaggctaaggctagtggatcacctgaagtcaggagctcaagaccagcctggccaacatggtgaaacaccgcctctactaaaaatacaaaaattatccaggtgtggcggcgggtgcctgtaatcccagctactcgggaggctgaggctggagaatcacttgaacccaggaggcagaggttgcagtggagattgcgccactgcactccagactgggcaagaagaatgaaactctgtctcaaaaagaaaaaggaaattgagaatacaatgactaaaatttgaaatagataatgtaaccaacttttccgttatgtttggggtcattgctatggcaacaataaaagggttccctatttcccatcagtcttaagcaagatctagtggcaacctaactgatactgctggcacttaaaaagcaaagactaggcgtggtggtgtatgcctgtaatcccagcactttgggaggctgaggtgggaggatcacttgagctcaggagtttgagaccagcctgagcaatatagcgagactagatccctacaaaagttttaaaagttcactgtgcgtggtggcaaggatctgtgattccagctcccactcaggaagctgagatgggaggatcccattagcccaggaggtcaagactgcagggagtcatgatcacaccactgcattccagccttaatgacagagtgagatcctgtctcaaaaacaaacaaacaaaagccaaaacagcatggtaaaaatattttcatagaagaaaacagtcggccaggcgcggtggctcacgcctgtaatcccagcactttcgaggtgggcggacaacaaggtcaggagatcgtgaccagcctggccaacatggtgaaaccccatctctactaaaaatacaaaaattagccgggcgtggtggtgcacacctgtagctccagctacttgggaggctgaggcagaataatcgcttgaacccagaaggcagaggttgcagtgagccgagattgcaccactgcactccagcctgggtgacagagtgagattctgtcaaaaaaaaaaaaaaaaagaaaagaaaagaaagtcgaaattatttgaggtgtataattgttttcttagccagtatgcatgttttaaatttaggacaatttatcattaactatagaaattataaaggtaattaaacccatattactcatgttctgaaccaagaaagcagcatatttggcattctaaatacttacaaaacataaaagactgctagagcaacaagtcagccttgtaattaaatatgaaaaatcaacttttggttgttgataagttgtatctcatgcttactttctgtttcactgatttctacttttaactttattatttccttccattcttcccctttctttcctttttttgagacagggtctcgctctgttactcaggctagaatgcagtggtgcaatctcggctcactgcagcctctgcctcctgggctcaagcgatcctcccacctcagtctcctgagtagctgggactacaggtgcatgccaccatgcctggctactttttgtagagatggggtctcactatgttgcccacgctggtctcggacttctgagctcaactgaaccacccacctcagcctcccaaagagctgggattacgggtgtgagctattgcgcctggccttccttccttcttgtttctttagactcaattttgtttatttttcacctttttgaaatggatgattaaataatcaattttcagcttttcttgttttctattataggtatttaaggctgtacatttctatctaagcacagctttatataagtatcataagttttgataaataatgttttcattattttgcagtccagatttttaaaatttttattttttgactgatgcattatttagaaatatattgcttaattttctaatatatggatgtttttgagttttctttttgtttttgtttgtagttaatttataccatgatcagaaaccatactccgattcagttctttgaaatttgttgagaattgctttgtgttctgtatttggttaattcatgggtactttatatgattgtctcttctagttattgggtgcagtgttttatgtacaccagttgggccaggtttgtaatcacgatgtttaaatattcttgtttaaaaattcacaatgtttaaaaattcttgtttcttgtttatttcgtttttcagttactgagggaattacgttaaactctcctactaagaatatgaattcatttatttctatttccaaaaagagcatgagtgttctaaaataaaaggtttgaggattactctcctagaataaatttctagatacagtttcactgaatagaaggaaatacaccatttgtggtttctgatacatgatgtcaaattgtgacaatgcttttcagtagtgttcctgggccccgaattctcatggggaatgtaatccagcctgtatgacttttcccaatttgccagcctgcctcccataatagacccagtgatggaatgtctatgagaagcatgcttgggctcctgttacctggacttcaaaagatatcttctaatataaaaacttttagagttgtcaaaagagatggtagattgcatatacctgggtttaccaaccacggccccaacattcattacatggatgattatgagccagacacgtgccctttctgagccttgcttcttgcacctggaaatacaggatgaggttggtaagaacttgacaaaatacattctaggtgcttaaaaaatcattgctgggatttgtttttttgtattttcacaataaatatgaaaacagttttaatttaatgattatgaacaaaaaaggatgaaaaccaatagtcagtttctttgtaaaattttccccagccagtctatcatcaagtgtttaaataattccctccttacaactgttggagtaggtgtcacatctcttgatttccataacttctggtgctgtaactggctgtttgctgttttccctatcaggccataaacttcttgagagtttgtactgtgtcttgacaacctgtttcactagtgctttgcatccaagaagcaggtgaatatttttctggtgaagcccttgattaatcagtacagccccaccattggctgagatctgtccgtggtcctgaaggtcacacttgagactattaactcattcacaggaaagggaggcagctgattctagctgacttgtgcaaaggtgatctccacatacattcgtggaataaagtgaggacaagctttattgtttagtgaaaagggaaggccacaaatgagttcatggcatgtccacaatcccacataaagtctggttttatgtttattccatcactcaacagtcacttagcaaatgctgtgttagggaaagtgtgggggcggggtggaggcagaggaaaaaaaacagaaataatgcatatgtgattcctgcattcaaaatttctcacagtctgttggtattctgaaagtactaacctgactattacatgttcatattctttttgttttttgagacagagtctcactctgtcacccaagctggagtgcagtggcacaatttcggttaactgcaacctccacctcccaggttcaagtgattctcctgcctcagcctcctgagtagctgagattacaggcacgcaccaccatgcccagctaatctttgtatttttagtagagacggggtttcaccatgttagccaggctggtcttgaacacctgacctctagtgatccacctgcctcagcctcccaaagtgctgggattacaggcgtgagccaccgcgcccggccttgttcatattcttgtttctccaattgtctgtagcaatgcctgtacgtaaaatgtgttgactgctaagtaattgtgctatcaggagaccctgaagaaataagactatattgaagaatagataagaagaaatagaaaaatataagagaaagagaaaatatagggaggttgtaatatgagagaaaggatgagaaagtgaaagagaggaagaagagcatattcagatagaaggaaattctaggagagaaatagaggtgaattatttctctctaggagagaaatagaggtgacatgagcctctgtgtgggccttgaatgagccacccccaggacctttgcacgtgctgttcccactgccacccgggtcttcacaagattcctcctgtcttcacacagggctctgatcagaggtcacctctcatggaagcggtccctgactgctgtccccaaaagcccttcaagcacctcctgcattccactcatcatgaggctgacttttatttctccctgtttctgcctgtacttacagtggaatataaactcaatgaacaatggtagaaataagaaactcctgttttgagattcttctggtgccaggagattgttactggagatggaaaaggcccgaaggacaaaaataaaactatacctgatttcctgttaatcatcattcaaaatgttcacttcctggtgtggcgtatgtgaaggaacgaggaataaaatgccaacgggcaaaggagagttggaggtctgagcatagaaaagcaggagatcagtgggtattcctggcagggagagtgaacagaggggctggtcttgtttccaggcagtgctcagcgtccttggagaggggccaccgtgaagttagggtgagagcaggcaggatgagggcaaggctgttcctccccagccacctgcagctggaggactgagggatggagaaggtagtgtcagagctccgcggggatggagctttccaagggaaccacatgaagcagaatataaaaagagattcaattgtgtgcataaagtactgattctactgattgaccatgaaaggtgacctagaggtaaggtcaagatcagtggaagatggttgtatgaatggcgtgttggtccccaagagatgaatggatgttggcatcagatgggaagggggggtcccccggaaggcaggacgtgatgctccagatgggatgcttgaacggaggggatggtgtgatactctttttgtttgtttgtttgtttgttttgttttgaaagtctaagtttattatgggtcaacttgattcttttttattattattatactttaagttttaggatacatatgcacaacatgcaggtttgttacatatgtatacatgtgccatgttggtgtgctgcacccattaactcgtcatttagcattaagtatatctcctaatgctatccctcccccctccccccaccccacaacagtccctagtgtgtgatgttccccttcctgtgtccatgtgttctcattgttcaattcccacctatgagtgagaacatgtggtgtttggttttttgtccatgcgatagtttgctgagaatgatggtttccagcttcatccatgtccctacaaaggacatgaactcatcattttttatggctgcatagtattccatggtataaatgtgccacattttcttaatcagtctatcattgtttattggtaatgccaaggttgatgggaagtggaaggttaaggaagtttggacaggaaatttgggagagaggaaatcaatgtggagatagtgaaaagtggtgggaggatcacctgtgttagtgttcttccacctcagcatcatagaaaatttgggctggaatgttcttttatgcaggatggaggaggccgtcctgattttctagggtgtttgtcagcatccctgcctgctacccaggggatgtcaatagttctcttcagttgtgaccccaaatgtttatccaaacttgccaaatgtctcctatgggcaaaatacccctggttgggaaccacagattacaatacacataacattcacctgtaaattagcgggaagtaatattggtgaggatgacagttcacacccacagaggactaagatcacaaagagtaagggtttcgtgaggatctatgcaccaaccctgtctgtcattttctgtaattctgatccatgacatctgggaccttgctgactccacagggatgatcttgccaggtcttgcctattccgaaagacagcagtcagtttccttgagagggagcctttcacgtggaaatgaatccagagcccacaccccaaccagcttctatggagctgtcacactcagggccactgtgacctgccctgtcacccagggccataaccatggacagccatgggctctgcccagagccactgaaattattccaggtagtcaatcctgagcctgctcgttttgtctcccttgttttttccttcagaaaccataaggaaggctctttgcccacatgctcccccatgagcttctgcctcttgacagacactggggcttcccctgcggcccctcttggcctggtgtgccccctcctcttgtgaatgtcacaagctatttttgttttagtgacagtcatttcctactctttttttattttgttttgagatggagggagtctcgctctgtcgcccaggctggagtgcaatggcgcgatctcggctcgcaacctccgcctcctgagttcgaacaattctccttcctcagcctcccaaggagctgatattacaggcgccagccaccacactagctaatttttttgtatttttagtagagatagggtttcatcatgttggccaggctagtcttgaattcctgacctcaagcgatgtgcccgcctcagcctcccaaagtgcttggattacaggcgtgagtcactgcacctggccctcctgttctctttaattgttttgtgtgaaactttgtgatgcagggaattgcttcccgcaagaattcctaaattccattttgtgagagtccttcaaaacccagaggcattttctcatactacgtgtgtgtgtatgtgtgtgtgtgtgtgtgattgaaggggaattgggagatgactcttgagtctcaggtcatttacttgccccatatttaccttattgggaccctccctaaacccaaacacctaatctcaaggctacagcaaggcagcagccctgaaatctctcctctgggaggtaccagcacccggctgcttggatgctcagaggcaggatgggagcaggtgacgggggtgtgggcttgggaccagacagcctggagacctcccctctgtgagcccaccatcctcctttgtaaaatgcagacactcctaggacctcgctcacagccagggctgctggggatggctgtttatgttgtaccctgcactagggtcctgtccaaggcaaggggaaaaatgtgaaacccagcctgctctccgcagctgtgtccatgcagagctgagggattattttcaggcatcccactgatctatcccacttcccacagcccaccctgtacataggcacagccagtgtaatttgggaaaaactcattttaaacaaacaaaaaaatgtcccagccaatacaacatacccctttaaaaagtacattattgtgtttttcttttcatttgaagcaatgtctatgacattgcaacgtatatataacttaatatttaacattttaaccatatttaattgtacagttcccatattaggtgcattcacattgttttactatgatctccgttgttcatctccaatattcttttcatcttgaaaaactgaaactctgtacccacaaacaactccctacttctccctcacacctgtccctaacatccactttctttcttctttctttctctctctctccctttcttccttctttccttccttccttccttccttccttccttcctttctttccttctttcttttttttctgagatggagtctggctctgtcgcctaggctggagtgcagtgacacgatctctgctcactgcaacctccgcctcctgggttcaagtgattctctgcctcaacctcccgcgtagctgggattaaggctcccaccaccatgctcaactaatttttgtattttttttagtagagacaggatttcaccatgttgaccaggctggtctcaaactcctgacctcaggagatccacccgcttcggcctcccaaagtgctgggattacaggcatgagccactgcgcccagcccactttctactttctgctctattagttggacagcattagagacactaaattattggagtcatagggtacgtcttcttttgtgcctggcttgtttcactgagcataatgtctcagggttcatacagactgtagcatgtggcaggatttccttccttcgtaaggatgaataatatcccatggtattgatagaggatattgtgtttattcattcatactttgatggacctttgggttgcttctacttcttgctgtcgtgaatgctgctacgaacacgggtggacacatatctgctcgagttcctgctttcgattattctgggtctatatctcgaagtggtattgatgcatcatattgttagggaaacaggagcataggagaaccagggtgacaccgttttaaaatctgtccaaaaaaactagcaaggcacattccttgccagccctccaccatggccattaagatgtgtatagctgaggaaacagcttaatcaagcctgcaaggacaaactcctatgagagcaaaatgtctagataccccaatatggcattatatgcttttaagatgattacagttatgctttgatgcatttatgcaccaaaatgccaaggatagctttctttaaatcaacaaaataataaattttgtcatgctgccagcccacctgcacatacacataactttgcttagctattacatagataagacccccacataagtaaaacttaaaacaaagatgaggcattcctctcttggctttctgaggacaccctactctgtatctgagtcactttcagtaaatgatctcttcttactgcactctgcagctcacctgggagcccctcctgcaagagatccaaggaccctctcttcgggtctgaattgataactgttttctggcaacaatatggtaactctacttttatttgtccagaaactattgcactgttttacaaggcagctgcaccatgtgtccatcccactgtcgaaaaccaaaatttccaccagtttatttccactgtgatcagattcaggatcagctgctcgatgctcgaaagccaggcacgggagacaagggttggcagaaggaaagacaggttcaatcagagagccagaaaaccgagaaggtggtgaactagcgttctaaagcaccatcttcaattttagaattcaccatgggggtttcaaaaggaaatttgctgtgggagacatgcggagtgtgcagggtgcaggtctgtgcctttgttctggtggctatcatgggtatcacccaccctgagacctggctggcattatcctgacttcagaggaagagataaaggggtcagatgggagggaaaggaagtgggtgattaaaatatattttaaaaacggaggtccctggcctcacaatgattgaattggcatttgttagcgatttatggatcgggctgcatcccatctagaaatacaaaggcatttttgcccttatggcagaacagttggcgcacttttttgtcttttgtttttcttttgaaacggattctcactcggtcacccaagatggagcgcagtgctgtgatctcagctcactgcaacctctgcctcccgggttctagcaattctcctgcctcagcctcctgagtagctgggattacaggcgcccaccaccacgcccacctaattttttgtattttagttgagacggggtttcaccatgttgcccaggcttgtctcaaactcctgagctcaggcaatccacctgcctcggcctcccaaagtgctgggattacaggcgtgagccaccgcacccggccaacagttggcttttgtagggcttcttgagcaggaacaaagaaacagcaccatacaaaaaggcggctcttttaacgtctggttattttaggttactttccttttaagggttaaagcagagggacttccttctcttggcagctcacgttacttgggtcctttgagatcagatgctgtggatctcttgtgttttgaaaaaaccggcctgtttagggattttcctgtttttccaagtttcagtttgacgacatgcacttaacctgaaagactccatttttatttggtttgtgaagggctagagaaggagctccgtccacaacaacagtctcctatcaacttcatttaaccactaagtgcagaagggttccagtttccccaaagcctaccaccatcctttattttccattttatggagagtagccatgttaataatgtgtgctggttcttttttttcttttcagtggaaaaaatcatatttatttcatttttcaatagtaattatttattagtggtatgtgcgtgtctgttgggcactgcacaatttctcaaaccttgggatcagacgggaccatgccacctgactttcgaaaccttgctgattttcatgtggtaattgcccttcttcacagcaaccacggatgccccagcatcacaaagacatgatgtcagcaaaggaaatgtagagagaccgaatgtgaaatctgtgagccactggagctggtgtttcacatggtgtcagaggtggaatgctgctgtgcttcccctaattttaacatatccagggtccctctgtggacagctgaagctgtgaggatagaacagcaggaatgccgtaggaattagttggagggggcaggtaatggaagagctgatctggttgctaagcagctcagaatctctggagatgaatcataatggaattagagtaagagcagacagtgcagaaggggctactctgctccagccaaatgcagctgcagagaataagaaaagtgatgtggatgttccacagtctccccttttctttcctctcccctctcctcccctctcctcccctgccttcccttcccttcccctcctctcccctctcctcccctctcctcccctgccttcccttcccttcccttcctctcccctctcctcccctctcctcccctgccttcccttcccttcccttccctcccctcccctcccctccccttcccttcccttccttcttcctttcccttttcttttattttctttctttctattttttttttgagacagagtcttgctctgttgaccagtgcagtggcacaatcttagctcactgcgacctccgcctccaggctcaagtgattcttctgcctcagtctcctgagtagctgggactacaggcacccgccaccatgcccggctaatttttgtatttttagtagagacggggttttgccatattggccaggctggtctcaaactcctgacctcaaatgatccgcctgccttggcctcccaaagtgctgggataacaggcatgagccaccgcatccagccccaagtttcttaataagttctcatttgtttattctgatggtcttcatttgtaattgtatgtccattgcctgtatgtatatttggccagcaatcccctaatgcagttcaggatctgtgggaaaaatcaagacatttccagggggtccacaatttctagactatttttttaaagaacattaatattttatttgcttattttcttctctttttctctgcatgatgtgatattataatatttgaagtaagaagcagattggagaatccatttctcttccattaaggaggaaattaaaggagtttgcaaaaacttctaacaatatcacctttattactaagtttttgtttggaaaatataattattgttcacaaaatgtgagctatgttaatatacaatagatttgttgttgtcgttaagcttaaaaagtaacgtttgactatttataacatgatctatatgagatcatgttatgttttatttatatcttataccaagaaacatcctttgggagtttcccaataattttaagagggtaaaatagtttgagatgacaaactttgagaattactgtcctgggttaaattccttggttccgttttgctggattgaaagacacacacacttaatgtttctgagacatgatgccacattgctatgatgttccacagctgtttctctggctctattttctcacgggaaatgtaacccaggtctgtcggactcttaccaattttccagtctgcctcctctcataaattcagtgaaggaatttctttctctttctctttctttctttctttctttctttctttctttctttctttctttctttccttctttctttccttctttctttctttctttctttctttctttctttctttctttctttccttctttctttctgcctttctgcctttctttctttttctttcttttttctttctttctctttttccttccttccttccttccttctttctttccttctttgtttctttttctttttttttttcgtctttttcagaatctcgctctgtcgcccaggctggagtgcagtggcatgatctcggctcactgcaagctccgcctcccgggttcatgccattctcctgcctcagcctcccgagtagctgggactacaggcgcctaccaccacgtctggctaatttttgtatttttagtagagacggggtttcaccgtgttagccagggtggtctcaacctcctgacttcgtgatctgcgcgcctcagcttcccaaggtgctgggattacaggcatgagcctcgtgcctggcccagtgaaggaatttctatgggaagcgcacgtggcctccagttacatggatgttcagagatctcccctcatgtggggtatgattagatatctcagaagataatgttcaaggtatagtcttcagtttataaaccccagtcccgacatggggtgtcgtgggtgatcgtgggccagacatgtgccccttctgaacctcatttcctttacctgtaagtggaggatgggctgggtaaaaactcaacaaaatggccaacacattataggcatttaatacgttataactaggtttttctgaatttttacactaaataggaataagagttttaataattatgagcaaaagaggatgagaacaaacacagagtcggtgtctgtaaaatttctctcaataggccaggtgcggtggctcacacctgtaatcccagcgacttgggaggctgaggcaggagaatcactggaactcgagagaaggaggctgcagtgagccgaggtcatgccactgcactccagcctgggtaacagagagagattccgtctcaaagaaagaaaaaaaaaaaaggaatggatatagaagaaaaggaaaaaagaaaaaatatagaaggaaaagaacatagggaaactcataatttgggataataagcataataaagtcaaactcaggcagaagaatgtgattctaggagacagagagaggcaaattatttggcatgaggcctctgtgtttcccttaaatgagccgccccaggccctttgcacgtgttgctcctgccatcactgggtcttcatgtggtgccttcctgtctccattcaggactctgaccagaggtcacctctcagggatgccttctttgattcctgtccccagaagcttgtcatgcacctctaccttccaaccaccatggggttgattttttttatttcttccatatgtataaaaaaacaggatacatgtgcagaatgtgccagtttgttacataggtatccatgtgccatggtggtttgctgcacctattgacctgtcctctaaactccctcccctcaccgcctacccaccaacaggctctggtgtgtgttgttcccctctctgtgtccatgtgtgctcattgctgaactcccacttatgagtgagaatatgtggtgtttggttttctgttcctgtgttagtttgctgaggatgatggcttccagcttcatccatgtccctgcaaaggacatgatttcattcctttttttggctgcacagtagtccatgatgtatatgtaccacattttctttatctagtctatcattgatgggcatttgggttggttccatgcctttgctattgtaaatagtgctgtgataaacatacgtgtgcatgtgtctttatagcagaatgatttatattcctttgggtacatacccagtaatgggattgctgggtcaaatggtatttctggttctagatccttgaggaatcaccataccgaatcaccataccatcttccacaatggttgaactaatttacattcccaccaacagtgtaaaagcattcccatttctccacagcctcaccagcatctattgtttcctgactttttaataattgccattcatacagaatcaaagaagacttcgtatagccaagacaatcctaagcaaaaagaataaagctggaggcatcacgccacccgacttcaaactatactacaaggctacagtaaccaaagcagcatggtactggtaccaagacagatatatagaccaatggagcagaacagagacctcacaaataacactacacatctacaaccatctgatcttcgacaaacctaccaaaaacaagcaatggggaaaggacctcctattcagtaaatggtacttggaaaactggctagccatatgcagaaaactgaaactggatcccttccttacactttgtacaaaaattaattcaaggtggattaaagacttaattgtgaaactgaaaaccataaaaaccgtagaagaaaacctaggcaataccattcaggacataggcatggacaaagacttcatgacaaaaatgccaaaagcaatggcaacaaaggccaaaattgacaaatgggatctaattaaactaaagagcttctgcacagcaaaagaaactatcgtcagagtgaacaggcgacccacagaatgggaggaaatttttgcaagccaaagaaactatcatcagagtgaacaggcgacccacagaatgggaggaaatttttgcaagcaaaagaaaccatcgtcagagtgaacaggcgacccacagaatgggaggaaatttttgcaagcaaaagaaaccatcgtcagagtgaacaggcgacccacagaatgggaggaaatttttgcaagcaaaagaaaccatcgtcagagtgaacaggcgacccacagaatgggaggaaatttttgcaagcaaaagaaaccatcgtcagagtgaacaggcgacccacagaatgggagaaaatttttgcaagcaaaagaaactaccgtcagagtgaacaggcgacccacagaatgggaggaaatttttgcaagcaaaagaaactatcgtcagagtgaacaggcgacccacagaatgggaggaaatttttgcaagcaaaagaaactatcgtcagagtgaacaggcgacccacagaatgggagaaaatttttgcaagcaaaagaaactatcgtcagagtgaacaggcgacccacagaatgggaggaaatttttgcaagccaaagaaactatcatcagagtgaacaggcgacccacagaatgggaggaaatttttgcaagccaaagaaactatcgtcagagtgaacaggcgacccacagaatgggaggaaatttttgcaagccaaagaaactatcgtcagagtgaacaggcgacccacagaatgggaggaaatttttgcaagcaaaagaaaccatcgtcagagtgaacaggcgacccacagaatgggaggaaatttttgcaagccaaagaaaccatcgtcagagtgaacaggcgacccacagaatgggaggaaatttttgcaagccaaagaaaccatcgtcagagtgaacaggcgacccacagaatgggaggaaatttttgcaagccaaagaaactatcatcagagtgaacaggcgacccacagaatgggaggaaattttttgcaatctacccatctgacaaaggtctgatatctagaatttacaaggaacttaagcaaatttacaagaaaaaaaacaaacaaccccatcaaaaattgggcaaaggatatgaacagacacttctcaaaagaagacatgtacgcggccaacaaacatatgaaaaaaagctcaatatcactgatcatcagagaaatgcaaatcaaaaccacaatgagataccatctcacgccagtcagagaggctgacttttttggtttacttcctgttttgtaagatattgatcaataggatgctgtctgctacccagctgatgccttatattctccctctagtggaatataagctcctttgaggatggtagaaataatgaacccctggtttgcattactgattgtgccagaagattgctactgtgaatgaaaagctccgaaggacaaaaatagatccatacctgatttcctgctcattatcatgaaaaatattcatttctcaatgctgcttataccaaggaaataggaataaagtaacaatgcacacaaaagagttggaggtttgagtatagaaaagcagtcatgcagtagtactggacacaaagtgaatggagaagctggtcctatttccaggcagtgctcagtgtccttagggatgagtcaccacgaggttagagtgagaataggcagtggggcaggggctgttcctccccagccacgtgtacctgcaggagtgaggatgaggaatgacatggagggagtcatggctcatcagggttgagggtttccaagagaatcacatgaagcagagtatgaaaaggagatttgagtttgtgcagaagaaactggttctaacaattgaccatagacagtgatctgaaggtgggatgaagattagcgggaaatgggtgaatcaatactatgtttttcctaaagaaaaggaaaattggcatcaggtgagcagaagtcacctggaagataggcagtgatgttgcagatgggaggcttgagctgaggagatgggctgacagcctctattggtaacaacaaggctgatggcaatcgatggctaaaggagtttagataggaaatttgggagagaggagatcaattttcagatagtgaagtgttgggagggtcagctatgttagtgttcctccacatcagcactattgaaaatttgggcttgaaagttctttttttgcagggtggggaagcctgtcctgtttttgtaagatattgatcaataggatgctgtctgctacacagctgatgcctacagccctcctccagttgtgacagccaaacatgtttccaaaaattggcagatgtctcctcatggcaaaatcttccctggtggagaaccacagatattaacgtgtaggatattccccaggattatagaggaaagtgatgttggtgaggacaacagtccacatccacagagaattgagatcacacagaaatcggggcttttcatgaggctatgtgtcccaaccttgcatgttattttctgtaattctgatgggccacatcttggatcttgctgaccctggagggatgatcctgctgggtcttgtcaattcctgaagatagtaaacagctcccttgaaaggcagcctttcatgtggaaaccaatccagatcccactccccaatcatctcctctatggagcattcacactgacagccacgaatcactcagctctcctaatcaccccaggaccaggcatcagacagctcggggacaacccctatgcccagagccactgaaattcttcagagaagccaatcttgtttacctgctcatttacccccacttgttctttcccttggaaaccataattaaggctcttcactcacaagtccttccatccccttcctcttgccagatacttgtccttcctgtgtgactacctggtgtggtgtgcccctcctcttgggaatgtgagcaaacagctatatttgcagtaacaacttgtccctcagtctgttttaccgttgtgtgtgaaacttggtaatttctggtcttgattcatgcaattatgagcctcattttgtgggagtccctcgagtaccctgatgcatttccccatcgtgtgtgtgtgtgtgcgagcacgcacgtgtgtgtagttgaaggggagtttgggagacacggcattctcaagcaaattggagatgcagaccactttccctgcctcttatctatattattagaatcttgcccaaccctaaatgtccagtcccaaagatggagcaagacaggggccctggactccctcttctgggaggggccagggcacttttctttggatgctcagacgtgggatgggagcaggtgatggaggcgtgggctcagggccagagagcttggagacttccctctctgagcccagtattttccgccataaaatgcaggcacttgtaggtctcactcacaaccagggctgtggggatggccatgcgtatgttcctcagcattgaggcttctgtccaagaagctgaggggaggtgaaatctagcctgcactctttccaagttgtgcttagttcgaggataaataatcccaccagcgccactccctcattgatctctgcaaagccccttagcccaccaccgtggccttgggttcactcatgaaatttgagaaacaaattagttcaaggaacaagagagcaaataaatagtgacacagccattttcaggatctcatttttttcctgtttcttctcacatgaggcaatggtaatgctactgtaaagtgcctttgccatcactaggtggcactcttgaagcaatagaaagtatacagacgtttaacactttttatcttttcatttttaattgtggcaaaatacacagaacataaactttaccgtataatccattttttactaatattaattgaaaaacaaaggctggcaagtttaatttttttttttgagaccaagtctcgctttgttgcccaggctggagtgcagtggcgtgatctcggctcactgcaagctccacctcccgggttcaagtgattctcctgcctcagcctcctgagtagctgagattacaggcctgcactatcacacccggctaatttttgtatttttagtagagacggggttttaccatgttgaccaggctggtctcaaactgttgacctcaggtgatcacctgcctcagcctcccgaggtgctgaaattacagacgtgatccaccgcgcccatcctctaattttttttttttttttttttttttgagacggagtctcgctctgtcgctcaggctggagtgcagtggcaggatctcggctcactacaagctccgcctcccgagttcaccccattctcctgcctcagcctccacagtaccacagtagctgggactacaggcgcccaccatcatgcccggctaattttttgtgtttttagtagagacggggtttcaccgtgttagtcaggatggtctcgatctcctgacctcgtgatctgcccgcctccgcctcccaaagtgctgggattacaggcctgagccaccacgcccgacctaaaaatttttttaattgtaaaaaatgatgtaggccaggcacagtggctcacgcttgtaatcccagcactttgggaggctgaggtaggagcatcgtgtgagcccaggaattcgagaccaacctgggcaacaaggcaaaaccctgtcgctacaaaaaataaaaataaattagctgggcatggtggtgcaggcctgtaatcccagctactcaggaggctgaggtgggaggatggcctgaggtctgctgtgagctgtgatcgtgctgctgcactccaacctgggtgacagagcaagatcttttctttaaaaatggtgtaaattattacatagtttaacgttgatattttcatcatcttttaagtgtgcagtttgttggcttccattacattcgggttatttgcaaacatcactaccttccacgcccagaacagtcttcatcttgcaaaactggaattctgagctgattgtacatgagctctgcatttctcctctctaagcccccatgagccaccattctactttctgggtctatgaattaggctagtctggggcctgacctaagtggaatcatgcaacagtgtccctctggggctgacttattccactcggcatcatgtcctcagggttcctccgtgttgtagcatctgtctgggtttcctttctttgtaagactcagtaatattccattgtatgtgaacactacagcttgtttaccaatatccactcatcctttgatggacacttgcggttttccacctttgactattatgaataatgcatcgtgtcacatttccatcaacaaggcagaagtttcctacttttccaaagcctgccagcacttgttattttcaggctgggcgtggtggctcatgcctgtaatcccagaactttgggaggctgaggtgggcagataacctgaggtcaggagttcgagagcagcctggccaacatggtgaaaacatgtctctactaaaaatacaaaaattagccagaaatctcttgaaccctggaggtggaggttgcagtgagccgagatcatgccactgcactccagcctgggcaacagagtgagactccgtctccaaacaaacaaacaaaaaaccacttgttattttctgttttatggatcatagcaatgttaataaatgtgtggtggtttcttctttctcttaaaaataatttttcttttcaaacaaaaactattttatttagaaaagccatgttgaatcatggcccagcttggaaagttatttatttattaaaattaattaatttttattaaaacttttttaaaatgtagatacaggcttgttacaaggacatcttgcctgatgtggagtttggcttctaatggccccgtggcccgcgtagtgaacgtggcgtgagacaggcggtaccttcccttctgctgttgacagtgtctactgttctcatatccttgtgcctgtgtacccaatgacaggcggtaccttcccttccggtgttgacagtgtctactgttctcatatccgtgtgcctgtgtacccaatgtttaactcccacttataatggagaatgcatggtaaaaatcattctttattcttcaatcatggcaagtccttcatcatgggacgcacgtgcctgttggggactgcaaacctcttatcccttggcatcagcctggactgcaccactctcatttccttatctatgttaatttttgggtggtgattgcttctcttcacagcagccactgacacccccgcatcacagagatgtgatgtcagcaaaggaaatgttgaaactgtgaacccctggagctggcaggttctgtggtgtcagatttcgaatacagctgtatccgatgccttcaatgttaaggtacctaggatctctctgcagagatcgtcacagcggtgaggatagaacagcaggaatgcagtcggtgttcactgcaggggagagagtggaggagctggcctgattggcaggcaatgctcagtgtccttgttggagagagtcaccatggaaacagagtggaaacaggcagtgggggaggggctgttcctccccagccaaatgcagctgcagagaagaaggaaagtgatgtggggccggtgcagtggctcaggcctgtaatcccagcactttgggaggctgaggcaggtggatcacttgaagtcaagagttcgagaccagcctggccaacatggtgaaaccccgtctctactaaaagtacaaaattatacaaaatacaaaaatacaaaaaatacaaaaattagctgggcatggtgatgcacacctgtaatcccagctacttggaggctgaggcaggagaatcacttgaacccgagaggtggaggttgcagtgagccaagatagtgccattgcactccagcctgggtaattcaaagtgaaactccatctcaaaaaaaaaaaaaaaaaagagaaagaaagaaaaaaaggaaagtgatgtgaatgtcctgtagtttctttcatggataacctctcatttgtatgttcagatgatcttataatttcatatccactatttgaatatatcttacatcaatgttgtcccaaaaggtagttcaaggaccttgtgaaaatcaagaccatttgaaagagttcacaagttctatatgttcttaagaacactgttttatttgcctttttccttcccattttctcttcacgatgtaatattgtatgtttgaattaattagctgaaatgagaattcggctgctttgtattaagaaaagatttctttttgtagagacaaagtcttgcctttgtcgcccaggctagagtacagtggtgcaatcatagctcactgaaacttcaaactccttggctcaaggaattctcccaccatagcttccagagtagctaggactacaggcacatgccattcaactggactaattaaaaaaaaattttttttttttgtagagggggagtctcactatgatgaccacgctggtcttgaactcctggcctcaagcagtccttctgccttggcctcccagcatgctttgatgacaggcatgaaccatagcacctggttattaagaagagtattggctgggaggagtggctcatgcctgtaatcccagcactttggaaggccaaggcgggtggatcacaaggtcaagagatcaagaccatcctggccaacatggtgaaactccgtctctactaaaattacaaaaattagctggatgtggtcacgcacacctgtaatcccagctacttgggaggctgaggcaggaaaattgcttgaacctgggaggcggaggttgcagtgagccaagatcacgccactgccctccagcctgggtaacagagtgagactctgtctcaaaaaaaaaaaaaaaaaaaaaaaaagaagagtattaaagggatttataaaaaagtgaaacagtgctccctttataactaattttttgtttggaaaaagtaattattgttgataaaatgtgggttctgttaatatgtgatagggttgttacttttttatgttttaaatttaaaaatttctcagcttcaatttataatatggtaaatactcctagatataaaccatgcaaagaaaaattctttagagattctcaattatcttgacaagtatacgggccttctgacttttaaaagtttgagaaatactattttaggctaaatttctaggtataattttgtggggttgaagaagacacatgcttaatgtgtctgatccacgatgccctatactttcagagtaagtgaaagaaagtatagagctgttttctggctctgaaagtatagagctgttttctggctctaaattctcatgggagtgtgatttatatgtgtcaggcttattgatttgccaagccgcctaccattataaacccagtggggagatttctccaggaagtatgctctgactcctattacccaggctttcagagatctctcatataagtttagaattcccagaagagaaggtagaatgtatattctcaagtttataaatcccaggctaacattcattactgggtgatcatgggccagacacctgcctcttttgagcctcgctgcctttgcctgtaaatgaggattgggggtgtataaggatttggcacaatgcccaatacattgtacaaattcaataaataatagttgtacattttgcatttctaccataaataagaaatacagtagtaatttaatgatgtgagcaaatgatagttagaaagaatagagaggcattttctttgtgaaagtttctccaacgactgtatccacaatggttaaagctcttctctccccaattctggtatgataggtgtgccacttctcctgttccttgtctctcttggtgatataactgtttacccatttccttcactgggccatgaactcttagtgttcgggtcgtgtctctaaaacctgtatcaatagcactttgaacttaaaaagcaggtaaatagtttcctggcttagcccttgatttaagaatcaggacagaggccaggcgcggtggctcacggctataatatcggcactttgagaggccgaggcaagcggatcacgaggtcaagagatggagactagcctggccaacatggtgaaaccccgtctctactaaaaataacaaataccgggcatggtggcacacacctgcaatcccagctactcgggaggctgaggcaggagaatcacttgaacccgggaggcggaggttgcagtgagccaagatcgtgccactgcactccagccttgatgacagagtgagactccatctcaaaaaaaaaaaaaaaaaaaaaaagaaaaagaaaaaagaaaagaaagaatcagaacagtaccatcaatgactaaaagctatccttggggctgaaggacaatgagactatggactcattgataagggaagtagttgatgctaaccaacttattcaaaggtgacctcaaagtatatttgtgggataaattgaaaatttattattttacaaataagaagacagggccccaattgggtcttctgcctacagctccacataaagactggttatgtgtttatttcattattcaacagtcaccagcacatgccatgtgttaggcacagtgctagggacagagggaagagtagtgcatatatgataccagcattcaaattcttcacagtctgtgggttcactgaaggtcctacgtaaccattccaatgtttgtattcttgtttctctaataatctagagcaatacccgtacatgaaatatgttgactggttaataagtaggctttctggagaacctgaaaaaaaaaatcaaactatagtccggcgtggtggctcatgcctgtaatcccagcactttgagaggtcaggagttcaagaccaacctggccaacacagtgaaaccccatctctactaaaaatacaaaaataaaataaaatacaccaggcatagtggcacaggcttgtagtccaagctactcaggaggctgaggcaggaggatctcttgaatccagggggcggaggtcacggtaagccaagatgacacgactgcactccagcctgggtgatagggtgagactccatcttaaaaaaaaaaaatcaaactgtattgaaggatgagtaagaagaaagaggaaaggggaaaatgaaggagaaagggggaaaatgaaagagaaagagagaaaataggtagtttgcgatatggaaggatgaagagaaagcagagagggaagagagagcattcagaccaaaggagattctaagggagaaatagaggcaaaatgtttagctccagccacatggttatatcttataccctggaattaatcagcctcaggaccttttcatgtgcagctctttccatcaccctaggtcttaatgttgcctttctctgactccagttaaggttctgataaaagttaaccacccaagaaagccccccctatatttctatttccttaatagaaagcagccgaattctcatttcagctaattaattcaaacatacaatattacatctatttccttctttctttctttccttcctttcttcattccttccttccttcctttctttctttctttctctctctctctttctttctttctcttttttttttcggagtcttgctctgtcaccaggctggagtgcagtggtgcaatctcagctcactgcaacctccacctcctgggttcaagtgattctcctgcctcagcctcctgagtagctgggattacaggcgcgcaccaccacgcccggctaacttttttttgtattttagtagagacagggtttcaccatgttggccaggctggtctcgaactcctgaccttgtgatccacccgcctcagcctcccaaagtgctgggattacagacgtgagccaccgcgcccggctgcagatgcttcttttatttgcttgcttttcactgctttcgatccactggaatgtaaactccatggataatgtttgaaaatgaacctagcgttgtgagtttctgctagtttcaggtttgttactgggaatagaataagtccaatgagcaacaatagtaactatatctcattttcttttgagacatcatgaaaatattcactctgtgatgctacttgtatttgggaaatataaatcaagtgaaaatggggatgacaggcttggaagtttaaggatagaaaagctggcatgcagcaagcattcatcggagggggattgaatggagaaagtggtcttgtgttcaggacgccctcggccttcttgacagcgagtctccatgaaagcagagtgagaacaggcggtggccgagggtctgttgctcctcagctatgtccagctgcatgagtgaaggacagagcaggcagattcatagtccagcaagcatttatttttctaagagactaacaaaaagtagaatatgaaaaattgcttcatatgtgtgcataaaaattttgttttaaacagagatcatagaaggtgaccttgaggtgaaagttaagatcaatgaaaaatgggcaagtcaatggagcattggtccctaatgaatgaagtgatgttggcatcttgtgacaagttacctgaaatgtaggaagtaatgttggagatggggtgctttaggtaaatggatggaggggtttgggttattggtaatgagaaggctaatgggaatggattgctaagaggcattggacagaagcactgaagaagaggaagtcaatatattgatagtcaagaggttgggagaaccatccatattaggtattatctaccttagcaacgtagaaaatttgagctggataattctttatgtcaggggggttctgttctgacattatagaatgaggaacagcatccctgactactatccaccaaaaagctcactcgtcataatcaattgggttattccagggatgcaaggatgtttcatcatatgtaagtcaataaatgtgatacatcatatcaatagaatgaaggacaaaaatcatataataatttcagcagacacaaaaaaagcatttcacaaaatttaatatcctttcagagtaaaaattctcagcaaactaggtgtggacagaatgtactcaatataataaagaccatatatggcaaacccacagctaatgtcatgcttaatgagaaaatgttgaaagccttttctctaagatctgggacaagaacaagtatgcctattcccaccacttctattgagtatagtactgcacattctatccagagtaattaggcaagagaaagaaatgaaggcatccaagttggaaagaaagaagttaaattgtacctgtttagagtgacttgaccttacatatagaaaatcttaaaggttccattaaaaagtgttataactaataaacaaattcagtaaagttgtaagatacaaaatcaacatgtaaaaagtagtagcatctcgatacactaatggcaaaatatctgaaaaggaaattaagaaagcagtttcatttacaataagcttcaataaaataaaattcttaggaatgaattaaacctagatggtgaaagatcactacactgaaaactatacaaccctgaggaaagaaattgaagaagatacaagtaaatggaaaaatatcttgtgtttatagatcagaataatgaatatagtgttaaaatgtccatactacgcaaagtggttcaatgcaacctctctaaaatcacaaatggcattcttcatagaaatagaaaacaatcctgaaattcatatgaaaccataaaagacccagagtagccaaagcaatcttaagcaaaaagaataaagctggaggtcttacactacctgacttcaaaatataccacaaagctataggaactaaaacagggtgattctgtcataaaaacacacacatagaccactgtaacagaataaaaatcccagaaataaatccacacattcacagccaactgttttttacttttgacaaagataccaagaacacataataaggaaaggacaatctcttcaacatattgtgttgggaaaactggatatctatatgcaaaggaatgaagttagacccttatctcaccttacatacaaacatcaactcaaaatgaattaaagacatagagggaagcctcaaaactataaaactaatagacgaatacataagggaatatccccatgaaatataaaggaaaagtcattcacctgggcaatgactttttggatataacctcaaaagtactggcaagaaaagcaaaaatagccaaatgggattgcatcaaactaaaatgatactgcacagcaacgaaaacaatcaacagagtgaagagacactgcacaatgagagaaaatatttgcaaactatatatatctgatgaggggccaactcacactcacactcctcatccacgctgatttcaggtggtgatcttttctcttcacagcaaccactgccaatccagtatcacaaaggtaggatgttagcaaaagtaatgtagagagagctaatgttgagtctgtgaattgctggagctggtagttcatggtgtgtcagatgtggaacattgctgttcttcccttaagtttaaagcatggggataccccagcagacagttgcagctgtgaggacagaaaagcaggaatgcagtaggttttcactgcagtcggagagaatgaaggagcgggtcctgtttccaggcagctgtcagcatccttggagatgagttgccatgagataagagtgaaaacaggcagtgggagaggagctttttctccccagccacgtgcagccacaggagtgaggggcagagcagaaaagggtcagagtccagcagcgatgggatattccacaagaattgcatgaagaatataaaaaagagatttgcatgtgtgcagaaggaattgattctgaggattagccatggaaggtggccgggtgtaaaggtgaatctcagtgtaaaatggtagaattcctggagcgctggtcaccaaggaacggggggacattggtgtcaggtggggaaggggtcgcctggaagtcagggagctgatgtaggagatgggatgctgatctgatgggataaagtgattttggttattggtaatgagaagttcaatgggagtggaaggctgagggaggattggagaagaggtcaatatatggatcgtcgagagggtttggaggatcattataatgggttttccaccttggtggtgtggaatatttggattggataacgtgtcgtgtggggacagggacttcctgtgcattggaggatgttgaactgtattcctggcttcacaggaccctttcagaggtgaaaattaaaaatgtctctagatattgacaagtgtccccagtgggcaaaatcaccctggcttggaactactgatctaagtgggttataatagtcaaccacagtgtggatcgaagtattttggggtcgtcactccacatccacagagaactcagaacaacaggaagtggggagttccctgaggatgcgggcaccaaaccatctttaacttcctgtattctgatgctttgacatctgggactggctgaccctggagacatttcccctctcagctgtcttcaaccgctggagatagtcacaactttcctgcaagtgtgcctttcatgggtaaaccaaccagtcctagcttacacccccagccacaccttatggagctctgagccacaatccacgtgcacagtcacccaaggtcaggtatcagaaacaacgaaggacgtcccataacccacagctactaaaatgacctaaatgagcctgtcgtcagcctgcttatcctgcatgacctgtttcttccaaagggaacttcagtggctttgtccacatttcctcctgcatctctctgggtttttgctgaccaggtgattccccgtgtagctcccctggctgtgctgtgccctcgacttgtgattatgagcaacaaactttccttttaatggcaggtatctcctgatctgtttaactcctgtgtgtgaaactttgtgattcatgcaatgagaacaaggctttacgtgaacagaccagagcccaggtgcagggcggtcattccagagcccaggtgcagcaggtgcagggcggtcattctgcccacacaggtatgtgttgggggagggcaagttgaaacagagcctgagagatgaattcattaatgaacaaatttgagccccaagccacatttcctcctttacagccaccttggtaggaccctacccaagccccaaatgccaagccagaatgcagagcaagacagcagccctcaaatcccccctctgggaggtgccaggactcccctccttggatgctcagagacaggatgggagcaggtgacggaggcgtgggttcagggccaggcagcctggagacctcccctccctgcgcccagtgccctgctctgtaaaatgcagacactcctaagacctcacgcacagccagggccgctggggatggccgtgcgtattctaccccgcacttaggctcctgtctgaggagatgagaggatgtgaaatgcagcctgcactctctccacagctgtgtccatgccagggctcaagatcccacacctcagcctagcattgctctgtccaaaggcagacagcctggtacagccatgtgtgcagttattttcacttcaaaaaaaaccttattaaacaaaaaccaaatatatgtaaacacaccagttttttaagtatctcatttttttttctaatttgaggcaatgcctattgtcaagtatctttgctgtcattagacggaactcttgaagaatggaaaagtaaataggtattctttcttaatatttagttgtagcaagatacacataatacaaaatttgcagccacacacggtggctcatgcctgtaatcccagcactttgcgaggccgaagtgggaggatcacctgaagtcaggagttcaagagcagcctggccaacatggtgaaacttcatctctactgaaaatagaaaaaaattagccaggctaatttgattcatgtctggctcccccactcaactgacagcaggccccaggacagccagtggctgtgtcatcatgatctgctttgccctcactgtcctctcttacatccgcatcttggccacagtggttcagatccgttcagcagccagccgccggaaggccttctccacctgttcttcccacctgggcatggtgctcctgttctatggcaccggcagctccacctacatgcgacccaccacccgctactccccgctggaagggcgcttggctgctgtcttctactccatcctcatacccaccctgaatccgctcatctacagcctgaggaaccaggacatgaagagagccctgtggaagctctatctccaggtgccatactagggtctgccatctggatgcgggagggacccaaaaatccaccttcccaagattttccttgtggtcgtggtggaagtgttagtgcctccagagacccccaggaacacacctattcgccaaagttgtcaacaaagttgaattgcaatgaatcatgcaggagaaccctgatggatgtctggataaaatggagacaaatccaatgtgcatttaatttaggcaaatagtattaaatgtacacaggggaggagagaaagaggaggagcaaataatttaaatagggtgggtgattccacccaagagctcactcaataaatttatgacctggactacgaatccaataggagactgtcctctcagcctgcctcggtttccatgcacttccccatgtggacatgttttatcctgctcaatgtggttctaatgtttagtggtacacattttttcatctagtgtttgtcctaaatgcaagccaaagccttcatcacaagcagcagcatctattccagaagaaaaataggccatattggacgtgcagagaaatggttggtagtcttcacgcggctgcttcctaagggaaagtcaagggtacctttatctttctgcaatgtttctctgatagcaaaccctgtatttgttgtatttctggttcagctgctttaacagaaacaaaataacagcaacctaagtcatacagaaggcttgtttctcttttgtgtaatcatttgtgcttggaggtgaccctgggtgtctctatgccacagtcatcctgaggccaggttccttctatctcgttgctctaccatccctgaaggtttccttattcctatggtgggagttggatcactagcacctcattcacaatccagctgctggaagagggacagaggaaatggagggcaagctacatggttttaagatgtgacccagaagttatacgcttcacttctgctaacatcttattggctggtgtttagccacatggtcacactgaccgcaaaggaggctgggaaatgttgtctccagctgagagcccagataaaactcatgaaaggagagaatgttatttactaatttgtaatcagtccctcacatctgatctcttgatgagccaccatttatcttcttactcaatcctaccattatgcttccaatggccacctgtactaatgtttagtggcactaaaactttacatacattgtcacttttatgtacattatctctaatattcaaaacacctctgtgaggtagttgtaattttcctcattttttagataagcaaaataaaattctgataagttaggcagtttacccggagttaagaaggttgagaaaggcttgatatttttagattgatatttttaggtttgatatttcagaatcactcaggattctttttttttttttttgagatagggtcttgctctattgcccagacatgagtacagtggcatgatcatagctcactgtagcctcaacctcctgggctcaagtgatcctccaacctcagcctcccaaatagctgggactacaggcatgcaccaccacaccctgctaacatttaattttttttttttttttttttttttgtagagatgggagtctcattatgttgcctaggctggtcttgaactcctgggctcaagcgatcctcccacctaggccttccaaagcgctgggattacaggcatgagctaccatgcccagcctctacttcttttaatgatagagattgaattatatgtgtctagggctttaaaaaatcttaccttacagaggcatttctcagaagttttaggagtccgttgcagtcctaccaacatatccctgaggattgaacaattctgctctacctgggaccaccctttgatcaaagacataacccttaggggagacataaattggccaaagagagagaaaatgggtaggtgaccagccagcttgatcaagtctctggtgactactggggcatggcagatgcacacaaaggtgaccaccaattagtcactttcttgtataaacccttccccttgagtgtggtaggaacctgggatttgccttcagccaatagaatatggcaaaggtaagggttggtcacttccacagttatctgagagctcctctctgaggtgaaaaacacctcattctgttttactatctccattacatttaccacccttatgaaattatataaattattgagtgtgtttgttctaccccaaccaccccattcctctgaatataatatccatgaaggcacggtcttgttttcttcaatgccgtatcccctgtgcatagcgtagtacctgacacatattaggtgttaaatatgtatttttatgaagaaataaatgtgaagcagaacaacaaaaaacaaaaaccagagctgttcttgtgtaaacgagggtgagagggctgggatccttgtctatttggtgttttcccaacccctcagcacagtcatttctgcaacacctacatgggatctttgagctccacaaacctggttgagacacctcttctctaatcagattaatacatgctattgaatagaaaccaccattgattgtaagatactccactatcttgcattccattaagaaagaaaaagacactgccaatcaaattgtgacactccatcaataaaacatcttgattttccatgctaaaatgtgctcctcagccttcagatcacagctgaaatgtcacttcctgatcacccctgctggccaacctgtgtcatttctccttctatactctcagcgaacacacactgcaattttaattaattatgtaattatttgtttaaaatgtcttctgaagcaaaaatgaaaacagaatgaaggttagaattatgtctgcttgcatactattatccagtggtatgttgataaacttgctctctcaaaaaaaattataaatagcatttgacagtttctatggtgtaaatattctcaccacagctgatgtcaagctatcaatagttcaacaacttatttccaacattcctgaatatttataattggctcttgtgagctgacatcagcttgctccagcacagttcacccaggaccaaacactgtatctgtacataataatggcttaataaatgattggttagtgaatgaataaatggttgtgagtcacactgaatgaatatgtagcaggtatttcaaagttaacagttcaaaatacagccctttatgtctccttcatacctgtggtttttccgttttcacctcagttagcagcactgacatctgctggtcactcagggcaaaaatctctaggcatattgatttctctctctccctcacctcttcccagcactcttctcattatatccatgagtcctgtcaattctatcctcaatgtgtattctattctattccaaacccatccctcacaccatccccatggccaccatgctaacccagcacatcatggcctggccacaacagcctcctgcctggattccctcccttcagtcttacctttcaaagctcatcctccctccaccttaactccccacaccctgcctatgcgaaagccacagggtgttgctgaaaagataagtcaggtcccatcatcctcccgctgcggccctccaggtcctccacgatcggaccccacccagctctgcagcctcctctatcacgctctctcctgcagcttttattcccagctatgctggccttagctcagttcttcaagcaaaccattcttctccctacctcggggctctgcacttgctcttccgtcagctgaaatacccttccccaaatctgagcatcaccgcctctgcatatctgagcttcattctagacgtcgtctctttggaaagacctctcctaaccacttctttaagtggcatcatcccctccccctctcgcacatccccccgttttattgctttctgagcccttatcactgttggaaatcaccgtgttgcataactttgcagagcctgagacaaggacttgggaagggtggtttatgcctgggaaaaggcaggccgggtgccgggatgtagtgcgcctgcacgccgtctccagactacaactcccagaatgcgcggcgccccgagcgtatttccgcttccggtggcgttttagcgggagatccgagcgtctcggctggtggaaggggcgaggagctttgcagttgtgtgcgagtgtgtacaggtgagtttgtccgtacgcgtgattaagtgtgtgcgtgtgatcaagtgtgggggcgagtgttgcgtgagcaaacctgtgagagggtgagagtccgtccgtgtaggtgagggagctagcaagagtgtgagcgagtgcgaatgtccctacaagtgtgggcgcgtgatgtgtttgaaggtgtgtttgttcgagagggtgtgtgttggggtcaacgagggtgcatgtgtgtgagtgaggaagcctgagtgtgtggtgtgtgcgcgagccagcaagctggaatggctctcgcgtgcttgtagatcatgagcgtgacttggtggctttctgtgatggtattgggtgtgtatggctttttgctgtccatgcatgattgtgttagcttgactcgtgttggtgttgtttatgtgggaatgtgagggatttagttcatgagattacgtgtgtgttgctctgcagtctcaagcttgctgggttagctgtttctgaataggatttgacccaagttcagcgtcagcttttcaaacagcctaaaaactctggccttgggcattgagaaatcagaaagtttttttttctctctgtccctctgactataacagttgtggaagaattagacaattctaagaaagaaagtttcctgaattagcattaggaaaactagacacaaaaatcccactttctgaaaaaatgagaaacttcctaattgtaactaaaatgatcagtaaacaagccacttgctggtttggaagaaaggaaacacacctatgtgttctctttctgccaacacttgaattctctggtccaactgttacgccgtctacgtgacttccattaagaacaagcagcacccttaaatgcatctcaagtgttgtatgtcgctaaaggccatgaccggttcttggttttccttatctccaagctaagcctcagtttctgcatgcacaaaattaggaagataatatccacccatctacaactcaatgcattgagtcacatgaaagttttgtagacaggaaaagttctgtggcactcggcctgatcaagtcagctttcctgggtgttgctgagttaactataaggattatatggaaggaccatccctagactaattctagacctggctcctaatgtgcaggtcagcagttctttccgtgactggcaagtctgaggtcatttgcaagttaaggaagataaatgtactgatatctgacttggtttgcgccagagatgattttttcaaaagatgtattaactgggttggatgcagtggctcacccctgtaataccaacactttgggaggctaaagcaggaggatcgcttgaccctggagttcaagaccagattgggcaacatatcaagaccctatctctacaaaaataaaaaataaataaaaaattagctgggcatggtggcacttgcctgtagtcctagctgcttgagaagatgaagtgtgaggattgcttgggcccaggagctggagggtgcagtgagatgtgatcacatcactgcactccagcctgggcaaccgagcaagaacctggctcttaaaacaaaaatttattaactggaaaattaggcttcttcaacagttatttcaaacttaagagccggatgcccccacataatattaaagctgattttcaaggatctcttttctcaatgtaagaatgagtcccaaaagtgagaaaagatctgtgaaggctgtggtggagcagtgaaaagcattgtaattttcttgactctttggtccaaacatacaggagggacttctttccagtaaacaggagtgaggaaaagacaaggaatttaaatatatctatgtatgatctgcaaaatacacgagctgtggcgtataagttagaaagatccagccatctttcatggtttgcagcagtagatggacacagctttgcagaattgcagaacttgggtgattgagatacctaaacctggagttttgaatcccagctttgtcattactagttgtgtggccttaaacaagtcacatcacctccctgtgccttagtgtctctgtatgtaagatggggtgttgttacccatctcacagtaatggtgtgagtgaccgatgtgaatctcccagcatccagaaaggccctccagtctaggaggggccctgagactatcaacagtagccagttaggacaaaccaaactgaaaatagcaattatcaagcctctattcactgacttcaatagcataaacagaggccaaaaagaaaaaagtgccagcttctctgttctttttcccacgtagcagcaccgggcgagggtcagatgaatctatacaggaggtagggctcatctccctgccagggaaccctgaacaaagggccccagatcagacttctcaagtcgggatgattttacctcccagataaaatgtcgaatgacatttttgcttgtcacaattggagaagcgggtgctcctggcatccactgaacagaggccagggatactactaaacaccctacaatgcactggatggtccacaggagttgcccaacaccaaatgtcaactgcaccagtggagaaatcagtcctggtgctgctcccacatctgatcctatcactctccctctcactcgcaacccttctactgtctcctccaccaacatacaaagctattttctgaccaaagagcttcgctcatgctgtttcctctgcccggacactctcttctccagggtcccaggctgacttctcatctgatggtctttgcttaaaggccatctcttcagagagccttttttggaccaacctgtcttaaattagccctcccacttccatggtaactctctaccctctttcctggttttatttttcttcatagcatttaccaccttattttgcttattgcctgtctcccccatattgcacattaaagtttgagaaatactggtttcaagaaaggattgaaaactgaggatcctacaggggccagcagagatgatcttgggtgactttatttttttattttattttattttattttttattttttttaattttatttatttatttttttttgagacggagtctcgctctgtcgcccaggcgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctgctgacctcatgatccacccgcctcggcctcccaaagtgctgggattacaggcgtgagccaccgcgcccggcctgggtgactttaataaagcagccaaatgtagttagtctggttctaaaatttcagaattccttggcaatgccgaagtgaccctattcttgagatgctggctttttagaagaaatataagaaaaactctatagaagaaaactcacaactgcaaaaacatgcagaaataactaaggaaaacttgtgacattttgataagaaaactataaagctttactgattgatacaaaagcttgaatgaatgaaaacacagtatcatattcctggatgttaagattaaatgtaacaatgttaatccttcctaacttataagttcattgcaataataatcagaaggttggtttttgattactaaagataaattttaatctggaataacggaaacttatatataacttcacataaatttatgcatacatgtacatatactttttaaaggcacaatgatggaaaacattaaatatagccataaaaattaagaagaatatagatctaggataaaacagggcaacaagccaataaaagcaagtagatggtccaaatatagaacctacattataaaatataacaatttataatttactaataatgttggggcaattaacaatgaggaagaataaatttaattctcttttcatacaatatgcccaagtaaattcaataatcactaaagcatatttttaaaactccagaataaaacactaatgtttacagagggttagattttgtagggttggaagaaaatagaaggattgaaatatataaaaattgaaacattttcaaaaaataaagaaaataccaaagagggaaaatcatttgcagccaagatgacaacaaagaattaatatctttattatgcaaagagatggttcaaactgataggaagctattaaagtcacatagacaaatgattaaaagacagacaatgtgaagagaggaaacaatggcttaagaagcttacaggagaaagttcaacatccttaaaaatcaaagacaattaaaatgagatgccctttcccctattagcaaagttgctactaaacaccctacaatgaaaagtgctgttattacataatgccagctgggcgggaggtgtggggggtagtgggtgtgtgtgaggaacacgtatccccaagcattactagcagtagcagcagtgcaaactgatgtaatgtttccaaaaggaacttggatatatcaaaaatcttaaaagcaattatacaccttctgatgcagcaattcctctttggcaaatatgtatcgtaaagaaattttacatttggaaaaaggtttaagcaccgaaatgttgattatagtatgttcataactatgaaaaattgaaactgaattttacctcctaacaacagaggaggagccatccacagaaagcactgggtttgctgtgccactggtaaggcggtgataaccacagacgagtgagtgatgacagcagttttgtaaggtataagattgggtagaaaaacaaggtatactatcgcacacatggaatagtcacagctatatgacaactatctataaataccttaaaaataggtaatacagggttgggtgcggtggctcacacctgtaatcctagcactttgggaggccaaggcaggcagatcacctgaggttaggagttccagaccagcctggccaacatggcaaaaccccatctctactaaaaatagaaaaaaaaaaaagccgggcagggtggtgcatgcctgtagtcccagctacttgggaggctgaggcaggagaactgcttgaacctggaaggcagaggctgcagtgagccacgatcgcgcccctgcactgcagcctgggcaacagagcgtaatacagtcatgagggtaacaaagtggacaggtatagaccatgaaaatgagatctttacttcagccactccccagaggcgactaccttcataaatctagtcattaattttaagttacaagaaaacagactaaaaatgttagtggtgttcatagtgtatttttctgtttcggggcagagggagggagagagatctacatttctgtaaagtagttgcctttaatgagtcaaatattgctttaaaaagaaaaataaacattaatccatcagaaatgtgtacttaaaaggaaactgagttcacacaaattagtaagaaaaagcataaagacaaaaaagctaaagaggtaaagggcctaggttatacataaagaagtttttaaaacttatttggaaaaaatgcataataataatgcaaaaatggattaattattgttaataataatctttttattaccaaataggtgaagatttttatctttttattaccaaaaagatttatctttttattaccaaataggtgaagatttttatttatctttttattaccaaaaagatttatctttttattaccaaataggtgaagattttttggttgttaagtgaataaatacccagtgcaggcaaagttatttaaagggagtatttatttggtaccagggtgacaaaggcagttctttgcacatacaaaaactgcttagtgtgtcttgtttgccttgggtgctgtgctgagaaagatccaaccctgtcctcaggttcactggaaccagagagtgcataactggttaacaacgcctgccagggactcgagagggaggattgtaagtttaccacctatttcatacctctggccctccctatgctgagggctacaaatggcagagcccctccacaaacaaatccagcaggatctttcgagagccttagaaatgttcatcacatgtcatctagtgaaaccactttttggaaatcgattctaaactgtaaatacagtaatttatgctttgttaatcagacttttatataaattaaaaattgtcacaaaatcagaaaagaactttaaacttgtaatattatttttaaaaacctacacatagaaaaaaatatttgtagaaaaaatactaaaatatgataaaatgtggttgcgttttgatgtgttaactatggtttacaactctagtttattgctgctaataaaacattttaaaaaataaattttaggccgggtgcagtggctcacgcctgtaatcccagcactttgggaggctgaggtgggcacatcacgaggtcaggagtttgagaccagcctgaccaacatgaggaaaccctgtctctactaaaaatacaaaaattagctgagtgtgatggcacgcacctataatcccagctactcaggaggctgaggcaggagaatcgcttgaacccgggaggcagaggttgcagtgagccgagatcataccactgcactccagcctgggtgacagagcgagactccatctcaaaaaaaaaaaataataataaaataaaatttaaaatactccctaattgcaactacttgttactgagtgccttctaaataccaggcactattaggctcttttctatagatgaactctagaccttttaatggttctcccaggggaggatccccatttcctaagaaaacgaggtataatcagcctctaaggaggaccttgaaatttgacctcagctctccctggctccaaagcccaccctctctcttctctgccaagggtctcttctacttgtgaatataactacctccctggacttgtactagttgcatacctagaactattaggaagtttattagccttctctgttttgcaaaattttctttaatatgctcaatattatttgtatagtgaggaaacaatacctaataaaactatgttaaaaatcatagttcaggccaggcacggtggctccacacctgcaatcccagcactttgggaggccaaggtggggcgggtcacaaggtcaggagatcaagaccatcctggctaacacagtgaaactccgtctctactaaaaaaaaaaaaaaaaaaaaaaaaaaaaaaaaaaaaaaaaaaaaaaaatttgccaggcatggtgacgggtgcctgtagtcccagctacttgggaggctgaggcaggagaatggcatgaacccggaaggcggagcttgcagtgagctgagatcgcgccactgcactccagcctgggtgacagagtgacactccatctgaaaaaaaaaaaaaaaaaaaaaaaaaaaaaagagaaattataagcaaccccagtttccaaccatgaaaggccagatgaaataaattaggacacatccatgcaaccaagtactaaaaggaaatttaggaatgtatttctgtatatggaaagatgttcataatatatgagaatgaaaatgacagccctcaaaacagtgtttatggtagtatatttcaattcataaaaatataactttttttttctgagatggagtctcattctgttgtccaggctggagtgcaatggtgcaatctcagctcagtgtaacctctgcctcccaggttcaagcgattcttgtgcttcagcctcccaggtagctgggactataggcgagcgccaccatgcccggctattttttcatatttttagtagagacaggatttcatcattttggccaggctggtctcaaactcctgacctcaggtgatctgcctgcctcggactcccaaagtgccaggattacaggcatgagccaccatacccagcctaaaaatataatttttaaaagctatacaggtttatgcataagaaaaaatgggcataaacttttagcagcaagtatatttgggagggggaaatacaaatattcaaagaaaaaacaaactttttctagttttcttcagggaatgtatattacttgcatcaccactaaaaaacttaaaacatgagtgtttctaaatttataggcgcgagccaccgtgcccggcctacaatgtgaatatacttaacattactgaactgtatgcttaaaaacggttaagacactaagctttatgtggtttttaccacaatgaaatataagaatttttaaatgagttcttctaaatttaaaaatgtaaacatgaagaggagtctctaaactgttagacatatcacgaactgggtaggaacaggagggaagttctatattaacctcagggttgcacaggccttaaaaacgtgagaggggattgctttagattaagagacttaagagattaaacaaccaaatgcaatctgtggaccacatttagatccagattgaaacaagccaactgtcaaaggacatcttggagataatcagggaagtctggttatcgtgtgagtaaaaccctttgtctgaggtgatttaaaaatttcctttttaagtagaggtactgaagtttaaaaaacataaatgagtccattaaaaatatgtcaagtaaataacagttcaagcagaatacagatttagcaaaaactgcaacgggagaagtgaaataaaagactgatcaggctatgagccttctgaccatgaggaaagaagcagatttcatgagagtgaatgaggtagaaactaccttaaagacatgatagggttttcctggaggtgaagggagaaaaattatggaagatatagaaaggaagtggttcctgaaaaggatgggagcttattgaaaaggcacaggagccgactgaaagagctcccaatggccaaagctgtagccatttgaacaacaaaataaatgacagtactgaattacagcctgtagaatacatatccacgaatccaatctgatataaaggagggcaatcctccctcacgatgagtatcactgaaaaaggcaaaatctattagctactttcctatgcaacaaaaatattctttgtaagcttttcacctgtgtgacgtgaggaatcccctcttcgaaaaattgcaactttttttttttttttaccacactttgatgaatgttcaagttgttaacaaggtggggctagtgaaaggccttctcacactcacaacactctaggaggaagccaataatgttgagaaaagtgtgtgctgtgactaaaggtttctcaacagtgatcgcactcaacagttttctcttgagaatggagttgataatgttgagtgaggtatgagggtcggccgaaacatttcccacatagctgacactggtaaggcctctcttgagtgtgagttctataatgctgaatgagatatgaattccgactgaagactctgccacagtcacaacactggcaggctctctctccaacgtagtcatgtttccgctgataacgaattaagtatgtcttgctgtgggacaacccaggaggaaggactcttgctgcctcatgggctttgagatgttgaagaagatgcacattctggagaaaagctttgccgcactgaaaacattcaaagtagtcctcctgactgtgaattcttacacgttcacagagattcgcacactggacggaaggctttctaccttcattgcagccagaagtcttcctaccagaatgggtcttctgatgtctgttgaggtgtggcatgagatagaaggcttcagcacactgtttacattcatagggtttcttcccagtatggatccgttcgtgtctcctaagggctacttgcgtactaaaggttcgtttgcaaaattcacatctgttgtgtttgttctcttgggatgctgactggggactcgtacatattccaggagcagtgccttcctggggatcctttcctagaggatcctttgattgtttactaagattagagcttctctcaaattcatcactgccatagcttctttccggagtgagggtcttggggtcattcattgttataggagtcaaaagtttctcttggttgccctggtgtggttccaatggatcatcatgagactctcctgcagagacaatgccagaagttacctaccgcccaattatccaatcctgccccccaataatgatatttctataggcaggctttgccctggagttagtgctttggtttcaggtctcttttcctaatctgaaaaaaaaaaagtaaaaattcctctattctttttactcagagagacataccaatataatagaaataaagagaccaaggataacaaacagatcttatggaggttgagagagttttctgaaaacctaaagagaaaatggaaaaaggatagaaaggacagtaagtggccgggcacagtggctcatacctgtaatcccagcaccttgggaggccgagatgggcggatcacaaggtcaagagattgagatcattctggccaacatggtgaaaccctgtctctactaaaaatacaaaaaattaactgggcatggtggcgcgtgcctgtagtcccaactactcaggaggatgaggcaggagaatcgcttgaacccgggaggtggaggttgcagtgagcagagatcgcaccactgcactgcagcctggatgacagagtgagactctgtctcaaaaaaaaaaaaaaaaaaaaaaggaaaagacagtaagcaaggaagagtgaggaagaaacagaaaaaatatcatctaggaggatggcgtgtcaaaaagatgccacaattgtacagagtagaatgagcagaaatcagagaaagagctggggttggggtttgtcagcattttccaaaccatgtttggcagatcgctaatattctgaaaaacaaatagctgttaccatgaagggggctccactgtcaagttaatttgggaaatgttgtatgacacaaatcaagcaggtttcattcctgtaggattcagaacttttaatatgcaccttgaaccctaaagagggaaggtacagaatgtggcatttcttaaagtgatcttgctatgaaacattttttttagaacatctattactatggttcttcaggactactgaggaaacactggagcaaacaggtcaacaacctcttgttcagaattaaacaaagattctcctttcttagctctgaatctcttgttttaccccaatctacactgtcaaccaatcctctttaattcaatatttattaaatgcctgttttgtgcaaggcattatctaaccagatgggtcagaggtctgtaaaagggactctaatcagactgtaagtgacgacaggagcagagatgggggaactgactccacttaggaacagaaaatgattagtggaggggacagcatttggcgtcagtaaacggggaaggggggcgagtttatataaaacagcctgagttaagctatagaactgtgaaaatatacagtcctggggagctagaaacacaggatcttagttgcaagatctgtagatgaggctgggatgcaaatttcaggccagaatgggaggaacttcagtgttttgctaaaagtttgaattttatcttgacggaggtaagaagctgataaaaagtctgtgctttataaaggcaactctctggttggaaaaatactgaagccaaggaagtcaagtataagactgtggtttggaagagaggtgatgaacacagtggttgcatcctggcagacacttgaagtatgtgaacagagtacaggtaaaacagcagagccagaacatggcttaggaagtcatcaggaaaagagggatagctgggcccatcacaatggattgactcttttaggaagtggtctttgaagagaacactcaagaacggaagagtaagagaacacctagtcctcactggctcttctgttttccttaccctgctgtatatccaatatttcagcatgttctgtcagttcttctttcagggaatacctccaacctgacccctctacaaccacggcctcagcctccatcatctttagcctggtggacttcaatggcctcttgaactggtttctctggcttttcctcttaaagcccgttctccataggacagccagatggatctttctagaatagcactgcccagtagaactcccagtgatgatggaaatggtctacatttttgctgtccagcacagtagccattagccacatgttgctatcaaatacttgcaatgtggcttgtgtgactgaggaactaaattttaaattttatgtaattcttactagtgtaaatgtaagtagccacatgtgcctactgtctagcatattggacagcaaagttctaaaatatcaataacactacttcatgcccctgctcaaaacctccccccatctttgcatctcacttataataaaattctttaacatattcctaagcgggctggcccttgactatctctgtgatctcatcttctatcttccacttaactcagaccatattgcccttcctactgtttttggaacacccaagctcattccaatctcagggccctggcacttgctgttcgctctgcctgtaacactcttcctcaagatttctacattggtcagccccccatctcattcaagtcttccacagtgaggccttctctgactattccatctcaagcaacctcccatatctcattctctatccactttacgctccgttattatttgtctattttttaaaactactgcccccattagaatgcaagctctatgaaggaagagatttgtctgtcttattcattattgtatccacagatactaggacagtatctggcccaccacagaagcctgataaatatctatgagatgactgaataatgaagaaaccagagtagggaaagaaaagaagacaatgaaagaaacagagaggagtcttcctggtaacttcttgaattttgtttggacatccacttttccactcacacagacaaacgtggaggagggctgtgtcaatcagcactgtactggacacagctgctagttcaggaaagggatataacccgatatggaacaatgaaaaatcaggagagctggaaaagatgcttcctctctcttgagaatgcttcttggacacaccagctctttcttgctccttttttgtacaggaacaaaaaaatgcatctaggatttattgtcagagtcgaaggcagagtagaaggagaaaatgaaactaggtcttcgatgacttcactgggtccctgaatacagcccagctgatcagtattataggctaataatccctctatgactttagccagtttgggtgtgggttttctgttaactacaactgaaggacaacagtgatccagccgctgcacatggtgacccatttcatgaagatggtaagcgttattagactgtagccatagagtttggaggaggtgaagtctatggttccagaactataaggacgctagtgggaaccttttgtggaagtttcagaaaagagcgtatatgtgtgtctgagttggcataagtagggggatggaaaccagagggtggggattaagaagaaaagggaagggagcgtctaggtgtcaacaagtctgaggagctgatgtgagggaaagtgggagggcagtgagaaagacaagtggtatcaggccaggattttttgtttgtctcagttaaagaggagagatgtatgatgtttagctgcaaggagaaaggcatgagtggacggaagggctggaacacgagggtgaaaggacactggcctccctggagctaagcaggagaggagctcatgctgcatgaagagatgggcttcagaaaggagaccaaggggagtactgaggagaaagggcacctaccagacttctcctggcccaggggactttgaggaaagctctctgactagcatttactggttccccctcctacaccccgggcttccccctcactactcaccttgacaaatcactgtatgtctgctgtctgtctccattgcatatgattcctcctcttccaggcgtgagataatgtcaggtttagagaactggtgccctgttggagaggaagactgagaactcagggtttcagtaactcccaaccttaggtcccaaagactctggaataataaggaaggaacaaactctcgcaggagtaaaatgaagcctgtttccagcctacagagattttaccccctaagggacatctaaaatgtatggagatatctttggttgtcataactgtgggagcagagggaggggttcctagtgtctagtatggctggaggcagggacactgctcaacattctgcaagacagccccacaacccgggacgatctggttccatgtcaagagtgccaaggttgaacaaccctgctatgaagactaaaaagggggcatgagggcagtgtgctgagctctacacttcagcaccaagaatctgacatagctgctcaaaaagtcaacattatggttcttttccctcctgggataacgtccactgcccctttgtcttgaagtgctgctcctccccctcccttagttccttgtttcccaaacttttatcatttgcataccaaattattatctatttgtttactgtctgactccactgaaatgtaacatccatgagaaggggaaatgtcatctattttgtaaccaaaatgcctataccaggccttgtatgtctgaattcactgacgagttaatgaatgacccttgcattttggcatttctacgtgccatttatagtcatattcagtatttatttaatgtttttctttagatcacctttctttttaacttagatatgcttattttcttttttctttttttttttttttgagacagagtctcactctgtctcccaggctagagtgcagtggcacgatcttggcttactgcagcctctgcctcccagatgcaagtgattcttctgcctcagcctcctgagtagctgggaatacaggcgcccgccaccatacccagctaatttttcgtagttttagtagagacggggtttcaccatgttggccaggctggtctcaaactcctgacctcaaatgaaccacctgcctcagcctcccaaagtgttgggattacaggcgtgagccactgcgcctggccaatacgcttattttcaatggaagctttatatcaaccctataaatggaaaccaatgtcactcacacacacacacaaaaatggaaggtaacatcatgataaatataacagaaactaaggttattgagtgctagctagcttctgttgcctatctaacattcagggtttgatgtctgctctcactttactaaaatggaagaataacaagatagacatgctaacaccaaactgatattctctacgtgataccatcagaaggcttaaaggaaaattgaagaacttctttttcaccaacagattgaaggattatgtcatgctgtccatgtactgcctaaaataatcttctatttagcccactgtactcattccacacttaggaagacaatgtcccaggtgatatataagatctctattaacacaaaaccttcagtgttaaagaagccaagggctcacaagatagaaatgctccaggtcactgcatgagagctggaatgatacaattaatttatttcctctattttgatactattccctctattttaagtcataaaatgtggtaagctagagaagagtgtaaaatatgctggaaaatgtacttccttgtaaccgataagaaccagagttaaacatatgcatccctgtgctaggtttggggtaggatgtgtgttttcccactaggtccctgacttgccagtggaacagtgtttgttttggattctgtttttcaggagacctcaagcccccaaaaaagccactgaaaaaggagcttggcactggcaacgtaaacttttcacttttcactttcaactttacctgtgagaacaggtaaaacaattttgcctccgcacgtaaagagagattggcaatctctgtttcttcaaactcaagccagtagaagtctttggagctcctggaatttttagcaattccttcgctcattcagtaaacatcattttgagccttccattgtgctgagaactggtggagcaaacccctgtctggtagcacatcagagtttaaaagagcagattctggagtctgcttggggttaaatcccagctttcgacaagtactttagcctttcaatgactcaggttcctcaaagttaaaaatgtcaataataacaacaacaataagtatacctccccctcacaggcctagtgtgaggattaaaggagttgaaatatgctaaacacttacacaagtgcctgacacatatgtcgtgctcaagaaatgttagctatgttataattaacagtgaatttgatattcaaatattaaaatattgcctctgacctgggttgagactcactgacatggtgaaccaccattactgatgagaggacacgaaggagttgagagctactgccctagtgggaagaaaccaagtcctgtggagaaggcatacttacccagggagaccaggttccggtaattctccagcatcacctccctgtagaggtttctctgagcagcactaagggaactaagttcctctgggctgaagtccacaagcacatcctcgaaggtcaccaactcctcaaacaccagaaatgttcctaagtgtttgaagtccgggaactatcccagagagaggagaagggacgtgattagagaggactgaacatgatgcaggcattcagaccagcagagagcttccacgtgctctaatccagagccacaggcacctggcattgcatctttctttgtcttatcgagtctgagagaagtgggaacattactgaaacagttcctattgctaattactacagatttgggttgagggggaaatatccttttaagccactttataaagacagaatgcaagcatgcaaatacttaaaagctcagcagtatacctcagcctcaggaatcagagtcctggctctggttctttgtgagtttgggtaggttaagcctcagggtcccacctgtaaaacaaagtgctcataacatgaagaaatattcaatcttgttaataaacaaggagatgaaaatcaaaatgacaaaataccattttatacccattcaattaagtattgggtaaaaattaagtaattgagtgaaaattaagaagtgggacaataccaactattatataaaacatggatccactggcgatgctaagggaaatgtaaattagaaaatcacttttgatccagaaattctttttttaatttttaaaaatttttgtgggtacatagtacttgtatatacttacggggtacatgagatgctttgatacaggcaggcaatgtggaataagcacatcgtggggaatggggtatccatccccttaggcatttatcctttgagttacaaaggataataaagagttacactctttattttaaaatgtacaattaagttattattgactatagactccctattgtgctatcaatagtaggtcttattcattctttctactttttttttgtacttgctaaccatctccacctccctccagccccccaactacccttcccagcctctgagaaccacccttctaatctctatttgaccccaaaattctattcctaggtatatttactcatgtgtacttaaagacatggatgggcatgtttattatagcatgtttggaacatccaaaatctggaaataacccaaacattcattaacagtagaagagataaatatagtatagccatacaatgaaatagtattctagcaatagaaatcaattaactacagttatatacaacaatcttagtagcctaaggttgaatttaaaaggcagataccatatacccaaaggaaaataagctgtcctaccaaaaagacacatgcactcatatgttcatcacagcactgttcacagaagcaaagacatggaatcaacccaagtgcccatctacagtgaactggataaagaaaatgaggtgtgtatacaccattgaatactatgcagccaaaaaaagaacaaaatcgtgtcctctgcagcaaccggaatgcaaccggaaacctcagatgcaacgggaaaccattatcctaagcgaactaacgcagaaacagaaaaccaaataccacgtgttctcacttattagtgggagctaaacactgggtatacatggtcattaaaatgggacaacagacactagggaatacaagaggaggcagggagggaggagaataaggattggaaaaggccatttattgggtactatgcttactatctgaggtgacatactcattcatgctccaaatcttagcattgtgcaatacacctttgtaacaaacctgcacatgtgtgccctgattctaaaataaaagtgaaaaaaaaagatagactgacctcttcaaatctaacattatcctgaggcaataggatacttaccttccttagcaaatctgaatatagaaaattgtaacacgtgtaagaaaatgcataggatctccccactcaaatatgctaatccaataagtctttataaacagttaatgacaaaaattgaaaattaaaacttactagccattttgctcaaaatgttgtagcagttaatgatttttctgtctgtttccagtcatactttggcaataaaaaaaatgattcaaaaccaaaggtacattgttgttaggctgaggtcttaacctggcaatcacagattcttaaggctgagctttgtagtgcatgtgcacctttctggaagataaaaattccgtttctcaaaggagtctgtgactcaaaatatttagcatagagagcaatctcagtttttcataaccttttttcttgtgctttattttacttaatacagttaatatgctacaataccttgaatataatggataatcaatattattatattaaaaaaagattgttaaaagagaaatgttacctgattcagtataagaaaattgaatttagttgtagaaaaggtatctatttcaagtaagaatcactgtatggtaggtcatgatttctcagtcacagtgtcatatttaaacgatggtggtcatgtggtagtcagagcatttttaagactgctatcttactgttcccaaatgttttcctactgttaactgtccattgaccctcctttcttttttccatctcatactctgtaactattagagaaaatcatgggaacaaacctacactggaataaggagttttgagttctgctattagctagttgtaaggcatgggttaattaatctctttgattctcattgtctcatctttaaaataaagagatccattacattatctctaaagtcatttacactctaaaattttataataaaacacataagatcccttgatactataaaaataaaaaggcagataccagaacattacataagactctgatatccattttattaatatacatcttttgtgttttaagtgaaactttctaaaactttttatgcaaatcaacaaacactggattaaattagggatcatatactggctgcccagctccttcagatgggtttatttggctcacgtggtcctattgttttttaaaaatttgtattagctgccaataccaaaaaaaaaaattaggaaatgtcattcttaactggttttgtggcttctgattaaaagcattagaaaatctggggactgggtccacattctcacatggcaccatcagcaaaagctgagtcacagctgcccctatatatgggacaggcactccccctgtttctcataatccacccagaccaattccttatttatattcccttggtagtccctccagggcatctttgcttggaatccctggcacagacaaggtagggacagagggctactctcaggagcagatattctagaacagtgtttctcaaccttttttccttacctcgctccccccaccccagtaatctttatacgtcattttttctaatcacaacccccatgaatttttttctggttctaaagaaagcagagtatattaatttcattattgtcttttaggtttctaaaacatgacttaacaagaacactggagaacatttttgaaacaaaaaatcagaaaacctcataacagtatcatgtccctataagagctgccatttgttaaaggcctacaataagccacaccctttgtgtgggtagaaggggttgtcttcatttacactattttcattgttgcaaagtacattccagcccttgacatggatatactttttcaaacaattataaattagcattgattcacatacacaggtattggatggttccaattttaatgtgcacacaaatcacctggggatcttgttaaacacagattctaattcagttggtggaagtggggccacagatgctgtatgtctatttttttaaataacagctttattgagatttaatttacgtattataaaagtcacctaaagtatacaatttaatgagtttttaagcatattcacagagttgtgcaaccatcaccccaataaatttcagaacatttcatcgccccaaaagaaaccctgcaccttctagcagtcactctccatttccctccaacatcttcccacgccctaccccaagccctaggcaaccactaacatactttatgtctccatggatttgctgattctggatatttcataaaaatggaatcgcacggtaccccatacattttaatatcgcaaatatactgtgtatgtactgtatgtatgtctgtgctgtacacataagaagaatagtatgtgttcaccctcaagaaccaattttcttccccttgaaggcaatatcctccttaagaatgcgtgttccaggacatgactttcaaggaaaaggcccttttcaattgctctgtgactttttggcacccccatatggttctaagaacacttttttccctcaaacagagcctgacaccggtagacgttggtgaataaacaaacagatgatgacactaccagaatcatttgtataatcttgtacaacctgaaaaaagttttatgtttgatgatttcattaaactattattcattattttggaggaaatacatggtaggacataactacctttcctttttttaaaattctggactattctagcctatccatgcttcccagtggaccccattgtctcaaatccccaaatccaaaaatttagttgaaataggacggccagataaaattcagcatgcccagttaaatttgaatttcactaagttttaaggggctgagtttttttaaatctttgacaatttcattcatggatagtgtgttgggtgggaagagcactgggctggcagttcagagacctgggttcaagtactgtactgttttattgttttttgttttgttttgtttttcttgtttgttttttgagatagagtctcactctgttgcccaggctggagtgcagtggtgcaatctcagctccctgcaacctccacctcctgggttcaagcaattctcgtgcctcagcctcccaagtagctgggattacaggtgtgtgtcaccacgcccagctaatttttgtatttttagtagagatgcggtttcgcatgttggccaggctcgtcttcaactcctgacctaaggtgatccgcctgccttggcctcccaaagtgctggggttacaggtatgagccactgcacccggtctgtactgttatttaatttcattggacaagacaggtaacatctctgatctggaccttgatctataaatggtcattgtactttttgtatcatagggttttgtgaagaacaaattttgttatgtgtctattaaaaatcttttttggttttgtttttgttttttgagatggagtctcactctcactcaggctggagtgcagcgacatgatcttggctcactgcaacctctgcctcccaggttcaagtgagtctcccacctcagcctcccaagtagctgggattacaggcatgtgccaccacgcccagctaatttttgtatttttagtagagacggggtttcaccatgttggtcaggctggtctcgaactcctgacctcaggtgatcctcccaccttgggagggatattggcctgaaattttctttttttgttgtctctgccaggttttgctatcaggatgatgctggcctcataaaatgagcctctttttctattgtttggaatagtttcagaaggaatggtacaagctcctctttgtacctctggtagaattcggctgtcaatctgtctggtcctgggtttttttttttttttttttggttggtaggctattaattactgcctcaatttcagaacttgttattggtctattcagggattcgacttcttcctggtttagtcttgggagggtgtatgtgtccaggaatttatccatttcttctagattttctagtttatttgtgtagaggtgtttatagtattctctcatggtagtttgtatttctgtgggatcagtgatgatatcattttttattgtgtctttttgattttttattgtgtctatttgattcttctctcttttctcctttattagtctggtaagcagtctatctgttttgctgatcttttcaaaaaaccagctcctggagtcattgattttttttgaagggtttttttttttgtctgtatctccttcagttctgctctgatcttagttatttcttgtcttctgttaacttttgaatttgtttgctcttgcttctctagttattttaattgtgatgttagggtgtcaattttagatctttcctgctttctcctgtgggcatttagtgctataaatttccctgtaaacactgctttagctgtgtcccagagattctggtacgttgtgtctttgttctcattggtttcaaagaatttatttatttctgccttaatttcgttatttactgagtcattcgggagcaggttgttcagtttccatataatcgtgcggttttgagtgagtttcttaatcctgagttctaaattcttttccttaagaatgttgatattgacctccactctcttctggcttgtagggtttctgcagagagatctgctgttagtctgatgggcttccctttgtgggtaacccgacctttctctctgactgcacttaacattttttccttcattttaaccttggtgaatctgatgattatatgtgtcttggagttgctcttctcaaggagtatttttgtggtggtctctgtatttcctgaatttgcatgttggcctgtcttgctaggttggggaagttctcctggataatatcctgaagagtgttttccaacttgttttattctccccgtcactttcaggtacaccaatcaaacgtaggttttggtcttttcacatagtcccatatttcttggaggctttgttcatttcttttcattcttttctctctaatcttgttttcatgctttatttcattaaattgatctccagtctctgatatcctttcttctgcttgatcgattcgctattgatacttatgtatgcttcatgaagttctcatgctgtgtttttcagctccatcaggtcatttatgttcgtctctaaactggttattctagttagcaattcctctaaccttttttcaaggttcttagcttccttgcattgggttaaaacatgctcctttagcttggaggagtttggataaacaacagttttttacataagtatgtcttaaatatgaaacattgcatccttatgcaaaaaattgtctatctgaaattcaaacttcatagttatgctaaaaatttatttatacttatgctaaaaatttatttgtagttcatctaaaattcaaatttaatttggatgttgtgtatatttacttgctaaatccggccagccgaagttgcagtaactgcactaccttaggcagcaataactaagtggttatgaatgtggactctaaagccagactgcctgggttcatatctcaatcgtattatttaacagctgtgttacccttcagcatattatttagtctttctgcctccactccctcatatataaaaaggggaacaataataatgcaaaccacacaagggtttttctgaataaaatagaatactaaaaaaataagtaaacaattaattcaaaagacagaaaaaaaggaaaaatattaaatatatagtatgtgggatggtgataagtacaacagagaaaagtaaagcacggaaggaggataaaagagtcagaaggatttttcttggagaaataagaaaaaaaagaatcataagcaaatgtcagattagtcagaaaaaaggctcagtaaagtgatatttatataaaaacttaatggaaatgagtatgtggtttaattaaataaggaagtccacaaattaggaagataagatccccatatttgataaccatgtcagaggaaagcctgactcacctgggacccagcagatggcagattgtctaacatctctgtgttcctcttttctgcagggacagagtcctgagcaaggaaacctagaagggagagaggaataccatggaattgagtcctgtctggtagcactgacagacacagtggccagccaccctcatgccaccctgtcctgccatgggaaggaacagcagctctagagttcctatggtgagaaagtcagatatcatttctcaactcaaaataacaagttccaaaagagagctctggttatttcccagctctaaatgcttcaatggctcccactgccttccaaataaagtgaaagttccctccatatcagtcatttcgggcctcactgtccagtcaagatcaccacagaacctctgtttctcaactgtaaagcagaaataatgacaatacctatacagtagtccccacttatctgaggttttgttttctgcagtttcagttacccatggtcaattgggggtcaaaaatatttaatggaaaattccagaaataaataattcatatgttataaattgtgtgccattctggtgatgaaatctcacactttcctgctctgtcccacctgggacatgaatcatccctttgtccagtgtatccactctgtatacactaccccttagtcacttattagctgtcttggtcatcagatcaactatcacggtatcacagtgcttgtgttcatgtagaccttattttacttaataatgcccccaaagcacatgagtagtgatgctaacctactgttataattgttccattttataactagttgttaatatcgtactgtgcctaattaataaacttcgtcacagatatgtatgtagaggaaaagacatagtatatatagggtttgataatatccacactttcaagtgtgttagaatgtatgcccctcagataaggggagtatactatacctctaagggctcttgtgagaattaaacattacatatgtaaggcacacagtaggtatttttttggtaaatggcagctcttatgattaagcctttcctacatatttttcactcgttgatctaaaagacaaccacccctttccctccaggagccttaaccttgatggccttccttgcctatatattctcttttctcggtaaacccttcattaatctgttttttctttctggtaccctagggaactctctttccttctcactgaactctagcttcatcaataactcagtgcctctggccaagtttttagcctctgggacaacatccactatatccatatgaggcactcatgtaacacggtgattaagagtacagatgctgaagccagcagcctaagtctgaatcctgactgccaattattaatataagttgtggaaccatggtcaagttactcaacctctttatgcctctgtctcctggtctacgaaatgaaggtaatacctatttcacagagctattaatagaagaaaatgaattaacatgaaagaacacctatgataatacattaaaacattctaagtgctcaagtgttcactattagcattttaaaaattcttttaagtaatgtgggagcacagaatgggattaatcataatccttagttcatgatatgctatctttattgagccatgcatggctctcatggttattttaaattcatttgtttatatttttaagtataattaaggcctgtgaatgtactatccaacccaaaagtataacattcccaataacttacatctgcctgtgtgcttctttcatgtccatactcgagccttccctctagagataagtatgccctgaggtctggtgttagtattcattgttcccttgctatatatatgccccaaacaatactttgcttttagttagtattatttgtttcaaagcactataaggacccagtggctttcttctctcattcttgaaatgcctccttagctctaatctaataacttgagtttctaagataccagtcaaattttggcagaagttgaacttccagtctttgtatctcccacattttatgcccccttgcatctaaaatttagctaatcattcttgttcttgaatagaaagactaaataatgtaaagaccaattttcccaaatttacacttaatatattaatgccacaagcaatcccaggagttttttttttttttttgtagtgtgtctgtcttgttttatgttgcaactaaggtttacactggataagaaatgtgaggcaaggtgaacaaagctgatacactcagagaaatagtatatgttaaaagcaaaagccaaacccacataggcataaaaaggaatgaaatcatgtcctctgcagcaacatgggtgcagctgaagccattaacctaagcaaattaacacagaatctgcggtggctcttgtctataattccagcattttgggaggctgaggtgatccacccggatcacaaggtcaggagttcgagaccagccctaccaacatggtgaaaccccgtctttactaaaaatacaaaaattagccaggcgtggtggtgggcccctggaattctagctactcgggaggctgaggcaggagaattgcttgaacccgggaggtggaggttgcagtgagctgagatcatgccactgcactctaccctgggcgacagagcaagactctgtctcaaaaaaaaaaaaaaaaaaaaaaaaaaagagaaaaccaaatactacatgtttccgcctttaagtgggagctaaacactgggtatacatggactctaagacgggaacaataaacacggaaaattccaaaagggggtaatgaggaaggagggcaaaggttgaaaaactgcctatccagtactatgttcactacttgggtgacagaatcattagaagcccaaacttcagcagcatccaatatacccatgtaataaacttgcaaatgcacccctgaacttaaaataaaaattttaaaataacccaaacaccaaatttctttcatctcacatgagattaggcagatcagactgaatgtataaaatgcattctttcattcattcactcaacaaaatttctatttagctcctattacgtgccaggcatacagcagatattcaataaacagaagcagccagttgcttcctccttctcaccttccttctcacatgcctgaataaagtttgccaccatggttcctgcctctttgctgttcttgggctgttttgacctcacccatgtctgaatctcctctggcagggtgctcagaaactgtgtcagcactagttgctctatcatctgctccttggtgaggatctctggctgcagccattgcaaacagagctcctggatttggctcacagcttgatgaggcccattcactgacaggtactgaaaatccccaaacttttgatgagaaactttcagtgtctctgtttctagtttcttctcttgaccacacacacaaaagatgtagggattcctcaagatatctgaaacccctgtcacatccagcatctctacaccttggccctttacaggacagagctactcttaaaggcaggctgctccagtacacaatgttgtggaagacggtaggcagggctgtatcagctgaaaggatacagaaacctcaggacctgcagaaattacatacagacttacaactagcctgcatagttatgattggacagtggagtgaaggtgatctgaacaagtattacacaaaagatgacagctataaatagccaatcaacataaaacaaggctaaacttcattagttatcagagatataggaattaaaaccccaataggataacactatgcaccctccaaaatgtccaaaatgaaaaagtcagacaataccaagtgttgacaaggataatagagccacagtaggatgatatatttgtatattggaatgctaaacagaaaatatgaatgttaagttgctgttgaatgaaagaaaccaggctcaaaaaaaaaaggtctgtattatatgattccatttatataaaggtcaaaaacaggcaaaataaacctaaagtgtttgaagtcagaatagtggctgctgttggggggaagggtggtaatgactggaaccaggcattagggcttctggaaagctaggaatgatgtggacacagtgtattcactttctgaaaactgagctacacatttgtggtttgtgcccttttccatatgtatattttgctaaacatttattagctgtattatagttgtaggaaaacatctagtcataatatcaagcggaaaaaggaaacctgtacataacaatatatgcttacccatataaagcagagaaaaggtggtaaaccaaaatactgtgccagtgggttaagtacgaacggtaatattataagtgatttttataggtgattttgtactttctctcaaaactattttctagcttcaagatgttctacaacaaaccttcatttcttctgtaatcacagaaataaaacataccttccataaaggctacactcactctaagaaaccatgaacaaagatgccacttggggaaaacatttttttcttttcttatccccactaaaacttacgccttttatttctataatttaacagtttttccatttgaaagcatttatttttgttttccattagaaatcataacgtaatgaacatcactgaaactaagtatttgctcccaaattacatagacaaaagggataaactgtttttaaaagttcttgacacaatctgccaaattttcctttcaacggctaccaacttcttcttccaaactcaatgtataagattacatgtctcactcagtccaccttacaagccaatagtgccatcttcatgggcttgtaatcagggcagtcacaagagccccattctcataaagcccacaggcctagtttaatgctttactgtcactctcttgaaatttttcacaattttttggacaaggagccccacattttcattttgccctaggccctgcaaattatgtaactggttctgccaatcaagagcattatcatccctcaaaatctgttgtcaattagacagattgaaaaatatatcattttattctttaattttacatttcttttgattaataatacggctttctctttgtttcagatttacaagccaattataaattgttcacgccctttgtgcttctttacattggggtgtttcttttttttcttttcttttttttctttttttgaggcagagtctcgctcagtcgcccaggctggagtgcagtggcgcaatcttggctcactgcaacccctgcctcctgggctcaagtgattctcaagcctcagcctccggccttggggtgggctccaggcccaccagcgcagagccgtcctgggtccctccctgcaggggcaccgattttagggcagtcagacgcagccctcgcctctggggtggcttttccaccacaaggccccagtagggcccgccgcggagtcttcctcacgaagccgcgcgctgccccgcgctggatgcctcttgcgccctcaagtccactggggccccagccccgcccaggcccctggctgggctacccgctcgccggccgctatcctaccccgggcccagcgaacttacctcgcacgcctcacgccctggcctggctgaacgtctccacgccctgaccaaaaccagcagcgcatgcgccgtggctggcttgcgcgtgcgctctgcggtggacgggctgaggaaccacagccgctcctggccaagtgccctgtgagacacgaggatagggttggtacggcgaggagaagggcggcgacgtaggagggcgctcctgtgaccttccttcttaaaactaacgccttctgttggtggtgggcgcctgtaaccccagctactcgagaggctgaggcaggagaattgcttgaacctgggaggcagaggttacagtgagccgagatcgcgccactgcactccagcctgggcgacagagcgagactccacctcaaaaaaacaaaaacaaaacaaaacaacaaaaaaactaatgccttatgtaagttttggagagttaatatgttacttagaacttgaggataagtggtaaaaataaaaaataacaaactaatttcaaaaatttgaaaataagcggtagtcagtgaaaacccttcctcacaccacgtgtgcaccattcaccaaaattttacccccaaaacatacgtaaccactgtaactgatctgaagtgccccaccaatgtttctttatacttgtagaagaaatgtatatgtatatgtgtgtaaggcttccctcagtattcctgggggatttgttttaggaccccccagggtatcaaattttgtggacgctgaagcctcatgtaaaatggcatagtatttgcatataatctatgcacatgcttaggcatactttaaatcatctctagattacttacattacctagtacagtacctacacatcattcttgcggatttgacagtacgcagcacacatggcaaatttaagttgtggtttttggaacttggtggaattttcttccaaatttttctttttctttttttttaactttgttagagatgatgtctcactctgtcacccaggctagagtgacagaacagtggcatccccgaagctggatgccactgctgcaggttggctccactcatgcccgaacctctaagctggaggctgatccccgctggagagcgggtcagtcctctaggcccagaaatgaccaagcaaagcttaccctctggctgctcacccatggacaactggggtgagcttgctcagtgagtccactaaaggtcccccaggcagtggggggtggggaggctgaccatatgcccagaatgagtgggacaaagagcaggcaaatgaaagcgttgccagaaaagggtcttgatccaaaccccaaaagagggttcttggatctcacacaggaaggaattcaaggcaagtcacagagcatggtgaaaaaggcaagtttattagaagctattccattacagagtagggtgtcgtcagaaagcaagcagacaaacacaccatctttgttttaagtttttaggggtcttgtctacgtaaagactaaactaagctgtgactacgtgagggtgagctgaaagcatgacaaaatttattattctattgatttaaagaggccaggcacggtggctcagccaggcttggtggttcacacctgtaatcccagcactttgggaggctgaggcaggcagatgacctgaggtcaagagtttgagaccagcctaatcaacatggtgagaccccctctctactaaaaatatttttaaaaaatagctgggtgtggtggtgcacacttgtagtcctagctactcaggaggctgaggcatgagaatggcttgaactcgtgaagtgcagtgagctgcccactgcactccagcctgggcaacagagtgagactatgtctcaaataaataaataaacaaataaataaataaataagctgtgactatgtgagggtgagctgaaagcatgacaaaatttattattatattgatttaaagaaaaccatccttagaaaggtgagagaggaattgaagggttgacagtgtagactacagaaccaggaaatgacctaccagcaagtcttttatgtgtgtgtgttcttttctatttctttctgtttattcctgttagtgtttgttctcttatgcctgtgaaaacctcctacatgtcaatttccatgcactggaggaacttggatttctccccgtcttaaaagtacctctttcttcttctcctccttcttcccctcctcctcctcctcttcctcctccctgaggccctaaaaacaaggtggccttggctgctctaccaaaaggaggatgattcagaggctgtgagtttaagggaccacttttgggggattggaagaaatctccattatgaggttaaggtacctatgggagactacctgagacagggtgccagtgatgcccactagcctcaataagacaccagggatgcctgagtgcaatggccaatatcggttttgtgcacagtaaggaaaatttagagcttaaatggttaatctgctgctacagagttaagtagaatcctctaaagctccatatcttcctttcttttcttctctgccagctttgaatctgctgttattaagttgctggtgctgaaataacacttattatttatgatctaactgaaatgggaacactggaaacttctttgaaactgaagaaaaaaatgaaaaagaagtttttacaatcaaaactgccatgaagactgctttacccaaaattttggtccacagctttcattgaattacttatcagggcaaacaaagtttagccatgtgaacacgttccaattttgttggaaataatttggatccagctatctttatacaatggtgagttcgtattgcatctcatggctaaaatactgaggtaaaggcttttggatctttgtgtgtgtgtgtgtgcatgtgacaaaaacaagcaatggggaaaggagtccctatttaataaatggtgttgggagaactggctagccatatgcagaaagttgaaactggagcccctccttataccatatacaaaaatcaactcaagatgaattaaagacttaaatgtaaaaacccaaactataaaaaccctagaagaaaatctaggcaataccattcaggacatgggcacaggcaaatatttcatgacaaagatgccaaaagcagtagcaacaaaagcaaaaattgacaaatggaatctaattaaactaaagagcttctgtacagcaaagaaattatcatcagagtgaacagacagcttacagcatgggagaaaatttttgcagtatatccatctgacaaaggtctaatattcagcatctacaaggaacttaaacaaatttacaagaaaaaaaaacaacgccattaaaaaatgggcaaaggacgtggacagacacttctcaaaagaagaaatttatgtgggcaatgaacattttttttaaaaaagctcaacaccactgatcattagagaaatgcacatgaaaaccacaatgagataccatctcacaccagtcagaatggctattacttaaaggtcaaaaaacaacagatgatagcaaggttgtgaagaaaaatgaacacttttatacgttggttggagtataaattagttctacccttgtcgaagacagtgtggtgattcctcaaagacctaggggaagaaatatcatttgacccagcaatctcattactgggtatatacccagaggaatataaatcattctattataaagatacatgtgcatgttcattgcaaaatagcaaaaacatggaatcaacctaaatgctcatcaatgacagacttgataaaggaaatatggtacgtatacaccaaggaataccatgcagccataaaaaggaacaagataatgtcttttgcagggacctggatggaaccagaagccattatcctcagcaaattaatgcaggaacagaaaagcaaataccacatgttctcacttgtaagtggtagctgaatgatgagaacacatggacacatggtggggaacaatacacactggggcctgttgcagggtgcggagtgggagggagagcatcgggaagaatagctaatgcatgctgggcttaatacctaggggatggaatgatctgtgctgcaaaccactatggcacacatttacctatgtaacaaacctacacatcctgcacatgtacccctgaccttaaaataaaagttggaaataaaaaaaaccctaaacatatacctactacctgatccagtgatttcatttttaagtatttacccaagagaaataaaaacatatggccacacatgcaaaagaaatacttgtacatgaatgttcttagcagctatattcataatagccaaaaatctggaaacagcccaggtgtcaatcaatagtagaataaataaccaaagtatgctaggttcatgcgatggaatactacactcagcaaaaaaggaacaaactgcctatacatgcgataaaatggatgaatatagaaaaacatgctgagtgaaagaagagttacacaacgaatgcatgctgtgtcattccattcatgctaattctacaacaagcaaaactaatgtgtggtgaaaataaattggtggttgcccctaaggagacagagttggagactgattgatgaggagcaagagggaattttgggattgacaatattgttttgtatattaatagagatttgagttacacaggtgtacatattttccaaaactcattgaataatatccttaagatctgtatgttttgatgtatgtaaatttgacctcacaatagaaaaaaaagaatccttaaaaaaatgaaagaactaagtacatataaatgggaaaaatgcttgtagacagacttttcatgtaatttaaaatcttataattatcttgaataataaatactcattagatgttgggtgttttccaattaaaaatgggttataatatgaaaaaaacatgtttctaaaaattacagaatggtttcagctataaaatgctaacatctgataaacagttcaagatttattgcttcctgagttttcactaaaatttaaggttactaaaagtaagaattgcaataatatataactctgtaagttgtattcttattgagaaaacaataattttatgtagtttagaggttatttaaaagttatttatttaaaaaggtagaaaggaaccagtaagtaagagagagaaagagagaaaagatttttagacataaagatgtatttttggtaagaaaagaaataattttatataagaaaaggatttcatgtggtaaagttttgtcctaaaataaaatgaccgattattttaaaagaggtatgatagaacaaatcaaaaggtccaagcatgtcatagatggtctgtgtaagttcatgatcaagtctgtggaagaaaatttataaaaggaattttgtatatgattaagttggctataattaataagaaattattcataatagtctttctgagattggtcccctatgttaaaacaaggtttcttgatggtattactttttttttttttttttttgagacagagtcttgctcagtcacccaggctggagtgcagtggcacgatctcggctcactgcaacctccgcctcccaggttcaagcaattctctgcctcagcctcccgagtagctgggattacaggtgcccaccaccatgcccggctaatttttttgtgtttttagtagagacagggcattcatcatgttggccaggctggtcttgaactcctgacctcgtgatccacctgcctcgccctcccaaagtgctgggattacaggtgtgagccacctctcccggtctctttatggtattaatttactattaatgagattgtaagaggttttgatttttaattctataatctttgacctatagctcccttatcctcagtggcctctgcaggcaacacactccctccttaccaatccccttcagactctgctgagggactcagcccagccactacctggagcaggacatttaccagccttactctatgatgccccttccagcagatccccagtgcggaaatagagatgtttgctgtacattttcccttcacaacttcagagctttataacggaaagtctcattctaaaggactaagggaagatcctgaggggtttcaaaacctcattcagaatagtttcagacccatgacctcaactgggcagacgtccagtcccttttaatattctcctcagtgaaacagaaaaatacctctgctctcaaaagggcaagggaggaagtggaccaatcccatagagaagagacaaacaatcctattgtagctctcagagcacagcagacattagacataaactccaaaaagtaaaattagagctcgatgctctcatctcaagactagtagacctggccaataaggtgtccaacaaccgggatagggatgaagaacataaagaagacagagaggacaaatggcaagcccacctactggctgttgccctcaagtgccagctggataactcacaggatacctatccataaagtaccacagctgaagagagtgatcccaggtcccctaactaacagaaaggatcctaaagacctaagggactaggaccaaaccaacatgccctctataagggggaggatcactggaaaagggactgtctccttcatgtctgaagggagggggaagagggcaggttccaccaggtgcctcacagaggcagatggtccaagtagtaaaaatgacaggtcctggggactcctcaattggccctccaggtgtccatcccccaggagcccaggctgacactgggcatgaggaacaagcctgttgacttcttggtcaacacagggggccacctacttggttttgaataccctcaaggataaaattacccaccaaaattgactatggaaacgtgagggaaggcaaaagatagcccctttattgagctcctaaaatataaactagatcaaacgagatgcactaaaagggatggccccaatgattaaaaagcttagaaaacagggacttctgagggcctgtcaatccccttgcagtactcctatcctccgtgttaagaaatcaaatggaaaataccaattagtgtaagatttaaggacaattaatgaggtcacagaaaacagaaacccagggtacctaatccttatactctatggtccactctgcctccaagttgtacatggtactcagtcctggatctaaaagatgactttttctgcattccactggccacagactctcagcctctcttcactttcaaatggcaggatcctcagacaggcaggaaacagcaactgacatttactgtgttgacccaggtgttcaaaaaacttccccaaaatatctggagaggccctagccatgaagctggaggatctgaccatttcgaatggatgggagaatgtgaccaagcattccaaaagctaaaaacccagctcacgagagacccagaattagccctacctgatttaagcaaacctttccatgtttatgttcatgagaggggaagaattgccctaggaatacatattcaaaggttggacccactgacctgggtaatgatctacttttccaagcagctggactcagttgctaaaggatggccaccttgcctttggttggggatggccatggccaccctttcaaaagagacaaaaaagttaactgtctggactccccaccatacccagaccctcataaaagaaagggggcagaagggctgtccccaggcaaggctctccagttacaggtaatgcttattgatgacccccacataactttgaaggtgtgtaacagcttgaaccctgccaccctctttccatctgaagatggttacctatctcacaactgcttagaggtgatggtgaagtgtactccagtagcccagaccttaaaagtgaacctactgaaaatgtggaagtccaatggttcactggtaggagcagctatctgcaagaggaacagaggagggcagatgtgctatgttctctcccactgaagttatacaagccagcgctctcttgccaggatgctcttcacagaaagcagagcttgttgctctaacccaggcgttagagtttggggaagggaaagtcctcaccgtatacactgattccaggcacgtgtattccatcttacacccacatggggctatttggaaggaaaggggcaggttaaactcttaaacgttagtgccatcattttaagattattggaagctggaagaaaaccagcccacatggcaatagtccgttgctgaagccaccagaagtgggacattgaggtaattaaagaaaataataaagccaacctagggtcaaaacaggcagctttagggaaggtcacattccaaatgccacttttgcctttcctcctgggtcctgctcttttaaccccagttttctctcaaaaggaatggaaaaaggcgaccaaatggggttataccaaaaatcctgaccatccaggatggctaataaaccctcgtggacaatttcttttcctaaaaacagttgcactgcaggccattaaaaaggctcactctaacacccactttggtgaagaaatcctttataactgattttgtgaaagcatgactgtcccaaacttcagggagtcaatcaaaaaggtggctgggactcatcccacctactatgttaataacccctgatacccaccccacgtggggatagcaggggtgagaggaactcagagagggctcctcagctggtccagttccaaggtagatgtccaggggaagatgagaaagttttcatagttatgcccagaggcctgggaaactttaaatacctcctgatcttcactgacaccttttcagggtggatagaagcctttgccacctgcactgacactgcacatcaggtggcaaaggtgctattaaagaaagttgtcccaagaattgggctgcctcagtcaatccaactgagggaccagcattcatatcttccattactgaagctacttctcaaagcctagaaacaagatagcacccacatgctacctggagaccgcagtcttcaggtaagcaatgagtaggtgtagcgatttctgtcaagactattattcctacctaatggttatttcctcttctacatgcttgacgtactatgatctcatgtaaccctcacaaggtagcctctgttgttatttctccattttacagaagaggaaactgagacaagaaagcttcactaacttgtcccactcagtatgattagaatgggacaggcagagggttaggattagaagtgtgcatctaaccttcttcaagggtggaaatttccaatcagttatgttacaaacatttgtaaaataggcatgttccaagaatggtacaagtaatgcactcacttaaaccttatagtaaccccgtaacgggggtactaacaccagccccattttacagatgaggaaactgaggcacagaatagttaaggaaataacccaagattgacagctgttagtggcagaggcaatatttgtgaccaggcagttagaccccagagtctgggctttcagcttcaccaggctggcattttcagctgcgaggcatcagagtagactggagggttgggtctctgctctgtcccccttcctttgcagaaccatccttcctctgctccagggtttttcagccttggctctactgacattttgggtcggttcattctgtgtcctgggggtggggacactgtcgtgtgcattatagggtattgagcagcttccacctatgagatgctggtagcatcaccccttcagttgtgacaaccagaaatgtttccagacattgccacatgtcccctggagggcaaatcgttcaatcccatttgagaaccacagacttactccacaatttcattgtttaactttagggagagtctgggaccttccactgggaagggccaggcacgcaactcaggctgggccaataagagtcctacatcccccagttgtggattggttctgcagtagacatgtgacccatcatggaccaatcaaaatattccccaatccttccttacttgctttatctaagtgtctcccactgattgtttattagttgcaaggagggaaaccagaaagtattcagtgggtaaatcaggcaaccaccttgactgggtggatcaaaactagcatcaccagtgatggcatatggatctcttgtgggttaaaacgtgaggtcctgaaaggacacagaatcacttatgtggtattccaggaacgactgcataacctgaatctaattcataggaaaatggccccccaaaccccaaagtgtgtcagagtgtgacttagaaaccaaagaaaggctgaggaggttttccagattaaaggaggctactttacaactgctaaacacaggcctggtcctagccctagaaaggatactgtactggagaaaaaaagaatatttaaatggagggtatttagcaagttgataaaattggaatattgacagatttgataaaagcactgtgtcaatattaaatgtgcaaaggttataatagtacctcagttatgtaagagaaaattcttattcttaggtgacacagactgaagtattcagaggtgagctttgtgatgtgtgaaatctatgcccagtggttataaaaataatgtattaggtatatatataatagagtgtgcaaatgacaaaacaaataggagaaatgttaccaatcagtgaagatgggtgatctttgtactattcttgcaactttcccatgagctttaaattatttcccaatatttgtttgtttcattcctgtaatgaagagcccccaattaatagatgcttaaatatgacagatgtttatttctcatgtaaaagcctggataggtagtcaagaatcatcagacataagctcttatctcattactctgacatcttcaatacatggcttcccttttttgatccaagatggttgctccagttcctaccattatttctacattccagcctgtggggaagggggaggagagagtagaaggctggttgtgacctggaaatcacacatacctttactgtgctcatcccatggaccagacattagtcacatgcctacttctagctgcaagggaagctgagaaaatatttacttcttctaaatagccacataaccagtcaacatttagcaagaacaggagaatgtatattgggagatatattgttactgccttcctccccgtacatactgctgtggtctgaatgtttgtgtccccacaaaactcatatgttgatgttcaaaccccaatccaacagtactaagaggtggggcctttaggaggtgattaggtcatgagggctaagccctcatgaatgggattagtgcccttataaaagatgtgcaagggagctacctagcctcttttgccatgtgaggatgcagcaagaagtcatcatctttgaagcagaaagcaagccctcatcagactccatatttgctggcaccttgatcttggacttcccagcctccagaactgtgagcagtaaatttctgttgtttataaattccccagtctaagatattttgttatggcagcccaaatatacacatactcttggttccatgagggcagggaccatgtctgatttgtcccccacagaatgccaaatgccccaaacagtacctgacacttacaaatggcccatcaattattgaatgaattaaggtggcttgggagttcagagtcagagaaattttaagaagaccttgcatggagaagagacctcatggttcttgaataaaaggcaaaacgtggttataaaccaaaatgaaaattgacttctttcccagtgatccctgaagactaattcaagatgacaggcaaatgaccaacgtatccctttatgcgcttcctcatgatgggatgagggaaaaaatagaataaagaacttaaatcagaattttttgagaaagtgagttcccatttgtatcatgttatgattatacagacagaaactttccatatgttcagctgtgataggatagattcccttgaaaataagtcttcttgagtttggaatggtcatcaatatctctgacagggcaacaacaacaaaaaaacatgtctaggccaggcacagtggctcacgcctgtaatcccaggattttgggaggccaaggcaagagggtcacttgagccctgggcaccatattgagatcctgtctctacaaaaaattaaaaaattggctgggtgtggtggcacctgcctgtgatcccagctacacaagaaggtgaggccagaggatcactcgagcccaggaggttgaggctgcagtgagctgtgtttgtgccactgcacttcaggctgggcaacagagtgagaccttgtctcaaaaaaaaaaaagaaaattaaaaagaaaacacatttgtgctagaattctctgcttgcaagtaacttaaattcattcaggttaatttaagggggaaactggatcttactggaataatattgtgtagcttaaaatagtgagtaaagagttatcagtccttctagtaggacagcaatcaaagaagacttgttaatctcactagggggaaataatagactgccttttctcagtgtggccataagaatgactgggctttgaacaccttcaatccatgtattgctctactgaaaattcaaattcttgggtgaggaagtctgactggtctaccccaaaccatgtaattagtcctttgctggcatgagggaggggcagggatggtgatcagaaggaatggggtcaggatagtccaccaaaaccatgcagtgtgctgttatttaacggatgctgggcatacagaagagctatcctggacaattcaccctttggctttgtggaagaaaccatgcaattatcacggggaaccttcttgaactactttggtttgagagtagtctccccagattttttctgtactccttgctgcttcatatggtatataagtggtacgaggcatgcagtaagtcagcagacattcctgagaggctggtgggcaggaaaagtcaagtctaagtccagaatgaatctctattccatgaggctacaaaactgccctttctgtggttaaaagggcttggtatgatcaatcaatctgctgtctggctggtggggagatatggtaccagtcctggcttcttcatcactcctgcctttctaggggaggagtgacttaaactcgagagctggctagcctgcagacagtgtatgttcattgctcttcaccctgcaatgttctgatccccaacaattagtgtttagattcaacatccactaatccttgagaggtttgtcaaaaaatggattaaccatgtaaaagaaaccaagggcaggcagttcagccagactccacaaggcactggggtggatgaggcaccaggaaccaggattccctctggctttatggtctatttccttctaggcctgtttattcacaagtatacccagccccaacccatatgaccacctaggtagccctcactctgagtctgactggacacggggaacctatgggcatcaatcaactgacaccagggagaggtcaagtctaacagaataagcatagcagtagggaagttagttaccccttcaactgggttgtggggtggaggaaggaattgcccaagagtataaggattggtcaaacaacccctaatgacacctacttcattcccttcctttacagcctcttgtaacacattatttaggaaatccatccttaaaaagtcccaatcctcccaccctgacctatgctgatgctcgtcacagaatgaccatggaagctgtgaccaaatagtcagatgccacaagatataaagttctaagaacatgaaagaatgcaggactctgtcaaatcctagttagaattagtggcaagtacacttttatatcttaagaacaaaatccaatcatgtgacatgaaggatattagacgggcatgaagtacacaatcatctcctcctccgacttatggaatcagggacacagcagccgcaaattgggtatggtgctatccactgtggtcgccaacagggttccagttagcaagctggttgaaaagctctgatcattatggaatcacaggcatgtttaaaaattactctcagggatgacaatctactgaattgcatgggatgtttctcgtggggaagtcaggttaaagtatggttaatgaacttgggggaaaaacagtacagagatgacccactcaggataattaccttttaacctcaggcaagagtcaggaataaacacttgagattctataacatagtatcaacacttttatgttaagggtttattattgtctgtgattttttatgtttgagacaatctcacatttccaattaaaaatgcccactcaagtaactaagatgtacttgcggtcattatcaactttaaaaaaattgttggaacatatgttttagtttcataagggcagttacaaatgtgaaatcaaacagtatttaaaaatcccttagaagtaattgttgaaatagataatacttaaaaatagagtaagatttgcaaaccaaactttttaggctaaaggaggaactaagcttttggatttataactctaacaaaataacatatttaaagccccaaaaacaaaacagacaaaagagactgagaaatatttatttttaactttatttttattgttgacactattacagatagaatgaccacaaccatattaacaaaccaaaaacctgtgcacagaaacaagatgaagaaaatatatcaagatgttaaccacactctttggatggtgaaaacatgggtgagtttctcttctacatttctgtaacttcaaagtttctataatgaacacatttcatatataatggaaatatatgtagtaaaggtggactaccaaaacactagaatgatgacctttcaaggaaaccgaaacaaaataaccataatcccacaacaaccacacaactatttcttgtttttcatctttcttcccatctttgacatttatgcatacttatcactaacaccctaataatcacagactagtgcacagatcaagatgttaacagttaattgttgttgggtgttgggaatatgtgtgaattttctttactgaatttccaaagttttgtatgagtatgtattatatttgtaatggaaaatacatacataaaatttattaccaaaacaccaaagattatttaaggaatttgagacaaaatatttaaccaaattcccacaatgacaacactattttagttattttccacatcttttcatttaagactttatgcacacatatttaacactgttatcacaagcgtgtgcactgaaacaagatagaggaaacagatcaagatgttagcagtagttgttaggtgttgggaatataggtaattttttaaaataatttactttattttctaatttttcctctgggtatgtattatgcacaccaatggagacacacataatacactgttatcaggacattattatagggaacatttgaaaaaattaaagtgaaagtatttaaccataattccacaaaggtaatgtaacagctattttgaatatacattttgacacagttataatcataaacctgtgcacagaaacaagaatgaacaagataagaggagagtatatgtctttggatggtggggatatgattttttttcctccacttttctgtattttccaagtgtgtgataatgagttcaaattatgttcacaatgaaaatgtgatcataaactttttagtaacactaccataaagaacattcaagaaatttaagaaaataatgctcaactataagcctacaacaacaacaccacaacagcttttgactataagcatatatatttttaaacagttataatgaactgtttaaatgaactgttaaatgaacagcatataaatgaactgttgagttataactgtagtataaatatactttcgtgtcctgctttctccacttaatgttctgtaaatatatttccacgttgctacataactcgtgattatcatttttaaacagttgcattaagtgtccacagataggtttaaacaatcattctcttgtttaccatttgttactaccttttcactagctgaaggttggaacggacaccctgacttacagcaagttgctttctgaaaaggggctaccactgccaacaatgttaacaccaagtaatgtacccacaaagttcaccccgacatcaacactgattctcgtttcaagagtccttttcccatgtagtaaacctcactgcccctcagctttcccgatgtccgttccaacctcagtccttcctatgcagccagccctcacctacaccataccatcaaaaactccttttccaaactgctcaggacaccccgctcaattcattctcagaaacctggccttctacagttcttgcctctggtgttttcttctgtctgtctcctctcccctcctagatctggtgatatattaggactcccttctttgactcactcatttctgcttcttgctctcagctctacaatcttcctaaactttgacactccctgcatctttgacatacttccaagccctaatcctgcagatccagaagagtaagattcagacacatttcccccagtgggtactttaattttgcttgttcaaatgatctacacttacattttgcaaatctttttttttaaattttttaaattttatattttttttccagccaactcaaggccaaaaaaaatttcttaatatagttattatgcgaggggaggggaagcaaaggagcacaggtagtccacagaataggacacaagaaacctcaagctgtgaggtcaatttgtaattaaaagaatactaagattagatgaacacaacactcagaaatactctaggagagctgaaaaagaaggaacagatgttaacaaaacaaattaaggctgctggggaacctgagtccatgttaagcttgggttgactgtaaagaatttttttttttttaatgcaagttagacatggagttagagggtcagataaataacgaagagaattaagttagcgatagaaagatctaaggatactagctcctgggcacctagggtgcaaactgacttgtggcagcataagctgatgctgcacaggggacccaagccatgttgctacttgtcacttaaggcaggaagcgcacaaaggaagtgatgaaaggttattagcctgcaacattatttacagcatgagagcctctcctacggttctcaaccttcattaggcactactgtgatctagtgatggttgtaacccattctttaaaggcaaagatgtaagatttacagggaaaagcttcgggttttatcaattcactatcatcaaacacatattgagttggttaaaaaaaaaaaaaacccagaacacaaatgtgtaatatttttgcatgagaaccacttcaacaaacataacatgtggcaaccaatcaatctgggtcacaaaaagccaatccgtatattgtaaagccttacacagtattaggttccaaagtgttggcgcagatgaaatggctgcagaaagaagctaaagtacttatcttttcaaacagtaaggagtaaaagccatgttatctatcatgcctacagcttcacaagactatttaagggtaagaaacaaaacaattactcaaaaagatattgacagggttcaaataatgcacaataaatctttctcaggatctaagacacttaaaaatataatcaaatttgttgctctcttcctcctccaaaaaaaaaaaaaattcaaagaataccaggtaaggtacctctgcagagtaaactgtaactgtatatcatataaatccaaatatatgtgatcactgttctgtcataatttgctattttatatacacctcatgaaacactatatatacgttacacaagtgtcatttacagttgatttgggcaaactctgtagtctggaatactcatagggttttctcaatctgattacttggaaaggtaagatgtgtgctatggctttcccacatgcagacactgacatctgaaggggaaagcttaagactgtggaatctgcacattcggtctcttttcaatctgagtttagagatgttaagtcaggtgtgtaacacactaaggttaagtctcctactgacattatcatggattggtttggattctctgtggtttggtaagggtcaagtcctaggtgaaggttttctaacctttaccccatgccctcagccagtgtgggtattctggtgtctggcgagggacaggcggtcattgaagagctgcccacagacgtcacatttgaagtacttctcatcagcttgattggcaccacctgtgctggtgctggcacgttcgatgtagcctgagcactccccaaaggcatttgcaggctcaaatatgatcatgctggcatgagttttcaggtgttcactgaatgctgtgctggaagtgaaggtttctgtgcattcatggcagtcatagtatggttcttctacctgaatctcttgatcttcaccttcttctgggtcttcaattcccacaccgtcaggctcgtcggcatctccctctggctcttcagcttttccctctggctcttcagctctttcttctgggtcttcaatacctgcaccatctggctcatcagcatccccatttggctgctcggcctctccatttggctgtccagcctctccaatgggctctgcagcctctccatctggcccttcagcctctccgtttggctcagcagcctccacttctggctcagcagcctccacttctggctcggcagcctccacttctggctcagcagcctctacgtttaagccctgaatcctcagaactacttgtggaacatggacattggcttcaacttcctgggctgctgctgctgcagctgctgctgcttcatcttcttcttcttcttccagatgaagctccttatgtttagtgaggactgtgctatgaataaaggacttaccacaatccttgcattcatagaatggtatagctcctttgaggggctcagtaagaaatgaggtgtgagtataggaggacccgtactcatagggctcattcttatgaacagttacgtgatctgcaagttctgctgggttgacgaaagattctccacagactgcacattcaaagagtctctcttcggtctgacttctctgaaactcagtgagggctaagcctggaatgatagcttcctcagccatctggctctgctccagtaaatcatcttccctatgaagtctcatatgctcattaagggcagagctatgaatgaagccttgtccacacaaaaggcatcgaatggccgacccagcaagagcaggattcctctctgcagcacgattcctccgtggcttcatgggcaagagggcaataaaaccatcatcacaccccttcatggaatacaactggtcttgttcatggattctctgatgctcgaaaaggaatgagctatgaataaaagattccccacactttggacattcatacagctgctctccagtgtaatctctctgatactcgctgatggaatgggtgtgaattacagaatgtgtgtactcccgactgtcaaccaggcacttcctgctgtggactttctgatggtctgtgaggtctgtgagatccacaaagcccaggccacagtcctcacattcatagattttgtcatcagggtcatccttctgagggtcttccatgtctgagccttgaatgacagggtcttcaattgtctcctgaccatgggtctcctcgctgtgggtctcctccccatcagtattctcgccttgagactcctcgccatgagacttctcttggtcatagattttctggtttgtgttgaggtcttcgctggtagcaaaaaattgtctgaagtccttacatttgttccgcgcttgctctttagcatactgctcttgggcgtaacttgtttgagggtcagtaggggccaagctgcgaatgacagaccattcatagtttctgcttccagagggcttctccctatcatgaatcttctggtgctcagtgaggtcagagctatgagcaaagcactccccacactcctgacattcatagagcatccctcgagggcgaaatgtttgttcaccaaaaggcagagagtgaattacagaggtctcattgctcctatgctcaatgtatttctttttagcacgagccttctggtattcacggacatttgagctgggaacagagaattcgccatccttcttaaactcaccagatccctctccaggaacacttttctgaggtttggcacggaatacactctgtatgacagagtcttcatagttgcgattcttactgcccccttcacaagggttctctctggcaggaatcttctgtcgcttatcattaaggtctgagatataaatggaggattctcccttctcattagattccaccaattcatttccattgtgacttcttggaggtttggaagccactaagctatggataacagacctactgtattcccttccttcagaggtgttccctccagcacgaactctctgatggttgatagcatcgaagctctgaatggtagactctgccattacttttggtttactgggccctgctacactgtgacttttctgagcttccacagaggctaagctatgaataacagacctctcatatgattttgcctcatagacattttccttagtgggaatcttctggttttcataggggttagagctaatggtgaacgccttttcgtcctcatcactttcaagaggtcttgttatagtatgactcttctgagattcagtgaatggcccactatgaatgacagatttctcataccctctgccttcaaagaggttctttcgagaatgaattttctgatgctcactgagctctgagctttgcatgaaggcatcccggccatctgtaaagtcacagagcttctccttattgtaagttttctgacgccttttaagggactgaccaggaataaaggtttcctcacacactttacccttgttttcaaatgggttccctctagtatggattttctgatgttctttcagggatgagctatgaaggaaagtctccccacacaccttacattcgtacattttctctttaccatacattttctgaaactcattaagggctgggctgggcctaaaggtttccccgcgctcacgttcacgttcacgttcatgttcacgctcattatctttgtcatccccaaagtggattttctggtgctcaatcagggcagaactatgaaggaaggtttccttacacaccctgcactcgtagaatttgtctttgccatatattttctgaagctcactaaaggtggggctaggcatgaaggcttcctcacattcctgattcttacattccacaagataacctctagcatgaatcttccgatgttcagccaaggcggcactcttattgaaggtctctccacagtccttacattcaaaacgtttccctccaacctgacttttctgaacttcactgacagccacactgtggataaaggactcaccatactcatagaggttctctctagtatgcatgatctggtgctcaacaaattctgagatgacactgaacgacctcccacactcatcacatacatatggcattgccccaaaatcaattggctgtgactcggtaaaggagggggagctgaggctgctcaggctgctcacgctcatggcttttctcatctcactaccacattcaaagggcttcttcctgggacagcctttttgatcgtgaatcgagcccttcccatctgtgtcaaaatgatagcgcctctttctttcaagaactctctttctggaaacaagggttgaattaaacctaaagcctcccctaaatgcattcccttcataaacccgctgctggatcactgactccctcttgttcaatgaaatgtccttccagttatcatctgacattctggggaatctctgtgaccggtcgcttgactcccttgctcttcccgatttggaactgcgtgacacatccttgatgaatttttccattatcactccgtgggaagattcatcttcacaaatcccccgccggtgggttgattttttggcttcaggcatagtttttagacctggaaagaaaccccaaatgtaaatactccctagtccccataagaaggacagtgggacttggaggggtgcacccttctgtgatgtttaggaatgcaaagtgtagaagttccttgatagcatctcactggttgtgtggctcctctgtgggatgtgcctcctgcttacctcgactggtgcttgggtaggcacttctcttggatcttgatgagtggccctgcgtcatgtgggagtggccatcgtcttcagcaagctgcactcctggtcacaaggacaatatgatgcctcaaattcaagttgaggaccaagactcatcaccataaattgatcttcatctttcactgagccactaaatatgaggtggcccacatctgattccttggatgtcagaagacatttgctgtctcatttccctactatctattccctaatccattctaatctacatgtaattcttctgactccactcagaaatgtgtacaaagaccccacatgtccctgaaatcagtgcattgtcttttagtcttcaccttcttgtaaccactttttaagtcctcttttccactggccttcttcctcttacctcgcgactgctcttcctccacccactcccttgaggccccatggccttacagacctgcagcacagccaactgcccactaccaacttgggctagatgtcttccaggaaagtccacatgggaactcaggatcccatcctgaatgtctacttaaaaacctccagtgctaccactctggaaaaaagtatcaactcttgtggcaagaagcatctccctgcttgtccccaccctgtacaatgtatctttacccaaagccagaggcatttcttaaaaacacaaattttatcatttactccctcatttgaaatctttcaaagatttcttattacccttgaagtccaaatatattaatgtggactctaacatccagcttaaaaaggagcaagatgacaaaatgctccaatgactggactgggagtgactgagagaagcagctgcttaccgagggagagcagcttcctgtagttttccatgttgtcctggattgtgttgtgaggtttcctgtcctcagcgaggtccaccacattttggtatgattcagcatcctaaaacagcaaacacagacctctcaatggagtctgtccccaccgatgttcaaagacagaataatgttggcaacatgggagttacatatatgaagttatataggaagtgctcacggtattggggttctgagtgatccaagtcaagtgttactagggacctacgtcgtacctaccttggtgctacactctgaggcagatcccaaagacgcatgacacatattccttgccctcatgcagcttataatttggttggagagaaaagactcatgaaacaattagagaacaataaacaataaatcggggtacagatagtaagtgctaaacgggttttgtagagggacagttcagggtgggcctgaacagtgtgcaaaggtttgtggagggcaggtggggccttaagtggtaagtgagattatgacacatatagaaagggattggtgggaaaacttagactaaatatcaaacaggcacggagtactcagggaacagaaagaagacacacacattcaggaagacatctggtcaggatgtgacttaaacctccctcccggtttctccatggcatagcatggctacattgagggagtctccagtttgcacaatttccaaatcacccaggaataactgtaagccctgagggcatttttataattgccttttctgtcttaatggatatttacctaaaaaggaattttaaaattcctcacattactgaggagaaccttctaccaggattctaaaggacctttgcttattgccagagggctgactagaactggtttcagggagtcatggtcccaggaagaatggcactgaggctggagagagacttgaggagggagatggtgctgtgggaagcccacaggctttggagctggacagagatctgggtcaaagaaggattgcaccaattatgagctatgcagccttgggaacggaaatctttttgaacctttctttcaggttcttcacctgtaaaatggggagaagagtatctatctgctttgcaatactgtgggtgaggattttctgcagtgtgatgtcttgcttaaatattaagaaaattatgtaaaggaaatacaaatgtcttgatattaaatctaccatagttctattgctgggaagaggcatggagcaacatgaaaaatgtagcaaaaaaaagaggacttgctgagtaagcaaagacaaagaggtacgggtatctgggtttaagagggaagccttatccatgaactgcctgtgtcctgccacaaaaaagcagaaacaacaacaaaaactaagtagggcaaggaaacacagcagagcttcacagataaaattcttttttcacatgaaagaaaaagcacgctttgattgaaaattaaaatctaggccagtgggcagccctaaattggttgttcgctttgtgtttgtaatcaacaatgacatcttaatgcatacaaactgcaatcaagttcaatggaagagatgctgttctgaaaacaatgctagtatggctcaatgtagttttcacaacatgatctatacatgtgaacaattaagaaatttacacatgaagctaaaagatgagagaattttctgttgtgtacaccttcaaaatgtaatttgtgtcatttgctgctggtgttaccaccatactgagtcagtaggaatcagtagcttccagacttttaattatgcagacatggggctcggatgccaattcttcacacattgtcaaggaagggcatttaaaaagcaaaacaagacaaagcccaactaccaagacaccagtggccaggcccacacatgcctccagccttcttcctatatcccagccacctggcccttggtttggttcccatcccacaactttagctgagctctccctaatgcctggggtcccctcccccaacacctgacccggcgtgctcctggctctaaatggcaactgttaatgcctccaagacatttcccttcaatccaaatcaaggcccttgttacaatttcttgttaactctctatttttccttgaggacactgagaatgatgagcagttatatacaacatttgtgtcaatacttatttgtgcaactgtcaaaagcttctcagggcagggcccctctctgtgttgctcactgctgtgccccccagggcctaggcctgctttctgacatgggatgggtactgatatgtgaaggaaaggaaggctcagcccaatggcttctcccttctttgagtccagtcagtgctggggtcctcctccacactccaccatgtataagtgacccctctcctccttcctaaaaaacaagctcaagttccacattttttttcccttcatgaatctccccggcacatgctgcctcttaaaccacaactgccataattgttaacatttaacggtgtgcctaccatgtgccaggtactttatgtatgtgtgtgagtgacttttcacagcagccctgggagcaatcaccatattcattttacagatgaggaaacttaaattcagcttatgagtaaatggcccaaggccacacagctagcaagtggcagagccaggctttaaacccagctcctgtcagctccagagcctttgtgctccctggccagtctactctgcagacccacagctttcctggctccctcctgaggaccagaaacatctccagagtcactctgcttccctggccctgtagggaacggccaatgtgaccaacctaccaagtgacacacatgctgagggggcaggagctcctctgaccacatgaacgacaaagaaacagccagcagcaacctgggctacttgtcacctaagggatgggcccgggctcctcctggagcgctgggactctcaccccagctggactctagggggcagataaacacaccatctggggaaagaaaggcgtctctgccatgaaatgaagatggcctttctagaaagagaggaaacctgagcatacctgagatcgggactcataagccctggagtccctgtcgtcctctctgtccatttcaaagcttgttttcgccaccacaggaagggaaagatcccgcggaggcatccctgggaagaaaaaaggcatcaacaagaagcagggcccagtccatcctgcaggtcccaggtttgtcccactcaactatgaagccagctggggtgtgagtgtatgagagcaagtgcctttctcttctctgcattctgtggcagcctctgaggagtcccataaaaccagtggccctacaacaacccagacccagggcagggccaggggccctgcctcatccttctgctcccagtctcggaggtggttcagattgtgcccaagctgtgtgggtccaggtacagtgtccactagcctcatccttcgggcacaacctctgggtctccccagctgcaatgtgtgacagggagatggcatcagagaccgtcccacagggtcatggctctgaacaatgcctattgtgttgtgaaccgtcactaaatgtcactcactcctgatatccttctcctgatcaattttagggtgccctgctgcccacagcagtgttctccaagtccaggaagaagaggaaatgatttccagcagtatggacaccaacaatacactggtgtgatgattgattcccttccaaatctcaggcctggtgctcagatgtggcacttccctaacactgcaggaagtcatggcagacattcctagttaacaatattgttacaatgtgtttttcattctcgccttctgcctatggcacttcatactagttttcaatttttgcagtggcatagtctttcatacagaaacttccagtttttttttttttaatgcaccagcttaagaatactgagcaaatagtttaggtggcaacaggtctatgtggtgaaacctgtgctggtggtaccgagtggaacttcaaaaatacgagccttggactaaacttttggggaagcggaatatactccaaatggagcagcagaaacttcgaggccctggcactttccccttgaacctgtgcacagcacatgctctatatctcctactgggaaagaaagtggttaagactcactgcttcttgggttcctggtgtgggaccagcggtctcgtggctccatgtctctgcttctgcccctccggtcccagtcccggtcacctaagcaggtgagacattccagtggttaacaaagctctttgacacacctgttttccctgcatgtgcacaaacacccctctggaaagagatgctaccctcttcccacaaggagatggatccaaaacagagagctccaggttcccaggctcatctggccccttctttatcatatacccgcaacatggtttctgcaggctttgcccaagtggggcttgcttccaagcaagttccaaagctcagtccagtagctaacccccacttcagactctttgctggcttcccagttcctaaggggctgagtccacattcaggagaatggactgcagaccccctactgtctggcagccgatcttaaagtacacgttattctactacaaaaaaaacaaaacccaagaaaacaacacacacaccctccctgaaagcagtgctccctataaaagctcactgaagcatctttaatgaaccttcctgaggaggctgggggtacagctggaagcagcctgttgcaaattccaaatagctttatatactttatcgttgaataaaacggtattaagtatttaaggtgtctgtttagatataaaaatgtctcattatgacatcaattaatttaccctctcctcagatctctgagtgaagctgaccactcggggatggcgggtcatcttcatggaggccccaacccactgtgtctccatctggaagcatctggcagcgcctgcccatgggtgaccagtggggatgggtactcaccactgaaagaatggactgagtgaggtggtgaggactctcttctgttccgggtcatgtcgtcgtcgctggtcacgtcactgttgttgtcgtctaagaggacaccggtcgccaagttactatctctggcccacattctcacaatagttccccccaatccctgagccgcatctccctgtcacagacacacatggttggaatgacctgatcctgacatttctgagttcaaaacccttcagcggcttccaaccactcctggcatactaaaaactgggtggggggagcatggtggctgtgaccaccccgacctcacccccagacacaaacagccagaaggcaacctcctagcacaccacaccaaaaaggcaggagccataggaggttttctcccttctacagaagtgtctcctttccctctcctgactcaggatggtggttctgcactagggaggttttggcgaccaggggatacctgggcatgtgtggagacacttttggtggccacacccagaaaatcatgatgcagctcaatatcccacagtacacaggacatccccaccgctgcccaggacagagagttatccagtccagaccatgtcagaagtgtggaggctgagagccccaggggacacctgaggcctgcactgaccaccaacaccccgtggagactctcaccttctggttggtacatctccttgtaattctccagcagagtgacgagcttctcacagttctccggcttttttgctcgcacccaaggcttgagcttttcagggatgatggtcaggtactgctcaaggaccaagagctcgatgatctcctccttggtgcgggtctccggctgcaaccaatcgaggcagaggtttcggagtttgatcagggtcttccgaggcccaacaaattccacatagattaggttccgaaacctctgatgaaaaaactcagagtcagttggaccttctcctatgatgacatccggctccttagtcaagtcactgtctagctcatacagatttggggcccaggacttcttaggtttggtggcagacaagtgctttggaggcagcatttctctaagtaaaattttcactggaggaaccaaacatgagtcaacaggaaagacgcggcagcctgtgaccgtcagtactcagggacctgtggatcgtaaggagatatacacatgtcccagaagttgaagaccaggcagcagtggaggccaccttaccagaggcatcgacaatgcttttgggatatgggagtccccagtaaataggcaaacaaccgcacaaagttggcctcagcacagcagttacaagcatgacctctgggcttcacagagacctactcgaggagttagctcggctactaacttgggctactaacttgggactgtgggcaacttgtctaatgccctagaagtctctctgtaatctgagaaataagaataacagcacctccatccctttcagaattgtgaagcttaaataaactaagatacctaaaaagacttaactgcccaatgcaaggcacaagagaaatgttcaaggccctagccagtactaaaatcagacgtcagcacgtttattagcaaaaatgaaaaggggaagtaggagttggggcaaatcctcccctaacatttcttcccttaacacaattattaaaacacagtatacaacatgtaaaaaatggaagaccattcaaaaatattaaaagtactcaactctaggtaatatgacattattccctcacacagtgagaagtgaccattgagcctcttgatgctactgcacgttcttttgccttcatcaatcttgacaaaggtctaatctgtctaaaagaaccggctttctgttttgacattcctttcttactgtttctttacttagttcatttatttccttctctttattttattatctgcccccttccattttttaaacttttgagattggacataaatgtaaagattttcaatctctccttttttttatgtaaccaagtaaagctatacatttccttaaagcatttttgctattatttgcattttattgcgtattttaatgactggtcagcacatctggtgcaactaagtaaggcaatatgggaaagaaatctaggtctgggagcataaactacctactggctttacttccagagaagaaaaaaaaccatatgcaacagaaattttctccctttgttttaaaaggaaagcaagtttaaattttttaatttggaaaaagtctaaaggaaaactgaaggtgtttccattattcagagtctctcattagacattatcacttgcaaatcaatgtggtaatcacggtaaactcatgtttactcgtctcagtgatgggctcccacttccctccctatgcaaactgccctcccacgctctctcctgcatattatcatcccatggagcttgggcaccatccaatgcaaatgcctcgatcctgaagaccttagcgactggactatttccttgctgccttccttcataggactgagaaaccacggagagcacaacatagataatgctctgctgggcagaagaatcccaaagcaagggaaggcaacagaccagagagtccaggctccagatgattggtgtgacatttcagacatggtcactctaacccaggacagggcaagagcagaggtctgtgcctgtgagggagacaggcaagggcagacggcccaactctgttatgtggcagacagactcaggagaacactctggtacctgaaatgatactagccctcatcctcaggcaacaagataccctcagatatgtaatcacctgtctgggaacaggatcctttctggaacttcagaccaagcagctatccacaggaacagagtcaaaacacaggtatctgcagaagttttaaaggaagaaatacacagactaagaatatgaaagacatgtagaaggagtgtcagagaattaactccccaaacaactggggactcaaatagcactggggtgatgccttctataccttcggggaaaggccattcccatgctatataaaccatgccagacaggagaaataaaaagctttcaaactgtctttatgaaaccagaacaagtcaaaaacgcaagacaaagatatcactaagaaaccacgaaccaaaactcatgaaagcagaaataaaagtcttaatgctgctattattgaacattattctatgcagttctactcaattacaataagacaagaaaaacacatctgaggcacagagagataaaactaacattcccttatgtaagatctatacacatatatatgcttctattctgtgaatttctctccctaacagacatgaattgaagcataaagtaccctaggtgaaagctatatatcagaatggcaggcttatagagttcaataggaaaccaataatttttttaaagaaaatacaaatagcccaacctgactcaagaagcagagaaaaatatgaccactagggaagaaatctaaaaagctgaaataatgtaaagagcaacttcccaagtaaactttctgtgaataaaatatttaccgtgttataaaaaccattccagagcacagaaaagagatggaggacttcctacaattaattttgtgaccacttgaatgcccatatgtatcttgtcacaaggtggatgccaacttctgtgccaaaaaaaataaaacacattgcttttcctcaagaaattcaggattaaacatacacaatcttcccttaacatgctcaagattttctgaccaggccaatagaacttggcccttggtcaatagaagccattgaaaaatggaagttatttttttaacagaaaaaccttaaaaaaaaaaatcagatctgagctacttcccaccatggcagaggaaactcatttgggagtaaagaaaggctttggaaacaaaacaatcaatcataaagccgggcaacatatgtttgtatgcacgggaagaaacaagtacactcatatactgcctgtggcaatgcaaattttatcaaaattaaaagtgcacatatcctcctctcctacaaattctacttctatgaatttacctcagagatatgtaatgacctatgtgcaagaatatattcattgaagtgttgttaatagacaagatatgttatgtttgtataatgaattactatgaaaccctttaaaataaggcaactctaaataaatgagtatgaaatgatctccaagatagttaagtgcaaaaccggacacagcactgtatacagcattctcagaaactaaaaaaagatgtgcttagacagatgatttctagaaggatatataagagactattaatgatgactaatcgcaattgcctctggggaagggaactaggggtcaggaaagggagggcaacttactttttcattgtatattctccttttgttttttgtttttatttttattttaccatgagcatgtattacctagtcaaaaaaataaattcaaagttaaaacaaaacaataaacaaaactaccagtagaggcctttagaggttgtgctactcacagagcaggtgcaggcagccgtaacatctttacactgatgctgagcccaggctctccccgcatcgcctccctatcaccatccacagcttgaatccatagtcataccctaacctggccattagcaggtacatgaaagtcaatttagaaaaccctaaagaatcaactttgaaacctgttagacccaataaatacttatgatattgcagttgcaatctgaatatacccctcaattacacccaacaactgtcagtacataaatacaatgccatcccctatcttggcaattccacttctgaaatctaactcacagacccatctgcccatgtgcacaaagatatacagttcaaaagtgtgttcacagaagcactgtttacaacagcagagaacagggacagtcaaacaaatgctcaagcgtaattccaatggcagagaccactgaaaggccaccacgtgggagacaggaaaataaagatgggtccaacttttctgcactataaaaaccaaccaaaataaaaaccaagcaaaaagggagggggaaaagtattttataacacagatgacagttaatgtttgaaatgtaaaaggcttttggcattaggaaaaatagcccaatatgaaaataaacaacactaatacacagagttcctaaaattagtgataataaaggccggttacttaacatcaaaaatcaaagaaatgtaaaatattacaataaaccttttttgacctgtcgaatgggcaaatgtttaaaagatgaaaattgatgctagtgagggtgtagagaagctagctggtgcaggcatgaaccacatttctggatcccattttggccactgtttaaagatactaaaaaaaacacctacttcttttgaaccagcaattctccatttaagaacaaatatagccaagtagataaaatgataataagaaaaaaaagctaaaaagtcagctgcagctgggcgcagtggctcacgcctgtaatcccagcactttgggaggccgaggcgggtagattacctgaggtcaggagttcgagaccagcctggccaacgtggtgaaactccatctctactaaaaatacaaaaattagctgggcgtggtggcagtaatcccagctactcaggaggctgaggcaggagaatcacttggacccaggaggcagaggttgcagtgagccaaaatcgcaccactgcgctccagcctgggcaacagagcgagactccatctcaaaaaaaaaaaaaaaaaagtcagctgcacactatggtttaacctttgtatgtacagctaatttctggtttgtaaaaggtaaaaccttgaacacaaaataatggcaggtaacacattttacacatggaatggtgggaagggacgagcaccactgacagggaaacgtgttctgttgtgttactgctatgtaaccacagtcctaacacaagtcacattagagcaacccagagccaaaggcaggaagaggaagtgctggtcaaccttctcctgcagggctacctgacacaaggtgggccatatgcaatgaggttagctgccttcctggccgagtggcccaacccttagccttggattcaacccgtcctctacttgctgcccaaagggcaactagcagtggggccagatgctgaaatttgcacctgccagggccacatacttacctcaccctgactggggaagaccagatcccacgtgaccttctgtgacagcgagtctggccaatcaaaagcataactgctctgcccacttggcccccacttccccaggccagcttctccatggcaacagccacgcctaccactgaagaaaacagaagatacgtgtttgcaggtgctgagaggaagaaaggtctaaaggcttgcctgatgctatcaaatgaaatattaaagctgaggagttaatctgcctgaggatggcctaaacgggccatcaataaaaacgtagcttattaatcagagctgtgcttgaagatgtatgaatccaacagaacaacagagcacctgtatttataccctaccgcaaggctccatgggcaaagactctgttacctttttcatctctatatttttataggtgttcaataaacattatttgcatatagatgcaaaaacatttaataaacccaaactaacaaagtccaaataatagcccatgatcttgaaaggctattccaggaatacaaggaggatgtcccatcagggtaaactgttacataaaggatgaaaggggaaggggagcccacaagcagtatttcaagttaaaaaacatttgcaaacttcaacagcctttcctcataaattcttagcagagtaaaagcaggagaccatctaagcattataaagacttatctcaaatacatgcaaacaagcatgttattaaacattaaagatgttcctctggaagtggggacaaggaagggacagctataccacaactacaatttaacatgaccctggaagtcctagctagtgcaactgaagaaaaagaaaagtataaatatggggcaagcattattttgaactacaaaaccttatgagtaaatacagcaagagaaataattcccattaatagcaaaacaaataaataaatctccataaataaatttaacaaagttacctgcaacttcaaacaaaatttcaaaaatttacagaaggaacacaaaaattagccgggtgtggtggcatgagcctgtaatccaaactactcaagaggctgatgcaggggggccctgggaggtggagggggcagtgggctaagatcatgcccctgcattccagcctgggtgacagaactagactgaatcaccaaaaaaataaaaaacaataaaaaataaaataaaataaaataaatgacagaagggcaataagtctgaaataaatacataaagacacgtgtatcacatttaaaaagctcctttttattttgaggtggggagttttgacaaactgataatccagttcttctggaagaataaatgtacaagaatatcaagacaaccctgcataaggtctatttggagtgggaggtggtttgtctgtaaaatgactccaacacacaaaaataaagtgttttttccaatataaggatataagcactaggacaaatataccactgggacataacagagtccagaattcaactgtgtaaaagtctatagacacatggggacttaatttataataaaggactggaaatggattccttatttaaatataaactaggaactttcttacagctaaatggcaaaggataactttaacaaaaaggccatgacaggaccgctaatacctcagtgtttggttactcaagcatgcatttctagaattagggttggcctttgacgttaggaaaggccaatataaccactgctggcatggagcctcccctaagaaattaggtatttcagctacacatctctggaaggctaaggccactagggccagtgacaaacatactttgttctaagtaagttactgcatccaaaaatcagcatctctcctgagttttcattaaacaaggaatgaaaacaaagtatttagcaaaatgttacataaccattaagtcgtgttgtcaaggaatgttacagctttattttctgattataaaaataaaacacagcactacatgcaggtattgcaaaacattcaccatagaaactgcaagccacacccactggttaactttgttgctattaataaatcttaaaatctatacttatgttgttcttactgcaaatattcccatttacgtgtacacagagaatgagaatgtccacacaatggaatataatgcagttttcagaaagcaaagctatagatggagaccttgagtgtgaactgtttaataaatggcatgatctcatgtatgtaaaaaataatcaaacatatggcagtacatacaaactaaactggaagaaaactcacataaacttgtattaagactattcataaaatagaggaaatctatcagaataaatgattaataataacaagtctctgtttctttttccatctctatttaaaatgttattttaacttcgcaatcaggaaaaaaactgaatataaaaatgtaagtaaatgcaattactgtttcctagcgtgtttgttttccttcctgcccagcttgttacagcacatcaggccctgccctttctctgctgggttccccataatacaatctccctctgacccttaagcactcccaccgacagtaccctgtggtcaccatctgtacctcccctctccagtgactgtaccacagagggggctaacacgcatcaagctccacacccaaatcctcacttcattgacagctgtctagccgtcatatggctcaagactgaactctggcccacagggcaaacccatatccttcctggcttgaaggtgggctcccacacacccctcattactaaagcttccatatctccctctgctctctcttcagagcaggactcagtgttaagtagtagccaacagcagttaggggcacacaagggctagctgactctgggccaggggacaaagaaaggtcaccaacttcaaggggagggaggagaggcgccaagtgatggggccactaataaaggatccctctacacagccaggcaggaagggtgcttctgggagtctggcgttctttgatctccaaaggatgttttctttacactagatgtctaaacatgaaacctctctgtatacagaacaagcctggcgctgcctgctgcatgacagcattgccattgaagtctggatggtggtactgatgccattctttggatattttatgacactttacttctattccattaaaatgagtaggaaataaaagcatggctcttacaattaatataacacataataaagatgaaactcatcaggcatccttgccagaagtcagggaagatccatggctttaatcagagaaatgatgggtcagtgttcaactgagcagggaagaacttaatgaaagaacacatcatgcactagaaagcgtctgggaccatgtgtgagaagaaatcctgtgactccggtttggcctcaggctcccacatcccatctgatgcaggagaaaatccaccgagtctccttcagtcccatttctatttacttactttggtccctcaccatggtgcacctagattcagccccctaactcgttctacctacctcattaaaagggggctggaattgagaactttaaagtcaggaaccgaggaggttactctcttcgtctcccagggacagcgtggtgtgtggtctcgtctctcttcttgtttgctccattctcctgcctctctctgcagaccgacattctctacttcagcacgcacatggagtaagatgctgtcccagcccaggcctacgtcacctcccagtttaaatgcccgacactcagtgtcccttcatccaaattctcagtattaaagtgcatgctacagcctgattccttctagggcagtggttctcaaactcagatgtgcagaagagttgcctagggtgcttatgaaatacggagctacctttccaggtgggatgactcaggaggtctgtggttccccaggaaagaagcattcctacaatcactccaggagctgttctttgagaaccactgctctaaggtatccagtctggtccaatcacctatgaataaggtacatatgggacatagggactttagagggaaaattttatataggagcaaggagtaaatgaccaccaactccatctcacaggccacaacctccaccctctggtctgttggctggcttctctcagataatctcaacatcctgggcttatttctaccacattaagcttagcacttaccacactgcagcaaaatctccttgttgttgtccatccttgagagatttccccaaaagtttagaaagagaggaaataatatctaagagttcagtcttatgaccagcacaaaatggttcaagacaaataaagctactttaaagagacaaaatgtcttccagaacagtatgagttatttgactatattctaataacaataattggctcatctgatttttttaaggggagggagtactaaaaagtaggccacaaagcttggtccatccaaccatctacaggatagtgaacaactctcatcagacctaacttgaatggagtttggggaggacaagggtgttagataaggggcttccgatatcttggtaaccctaagcaagggtttcactgtgacaacatggctgtaccaggctatgtgacaaaccagcgctattaaagctcacccacatcctcttggttctgattccgtactcaccaagcaaccttctcattatggttgtgtttcccatgtaggtctgcctacagggagagaatttgctgatcatacacactgctgagtacttgggtccctgctattgtactcctaccatgaattaataaaccagaattgtgggaacaggaacatcctatttcaagtcacatgtcagtacggttttaagtctcctgagcttagttaaatgtggatctaccaacatgagccctcgggcaaaggaggtttccaagtctccacagggttaagcaccataatgcatatcttgagcactgaggccaggaatacaccaacccatcccaagggctcacctggtcatgtcagcttctccctaagcagtattccaccaccaccatagccacctatcttggtaaacacattcttactcttcttgtgatgggagtttccattcagtagacactgaggccagggattatgtcattcacttctggagactctaagcctggcatgatcctgtcctggatcaggcccagtatcaatgcttgctaacaaatgaacaaacagacaacctctagctatgtgcttgcttccccacatcatgtgactcactgtgcctcctctgaatcagtcagcaggccatgaacagagaaagtgaggagtctccctcctcaacacctctcaaataatctacccacttcactcctccctgtgatatgaccacaaaccaagccaccatctctcacccaggcccaagttggtctccccacacccactgcgtccaccctccccttctgcaccctgaaaccagatgatctttttaaaaccacaaatctgattatcatgatactcccatggttaaaagcacttcccgctgcacttaaggtcaagcccagttactcaccacagattacaagtcttttcacaatgaaaccacaacttaccttcttcctacctcaatcagatgccactcaacgattcccttgctctaggaatcctggattttcagctcctctctctgcatctctcaacaacaaccctatcccctctgctgagactactctccccatgacacacaccattcacactccttcagggctcagctttaatgttctttaccatctcagggaggcccctatgtggcctctctaagattaagtcagctgttgctagcagatgttctcttgcaaaagtataaatcaaacaattatgttttccacagctttaattcccaaatagactaaaaactctttgaaaacacttcctttcccccattggggctatgtcccagtacctggcacaaagtacacacttgatcaatattcacaaatgagtggatgaatctctcatgcttctttaatcaccaggcaagagaaaaagagtagccctgaaggagtagctgagtatgagaaaaagagggaggatactgaaatggatggtgtgaggccaaggagaatttttagagaatacacaatccaccagaagagtctgggtgttctcagagggcacaaatggtgctggggtggctatgtggaacacatatgcagtaggaaagtgtcagagtaaggaagtgcggtggtcactccaaagatgaatgtggcactgtgaggaggaaattcaactcacctggacccagccacctagcgtttggacctagtccctcttcctctcgccagtcgtctccaagaaggacggaagatcaagaaggcaaagctgtagaggaaaagaaaatgtgagacgccaagtttattttgcagttactgggttcctcaggggggaacaataccacaacagttccacatttatcttctatgatggcacaggtcaaatgagaccatgaaaagcatcccatccaggatgaatggccacgggtatagctcccttagaccacctcacaccctgggatgtactcatagactttctccaacaaggttacatcaaaggcattcaagtcaatttctggggtgtcttacaaccttctctggggctctagattaaggaatcaattcaagaaccccatttttggcgctggccgtccccatgttaggaccgctatcctatcgttattattaggtaatagtaccctttatcacgtaaaatattttagggtttatcaacatgttctcagtggactaataggacatagtccaagtcccactgcacctcagagtatgtgttcaatcaattagaggtccctgggggaaggaccttcatgattatgagactggtttatattccaagagtcaggtgggcatattttggtgaggttaaagagcttattaaaaactattcaaaggatgggcgcagtgactcgcgcctgtaatcccagcactttgggaggccaaggcgggcagatcacctgaggtcaggagttcgagaccaccctggccaaaatggcgaaacccctggtctactaaaaatataaaattagatgggcatggtggcgcgcgcctgtattcccagctactctgaagaggctggggtgggagaatcacttgaacccgggaggcagaggctgcagtgagccaagatcacgccaccacactccagcctgggtgagagggccagactctgtctcaaaaaaaaaaaaaaaaaaaaaaaaaaaaaaaaaattatgacaggctaggaaggaagcgtcatatgtgtcactttccctacctcaaacaaaacaaaagggctgacttaagatctccttgggtggagccagggctaggtaagtgagctctaggactccgtaggagagctagggctgggagggccacacccaaacgaactaagctttggaagctgggcagccctctagcggctctgctcatgaacagtttctccagaggccccaccctacctatggggcagcccctttaaacacacccccacctgcccagggcagcctcctagttcccatgcactgcccctctcaggaccacccgcagccctgaatttttccacctccagctgtacgattttgagtgaaaatccttcaccaacagagtctccaaatcacctagaccccaaatcttacacccacagcccacttcctccattttctcacttaaaatcccacctttccccaaatctcttaaaacgtctgagtttggccttggattccacttttctgctcactgacccaaggctgcacagctgaacccgcccgcttcccgaggcctggctttggcgccccctggaggaagtaaggcgccaccagccatgagggcacgctgcccaagatagcgggggtagggctcagctggcacgccagtgcagcccgcggtcactcaggaaggctccagtgcaggccccacccatgaaccggcaaagatggcacagaatgaatgaacacggctctacggccctgcctaccttgaaatcccctcagccccctccaacagccctgctgtcactcaagatggcgcctgcgcagtacacctctgctgcccccgccaccggccaacacacgtggtactaggatggacggggctcacgctcactcctacagcgcagctgtcattcagtaatggtgcctccgcactgcacccgccacattgaatgccggctgctctatcagacaagacacacatgctatggcccccctcagtcactcaagacaaagcagaccctccctcagaaccgcacctgcagccagcccagctgtcattcaggatggcacctgcacagtacaccgtggctgccacctaatggccagcaaagatgatgccacagagtgggcggggccatgcagaccccgtcagtcactcagtcctctgcacccggccctacagccaacccagcagtcattcaaaccagtgcctgtgtaactgccctcacgtgccccattacagccaaagattgcaccacagtggaccaggctcggcagcccctagtcactgagaaagccctccctcatgcccgcccctggggccgacccaggtgtcactcaagatggcgcctgcgcaatcaacctcgggcgccaccctgtggctagcacagacagtaccgtagaggcggtgaggggcagtggaggtgagggtgctctcagccctatcagtcccgaggaacggtcccgggccccagcccttagccccgccagcagggcgcctgcacaacccgcctcgcagctcccccactaagccgcccccatacacaagatggaaccacacgcatcctgtggtgaacaaagtcttggtcaggcaacaacaggggaaggggtgagcctctgccaccgttagccaaaaacacagcgagcgcggtgataacccgtcaccctgtccttaagcataaatggctccgcggccgctaaggcaaactctttaggcacgtctcccggctcccccagatgcggggactgagccagtcccactggcaaaacagcctggcgaccagcacacacagcccaaggagcgcggcactccacagctttccatcaccgcaaggcaggcaagcacagcaaccgtggccccgcccctccctgtggacaaccccacacctatgcggcaaaccgcagccgccccgatcaaagatggcacccaggtgggcggggcttgaacagaccgtcccgcccatgccacctgcagccacttcagccttgccccgccgcatctgccgccaaccaatccgggcaacgcctgcgcggcaaacctcagctgcccccatcaaagatggcgcccaggcgggcgggccttgtctcgcccaaccaactaggacagcgcctgcgcagcaaatctcaagcactttcattaaagatggcgcccaggtgggtggggcttgaacaaaccactaggtccaatgccaccctgtcacttcagccttgccccgccccatctgccaccaaccaaccaggacagcacctgcgcagcaaactccagcagcccccatcaaacatggcatctaggtgggcggggcctgagcagatcgtcatatccaatgctacacagtcacttcagccttgccccgccccctctgctaccaaccaaccagggcagcacctgcacagcaaacctcagcagcccccatcaaacatggcgtccaagcgggcagggcctgaacagatcgtcacatctaatgctacccagtcacttcagccttgccccgccccatatgccaccaaccaaccaggggagcacctgcgcagcaaacctcagcagcccccatcaaacatggcgtcaaagcgggcggggcctgagtggatagttacccaatcacttcagccttgccccgccccacttgccgccaatcaactagaacagcgcctactcggcaaacctcagccaccctcataaaagatggcacccaatgggtggggctggaacagaccattacatccaatgcaacccacagtcattcagctttgcctcgccccatctgccaccaatcaaccagaacagcgcctgcgcggcaaacctcagccaccctcataaaagatggcacccagtgggtggggcttgagcagacgattacgtccaatgccacccagtcacttgagccttgccccgccccatctgccgccaaccaaccaaggcagctcctgcgcagcaagcctcagccgcccttatttaagataccgcccgagagggcggggaaagaaaacccctacaggcaggacagcccttcgcccctcccaccaccactgcggcaaacaagccccgcccccagagggtagccgggcacgccggcgccgcgaggccgatggcaccccgcaggaaggggcattttcgcagcccccagacccagcccaggaggcccagggctcccgagagccgcattccgccgtggcaacagggatagcattggtgtcgaccttgctggacttgccgtggcagagcccccggctgtctgccctaatgcccccggtttgctgcggtggcccccggccagtcagaaaggcgcggagaccctgcagcagcccctcagaccccggactgcaagatggcggcaccaacgcagcagcccgggctgcgcccacccctgccccaaaaaggcaccaaccatccacagcctggccgccactgtgcccactctcggactgggcagcgggcggccaagtaccatgtccgccagcccgccctgccacaagggtcgctggcttgccgcggggtcttgggcttgcggcaagacggccactctggcccagagccgtcgcgacaccaaggtcccgcgggcaggaggcgcgcggggcggccgaaggcgcactcacctcacctcagtgctgcgcagcctcgggcacgaacagccgcctagcgcaccctcatggcgcccggcgcccggcggcgccaccagcccagggtggacatctcccgcgcctcccaaacctctcctcccgcagctgcccagacttctgcaccgaggtgcagctcgacgcctccttgtcagggcttctccgcagaggcggggcttctgtgctagccaatcagcagcctcaccgccctctccgggccccctcaccacagccctgtgacgtgccaatcaggctgcggttgccacagcaacagtttggcgcgaaggctgggggctgacgtcagggagtggccgtgagggaccccaaagccaggtctggaaaaggggggtgggttgggtggtgggggtgcagcccccaaagaaatgggggtcgaaatggaggaaaccccactgagatgctcaaatgtaaaaccgctgaagaataaagggacaaatgtacacatctgtctaaatgaaaaaaatgaaaatcctggccgcaaaaacacatacattaacgtctaaagacctgcagggaagacaagacttttccgcctgggacacatgaaagacatcgagctaatttccttaataaatgaagagctcttggaaaccaacgagataaagaccaaaccaagacagaaaaatgggcaaaagggataaaactggcaattcgcaagaaaatccaaacggctggccgacctgcgaaggaaacatcacgacctgtttgcataaagaaatgcaaacctgaaacaccgggcacgtgcggtttaggggagcgggcagtctcacacactactgagttgtttcccagcagccgtcaatacagaccttccactgcgtaagcccactgcattgccatttaataaaacagcaagaaaatgagagagaaaaataatgaggtagaattgtatgggattattaaggattgaattctcagtagatttagtgaaatatacaagttactgaagtttgtagaaacgaactggtaagtgttttctcatttatttgttttttaaggataaacccaaatataggtaaaactgttggaaaggtaggcaagaaattgttgatgagttacttctagggacaaggaatgtggggtggaagagggatttttcccttctgccatccatactgtgaatttccttggcagaaatacgtatttcttctctggcagtaaaatcaatgaattactaaaagttcactaatgtactctttggtccaactattccactctcaaggaactaaaaaagcaaaggaaatacagggatatacagaagattctatacagggatattcacggagcatcatttttatcaccaaaaatgtgctccacagaaaagaattaaactgtattctggtaaatttacacagcgcgattttaactgactaataaaaatgctgtatgattttaactttaaaggaaaaaatctgtaagatgtggttaattaccaaaaggtgtttacctaaggagcacacagactttaataccccaaattaaactttatattatactcaaggagttatcagtggttgcttgctacactgagaagctgctttatgtgttttagactccctagaccatcaacagtctctttttgcccagcagtgccacataaacataatatacgaatgaaaacactgtgcttcttatgaaaatacacgttcaaaacaaattccccagcaggaatattgaaggtgaatgtggtagtaccctgacttaggttacagattttcaaatctggctactctcattaggctcacctggagagctgttaaacaatgcagattcccagtgtcccacagagatctttgtttttcaggttcccaagggatcctaatgtctagttaaggttttgtaggtgattttaatatattttaaagactccatcatccccctgtctcctcaaaggcctctatctgcaataccagtttctctccggatcctgaatcattaatttccacaagacaccacatgctctcagagctcctgcagttaccacccccttgctcagcacctcttggccctgaaaatgcctcttgatagagcagtctactgtcactaactcaatggttttaccatacattctctcctgctaacatatatgccccacaggcttccatcccttccaaacccactgaaattgcttgacaatttcagcaattccttatgtggccaagaaacttgctcttaatctcactttatctctcagtaatattcaacatcctcattaaaacaagcaaacaaaaacaaaatcccatgcatgctatcttatttttggtgacaattacatggtcctggtttccgctcccctgccatcagtggtctcttctcagtcataaatggcttctgctctgcttgccatctacacgctggagggtcttgcctcagaacttagtcactagtcttctccatcaatgtccactccctaggtaacaacccttccctcctcacctagtcacataatttaaatgccacctacatgccaatggctcccaaattccaatcctctgccacaggactgtccacaaaagcgcagtcttttgcttagaaactgactgctccccttggatgtctatcaggcaactcaaagcattttaaacaaatattaatttcccctttccccatttctataaacagtaccagttgctgaagccaaaaaacaaaaacaaaaaacgacaaaaaaaaccctcacgattgttctcgttccttttttccttaccaccaacatccaatttatcagcaagtcttgctgaccctatctaaggcaaatcccaaatttgtcccatgatttccctttccatggtagtcctaagaaacattatcttcctacaaaaacccttcttccattccaaacccttcctccagtattctccacacagtattaagggtgatcttgcaaagcaaaaaagatgtcaatgttccagcttgaatgacctcctgcccccatcccaattgcatttaaagtccaaaagcccaaaattagaagagccaacattatcttttgtcttagaggacaattaaatataggtgttgtaaaatttcacaatctcttccttcaatgcctaatttaagaaattcttccccacactgatgtcataaagatattcaaatagctgtgcattttagttttctttatggttatttttgcctatgttctgtgttagggatctaattttcccctgactttgtatcatatttctctatatgagcaggtctgtgcttgaactctcttgttggtcccctgatccatttctctatctctgtgcattaacgcaccatattattacagctttacagtatcttggtatttgaaagggcgacggccctaccttgtttttcaaaagtgtctggccctaccttgtctttcaaaattatctgactcttagcccaccatctttcaaataatttttagaagcagcttttaaagtttgatgaactatcctattgagattctgacattttattaaatccacacagcaatttagagaaattgaaaacattatatcaagatctctcatctttgaccactgtctatatctcttacggctgtcaatgatacactgtaattttttttccctataaaggccttatttgactttaggaggtcctttttttcccccattaattgtataattggttatttaatagtttcagaattacaaaaaagttgcaaagatagtacaaaacttccccaccctgttttccctgatgttaataccttacataaccttgctactttgtcaaaaagaagagataatattaacactaaacaaactacagactttgttttgatttcacccatttttccattactatcttccttctgttccaggatctcatcccagacacagcattacatttagtgattacatctccttaggctccccaaggctgtgacagcttctcagtattttgtagaatactcagtttgtttgatattttctcacaacttgatttgggttatgaatttttgagaagagtatctgctattgcctttttttttttttttttttttttttgagacagagtccggctgtgtcgcccaggctggcgatgcaatggctcaatctcagctcactgcaacctccacctcccgggttcaagcaattctcctccctcagcctcctgggtagctgggattacaatcatttgccatcatgcccagctaatttttgtatttttagtagcgatggagtttcaccatgttggccaggctggtctcgaactcctgaccttgtgatcagcataccctggtctcccaaagtgctgggattacaccgcacccggcctgctattgctttttatacgctgactttggatccagtgaacttgttgactttttttttctacacaaaaaaaagttcctgtatttttaaaatgttaacatgctaattaatgacttcatttttactttcggagtttcaccatgttggccaggctggtctcgaactcctgaccttgtgatcagcataccctggtctcccaaagtgctgggattacactgcacccggcctgctattgctttttatacgctgactttggatccagtgaacttgttgacttttttttctacagaaaaaaatgttcctgtatttttaaaatattaacatgctaattaatgacttcatttttactctcattgacaatcatacctcacttcattaacataatgcattggctaggacttctggggtgatattgaacaagtcttgtcctatatttgaaaggggatactcttatctttactatgaaaggggatactcttatctttactatgaagtaaaaacattcactgcaggcttgttttgtacagcctctttattgggggttaaggaaattgccttaagttctagttttttaaaaaaatttatcataagtttaattttatataatgacttctctgcattcattgggaagattgtattatttaacatcatctgatgattggtgaataaagcaggttttatgttgaaaactgtattcctaaaccctgcttgatcatgattatgtgtatctgattcgtatacacatgcagctgggtactactgagttatacttttttattacactatccttgtctggttttgctaccaaggttgtaacagccttatagaatgatttggattgttatctcacttcttatattctctaccatagtttataaactcctctccattggaaattatgtccctttttctattactaatattattaatctctccatgtttctccatcagttttgctaaagatttgacagttttgtctttttaaaatgacttgattttgttgaccatattcttccttcttttccatgtaattaatttctgttctttttgtagttctttcttgttcagttctgtatttcattgtttccattagatttcctctttgcgacatgaagaaacgtctttaggggtcaaagatcttggggaaaaaaactatcttttgaatacagatttccaaattaattgcattatactcatatagcatggcccatatgctactatttcacatttgtcaaagcatccttggtgatcttaagatatggttaattttaattgttcaatatattagaaaagaatgagtattgtctaattgttaggtatcaatttctatttatgttcataggatcaacttgttaactgtgttcagatttttagtattcttggtaattttttgtctgcctgatctatctgttctagatataataaaatctcccaatattcctatggttttatccaccactccttataattaatagtttttgctttatatatatatatttcaaggctatgtttttaggtgcaaacaaggccatgactctttgttgagaaacacagggaagttaatctgcttacatttttaattattgatgtatttgtttaatatgcttttggtcatttattttctcctttcctgcattctactaaattgatcaagttttctttagtcccctttcttccttctgcttatttgggaggtttcaattatatttattacttcactgtctatctttaagttcctaatttctacataagcatatatttttttaacagactataaagtactaaagcaaacatgttggcacacgttagcaattcactggatttcccattcccaccttcattaatattgtctagaattttaattatacctgttttaaacaaatgaaaacatttttacagtcaatgattaattatatttactggtatttcaagaatttattcactcattcttgtttcttgaatctcactcctcgtccctcgaggtttactttttctcattgcaataaatccttaaatgtgtctttaaataagtgtataaggtagtctatttgtatttctaaaaatgtctttatgagacatttttgaatgacattttagccaggtatggaattcttaggtaacctttatcttctctccttattttgaagatattattccattgtcttctaacaaacctgatgaggaggtctgcatcagcgtaatgttcctttctaataacgtctagtttttcccgcggtagctttcagaatagatgttatgtatagatttttgtttatcctgctcaggattgatgtgaccaatgaaggtctttcttccattctggagaattcttgggccagtgtttctttaaatagaacttttctgccattccatttctactcttttcaacctataaagtataatgacccgtcttaatccatcctccatttgtctcaatctttctgtttttcatactgttttctgtgctttctgagtaacttctctttttaactgcatctggtaatagcatttccctagatgttttaaatacagtaactatgttttctgttctatgatttccaattggtactttttttatatctacctttctcaaatggatgaacattttatggacactattctttatttcttcaaaaatcgtaaagtcacactaacactatttgaattgcattttgaaaggactgaattcatgtcttgattgctagttttgctgtcttgttcattttaagatttcctaactttaacccagtgctttgcaagtttagtttctaagtgtttttcctatgggttatcttttcccctcctctctgaacttttcttccctccatgtctttttggctgtctctacctcacccatgagaagcacagtccagagacaatcttgtattgtcaactggggattttgtgccatgtgacaaaaggggtgtattagtcactgagcaagattaaagcttaggctgggtcctctctgcatggctttgttttttcaccccctgccaccactcgtaagtaaaaaacctgggtatccatcactgtttgttgttgttgttgtttttccaggctccttttatgtcaggagagtccaaatccagtacctgtttgccacaatgagcctgggacctcaacatgcatggagtgcttccggacctcattacccaagagcagtcagatttttaatttcctctgcctttttcaagatcattagttcagaaggtttatgttttcaattccacatatccttgcatttttctttcaagttttgacccatatggatatcttaaatattcctattattgcaagtttatattaaaaggaggttaaattgtgaactcacaaactcatagcatcatagcaccatctcaatcaaaagtattatcttctgtgaactacaacagttttcacttctttcgcaagtgtggagtgacgtttgcctgaggctgtatgacctgtgatatcatgacaaattgaaggccaaagcagatgcgaatccagctgttttctattaagtcaaatgccaaggagatttacaaagatgtaaaataatgcgcctcttctcaataacctttggttttgaaaattgttatttttcataaaaaatgttgcttccattaacctgtaataggtttactaccattattttaaataaaatacacatttcaaatggcttaattttttcttaagatataattgataagtaaaaattgtatatatagtgtacaacatggtgtttcaatatacatatacattgtaaaaggatatcaagctaattaacatatctatcacctcactatttttgtgtgtgaagaacacttaagatctactctgttagcaattttcaagtataaactatagtcaccatactgtgcaacagatcaccaggactttttaatcccatctaaccgaaattttgcaccctttggccaacatcagctcatctcctctgacccctgacaaccaccattctactctctacttgtatgagttcaacttttttagattccaaatataaatgagatcatgcagtgtttgtcttaccgtaatgtcctccaggtttatccatgttgtcataagtgacagcatttccttctttttaaaggctggaaaagtatgccattgtacatatattcattttatttatccattcatcaatccatggacaattaggttgattccacatcttggctaatgtgaataatgctgcaatgaacatagaagtgtatactgattttgtttagatatgtagccagaagtgagattgctgggtcatacggtagttttactttttttaaatgaatttccatactgttttccataatggctatattaatttacgttcccaccaacaatgtacacaggttccctttctccatatctttgccaacacttgaagctttttagtttgattcaatcccttttgtctatttttgctttttctgcctgtgcttttaaagtcttatccaaaaatcattggtcagaccaatgacaagaagtttcttccgttacgttttctcccattagtttcacagtttcagctcttaagtctttaatccattttgagttgattttgtaatatggtgtgtctaatttcattccttcatatatggatatctagttttccccacccacttatttaaaaaaaagtcctttccctgttgtgtgttcttgacacttttgtcaaagattgactgactataaattacgggatctatttctgggctattttgttctattggtctctatgtctggttttatgccagtatcatgctgtttttattactgtagctttatactcaattttgaaatcaggtagtgtgatgcctttccagctttgttctttttgctgaaagtttggttatttggggtattctgtggtttcttatgagttttaggagtatttttctatttctgtgaaaaatgacactggaatttttttatggaaattgcgctgaatctacacatcactttgggtagtatggagattttaacaatagtttctaatccatgaacaccagatatttttctatttgtgtcttcaacttctttcatcaaagtcttatagttttcagtgaacaggttaattttattttattatattatatatattataaattctggttaaatttattcttaaataatttgatggtactgtaataatttgatggtactgtaaatggaattgttttcttgatttctttttcagatggtagtagtacctggaaacaatattggtttttactgcaactttactgaatttgtttattagtttaacaagtttttggtggcatctttagggtcttctatatataagaccacatcatcagcagagacaatttcacttcttctgttcgaatttgtatgcctttcgtttttccttatcttgctcctgatcttaaaggaaaacctttctgtcttctaccactgatagtgatgttagctgtgggcctgtcatatatgacctttaatatttcgaggtatgtgccttctatacataatttgttgagtttttatcatgaaaggaagttaaattttgtcagatgctttttctgcatcaattgaaattatcacattttctatgcttaattttgttaatgtggtgtatcacatttacttatttgtgtatgttgaaccatccttacatcccagtgattaatctcacttaatcatagcgtatgatcctttcaatgagctgttgaatttagtttgctagttattgtgttaaggatttttgcgtgtatgctcatcagagatattggcctgtaattttctatttttgtagtgtctttgcctggctgtggtatcagggtaatgctgacctcataaaatgagtttaaaagttttccctcctctttaatttttggaagagtttgagatggctgggtgttaattcttccttaaatatttggtagaattcaccagtgaagcaatcaggtaccaggcttttctttgttgggaggtttttgattatagattcaatctccttactctttattgatctgctcagaacttctatttcttcatgattcagttttggtagcttgtatgtttctaataatttgttcacttctaggttatccaatttgttggtgcatacttgttcatagtagtatcttatgatcctttgcatttctgtgctatgtctcctcttccatttataattttataatttataatttattttataatttataatttataattttataattttgagttttttcttagcctagctaaaggtttgtcaattttatcttttcaaaaaaccagatttcactattatgatcatagtttcgttgattttttctattgtttttctattctctatttcatttatttttgctctgatctttatctttccctctttctctagattttgggcttaatttgttcatctttttctagtttcttgaggtgtaaagttaggttctttgagatctttgtttttcttaatatagaatttaacactataaacttcccttttagaattgctttctctgcatcccacgttctggcatgttgtgtttccattttcatttgtctcaagatattttttatttcccttatgattttttctttgacctactggttgttcaggagtgagtgtgttaatttccacatgttgttttccaattttcctcattattgatttctagtttcataccattatagtcagaaaagatacttcatatagacatcaatcttcttaaatttgttaaggcttgttttgtggcctaacatatgatttgtcctggagaatgttccttgtgtgcttgaaaagaatgtatattcttctgcagttagatggaatgttctgtatatgtgtgaggtccatttggcctacagtattgttcaaatcttattgttttctgcttactctatacattactaaaagtgaggtactgatgtggtttcgctctgtgtccctatccaaatcacatcttgtggctcccacaattcccaagtgctgtgggagggacccagtgggagatagctgaatcttgggggcaggtctttcccatgctgttctcatgatggtaaataagtctcacaagatctgatggttttgaaaatggtagtttctctgcacaagttctctttgcctgccaccatccacataagacttgacttgttcctccttgccttctgacatgattgtgaggcctccccagccatgtggaactgtaagtccattaaacctctttttcttcccagtcttgggtatgtctttatcagcagcttgaaaacagactaatacaataaattgtaccactagagtggggcgctgaagagatacccaaagatgtgaaagcaactttggaactaggttaacaggcagaggttggaatagtttggagggatcagaagaagacaggaaaatgtgggaaagtttggaacttcctagagacttgttgaatggctttgaaaaaaatgctggtaagtgatatgaacaataaggtccaggctgaggtggtctcagatggagatgaggaacatgttggcaactggagcaaaagtgactcttcttatgttttagcaaagagactggcagaattttgtccctgccccagagacctgtagaactttgaacttgaaagagatgatttagggcatctggcggaagaattttctaagcagcaaagcattcaagaggtgacttgggtgctgttaaaggcattcagttttataagggaagcagagcacagggaatgcttccagtttttgcccattcagtatgatattggctgtgggtttgtcatagatagctcttattattttgagatacgtcccatcaatacctaatttattgagagctttttagcatgaaggttgttgaattttatcaaaggccttttctgcatctattgagataatcatatggtttttgttgttggttctgtttatatgctggattatgtttactgatttgcatatgttgaaccagccttgcatcccagggatgaagcacacttgatcatggtggataagcttcttgatgtgctgctggattcggtttgctagtattttattaaggatttttgcatcaatgttcatcagggatattggtctaaaattctctttttttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatctgtctggtcctggactttttttggttggtaagctattaattattgcctcaatttcagagcctgttattggtctattcagagattcaacttcttcctggtttaatcttgggagggtgtatgtgttgaggaatttatccatttcttctagattttctagtttatttacgtagaggtgtttatagtattctctgatggtagtttgtatttctttgggatcggtggtgatatcccctttatcattttttattgcatctatttgattcttctctcttttcttctttattagtcttgctagcggtctatcagttttgttgatcttttcaaaaaaccagctcctggataaaagttcgaaaaatttgcagcctgacaatgcgatagaaaagaaaatcccattttctgaggagaaattcaagcctgctgcagaaatgtgcataagtaaggaggagccaaattttaatcctcaagacaatggggaaaatgtctccagggcatatcagaggtcttcacagcagcccctcccatcacaggcctggaggcataggaagaaaaaatggttttgggggctgcgcccagggtccccgtgctgtgtgcagcctaggcacttggtgtcctgcatcccagctgctctagccatgactaaaaagggccaagacacagcttggcccatggcttcagagagtacaagtcccaagccttggcagcttccacgtagtgttgagcctgcgggtgcacagaagtcaagaattgaggtttgggaacctccacctagatttcagaggatgtacggaaacacctgaatgtccaggcagaagtctgctgcaggggtagggctctcatggagaacctctgctagggcagtgcagatgggaaatgtggggtcagagcccccaaacagagtccctactggggcactgcctagtggagctgtgagaagagggccaccatcctccagaccctagaatggtagatccacctacagcttgcactgggcacctggcaaagctgcagacactcaatgccagcccatgaaagcagcctggagggaggatgtaccctggcaaagccacaggggcagagctgcccaagaccatgggaacccacctcttacatcagcatgacctggatgtgagacatggagccaaagaagatcattttggaactttaagatttgattgcccagctggattttggacttgcatgggccctgtagcccctttgttttggccatttctcccatttggaacagctatatttacccaatacctgtacccccattgtgtctaggaagtaactagcttgcttttgattttacaggctcataggcagaagggacttgccttgtctcatatgagactttggactgtggacttctgagttaatcctgatatgagtgaagactttaggggactgtttggatggcatgattggttttaaaatgtgaaaacatgagatttgggaggggccaggggaggaatgatgtggtttggctctgtgtccccatccaaatttcatcctgtggctcccataattcccacgtgctgtgggagggactcagtgggagatagctgaatcatgggggtgggtctttcctgtgctgttctcatgatggtgtataagtctcatgagatctgatggttttgaaaatggtagtttccttgcacaagctctctttctttggtgccatccatgtaagacttgacttgctcctccttgccttctgccatgactgtgaggccccccagccatgtggaacagtaagtccgttaaacctctttttcttcccagtcttgggtatgtctttatcagcagtgtgaaattggactaatacaggtactgaaatcctctgactttatttctaggtgtttgtttgtttgtttgtttttgagacagagtctcactctgtagcacaggctggagtgtagtagcatgatctcggctcactgcaacctctgcctcccggatcccggttaagcaattctcctgcctcagcctcctgagtagctgggattacaggcgcgtgctggagatggcatggtggggttccaccatgttggaaccccatgagactttggactgtggacttctgagttaatcctgatatgagtgaagactttaggggactgtttggatggcatgattggttttaaaatgtgaaaacatgagatttgggaggggccaggggaggaatgatgtggtttggctctgtgtccccatccaaatttcatcctgatggggttccaccatgttggccaggctggtctcgaactcctgacctagttatccgcccacctcagcctcccaaagtgctgggattaccggcatgagccaccacacccggccatatttctagtttttaaaatacctaaaactatacatattgataggtataagccacataagcaaaagttctttagggtcctcattttcatgagtgtaaatgggttttgagaccaaaaagcttgagaatctctggtctacagtaaatctgtaacagtctgggttatttgagcagattggatggaaatctgtctttttcactattatgatctcaaggcctagcacaaagcttaatacacagaagtctctcgataaatgattattcagctattgtttcagcaaatatttgagtacctactatcttattaggttggtcaaaagtaatagtggttttcgcaattacttttaatataagacccaatgctaggtcaacttcatggttcattgtaaatcaaattgaaatggcccctgccataacttatttatttaatatgtcttcagagtttcagtccagctgggaagagacattcaataaacctttaaagattatggtaaatgctttaaacaaacaaacaaacaaaaaacccaggatgccgaaatgaggatggttatgtttgtatggtagatacagaatagtcagggatctctgaggaagagaaactaagactaaattttgaaaaagccagcctggggaagaagaagggaagaacatttcaaaaagacaaaacaggcagggcgtggtgactcacgcctgtaatcccagcactttgggaggctgaggcggaggatcactcgaggtcaggagcttgagaccagcctggccaacatggtgaaaccccgtctctactaaatatacataaattagccaggcatggtagtgcatacctgtaatcccagctactactcgggaggctgaggtgggggaatcgcttgaacccaggaggcagaggttgcagtgagccgagatcgcaccacttaactccagcctgagcaacagagcgagactccatctcaaaacataaaaaaataaaaagaacaaaacagcaatatacaaagataataaaggaaaaaaaacagaaaagacatcagagtggctagaggataatgaggggtgtaaaatgaggttgtacaggtattcaaaagccagctcttttggaactgtagattaagaggaagatcttgaacttaatcctaaatgtaatggaggccattaaagatttttaaataaggcctgacacagtgcattttaagatgattcatgttgctctgtggagaactaggggactagagatacttaacagaggaagcaggaagaccagttaaggggcagcaaaggatggcagggctccaaactagtatggtggcagtagagatacgcagaagtgaacaaatacaagatgtactttggaaacaatatagagaaatcttgctgatgatttgtgtatgtgtggcaaagaaaaaagaatcagaaatgagttccacatttctggtttggacaactgggtgcacaggagtgttatttggtgagtaactgagacacaggtttcagggtaagagcataacatcaaaagctatgtgggacatgtaatatttaaaatgcttacactaaagcaagtggagacactgagcagggattctggagaggtctctgccagggctctgaagtcctccacacatagctgatttgttgcatggtcagattaaaataaacactactttacaagataaataaataaaccagttcttaagtatttcgaattcatgtgtatatattcggtgctgctggataaatatcttcagatacaaatttgtacaccgttcctcagtagtgcaaatctaacaaattttccttaaggaaaacttttattttttaactttctcaagtaggagtttcaggacagtataaagccaaacattcatattaaagtaaccaaccctttcacaaaaagtaccactaagtccaaatattaaaagaacagttcccaaaagcaattaattacatacaggattaaagacaggcaaaagaccacctccatcatgaatcagatattataaaaggaaaatatgtcaagtctggcagacagtgttaaggttcagaactaaagttcagcttatatgtccctgtccaaaagggcactggacaccatttctcatgagaagctaaaacattcagaagtcaagctataacatggtaaccaaagtagtacatgtagaaaatgcagggttactcatccactttttgctcaagttggcttaccagccagaaagctctaaccctgaactggcaaaatggtagatgttcatttatccaaccatctaataaacaggtaatgcgtatcaactacattcagacactagagacacagtgataaacaatggagacacagtctctgccttcatggggcttatagctcactgatgaagccaaacaatcaaataagcatataaataacataagtaacaagcaataaatgtgatgaaagaaatattgtgctataacacatatatcagagagcctgacccagactaggtaataaagaaagacattccatgcctagttaacggtgtgcacaaggcttatgaggctggaggagtacagaaacctgtgtagctagaatacagaatggcataagataaaggctacagaagcacagaagagtcagaccctgcaagacctgtaggccatttaacgactggagatcccatacaacccgcaactgtagcacactacaagaatttctcccaggtgagatcggcactcacatctcaagcaggtcccctgaaaaacagcatgatttccacacatactcacatgtcaatgcctaagaacatgaccagaatgataaggagagctactctggcttccacaatgcagatcatcgtgcaggtagagaaaatcatttttatctggttcattttaaaggcccatcatgagataaacctaagaagaatggagaaaaaggcaataattgatataaaagtaaaacatgaatcagaaagcagaaaaacatctggagctaagagatacagatttaacaaagtctaacaataagtaaaatgttcacaaagaggagactggatgaataaattatggcacatacatttaatagaaaaatctacaatgataaaaaagcatgcaaaaactcttatggaacaatcgccaagatacattgttaaatgaaaagccaaggtgttgaacagtaaacacagtatacttcatttattaaataaaaagagaaacacactgtatacatatttgcttctatatgcatggaataacactggaaggatattcacaaaactattgacattggttatctttttttttttctttttctgactcaaacacatcttctgagacactggttatctatagagagggaaagatgggaggaggaattttctcctttttgaatttcaaaccacacaaatatattacctattaaaagtttaaaaaagttaatattcaatatgattttagatgagtacatatgaaaattttaatgaaaaggaacattttcaaggaaaataaaaattagcaaactgactgccaaatgggggggaaaaaaggtaagaaaagccttcttacaaagaatcctgtatgttaaaactttctggtacattttaataatctagcccccacaggctccatgagataaaactaatatttattgaatatttcccgtgtgctatatactgcatcaagcattacatgtatttgcagctcatcctcacaattcctgagataggtgttctcatcacctctattttacatataaggaaactgaagcatatccagtaagtaactccagaggtcagactctgcaaccactatcctacattaattctgtattaataaactggaaaaccttaaagaaatgcataattttctagggaaacaaaattacttgaaatctgtttgactgtaagtgttcttccaatgcctaaggaacaaattattcttagtctgcacagatagttcccaggacattaagaagaaaaagacgagggcttgccaattcattgaactaaattagaagagtggctttcaagaacatatttcctacaatgaaaatgtgttacaagaatagctatcttgtatgggatacttaccctgtgccaggcactggagtaagtgctttataaaagatctgggtgccacttggaaaacaatctggcagttcttcaaaacgttaaacatagagttaccacatgacccagtaattctactggtaggtaaaattaaaacacatgttcacacaaaaacttgcacatcaatgttcttaacagcattattcataacatagccaaaaaggggaaaaaacccaaatggccattagctgatgaacagataaataatgtatagccaaacaacagaatattatttggcaatagaaaagaacaacgttctaatacatgctacagcatagatgaactttgaaaacagtaggctaagtaaaaaaaggcagtcacaaaagctcacaccttgtatgattccatttatatgaaatgtccagaataggcaaatctatagacagaaaataggtgaatggttccctacggttggaggaagaggggaatgaggagtgaagagtttttttttagggtaattaaaatgttctcagattgagggcagtgatggccatacaactctgaatattactaaacaccactgaactgtacacactgtaaataggtgaattgtatggcagacgaattatatcttggtaaggctgttattaaaaatacatatctaggtgtattttcctaacaaccttaatgaaactgaaactaatatacttattttgtagacgagaaatctgcagctcagaggggacactatctactcatggtcataatctaaatagttgagaaagccagaattcaaatacgagtttttctgtctatactgcttactatctcccaacacaatcctatgcaaatgcactgaaaatcttcaagaaacggcccccctttttcttagaaaacaaacttatgggttgggcgtggtggctcacgcttgtaatcccagcactttggcaggccgaggtgggcggatcacctgaggtcaggagttcgagaccagcctgaccaacatggagaaaccccatctctactaaaaatacaaaaaaaaaaaaaattagccaggcgtgatggtgcatgcctgtaatcccagctactagggaggctgaggcgagagaattgcttgaacctgggaggtggaggttgcggtgagccgagattgcgccattgcactccagcctgggcaacaagagcaaaagtccgtctaaaaaaaaaaaaaaaaaaaaaaaaaaagaaaacaaacttatgactaacaggttcatgaaggcagcctcctaagaacaaataattcatatacagttgaaaatcccaaatccaaaaaaatcagaaatccaaaacacttctggtgtcaagcatttcagataaggaatactcaacctacaatgctattaagcatttcaaacctacaataagagggaagctgtccatttaagaagctagcagatggcttccaagtgcatcttaattcaagagtgccctggagaataataaaaataatagctataatttattaaacttttacaatgggtaaggcctggcaccaagcaccttatgtgaatgattatgtttaattatcataacaacttaataaggtagatgccattattacccaggttttacagatgagaggcaagccttaagaggtattttttcccaggttacaagctaaagggtggcagagctagaaatcaaactcaaatctgttagattcctgagcctcagccctcaaccaccactcagtacatttctaggctattaaatttgaaagccataatgaaatggaacgttcttgaaaggaagggagataataaacacttggcagacgtcaggggagtactttcctcaaaaagttctccaagcctttgccatttataggcaactttcttcacatttccaaagaacaaataattcttatgctttataaattgtgtaaatttcagcaaaaagagacaaaagtgtttcatttgaagaaagcacatggattttcaaccccaaatataccttattttgacataataagaatgtgtatgtaccaggaatgtgtctgagcactttataattgttagcttctcaaatcttcatgacaactatctaaggtaggtactattaataatccctattttacagatgaggaaggggaagcacagagagggtagatgactggcacaaagtcacatggctagaaagtggctaggattaaaaaccaagtcatctagctctaccctccagcacttagtctactcaaccaactctcaaaaaagaatatgctatagctaatatatgattcactggactcctagcactgtggattatcacactgactcccttcacatgtattatcccaactgacaaccaagaaggtaggtaagtttactgcctattgcaagatgaagaccatgaggctgagtgatgtgctaatttgcccaaatacacccaattaacacatatcagaaccaaaattttattaaacccacgtctttctgactctacatcacaccactagtcactgtgtcatgaaatactatggtaggggtcagcaaattacagcaagcaggccaagtccagtctgctgtgtttttatacagttcacacagccaaaatacaaaaattcggttgaatcaaaaatagatgggccaggcacagtggctcatgcctgtaatcccagcatgttgggaggccgaggtgggtggatcacgaggtcaggagatcgagaccatcctgactaacaaggtgaaactccgtctccactaaaaatacaaaaaattagccaggcgtggtggcacacacctgtagtcccagctactcaggagggtgaggcaggagaatcgcatgaacctgggaggcggaggttgcagtgagccgagatcgcaccactgcactccagcctgggcgacagagcaagactccgtctcaaaaaaaaacaaaaaaaacttgatggttgaaaaaaacaaaatatttcatgagaaaattaaatgaaacctaaatttcaatgttcataaataacattggctgtgttttactggacccagacacacccatttatttacagctgctttcacactacaaggacagaactgagtaattttgacaagacatcggtatatcgaacaaagcctgaaatattctctgtttggccatttacagaaaagatttgctgaccctctttgttattatatttaaaactcttattaaaagggaggagtagtgcacaaaaagtaccccccaacccccgaaaaaaggaagaaaaagcatggcctcaaaaggtgactggagtaggaatggaaactaacctccaactttcaaggaacaaataatgtctctgttccataaagtgttccaaggcctagaaaacagtggagggcttcccagttcattttaattaactggttcacagaggtttacaatccctaagctgttttaattggaaagaacgctgcagaatggaaataacaacagctggcagttatggaactttccctgtgctgccaggtgctgtggttaaatagaagatttccatttaatcttcctgacaaccaggaaggtagggtgccattgttatccaattccacggatgaacctgggtcctcgggatgttaaacaaattgccgtatgttccacatagagctcagcactctaaccctcatttctgccctccagagattagtcttaacaccccaccatttacttttattaataaatctgcaaacataaggaaatacataatttcctgaaaaaatataacgtaccaaaagtaactatcaaaataatcttggtgagctgtataaatttcctaccaactcccaggaagcaaataagtatgtgccacaaattgatctgggtcataagaaaacagacaagttttaataccctagctcactgggttgcaatagcactcatctctaactcatcaccactaaaaaaaaaaaaaaaaaagcacaattaaaaaaaaaaccatgcaagataatgatagctaacatttttagctgaactatgtgccagacactaaacactcctcatgcaataactcatttaaactaggaataaatatcccctgcagactaagacataaggaggttaaatggttgtccaaaatcacacaagcgagagggcctggatccaaatccaagccagcaagtgaacaaacccggcatccttaacagactttcagctaataagtctgagaatcctaattatacatgctcaatccagggaaaaaagaaattgacaaaactgagccaaacttaagggcataaaggggtgcgtggtacacctacagctttcaagcaatgtcaacagtctctacgattcactcagcaaagcagttctgaaccaaaactagcttcctctaaaagagaccaaactccacataaacgttacaatatggatgaacttcaaaagtgttctgctaaaggtaagaagaaaacatcataaactgtacaattcagttttcatggaacgtccagaaaagggaaatctcaagagccataaagtggattagtgcttgcctggggctgatcctcaaatgggctcgagggaactggggatggtgggattggttgacgtaaacattctaaaagtgggttgcggtgatggctgtacaactcatacatttaccaaaaaatattcagttgtacactgggtacattttgacgtaatctgcatctccacagaactgtgtaaaagaggctgagtaccccagcaactgcttcttgtcgaaagccatttcctatcctccgcgctaggcgtctcacaggcttttcccccagtcaaatcaatgctaataatcggaaatagcaagttctgagaaacgctagcgtagaatgggcgcactaggggtaaggggatgggccccagacttcagcagccgttctgggaagttgctcgcctttttcgaagactctagctgcaaaactggaagccgtcggtggggcaaggcagagaagagaccacgtctggcggatgagtcctgtgattatcaggtcacctgggtaacgcccaaccacgacgggctgggtctcagcgcgaggcctgcagcccggcgccgactggaatccccagcactgccgtctggaggacatcggcggtatctccccaagagacgggaagtctgtgtgtcgaagaggcgcgggacgcaagcccaccaacctggccgaccccagggaaaggccgagcgtccagcccgcgggggcccaagatggtgccagagttcgaggccctctgtgcatgcaccccgcccgccttcgaatctagcctgttcgccgttgtggtttgtcctcccggttcctctgaaggagttggtcagtagaaccatggcctccattgactacgtcctcagagtcgcagctctcttcagtcgagctccagtcacagaggacggttgtggtgagacccaggcagaagtatttccggtcaacgaggtcgcgggtagtgcgcatgcgcttcgtgcagggccctgcgcaagggcgcctgggaaaccttgcgagaagtgacacacgccctgtcctcagggagcccacggccgactgggaaacaggagaacgggtcaaacgtgggacgtccgtcagctataccgaaaggtctgtgatagagcttggagaaatgtgcatttggacacattatttttacattgtgatctagacagtgaggtaatcttttaaaaaataagttttagaattctattaaatttcagttttagaattatatttaatcatattttgaatattttgaaatattttgaaatttcatacggtttttttgtttttccggtttttttgagacagggtctcgctctatcatccaggctggagtgtagtgatgtgatcacagctcacttcacctcaacttcccaggctcaagtgatcctccctcctcagcctcctgagtagctgggactacaggcacgcaccattacacacagctaattttttttttttttttggtatttttgtagaaatggggtttcaccacgttgcccagactgatctcgaacttctgggctcaagagatccgcctgcctcggcctcccaagatttcgttatgttgtggggaaaagatgtatgattctatgatcagaatgaaagctctgagagggcagccactgatgagtgtaggtgcagtatcctctacaccttgcatggtacttggcatggaatggatgctccttgagtatttctcaaatgactgactggagtctttgaaaaaggcaccctgagttactgttaacagacagattcgctaataattagctactgttaatcggatagattagctaataacaccaacttttgatttgtctcagagtgacctagtgtgaaaagtagggttgcagatttagtaaataaaaaatgtaggataaccctgtcaaatgtgattttcagataaactaagcaaataatttgttagcataagtatgtcccgtttggatatgctgggtgtcctatattttatctagcaacttagaagacatgttaaggtgggggggaaaaatgattgtgttcctcttagaaaaagaactggaggagaaaagaaaacggtatccggaatttgtaaataagtacttccaaacaattctaaagcaggtcagaaaactacacttgagaaactgtgatttataaagttcgtggtaagtgttgtatttatatcatcttaattgaaacctcttacacagtagaacgattatttttattttataagtgcaaacagaagctcagagataggaggttacttgtccaagttctaatattttcactgtcaccccaaaaaatatgtattgaggcctctcggtggctcatgcctgtaatcctagcactttgggagactgaggcaggcagattgcctgagctcaggagttcgagaccagcctggccaacatggtgaaaccctgccactactaaaagtacaaaacattagccaggtgtggtggcgctaccctgtagtcccagctacttgggaagctgaggcaggaggatcgcttgaacccgggagggggtggttacagggagcagagatcacaccacttcactccagcctgggagacagagtgagactccatgtcaaaaataaataaataaataaataaaataataattattatttattgagagctgactgtgtgctgctggtctcggatttctattccacataatctgcctccagagctggaaaattccagtgtctgaccattcctcagcctccctccccttccccactccagctgcagtttccatggtaacaaactgaacctgcttctgtagctaacaagagctaagagtttttgagagggaataagccagaacaactgacgtcagcataccctggctgggggatgggaaggactgcttgaagccctaaagccttctattcctccatcaatggtttatgcaagaattttgtatgtgtcaacatctgtccttggatggagtctctgcaaaagaacaaaaattgtctatgtaaacctctgcagaccccatgaattcataagttttcacttcaggaattgcttcaaacactggtgacataaactttatgcatccttaccatattaaaatgtatttagtcattattcaaccaataatgatggggggcacttctacatatcaaacagtgctagatcccaaggatataattactatcaaaacatacacagtctctattttcctgtttcttagagttcagtggaagagacatttgtttattcttcagtgtattctaaggacccttatgtgtgagacatgtattagggactgggagatacacagatgagttcaaaacaaatcgttgagctgcatggaaatgatcctggtgggattggggtcagacattaaatagataatcacaaaacagcagatatttactgagcagctactgtggtgccaggcactgttttaggcaaggggaggacagcagggaacaaaatagacttggtgtctgttctcatggaacttacattctgatggagagggaaaatatataaatgaattcatttgcttttagttagaagaaaaaggatattaaactcaaattgacttaaataaaaaggagaatttattggcctaagtaactgaaaatgccagagatagaactgatctcatcagtattcatgaacataatttatgttgttgcagatctctgtagtttttctgcccaacactccttccccaggcttcctgccacagaagccttctttcctatggagaactggttagcatctgacctaggcctggtcacttcatgctgttgctatgcccacagtgattggttcaggaatgggcacatgactccaatgggccagtcagagacttactgacctgggacttttccttgggaattatgagaaatatcgttccctttgctgtgatgctaaactggtctgaagtgtgcctggcctatagccatcttttttgcctatctgaataagtcaagaaagagcatcccactgtgtgtttttaagcttctactagataatgcatgtaatgtgcttaacacagagtaaattctcaataaatgttagccagtgttgttagtgatttacaaaggaatgagtgagaagaaattatttgcaggaactgaaagattgtgcttcaaaatgaaggtaaatcaggagggtttttggagtgcatggaatgaaaacatggaggtccacagtatagagcaatgtttcctctgagccacgatgaggttttatgagctgtccagggttcactgaagaatatacttgcctggattcaaaatgcttggaccaacccattcagacattcactgaccccttccctgggtaagattctgtaaaagagaagatgcacaaggcatgatcatagccattgaggaccttatactcaactggagtagcagggaggtgaacaaccagtaacagtaaggccagaggagtacggggcaagcttcagctccacattcatttacataagaaatacacaggaacatatctaacatgccagccatggtgcgaggtgtaagagatattgtattgaaccaaactgatgccttttttattggaacttataatcaagtgcagtggttagcaaaacttcaggaacagaccagacaataactattttaggcttgtgggctgtacagtctctgttgtaactatgcaactctaccattttgtgtaaaatctgccatggacaatatgtacgtgaatgaacatggctatgttccacattattttgggacactgaaatttgaatttcagatgattttgtcacatcaaaaatactcttctttggatttgttttcaaccatttaaaaatactgaaaccattcttagctcatgagccatacaaaaacaggcagtggggccagttgtagttgctcatgcctataatcccagcactttaggaggccaaagcaggaggatcgcttgagcccaggagttccagactagcctgggcaacatagagagaccctatctctactaaaaatagaaaaattagctaggcatggtggcacatgtctgtaatcctagcactttgggaggccaaggaggtaggatcgctttagcccaggagttcaagatcagcttgtgcaatgtatcaaaacttcacctctacataaatattaaggcttaaacagcagaaatgtgttgtctcacagttctgaaggccagaaacccagcagggctggttccttctgacaacagggaagaaggatctgttccaggcctctcccctagctgctgggggtttgctggcagtcattggccatcattggcctccattggccattgccctgatctctgtcctcatcttcacattgtcttctcctgtgtacacatctgtgtccaaattcctccttttcataaggaccccagtcgtactggattagggcctgtcatactccagtgtgacctcgtcttaatgtcttacatctgcaacaaccctatttctacataaggccacatccttaggtagtctgggggctcagactttaacatatgaatttctggggtggggttggggatcccacagcagcaagtgtgccagcctctttgctggtctccctgcttccactttttcccacttcctttcatttccccagcctaggcaagggtgacctttctaaaatgcagacaggaccaggagcctgctgtgagtcatggggctcactgaggccttgttttttggttttttgctttttgggatttttgtttgtttgtttgtttttgagacacagtttcgctcttattgcccaggctggagtgcagtgacgaggtctcagctcaggaatcaagggaggattcctaggtgtcgtgggccagcgtcccctctgcacgttcagcccatgtggatgttttgaagcttcctctcctcggggggcacaagcttcagccagaaaattcatcccatttgtctcaacatttctgtaactctccaaagaaatttgatcatctcccactatcagcactgtcagttggggtctgtccccaggactccatccatgttgccaccatctctccctgggcatctgctgtggcctcctaaacgttcttccttttctatctagtcaccttccacccgttccacacacacacagtggccaaaaagaaagcctcactgtgtaatctcctgcccctgctccgggtaccccagggctgccgcccatcagggtaaagtccaagtggccaacatgatgcctcgggccctccaaacccaaccttgccagctggcccagcttcacctctctctgctcccatcctgggtctccatgctgcggcagtaatgacaatcttccagttccctgcggaggccacgtgccctctgaggagctggctgtactcactgtccccatagactcatttctcccctcccattttctcctcagttcactccaaccaggatttgctgccactctacaaaatcttctcaagatcaacaataccctctgcctgaccaacatggtgaaaccccgtctctactaaatacaaaaaattagctgggcctggtggctcttgcctgtaattccagctacttgggaggctgaggcaggagaatcgcttgaacctgggaggcagaggttgcagtgagccgagattgcgcccctgcactccaacctggacaacacagcgagattccgtctcaaaaaaaaaaaaaaaagaaaaaagaaaaaacacacacacaagaaaacaaaaaacaaacaaaaactacatcagacactttctaaggattaggaatgtattggttaaaaatcaggtgaggcagttgtctctggagatgatgtcttaaaattaaaacatgaatggaaacccaatatggtctacccatacaatggaatattgttcagccttaaaaaggaaggaaactcgggcacttcttacaacatcgatgaacattatgacattatgttagatggaagaagccagtcacaaaaggacaaatactgtatgattccacatgaggtacttagagtagtcaaattcatagagatagaaagtagaatggtaagtgccaggggctgagccacaggaaatggggagctgttgtttaatgggtacaaagtttcagtttttcaagtagaaaagagttctggggctggatggtggtgatggttgcacaaagatgtgaatgtatttaatgtcactgaacttgaggattaagctctgattcttttatcttgcccaaattcctatgtaaggggtctgggaagtcatgccctacaaaccataaattctcatcagataggttttgtttaaccctatatattgtaacttactttctcatctgactccggcataacgttacgtgatgaagaagaaagtcaaaatattttaccccaaacatgtttctttgccatgttttgaaatggccattgaaagctgtcctttgtgggggaaaattcgcatctgtaaagaatctctataaacatagctagatctttttcttctaggccttcccaatcctgaggagattaactaagagtctagcaccttttaaaggtctgaatatgaaacatttgtcatctattgtgtctaagagcagccactataagacttcaaaagaaccctggggccaggcgcggtgtctcacacctgtaatcccaacactttgggaggctgaggcaggcagatcacctgaggtcgggagttcgagaccagcctgaccaacatggaaaaaccccatctctactaaaaatacaaaaattagctgagcgtggtggcgtgtgcctataatcccagctacttgaggggctgaggcaggagaatcgcttgaatccgggaggcagaggttgcagtgagccaagatcatgccattgcattccagcctgggcaacaagagccaaactccatctcaaaacaaacaaacaaacaaaaaaaaccttgtccacaatcttttatcttaacctgaacattttctttctgtagattccaactatttagacaaactcaaccaattgtcaaccggaaaatatttaaatttacctatagcctggaagcaccgcccccatctcatgcctccctaaaatgtataaaaccaagctgtaccccgaccgcctggggcacatgttctcaggatctcctgagggctgtgtcacgggccatagtcactcatatttggctcagaataaatctcttcaaatattttacagcattggactctttttgttgacaaactgtacacttaaaaatggttaagacagggccaggcgtggtggctcatgcctggaatcccaccactttgagaggctgcagcaataggatcactggagcccaggagttcaagaccagcctgggcagcatagtgaggccccatctctacagaaaattgaaacctgagacaggcatgatggtgtgtgcctctctagtcccagctacactcagaggcagcgagaagattgcttgagcacaggagtttgaggctacagtgagctgtgatcacaccactgaactccagcctgagtaacgagcgagatcctgtctccaacactttttaaaagcaagggttaagatggtaaattttatgttatatatctttttttttttttttttttttttttttttgagacagagtcttgctctgtcacccaggctggagtgtggtggagtgcagtggcacaatctcagctcactgcaacctccacctcccgggttcaagcaattctcctgtctcagcctcccaagtagctggaattacaggcacgtgccaccatgcccagctaatttttgtatttttaggagagatggggtttcaccatgttggccaggctggtcttgaactcctgagctcaggtgatctgcccacctcagcctcccaaaatgctgggattataggcatgagccactgtacccagcctgtgttatatatcttttgccacaattaaaaataatttttaaaaattaacacataaataggccgggcaccatggctcatgcctgtaatcccagcactttgggaggtcgaggcaggtggatcacctgaagtcaggagttcgagaccagcccgtccaacatggtgaaaccccatctctactaaaaacacaaaaaattagacaggtgtggtggtgggtgcctgtagtctcagctacttgggaggctgagacaggaaaattgcttgaacctgggaggcggaggttgcagtgagctgagatcacgccattgcactcaggcttgggcaacaagagcaaaaccctgtctcaaaacaaaaaccaaaaaaacagaaaaaaaaacacgtaaataaatgacacctaccttgtaagctcatcctccatgctgggaacacgtttttgcctcttggcttggcttcccaaagagtatattaccccagagtttcagagatacacacattctagtcctcacctaagctaattccattccagtccaactcttccacttttaaatggcccccttgtaggaacatccacatcactcatctgggaatatcatcatttggcaatttaatgatctctaggcaaagacacagtagagattttacccactggtgtggcttggaatgctgcctgtggtggctcagtgctgtgctcaacttggcagaaccagagtgatgtttcacagagtccactttctgttatggttctcggctgggcttggccaccagaggtgtttgcctgggatggagaacgcatgggtggagcggcagctgtgtgtgccctgtgtgtgtgcgtgtgtgtgtgtgtgtgtgtgtgtgtagaggttacagttgggccaggtgctatgcagctcatgcacgtccctgccagctgctggctcaccttgtgtatgtgtgtgtgtctgtgtctgtgtgtgtttagaggttacagttggaccaggtgctatgtgtgtgtgtatgtgtgtgtttagaggttacagttggaccaggtgctgtgtgtgtgtgtgtgtgtgtgtgtgtgtgtttagaggttacagttgggccaggtgctgtgtgtgtgtgtgtttagaggttacagttggaccaggtgctgtgtgtgtgtgtgtgtgtgtgtgtgtgtgtgtgtgtgtgtatttagaggttacagttgggccaggtgccgtgtgtgtgtgtatgtgtgtgtatttagaggttacagttgggccaggtgctatgcagctcatgcacgtccctgccagctgccgcctcaccttgtggctcatgggggcattcccagctcccactgaaaccacctttgcaaaaattatatcagtgagaaaatgttggcatggaggagagctgatctagccaatcttcctcttgcctttagctttcaagttaccttaattatcactgggcttaggctgagctaactttgagagatatttaggttatagtttaagtaataacatcccttccccaaaactcaaccgcctttggaaagccaatgagagaccaccagagtaagggaggggggaagactgaattctgctaaggtgtagacttaaagattgccagccattattctggaggtcctgcaggtaacattgctattgtggactggccttttgagatatgttttcaggttttttgcatgtctgacacccatgactccacctggacccatccacgatggctcctgtggccctacccagaaccaactcaacataagaggatggtttcaactccctataatttcacctctgacctaaccaatcagcagcaaccattgcataaccacccccgccccttatcccaaactacttttgaaaaacccccaacctacaagcctttgatgagattgatttgagtaataactccatcttttgtatggcgtggctggcctcacgtcaattaaattgtttctttactgccataacatggtctttatttgtgcagcagacaggaagaaacttttgggtggttacaccactagcttctcctgggctgtttgcatgtttttagctcacactgaagggctccagggtctcctgcaaaatgccccatccccacaggccatgagagactgatggaggttccaattcatctccgtgggtgctggcaagacctcccagatccatttgcacttgttcttcttcactttcctttctcaacggcagcaccagcaccaaacataggttccagggctaagctcgactgtcgagccacctccacggttgcagaaggtcaagtccctattttaaaacaaaagcagaagaaatcctcatgccacatcactcctagtgattccaacacctcggattggaccctgtgccagatccaccatctttttctcaatgtgtcctgtacgtccagtccaggtctctggtcacgcatgaatcctgctttcactggacgtttccacttcggtctggttccagttggtctcagtcccttgactccaaattctgaattgtttctttttcagtgttaatcagatgtgctcgggatgccagcacccacccactcaccaggtcagaagtctgggacgtcttgggtccttctgcccccctcaaatccatcacttgcatctccaacagaaaccttggtttgtccacacctgtctctcactgcctccatccccatgccaccctccttagctgccgagcttctgttatctcttccctgttcaagaatgaccatttccttgttgtatctgcttcctcactgcccctttcccatacgttcatcacatacagccaaggtcacctttccaaaaaacatactggccatgagtacattgggctgcctgggaagagccagaccccagcaggaagctgcagaaactgtcaaggcaggcaagacacagacctcctctgtccccactctgagtaggagtaaggagggaggccacagaaggtgagtcagggtgttgccaggggaggctgcatctgcttgtccccctctctctcctctgtctgcctctctaaagacctcacccttctcagggagtaggtgcggcaaggggagaaggcccctgagatgctcgtgaccctgacctgctgggtcagccttttttccctctctggaattgccttttttcttctcagagggtggaggcccttggctttgcctgaaattctttgcttagtcactgaacacataaacctgttccctgtcagtcaccccaggcagagacaaagctatagttcttaagtgctcctgtctgccccaagttcagccagtcagcttcctatcgctgccaattttacctcatttttcttttttctttattttattattattattgttttttgcgatggagtctcactctgtcacccaggctggagtgcaatggcccagtctcagctcactgcaacctccgcctccccggttcaaatgattctctggcctcagcctcccgagtagctgggactacaggcgcccaccaccatgcccagctaatttttgtatttttagtagagatggggtttcactatgttggccagggtggtctcaaactcctgactttgtgatctgcccgcctcggcatcccacagtgctgagattacaggcatgagccactgcgccccggctgtttttcttttttgtgatgagaagctttatttataataaccgcaaactgacaacaacccaaatgttcatcagttgattaaagaagttgttttgtatttttacaatcaatattcctcaacaataaagagtaaactattggcagatgcatcattatgcttaaatccccaaaagctgggtgtggtggctcacatctatcatcccagcactttgggaggctgaagtgggaggatcacttgagcccaggggtttgagaccagcctgggcaacacagggagaccccatctctacaaaaatatttaaaaattagctgggtgtggtggagcatgcctgtagtcccagccacttgggaggctgaggtgagaggatggtgtgagcccaggagattaaggctgcagtgagccatgattgctccactgcactccagcctgggcgacagagcaagactccatgtcaaaagaaaaaaaaaaacaaaacattaaaatgaggtcattatggtgggtgctgatccaataggactgctattcttattagaagaagaggttagggcatgaaaagatcacattctttcaccactttcttctaaacaggcttcctccctcccacccatgacacagctgtgctcaaaatctactatgttgtcagatccaacagtcactcctctgtcctcaggttatgtggcttcactgtggcaatcaagagagttgacctcttcctccttctcaaaaacgctttcttcttgtgccttcatagaccctctatcctgattgtcctggccccaccttcttccagctctccttcttctgcttgtaggtactaaagctgaaagcgtgcacaccctctgaccccgccattcttattcagggagcccagatgaccactccacaaatgtgcactgagcgcggaataataataattgccaatatgcatcgagtgcccacattaggccagtcacgcgccctgtccaggaatgcatttagacgaacaatttatatctccttcacgtttcacagagctgacagtctcatggggccccaattgtcaaaaaagttgagaataagcaagttctcacaagcttgggaaaagatggattagtcagcagccagggaaacggagctatcagaatcagttttaaagtcgtacaactgacccgtggcagcctgcctcagtgaacgcgcctttgcacgccaaacaatcatttggttaggagggactcactctgatacacacgtctctgagtgccaaccaatccacaagggtcccactcgagaaatcacggtcctgcagatgatgtcagccccttgatgtctatgaaagccccacaacctctgaactccacattgccccgaaaccctccataaaaccagaccgttctgcacagagagactgtctggttagcagagctctctctcctttattatggtaagaaatcaattcaggattgttcttttatttcagatattgaattgtgttagcttgggctgccatgacaaagtaccacagaccgagtagcttaaacaacagaaatgtattttctgacagttctggaggcaaaaagtataaggtccgggtgttgctggggttggctccttctgaggcctctctttggctgatatctggctgcctttcccccatgtccttacagggttgtccctctgtgtgtgtgtctgtgtcctggcctcctcttcttaaaaggatagcagcatatggattaggactcaccctaatgaccacattttatttacctctttaaagatcctatctctggccaggcacagtggctcacacctgtaatcccagcactttgggaggctgaggcgggcggatcacaatgtcaggagttcgagaccagcctggccaatgtgtttgaaaccccgtctctactaaaaatacaaaaattagccaggcgtggtggcgggtgcctgtaatcccagctacccgggaggctgaggcaggagaaccgcttgaacccaggaggcggaggttgtggtgagccgagatcgtgccactgcactccagcctggtgacagagcgagactccatctcaaaaaaaaacaaaaacaaaaaaacaaaacccacagataccactgggtgacagttgtctacagtattcaaaacaatagcatcctatccaggtgtgtggtctgggagcaactggctgtcctatagaggctgggtgtgcagtagactctaccaactaggtgtgtgtaagtgcaatctaggatgttcacacaatgacgaaatggtctaacagcgcacttctaagcacgtttagggatgtacggctgtgtagagttcgtggcaggtgtcaagtaagtagaattcttcccaggaaatttttctttttcttctttttctgagacagggtctcactctgtcacccaggctggagtgcagtggcacaatcacagctcactgcagcctccacctcctgggcttaggtgatccttctgcctcagcctcccaagtaactgggaccatgggagtgcgccaccatgcctggctacattttttttttttttctgaggtggagtcttgttctgtctcgcccaggcaggagtgtaatggcaggatctcgggtcactgcaacctctgcctcctgtgttcaagtgattctcttgcctcaacctcccgagtagcttagattacaggtgcctgccaccacacctggctgatttttgtatttttagtagagatggggtttccccatgtggccaggctggtctcgaactcctgacttcaagtgatccgcctgcctcagcctcccaaagggctgggattacaggcatcagccaacacccagtggttatttttatgttatttaacatattctctatattatccaggctggtctcaaactcctgggctcaagcaatctacccacctcagccttccaaagcactgggattacaggcatgaaccaccatggctgtcccccaggaccttattctaaacacagttcagtatttcccaagcattcttgaatgccaggaactaggctgggacaatagtagtgtgcagaacagactagacatctattcagcaatcttgcttctgggtatacacacaaaagaatataaatccgggtctcgaagagatgtttgtacacccgtattcatagcaccattattcctagtagccaagcggtggaagcaacccaatgttcactgatggatgcgtggatgagcaaaatgtgctctatacgtacaatgaaatattgttcagtcctgaaaagaaaaggaaattctgacacttgctacaacatgaatgaaacttatttttttttttttgagatggagtctcgctgtgtcgcccaggctggagtgcagtggtgccatctcggctcactccaacctctgcttcccgggttcaagtgactctctcacctctgcctcccaagtagctgggacctcaggcatgcaccatcatgcccagctaatttttgtatttttagtagagatggggtttaccatgttggccgggctggtctcgaactcctgacctcaagtgatccgcctgccttggcctcccaaagtgctgggattataggtgtgagccaccgcacccggtcttgaatgaaacttttgaaaatattatgctaagtgaaataagccagtcacaaaaagacaaatactgtatgattttacttatatactgtacttagagtagtccaactcataaagacagaaagtaaagtggtgattgccagggactgagggaagtggtgagtggggagttaatgagggcagtttcagttttgcaagatgaaaagagctctggaggcagatggtgatgatggttgcacaacaaggtgaatatatttaacactgctatctgtacggtaaaaatggttaagattggctgggtgtggtggctcatgcctgtaatcccagcactttgggaggccgaggcgggtggatcacctgaggtcaggagtttgagaccagcctgaccaacatggtaaaaccccatctctacctcatctactaaaaatataaactactaaacctcatctactaaaaatacaaacaattagctgggcctggtggcaagtgcctgtaatctcaggagctactgagacaggaggatcgcttgaacccaggaggcggaggttacagtgagctgagatcaagccattgcactccagcctgggcaacaaaagcgaggctctgtctcaacaacaacaaaaaagtttaagatggtaaattttatgttacctgtattgttccacaattaaaaaacaaaacgggctgtgtctctgctgtcatgctcttgttttcctgcacttcttggaggctgcactctcagtagccagacttggagctctggacctcttggcttgaaacatttccccttgccattccttcctgttctgcctgcacttttcaggacacttcctccaaggaggccctctctgatgccttcctcccatccccttcagaatcggggtagccccagtggtggcttcaccagcctcatgagatccagttttgttcatctcttcgcaactccacattcggtgatatcacattgttagcttcaggtcagccacagtgggaatatttacaccatgggaattggcagactctacaaagcatggttttgttcccttgagagctagttgttaaacatttaccagcccaccatggaatggtcaccccttccgtgctgctcaaacatcctgtcctctctgatgtgatgtctgtcttccctgttagatgataagcttcactaaggcaggggccaggcctgtagctggtgagtggtggaaccagggtttgaaggctcaggggatacaggttgaatatcccttatccaaaatgcttgggaccagaggtgtttcaggtttcagattttttcagattttggaacatttgcatttatgtaatgagatatatcttggggatataacccaaatctatacatgaaatttatttgtttcctttttttttttttttttttttttgaaacggagtcatcttgctctgtctcccaggctggagtacggtggcacaatctcagctcactgcaacctccacctcccaggttcaagcgattctcatgcctcagcctcccgagtggctggaattacaggcacccaccaccatgcctggctaatttttttttgtatttttagtagagatgggtttcaccagactggtttcgaactcctgacctcaggtgatctgcccgcgtcagactcccaaagtgctgggattacaggcatgagtcacgatggccggccttatttatgtttcatagacattttatacacatagcctggagataattttatgcagtatttttaataattttgtgcatgaaaacaaagttttgactgtgttttcactgcaaccctttgcaattttcctcgtgtggcatcatgctggcactcaaacatatcagattttggagtatttctgatttcagattttcccattagatatgctcatcctgtaatggccaccctaatttcagtctctctccctggaaatcaacaagacaataataatgatagaaataatagtcagccaggtgtggtggctcacgcctgtaatttcagcactttgggaggccaaggtgggcagatcacaaggtcaggagttcaagaccagcttggccaacacggtgaaacccagtctctactaaaaatacaaaagttagctgggcgtggtggcacgtgcctgtagtcccagctactccggaggctgaggcgggagaatcacttgaacctgggaggcggatgttgcagtgagctgagatcgtgccactgcactccagcctgggcgacagagtgagaccctgtctcaaaaaaaaaaaaaaaaaaagaaaaagaaaagaaataatagtcatagctgttattatgaattgcagcattcctgtattcctgcagaccttttacctttacaaaaaccttaccctagctcagagtcgtctcctcccacctctccgctggcttcttcagccacactgggtttctttctccctctccaacatatttctctccattgtcttctcacttctcggtatgttcttccctcagatctttgcttgactgatcatttaggcttccttcaacttaaatgtcacttccttgaaggggccttttctgagaacctgagctaaaatagcctcggtcaccctccagtaatgtatgtcgtgctgtaagtggcctcatccccataattaacccccagtctttcatgtggacaacttgtgtctcctcaaagttatttataaagcaatatacaaaccggcttcaagttcctttctctttaccctctgaagtccctcctatgtagaaactcctgaggaaccagcaagttccccagttttatgatcttcattaattattttattgtggtaaaaaccacataacataaaatgtaccatcttaattactttaagtgtacaatttagtaatgttaagtattttcacattattatgaatcaggtctccagaactctttcatcttgcaaatcggaaactctataaccatgaaaaaacaactccccatttcttcctaccccattccctggtaaatcaccattttactttctgtttttatgaatttgactcagtaacttcgtataagtgagataatagcatttgtctttttgtgactgccttatttcacttagcataatgtcctcaaggttcagtcatgttatatcacaacacttccttttttatgctgaatactaatgttccattgtatgcatataccacattcccattgtccatttatctgttgatgggcatttactttgcttcaacctcctggctattgtgaatagtgctgttaggaacatggctgcacacatatctctttgagtccatgttttcttttgggtaaatacctagaattggaattgctggatcataaggtaattctacttttaattatttgaggaactgccataccattttccaaagtggctgtaccattttatattcccatcaatggtgcccaagggttccaatttctccacactgccttctttattatttttttattttttgagacagagtcttgctatatcgcccaggctggagtgcagttggcgtgatcttggctcactgcaacctcggcctcctgggttcaagtgattctcctgcctcagcctcccgagtagctgggattacaggtgcgcaccaccatgcctggctaattttttgtactgtcagtagagatggggtttcaccaagctggccaggctggtctcgaactcctgacctcgtgatctgcctgcttcggcctcccagagtgctgggattacaggcgtgagccaccacgcctggcccacattgccttttatactttcctttttttttttttttttgatagtagccatcccgataggtatgagttggtatctcattgcggtttcaaattgcttttctttaatgattaataatgaacattttttcacgtgcttgtttgtcatttgtatatcttctttggagacgtgtctattcaagctctttgcccatttttgaattgtgttatttgatttttttggtgttaagttgttgtagttctgtatatattttcaatattaaccacatatcagatgtatcatttgcaaatattttctcttattccgtaggttgtctttgcattctgtcaattgttgtgttatttaaggcacaaacattttacatctgatatagtcccatttgcctattttcacttctgttgcctgtgcttggtgtcagatcctaaagcatgtcattgcctaattccatttattttaaaaattttcttgtcaggcgcggtggctcacacctgccatcccagcactttgggagactggggtgggtggatcacctgaggtcaagagttcaagaccagcctggccaaaatggtgaaaccctgtctctactaaaaatttaaaaattagctgatcaaggtagtgggtgcctgtaataccagctattcaggaggctgaggcaggagaatcccttgaacccaggaggtggaggttctagtgagccgagatcccaccattgcacttcagcctgggcgacagagcaagactctgtttcaaaaaaaaaaaaaaattatcttgattctgtttgtcagttcccacaccccatttcatccactccaggagaaaacagacatgtcttcggctcccccggacttcctagaatttaacacagtgcccagggcacaagcatgaaacatacttgctgaatgagtggatgctctgttgccgatgtctgacagaatattatttatagcttacacctgactgtccctaggcaaggtctctgaattcttctggtcggcaccagaagggagggacgaagcttccagaggagacctgcctgccactgccctgtgatggggaacctaagggacaggcagaccttggcttttggtcccccagagagctggctctgtactggggctgggaatctccctgatctttgatttgcagggtgaatggggtggaaccttctgcccctccctccattccccctactctggtgtgcaggaagctgaggccttctaggagactggggatactgaggctgagggaggtagggaggagttaggaggtttttgattctcacttgaatctttcccactgtagctgaaaacagggtttttgggtcacctgccccagcaggggatgggagtataggcggggtctgcgtctgcaaccccctcctgaatgtggaaatcttaacggggccaacacctcccccgttgctggatatggaagcaatgatactttctcccttccagctctgcactccttataccccactgggatagaaatcctgtctgttggtgtcaggcaggggtctccggctacccctcctctgctggggtggaagatggagaggtcaaaggagcaagcctccttcctggcccttgcaagggcctccagcctggcagccggagggattaaggacaagaggcccctggcgtccgtgagtctggcgtggctgcccaggagcctcccaggggagtcagcgtgggccagagggctggaggctcccagatcaatcagaggtctgaaggtcactggagctgtgaccttcaaattaggatacttgtaacccaggaggctggcacacccccacgggggatggggcgcatggttgaagagaatccatctcccagagaggtgccctagggcccccctttcaccatgaccctgctaacactttacagatgaaaagcatacctctctctcaccccctaatcttatcgcagtgaattgccctggggtgaaagaaaagcctctggatcccaaacctagaatcactttgaaatactgctgtccccaacggctccctttatagaggccctgggctgcctttgaggtgcatattttgcaaggttgaaagcaggagggagtgaaaaaatgcctgcatttgcctctgaggtgctaaaggaaaaaaatagctcaatgatgatggatgggcagactttatttgggatcaccgcagtgggtacggggaccactgccataggggcttgcggttggttggtgagagaggttgggttaattcctgaatacagcagggagagtgggaattcacagccaaggagcagggtcgggagcagtggctagaaaactgctaagaggaaacttcagagataagggcgattctggttaaactgaccttgctagattcctgctgaaggcagccccgggtgacaggaggaatccaatcagacatcaaaggggatcagatgtcgacagtggagggttccttctaaactcacttagcagggttcttccctgaaactgggtcttagatgggcctagcacaagattcagaagcctgtctaaagtgtggccaagcctgggcgcagtggctcatgcctgtaatcccagcactatgggaagccaaggtgggcagattgcctgaggtcaggagttcgtgaccagcctggccaacatggtgaaaccccatctctactaaaaatacaaaaattagccaggcgtgatggcacatgcctgtaatcccagctactcaggagtctgaggcaggagaatggcttcaacctggaaggtggaggttgcagtgatctgagatcatgccattgcactctagtctgggcgacagagtgagactctgtctcaaaaacaaaacaaaagaaaacaaacaaaataacgtgtggccaagcaaagagtctttgtcagtggatcagtgtctatatgtcaagtcaaaggaatatattgcagataatatagtatcttctgttttcctgaatgatgatctggatgtgtaggagaaaggctttcaccagctttggctgaagggtggttttgtattgcaactctgtcttcgacattcaataaatactgaattcactgtcagtcagtcaatgacttcttggctagtctcttgctagtttattcctaccaagccttacttcactcaggcaaatggcaatggggactctgttgttgattctctagtaagggatggacatctacaataaatttattatagattgtctctttacttacttgtcataaataagattattatataattattgcattacatatttaattatatgttatggataagattattgtaatataatagtaataacctataatgaatgagaaatgtgccccttttgcaaaccctgcacttacttgtctgatacctttcttcttgaatttcatggaatactgtctcattccagtaataagaaaattcacggaagatacaggcatgacctaagtgttctcaccaaacattttcagagtattctcgcaataaccctttgactgggtactttcagagatcctttttattttccacataggaagagataatttgtctaacagctactgaataaacagatccaagatttgaaccctcatagtttggatgggaatctgagttctttcttttttgtttgtttgtttagacaagctcttgctgtattgcccaggatggagtgcagtggcacaaccaccactcagtgacaccttgacctcctgggctcaaacaatcctcccgtctcagcctcccaagtctcagcacacctgggactacaggtgtgcatcaccacgcccagctaattttaaattttttgttagagacgggtacttcctatgttgctcaggctggtcttgaactcctgggctgaagtgatcctcccacctcagcctcccaaagtgttgggattacaggcatgagccactgtgcttgaccaacccacatctcattcagctcctgcaccatttctcttctcccccttagaactaactctatagcctcatctttacttttgcatttctctatctctcttaacctcattccaatcaagctttcatctataccattttactaaaaggccaccaataatctccacattggcaaatccagtagttgagttccagctgtcataaggacttgacaatttgtcacctgtccttcttcttccttttttttttttttgagacagagtctcactctgtcacccaagctggagtacaatggcatggtcttggctcactgcaacctccacctcctgggttcaagtgattctcctgcctcagcctcccaagtagctgagattacaggcgcacactgccatgcccagctgatttttgtatttttactagagacggggttttgccatgttggccaggctggtctcaaatcccaacctcaggtgatctgcccacctcggcctcccagagtgctgggattacaggcattagccaccgtgcctggcccaacccgtccttcttagaagacttgagtccacactgaattgggttcaccagacctccctgacaattctctcttctggctttcttcctacctcccctgttgctggatatggaagcaatgatactttctcccctttccttctctatactccctataccccactgggatagaaatcctgtctcttggtgtcaggcaggggtctcaggctacccctcctctgctggggtggaagatggagaggtcaaaagagccagtctccttcctggcccttgcaagggcctccagcccgacagccagagggattaaggacaagaggctcctggcatccctgagtctgaccagattgtagtagccagcctccaaagtggcccgcaataatcctcactccctagtagtgctcacagtcttgtggtctcttctgacaccgacccagagctggttcatgaccagctgaggctgagggaagtgtgaagggagagtctaggaagtttttgattctcatttgaacccttcccattgcagctggaaacagcagaacatggaggaagtgatagtgtgtgtgacttctaatgctaagtcataatggacatcgtagtttccacttggatcacttgcttgggagtaggggtaggaattcagccaccatgttgtggaatactcaagtagcccctggagaggtccaggtgcagaggaatcagcttgccagcaccaacttggcaaacttcgagtgagccacgtagattctccagccccagtcaaaccttctgaccacctcatgagagaccccagaccagaactgcccatcagagctgtttccaaatccccaactttcagaaaccataaaagataataaatgattattgttttaagttaatacatttttgcatgatttgttatgcagcaaattgctaaccaatacatattctttctcatattcctttccatgtttttctactatcatgtctcaattctagagtgctccagagttcagtgctcagatcttgtctaccatctggatttgatacctaaatgatcccacacattgctaaactttgcaatagcatctatatattgttaaatctcagatttatagctctagctcaacatctcccatgaattccatcaacccactgtttataggaaatttccacttagatgtcttatagtactttccatcttaacatagctacgagtgaacacctcatctcacctcatccctgacacagctacgtaccctcagtctgcccatctcagtaaatgacaactccatcctcccagctgctcagacctaaggccatttttgattcacagctctgcatatccaatccatcagcaaatcctggttggccctcaatatgatagtggcttggacaataatactgattagattcaggaagaatgttccaggtgaatgctcagaggtagaaccaagcttatgttctccagaaacttcaaggaggctgtggtgggctaaatgttgccttcccctaaaaagatacatccatgtcctaatcctaatattcagagcctgtgaatattgctttgtttgaaaaaaaggtggggaggtgttgtgggagatatgattatgattaagttaaggttcttttgttttttttttttgagagacagggtctcactatgtcacccaggctgagtgcagtgggacaatcacagttcactgcagacttgaccttccaggctcaagcgatcctcctgcctcaacctcccaagcagctgggactacaggcatgcaccaccatgcctggctaattttttttttttttttgagacaaagtctcgctctgtcacccaggccggagtgcagtggctcaatctcggctcactgcaagctccgcctcccgggttcacgccattctcctgccccagcctcccgagtagctgggactacaggtgcccaccaccatgcccggctaattttttgtattttttagtagagacggggtttcaccatgttagccaggatggtctcgatctcctgacctcgtgatctgcccaccttggcctcccaaagtgctgggattacaggcgtgagccaccacgcccggccctggctaatttttgcttttttgtagagacaggtctcactgtgttgcccagactggtctcaaacctgaggatctcaaagcgatcctcatgcctcagcttcccaaaatgctgggattacaagtgtgatcaactgcacctgatcttttaccattttttaattgtggtaaaatagacattacataaaaatttccatcttgaccatttatttacagacacagttcaatggtattaaatacattcataatgttatgcaactgtcactgccacccatctccagaactcttttcatctgtcccccaactgaaactctgtccccacgaaacactaattccccatttcctcttgttcccagcccctggccaccaccattttactttctgtctctgtgaatttcactacttaaggtatttcatgtaattggaatcctacagcatttgtctttttgtaactggctcatttctcctacaatgatgtccttagagttcatgcatgttatagcacatgtcagaattatcttcctctttagggatggataatattccattgtatggatggaccacatttttcttacccatttatctagcagtggacacctaggctgctttcacatttaactattactgtgaaaaaatgccattgtgaatatgggtgtgcaaatatcactttgagaacctgctttcaattctttgaggtatatactcagaagtggaattgctggatcatattgtcattatattttcagattttttttttttgagaaaaagtctcactctgttgcccaggctggaccaaagtgtcatgatcatgactcactgtagcctcaactttccaggctcaaacaatccaaccacctcagcctccaagtaactcggactgcaggtgcatgcagctaatttttaaattttttctgtagagatagggtttctccatgtggcccaggctggtcttgaattcctgagctcaagtgacctgcctaccttggcttcccatagtgctgggattacagatgtgatccacaactcccagcctttttttttttttggccagtttaataggtgacgaatagtatcctattttcttagttcacattttgaaaaatgagcaaagttaattcacctttaaaaattttgtgaggccaggcatgggggctcacgcttgtaatcccagcactttgggaggctgaggcagggcggatcatcggaggtcgggagttcgagaccagcctggccaacatggtgaaacctcgtctctactaaaaatacaaaaaattagctgggtgtggtggcacatgcctgtaatcccagctactcgggaggttgagggaggagaagagcttgaacccgagaggcggaggttgcagtgagccgagatcatgccactgcactccagcctgggcaacacagtgagactctgtctgaaaaagagaaaaagaaaaaaagaaaatgtttgtttcctggcagaaacaagggcagaatctgtctggaggggtataacctaacctagggcatacaggattcccactgataaaaccctagtaaagataagcccacaatccaaaactgcaaacaatgaaaagtccatcctgaatgagggttagtagaacaatcaaacagcaggattagatccccaggaattgcagctaacagaacttctgccagtcatgcattcacttatttaacaaatatttattgagcatgtgctaggttccaggcagtattttagatactttgggtacacaagcgtacaaacagtttacaagtcctgctctcagagagcataattccaacactggatagagactttataaaagaaagttattggaagatcattatacatggtatgcttgtatcacatgtaccccataaacgtgtagaactattatgtatccataaaactttaaaataaaaacataaatatattcaaaatgatccaagacaactcaacaacagcaaaacaacttgatttaaaaatgggtagagaagttgaatagacatttcttcaaagaagttatacaaatggccaaaagcacatgagaagatgctcagcatcgctaatcatgaaggaaatgtaaatcacaacggcagtgagaagccaggcacggtggctcctgcctgtaatcttagcacattgggaggctgaggcaggggaatcacttgaggccaattgtctgagaccatcctgggcaataaagtcctgtctgtacaaaaaaaaaattttttttaattaaaaaattagccaggcatggtggtgttgcctgtagtcctagctacttgggaggtgaggtgggaggatatcctgaacctgggaagtggaggctgcagtgagccatgatcgtgccactgcactccaggctgggtgatggagcgagaccctgtctcaaaaatttatatatatatcacaatgagccattaggttgtggctatatagatttttaaaaggcagaaaactacacgtatatatgagaatgtagggaaattggaatcttgtgcactgttggtgggaatgtaaaatcatgcccctgctatggaaaacagtatgatttaaaaaaaaaaaaacgtaaaaatagaattaccttatgatttagcctttccactcttgggtttataccaaaaaataaaaataaaaacaaaagttgaaaatggactcaggaaacgggtatctgtacacccatagcggcattacacccaataaccaaaacacagacgcgatccaatgtccattgacaggtgcatggataaataaaaatggagtctgtctacataaccgaatattattcggccttaaaaagaaggagattcttatacgtgctactatatggtaaaccttgaagacactattctaagtggaataagccagttacaaaacgacaaatactgtaagattccactcatataggtatctgaagtagttaaattcatagaaacaggccaggcaccgcggctcacacctgtaatgccagcactttgggaggccgaggcggatggatcatctgacgtcaggagtttgagactagtctgactaacatggtaaaaccctatctctactaaaaaatacaaaaattagtcaggcgtggtggtgggcacctatattcccagctactcaggaggctgagacaggagaattgcttgaacccaggaggcagaggttgcagtgagccaagatcatgccactgcactccagcctaggcaacagagtgagactctgtctcaaaaaaaaaaaaaattcatagaaacagaaagtaaaataatggttgccaggggctatgggtaaaggagaatggggagttactgtttaatagttctagagtgtcagttttgcaagatgagaaaggtctggagactggtcacacaacaatggggatacacttaataactcgtttaagatggtacattttatattccatgaattttaccacagttaaattattgaagacataaaaaaaatccaaatatttgaaaacaacaagacataataaaatatcggggatattgaaaaaaaaacctttgttttctagaaataagaatttagtcagtgaaggtgttaaccaggagattagagccatctaatgagataattagtgaactggaaaatagatttaaggaaaccatgtagaaggtggccagggaaaataaagaaattttaaatatgaaagaagttaagagctgtagaagatagaatgagaattctaacatatgtgtatgtaatgcatttcaatttttttggctgcaattgagagaaaccggttaaaatgggctccagacaaaatgatgaagggagatagcttttattgaccccagttacagtcagatccaggtgttgaaagctccttcgccaaattctgctgctttcctgttctctgctttgctttaatctctctcggcctcatcctcaatcaggatcttcccaaccagtggcaagtttgctactagcagtcacaggtttccctcctttccagcttctcaacccaattaggaaaagtaacattttttgttgttgtttgtttgtttgttttttgttttgttttgttttttgagacacagtctcgctctgttgcccaactggagtgcagtggcatgatctcggctcactgcaacctctgcctcctgggttcaaacgattctcctgcctcagcctcccaagtagctgggattacaggcttgtgccaccatgcccggctaatatgttttgtatttttagtagagatggggtttcaccatgttggccaggctggtctcgaactcctaagacttcaggtgatccacccgcctctgcctcccaaaatgctgggattacaggtgtgagacaccgtgcctggcctaaaagtagctttttctcaacaatttcagcaaaagtcgcagttggggctagcatagccttacttagattctgtggccatccctgaacaaatcactgagaccaagaggacgtgctgctctcctgggccagacctgggtccttttccctttcctggagtcagcagggtgggctcagccctgcctgaaccatatgaaaagagagccgagaaaggagccatctcagaagaagcccagtgaagacttggcaggcgaaagtggcacacggggctgggaacatggtagctatggtaagaaaagcaagggacgcgcatgtgttccgatagtgaaatacgcatatcaactgaattcacatccacgtttgtgttttccctcttctctcacatatgtctagtgcagtagcaaatatttttgcctgcttctttctattcaacattcaggaaatgaggctattcttagctcactcttatttggggctttcgaaacatgagacacaattttgtgtattttgcatagattttcttactttaccctgaccacaattctgtaagtccatatgcttttatttttatgttttattttatttttaggttttagagatgggggtctggctctgttgcccatgtggagtgcagtggtgtgatcacggcttactgcagccttgaattcctgggcacaagtgatcctccaactacaggtgtgtgccaacatacctggctaattttgaaaaaattttgtagagacagggtcttgcccagcctggtcttgaactcctggcctcgaacttctggcctcaagcaatcctcccatctcagcctcccaaagtgctgggattacaggcgtgagtcacctgacatgagtcacccagcaggtcatacatttcaatcataattttcacttcactgatgaagaaactgaggtgcagagattaaataacttgttcataggcacacaaaagttaattatggagatgtaattggaactgaggcagtacaattccagattccatcccttaactgccgtagtctgtgctgtgtctctggaattcaattcattttgaagataactctcatccagcaatgcatgacaaagtggaaatgtcccctcagaagtagttccctttggccgggtgcggtggctctcacctgtaatcccagcactttgggaggctgaggcgggcagatcacgaggtcaggagatcaagggcagcctggccaacatggtgaaaccccatctctactaaaaatacaaaaattagctggggctggtggtgcgtgcctgtaatcccagctacttgggaggctgaggcaggaaaatcacttaaaccagggagttggaggttgcagtgagcagagatcgtgccactgcactccagcctgggcaacagagtgagactccgtctcaaaaaaaaaaaaaaaaaaatagaagtagttcccttaaatggtaccaatttgcacattagaatcaatttgttcagtgtgtacgaagcccgtgactttaatggtggtttcctctgggtggtcctagaagactatcctggttacaaaagaaagaagccccatttacttcacctcataccccatgaccaccccacacccataagggttttcagtcagcagacatggccactccatggagcagctggggcaccgctggtctcagagggttgaggatgacagaaacaactcgaactggtttcggcaaagaggggggatttcttggcttaggtaaccaaatctgagggagggaaggggtgtagttgtcttcagggtgatggaatgcagccagcagctgtctctctaccacttgagtctgcatgttggtagtgagctgtcatgcaaggcttccccatgaggtcagaatggtgctattctcaggttatccatctgcaaggagaagacctgcctcccttgtccttagaaggctcttcaccagcctggcttgggtcacatgcccactcccatggccaaggcacccagcatactacaataggtgacctttgtggggatacgggtgagaagaagcagtccctaaaataaaagccagggtgagttttcccgaagcagcagggaggagtgccacacagatgaacccattcatacccaccttgcaccacatcctgtgttgtggggtcttaggaactccttcctggaagaaatagcctgtgtgacagggccttgaaactaagcaggagcttgctgaaaagaggaatgagaggggccaggcgcagtggctcacacctgtaatcccagcactttgggaggccaaggtgggtggatcatgaggtcaggagttcaagaccagcctagccaacatggtgaaagtccgtctctactaaaaatacaaaagaattaactgggcatggtggcgcatgcctgtaatcccagctactcaggaggctgagtcagaagaattgcttgtactggcacccagtaggcagaggttgcagtgagcagagatcacgctgctgcattctggcctgggctacagagcaagactctgtctcaaaaaaagaggaatgagagaggaacgagcatttggcagacatgcagaggtctacagatgagtagtttattctgactggcccgtggaggcggtggtggtggaggtgggtaaggtgaagcatggctgcaggggaggccacagggaactccacaaggcctgaacctgacctcgaaggtgcatgtgtaccttggatgggtacagtggatataaagttttgctcacccggtgttcactcttttatgaacaaaatacccttttccttttggagagcaccctctcccaccctctcagtccatggagcctatgaggcctctctctccagctcctgtgacctctacctggtcaatagaagtcactggctcagggatggacatgtgacccaatctgggccaatgaggggcagccctaggagttttgctagaaggattgcagactattcctgctagcaaaataagaccaatagatctctaattttttttttttttttttttttgagactgagtctcactctgtcgcccagtctggagtacagtggtgcaatcttggctcactgcaacctcctcctcttgggttcaaattatgctcgtgcctcagcctcccgagtagctgggattacagtaatggaccaccatgccaggctaattttttttgtatttttgatagagacaaggttttgccatgttggctaggctggtctcaaactcctggcctcaagtgatccgccctctttggcctctcaaagtgctgggattacaggtgtgagacactgtgcctggcctctgataaaaatttttggggggttgagtccaggtacgcatgaagccaactacccctggacttttcaactacatgattcagtaaacaacttttatttttgtttgtttgatttcgctttagcaatcagcatttctgttgcttgtcatggaagagatgtctctaaacaggagactgatggagttagacttgtgttttggaaggatgtccttcttgggatcggagaatggtatggaaacagcaagcaagagtggagacagccaagcagtgaagaatcaagggcggggtggactagagccatgtcacctgggggatatatcagtgtgagagatgagaaatggatgcacaaaaatggaaaacaagagagatgtggggactcatttatgggcagacgttgatctccacaagacatggtgactatttggatatggagaatacagaagagggatgagtcagggattacttgacaagggcccaggagaggggctttatctgtcatgcctatttcagatgtaagtgatgaaaaataaactcaaattggcttaaacaaaataaataggaatgtaataggctcaacatctgtcaagttcaaggagcttcagtacagttggatccagaacttctaatgattttatcaagatatgacctttatgtctgtgtttccttttttttttttccttgagacggagtttcgctcttgttgcccaggctggagtgcaatggcgccatctcggctcactgcaacctctgcctcccggcttcaagggattctcctgcctcaacctcctgagtacctgggattacaggcacccaccaccatgcccagctgattttttgtatttttagtagagacgaggtttcaccattttggttaggctggtctcaagctcgtgacctcaggtgatccacctgccttggcctcccaaagtgctgggattataggcgtgagccgccacgactggccatgtctgtgtttctcagacctgctttcctctgatgtggtttcatcctgccacaggatctcccctcaaaaaggtaaagatagctgccaacatctcagcacctgggtgctaccagctaagagacccagaggaaacagaacacttctatctcaatagttccaccaaagttccaggcccaaccatgagtcaattcctgagatgctgattggtcagacctgggacatgtgtccgttctcacatcaggaagtgatgtgatctccacttacactgcacaggctgagagtggggttggtctggatccccaaggaaaatagaaagtgctagaatcagaataaagggggaatagatgtggggtgggaaaaccaacagaggctcacttcagtgtgcatgggatacatttctgagtaatatgggagggtggtttttgtctagggatctacagaatgtgtgtttgtgtgtggggtggggatgaagggttgtctttaaggagcccagcagcattgaggattggtctgggatggaggcccagggtttggaggcctggatttggctgctattttacattttattttattttattttttgagatggagtttcactctttcacccaggctggagtgaagtggcataatcttggctcactgcaacctccgcctcctgggttcaagcagttctcctgcctcagcctcccgagtagctgggactacaggcacataccaccgtgcctggctaatttttgtatttttagtagagacagggtttcaccatgttggccaggctggtctcaaactccttaggtgatccacctgtcttggcctcccaaaatgctgggattacaggcgtgagccactgctcctggccttggctactattttagatagggcagttgggaagagcctcttttaggagatgacatttaacctgaactccgcagggtgaaaagagcttgtcttcatcttcatgagggtaagggggatgatttagaggtaggaattatcttgggatgatcaaagaacaaaatgatgactggcgagacgagaacatggtgcacagtggggagccgggaggcaggatcttgtgggcttagtcagttcctcattgaacactagtatggaaagccatgacaaagtgttaagcagaatcagtaaagcacagtgtcactcgacctttgaggattaccagaaggaggacaggccaatcgtaagcctgatcaagagaagggaaggaggaaggagaagggggaactttctctgtcaccttcccgccctgttgaggcagttttcatacgttggatgtttaacacaacccaaccaagactgggacccggtgcagtggctcacacctagaatctcagcactttgagaggccaaggtgaaaggcttgagcgcaggagttcaacactagcctgggcaatatagtgagaccctgtctttataaaaaaatagaaaaattagccaggcatagtggtgcatgcctatagtcccagcaactcaggaagctgaggtgggatgatggctcgagcccaggaggtcaaggctgcagtgagccatgatctcaccactgcaccccagcttggcgacagagcaagaccctgtttcacacacacaacacacacacaaagattggtatggtcactcttactttactgacaagaaacctgcgtacagaggagctaaaccaccatcccaaggccataaaactactgcgagtctaagccaggatatgtctgaatatgaagactcctctgaatgctgggtcccagaagcactaagcttggttatgaacctcatgggctctacatagcttctcaccaagttgggtcctgttgagcctattgtgcaaggaaggagaccaaacaccctggaggtttgctcacctggcctgagttacctggccgtggaaggcccctgggctcaagttccctgagaggcaggggttaaaccatgtgtcctagaacctcagcttgcatcccaccctggaattttcctctgagttgcaaaatcaggcaagctgccaagccatatatacattgccgggtagccaggcaacaccgtgctttttctgggaaggagcacaatgtggtcactgtgctgccgacgccaggttccagatggaagaaagactttaatccccagcttcacggctgtttggcacacttcgctcctgaaagcctgctcgggccagttttcactctgactctccagtgaggccattttgtctcattccgtttctgatgtttaaatgttaatcctttacaagttggttttagtggagtaggaaatggcggagaaggctggaggtggattcagatgcaacagggatggcacttacacctttcgatgaaaaagacgtgtgattccgcgattttgcagttgtgaattgtgctgctatacgcatgtgtgtgaaagtatctttttcacataatgacttcttttcctctgggtagacacccagtagtgggattgctgggtcaaatggtaattctacttttagttcgttaaggaatctccacactgttttccatggtggctgtactagtttacattcccaccagtagtgtcgaagtgttccctgatcacaacatccatgctaacatctactgttttttgattttttgattatggccattcttgaaggagtaagggggtattgcattgtggttttgatttgcatttccctgatcgttagtgatgttgagcattttttcatatgtttgttggccatttgtatatcttcttttgagaattgtctattcatgtccttagcccactttttgaagggatttttttttttttttttggttactgatttgtttgagtccattgtagattctggatattagtcctttgtcagatgtatagattgtgaagattttctcccactgtgtgggttgtctgtttactctgctgattgttccttttgccatgcaaaactcttcagtttaattaggtcccagctatttatctttgtttttattgcatttgcttttgggtttttggtcatgaaattcttgtctaagccagtgtctagaaaggtttttccaatgttattttcgagaatttttatagtttcaggtcttagatcaatcaatgagtgaataaacaaactgtggtatgtatatatatacgatggaatacttctcagccataaaaaggaatgaattaacagcatttgcagcaacctggatgagattggagactattattctaagtgaagcagctcaggaatggaaaaccaaacattgtatgttctcactgatatgtgggagctaagctatgacggcaaaggcataagaatgatacaatggactttggggacttgaggggaagagagggaggggggcgagggacaaaatacaacaaatatggtgcagtgtacactgctcgagtgatgggtgcaccaaaatatcacaaatcaccacaaagaacttactcatgtaacctaataccacctgtaccccaataacttatggaaaaataaaataaaataataataaaaaaagaaaaaatgtgtgagcaaaatgattaataggcaaatgatagaagaaaaagaaaaagcccatgaagttagaaagagaggcatcacttctcgagtgaacaggaaatggaaatcaggaccacataatgtcaagtttaactctcagagtgatgtaaaaatgaaaatcctagggctgggcatgggtggctcacacctgtaatcccagcactttgggaggctgaggcaagtggatcatgaggtcaggagtttgagaccagcctgaccaatatggtgaaaccctgtctctactaatgtgcaaaaattagccgggggtggtggcacacatttgtaatcacagctagttgggaggctgaggcaggagaatcacttgaacctgggaggcagaggttgcagtgagccgagatcgcaccactgcactccagcctgggtgacagagtgagactctgtctcaaaaaaaaaaaaaaaaaaaaaaaaatcctgataaaggccagtgttggtgagggtgggcagagtaagtgtctgctgtcatacgtggcaatgggagacatttagggtatgacctctctgaggtgattttatgggacttgccaacattttgactatgtatgacccccccaacacagcaaatgtgtttccactaattaatcttgcagaaatactcagagaagtgcacattttaaggcgagaattgcaaaatattggagattctctgtctatcaatatagaaatggtaaaataaatggtgttgcatccataccattgaatcttttgcagaaaaggttgatgcagagatgtgtgtttcagcataggaggttgccttgcctgggacatactgttgggtcaaatagggaaaaaaattaagttagtgaatgatatatagagtctgaattcaattctgttgaaagagtatatatgtatatatatgtttgtatttacttatatttttaaatacaccaagaacatttctggactttgtattttttttttttttttgagacagggtcttattctgtcacacaggctagagtacagtggcacaatcaccccctgtggtctcaatcaccgcctctggtctcctacctcagccccttcacctgtggagtagctgggactgcaggcgtgcaccaccacgcctgttttttttttttgttttttttttttgtaatgatggagtctcactgtgttgcccaggctggtgtcaaactcctggggccaagcgatcctcctgccttggcctctcagaatgctgggattataggtgtaagccaccatgctcatccagaaaaataaaatattaatactggccatcattttaggattaaaaagttgtcaaaaatgcactgttggttcaaaaaacaacaaagggcaagttgccatgctgtatgtagaatattattttatgtctataaaaaagacactgtgtgtgagcatgcatgtgtacacacaaacacagatactatatatacatcctttgtacaaaaatttagagaaggtaaaagcaagaaaaccttgctagtgattggccctgtgggattgggagaatatttttgcttttttgctttctatatttctatatagtttgaagtttctcaaaggttgcatttttttaatttaaaaaaattatttaaaatacctttaagaaactgccatagtcctactaccctaacaggagtaattttagcaattttctgtatgaatctctccctctctatatatatctttctttctctatacccccatctatatacacacatatacacctacccagtaagtgagttgttatcccttaaaccccctcccatgggagagtccccccttttctgagtcatcagtgtccattataccactctgtgtgcctttaggtacccatagcttaggtcccacttataagtgagaacatacagtatttggttttctgtctcagttacttcacttagaataatggcctccagctccatccaagttgctgcaaaaacattatttcattgtttttcatggcttagtagtatattccatagcatacaaatataccatattttctttatctacccattgactgatgggcagttaggttgattccatttcttcgcaattgcaaattgggctgcgataaacaaatgagtgcaggtgtgacttttatataatgacttttttttttttttttcagatggagtcttactccatcacccaggctggagtgcagtggcttgatctcggctcactgcaacccctgcatcccgggttcaagtgattctcctgcctcagccttccaagtagctgggactacaggctcccatcaccacgcctggctaatttttttttagtatttttagtagagacagggtttcactatgttggccaggctggtctcaaactcctgacctcatgatctgcccacctcagcctcttttcctttaggtagatacctaatagcgggattgctggagggaatggtagatctacttttagttttttgggaaatctccatactgttttctataatggttttactagtttactttcctaccaacagtatctcagcattccctttttaccacatcccctccaacatctattggtttttgactttttaaaaatggccattgtaattgaggtaaggggtatcccactgtggttttaatttgcatttccctgaacttctttttttttttttttactttaagttctggcatacatgtgcagaatatgcaagtttgttacacaggtatacatgtgccgtggtggtttgctgcactatcaacctgtcatctaggttttcagccctgcatgcattaggtatttgtcctaatgctctccttcctcttgctccccagcccctgacaggccctggtgtgtaacgttccactccctgtgtccatgtgttctcattaaaacttcttctttttaaaaacagttttgctgaggtaaaatgtcatcaaatagactctgcataaagtgtacaatttggtaagttttgacatctgtctgtacccgtgaaatcttcaccacaaccaaggtagtgaacgtatccatcaccctcaaaaatttccttttggccaggcgccgtggctcatgcctgtaatcccagcactttgggaagccgaggcaggtgcatcgcctgaggtcaggagtttgagaccagcctggccaacatgatgaaattccgtctctactaaaaaatacaaaaattagccaggcgtgatggtgggtgcctgtaatcccagctacttgggaggctgaagcaggagaatcgcttgaacccggaaggcagagcttgcagtgactagagatcccgccactgcactccagcctcggtgacagagcgaaactccatctcaaagtcagcagcaagaggtcaggagtttttactccctcttcaatgttttattcccaatatttagatcagtgcctggcatatagtagatagtcaaattgtaatttgaataaatcctagcttccttttgctacaccaaggcccacagctcctgctggtagctttacactaagaacgactgcggtctgccaagatcatgtgtgcacgtgcctccgggcagctgcatccaaggacgtgattaactgctaagcccccctggatctatgcattccttggtcagcacattttcttcccagtaaagaggctacagacccagcaatgttatgtaatccccaccacaccccatgtgagacaaatcctctaatcatttcagatgaaagatttgaagcacagagccattaaggatggatcaaggttggacatgaaattggcgtggttttatgcagtggatggtaaccaggacccaaaataggattcaagagaagtctatttgggggtggagcagtggaggcaggaacccaaatataagaatgtcatgctgtgggccatcagtcaatggcatttggggtctaggggtgagagaaggatctgggctacagctggcgtaccctgatggcggctgggcctgtggctgtggctgaattatctcagaagaaatgaattacctcagaaatgataaaggaggattaggaccatccacacccttggtggaatgcctgagctctggtggaagcaatatctgttcagacggatctcagctcagtacgcaagaaaaacccaccacaatggcttcaatgagtaagggatttatttttcttctgtaactgggggtggactgtcatagctcactgacttcatcagggattcaggctccttttttcttactctctccgcctttcatagcacacggactttcataacacacagacatcttcctcatggctgcaaaacggctgtggcgcttccaggcatcacatccgtgttccaggcagaaagaaaggggaaagaccaaaacccttctccttacaaagctttgctttttatttgagaatggatggcaaaaggattttcacccacgtcccactggccagaactgtctcacttgccccatttatacagctgcaagggtttctgggagaaaatatttttgactgagcacattgctgctgtggacagaatcagaggttgttaacattaaacaagagagagagtggaatgcagagcaggaaggcaagcagaatgtctggcacagtcagtagcaaagtgaggagagagcttcgagaagaggggtctaagcaggatcctggaagtgaggtgggtctccagagggagtgctgaaggtattttcatttcaggaggcaagatctggaggagcgttgggaagggaatcgaaatagctctcaaatgccctcactgccacccactaatggagacatgatcgttccccttctgcagatggcagaatgaagtcttacagacgctaacaggcccttgtcactgtggtaacttcctgaagcatttatatacttgaataagtagtcaatacacgtgatacaaaccttttatttaaagcacaaaagaatacgtattagtgaattttccttcccatcgctgtgtcccagctctcttccctggaggcaacgacggctaacagttacagttgatcttcattatttgcagattctgtgtttgcaaatgtacctactcactaaaatgcatttgtagcccctgaatccatatgcacaatgttttcatagtcatttgtggatgtgcgtagagccgtgaaacattcgagaccctcactgtacaggttcccagagaaggtggaccgaggtctccgccttcttgtctcagttctcatattgtaaacaactgtccttttggccgtctatttagtgccacattttttgcactttggttggtgatttggctgttaaaaatggctcctaagcatcgtgctgatgtgccgtctggtgtccgtaagcgcagaagctatgatgcgtcttatggaaaaaatctgtgttagatgagctttcttcaggcacgagctatagtgctattggccatgagttcaatgctaatgaatcagcaatatatattaaataaggtgtctgtaaccaaaaactcacataaagcaaggttttgtgtgaatcggttgatgaaaatgcaggaacctgagtgtgttaaccttttttttttttttcattttctgtatttgtgatgctttgacatttgagaatgtgctgatcccagagagcctgcctcttccagggccagccagttcctagagattgaaacagtaacctaggagtgcacctctctcatgcaaaccggtcagtctggaaaccttccttcaaaccacatccttcaactaccacctttgtggggctcccacaagtgacccacatcccccatgccctagtattgcctcaagtccaggtaccagacaactagtggcagctacaccctggagcctgctgaaattattccaatttgccaatctgaaggctgcctacccccaactggttccttcccaaggagaccataataaagtcctgtgccttcctttctcctcactcctctgtctcccggccaaccctggtgcttccccatgttcccccatgtggcatgctgtgcctctgggttccagggatctgtgtctatgaatctgttccttcacaacaatcatttctgtgcctgcctttttttttttttttttttgagacaagagtctcactctgtcacgcaggctggagtgcagtggctcaattttggctcactgcaacctccgcctactgggctcaattgattctcctgccttagcctcctgagtagctgggattacaggtgcccgccaccatgcccagctaatatttgtatttttagtagagacagggtttcaccatgttgaccaggatgatctcgatctcttgaccttgtgatctgcctgccttggcctcccaaagtgctgggattacaggcgtgacaatttttgtatttttagtagagacagggtttcaccatgttggtcaggatggtctcgatctcctgacctcaagtgacccacccacctcggcctcctaaagtgctggaattacaggtgtgagccaccgcgcccagcctatgcctgtcttaccatgcctgattataccaaatcccaggaacatttcaacactgaccctgtatattccctagaagcaatggttccatattgctaattcagtgtccacagtgacgttatagaacacatagctaccctgaataatcagaatcgactgtttgtatttatccttccagagatgttctggacctgtgccaggtaatagatttctttctatttctttttttttcaccacataaatgtatgcacattatagatgctattttgcatgttgatttttttaaaaaattgacaaataacaattgtatatttccatgggctatagtgatgttttgatacatataatgtatgatgatcagatcagggtacttggcatatccatcacataaaacattgatcatttctttttttatttttatttttattttttgagacagggtctcactccgttgaccatgctggagtgcagtggtgcaatctcggctcactgcaacctccgtctcctgggttcaagcgattttcctgcctcagcctcctgagaaattgggactacaggacaggggcccaccaccatgcctggctaatttttgtatttttttagtagagacagggtttcaccatgttagccaggatggtcttaatctcctgacctcatgatccgcccgcctcagtctcccaaagtgctgggattacaggcatgagccaccgcacctggcctatttttattttttgagacagggtctcactctgctgcccatgctggagtgcagtggcacagcgatcacagctccctgcagcctcgaccttccaggtgcaggagatcctcccactgcagcctcacaaatagctaggactacaggcacatgtcaccatgcctggggattttgccatgttgcccaggctggtcttgaactcctgggttcaagcaatctgcctgccttggcctctcaaagtgctgggatcacaggcttgagccaccacacccagctgccacaatgatcatttcttactgttgggaaacttcaatatcctcttgctagcatttggaaatgttatgttattgttcactgtagtcatccgcagtggtatagaacactagaactcatccatcttgtctgcatcctagtttttaaacctaaccatgtgtcttggtgattgcccactgtgttagcttgggtcttccgagaagtaggcgccaaaacaatattagatgtgtaggggatttattagggaaaagatctgtaagggaaaatgaggaatgagctggaggagtctggaaaagttattgaatttggatgccaccacacccgaccctgttatcactattttaaccctaacttgtacaccaccaggagttccagtggcagtttgctttgtgaccagtttctctctttcacaatcaccacaggctatggatccctggacatctttctagtccttggcaatctctctcttccagtaccaatccacaggcattccatctttcccagggtgaacagggctatccaattaattccccttcttgcaggacttggcattatagcccataggggaactggaattgcctccttaacctatagccagctctcgaaggaaatagccaacaacattgatgccatggcttgaaccttcgcaactgtgcgagaacaaatagactctagcagctgtagtcctcagaaatcattgaggactagatatgttaacagcagcacagggaggaatttgtttagccttagatgaaaaatgttgcttttgggtaagtcaatcgggaaaagtacaagacaacatcagacctggacggattcgctgctggtaacatacttggcccatattttgcccataacagcctggcccagggctgggtggtcgagtagacaggcctcgggtggcaaactgcagtgctgggaatcggaccagttcacctgattcccggggggctgcctttggtattctgaacacgccgccaggcacaaagcgctggatgttgggtgtctcgttcacctctcactgccttctacggatttcaacacatagcatcatgatgggaccacagctctgagaatgacagaagcaccgatctccatatcacatgactcctgagtagaggaaaatggatttgagctaagggcaggtgaattaaaaagttggtgcaaatcaagacaaagcagtttgattgttaacacatggcccagtttccgaaggcaaactcagctcatcagcctactgtgggattttcccctaggctgaaaagccaggtttgattccaataaacgtatacattgcagtgtaattaggcaagggaacagggttcttggagccacaaagccccatggtcagtatttgggtgacatctacttcctgactgtaaacagatttaaatataccatctgttttgcagatatttctcagaacctgtttttaatcagtttttctctctaattttcggatactgacaatcttgttttctttttctttatgtgttttaaaaaatgacataaaccagtattgcttttatttttttcatgtgcttggcttgattattttaagctaatttatataccttcattcgttccgtaacagccaaaagtgaaacttttttttcctgtttcttttgtcatcaaggcacaaagaataacagctttcaaaatagtctttggttttgtcctttaaatggtagaaggtcatcattttgttttcgcttttgtatttctatttctgatagataaatagacatagaaaaaatgatgtacagaagttggctaaattgtgataatatactctttaatttctgttaactttggataattctaataatgtttcttcttgttttgagtttttttgtttgtttgtttttgagacaaggtctccatagagtgaagatttactctgtcactccctggagtgtggtggtgcaaccacggctcactgcagcctcaacttcctgggctccagtgattctcccacgtcagcctcccaagtagctgggactataagcatgcaccaccgtgcccagctaattttttgcatgtctttatagagacggggttttgccatgttgcctcagctagtcttgaactcctgggatcaagtgatccaccgccggcctcgacctccgaaagtgctgggatttcaggcgtgcaccactgagcccagcctgggcaaattcttatgtgggggtcatttattaccatgtctgttattggatcactgctatttgacaatttagggcagaaatatcagaaaatagggaggccttggaggcttcctcttgttcgtgctgtgaactgttgggtgtgtgctcacaaattccaaatgaggacggaataaattagctcggttttgggatgccattcgaagctcctttataaaacttggaaagttgatttaagagatatttctctttcattgttttatttttaattacaaaagcagtagattttttttggataaagaaattagtttccctttcacattccaaaccaatgttcaaagatttgctggtttctgcctccttctttctgcttctagagctgcctcatgatccaatgtggttcttctaattatttgcttaaaaatgctcttaatgttttttgcctaaccaacttatttttaattttgcccaccctttgccattccctacccccaggcccgtacgtctttgcccgattgctattgaggtgcacatactttcagcagcctgtgccatttcacagggcaccacgagcaggctggcgtcggcctccttcattgatgccaccagtcactttttattacctgcctacgttccagaccaggttccctctatttcctgaagattaagaccctctgagtgtcactctgccctgctaaatcagttccgctcataatcctctgcttagaaatatctacagggtggactgggtcacgaccgacatcaccatctgacagctgttacaactccgtgcccaaactaaacttttcactaaacacttctttaggggacaccaaggacctcctcccagccctgccaaattaactcactgaatacccatttgccaaaagctggttctccaaatgatcacatttttaaaacttcccaatttgctggtttatcccaagttgtttttctcaaaacaacaacaacaacaacaacaaccccgcccacacacacacacattagaaacatttcatttcacttctttaacaaatgtttgtggggtttttactacacacaaggtgccaaagtgttggggttaaagtagtgagtaagagagcaaatgttctcatcctcatggaactcccaggccggtggaggaaacaggcaagaaggacataaataaatatgtaacacaggtggtcatggaaacatgtagagcaccctgaggcagcaagaagagtgggcatcaaataatataataacatatatgatgtagtatttatatagtataatactatgtgatgcaatacaatgtataatgtacacagtataaaaaataccatttgcagccgtaaaaaagaatgagttcatgtcctttgcagggacatggatgaagctggaagccatcattcccaggaaactaacacaggaagagaaaaccaaacaccgcgtgttctcactcaagtgggagttgaacaatgagaacacatggacacagggaggggaacatcacacaccagggcctgtcggggtgtgggggaaggggagggagagcattaggacaaatacctaatgcatgtggggcttaaaacctagaagacaggttgatagtgcagcaaaccaccatggcacaggtatacctatgtaacaaacctgcacgttccgcacatgtatcccagaacttaaagtaaaattaaaaaaaaaaaaagacagttgactcttgaacaatgtggggagttaggagtgctgagtcctgtacagttaaaaatctacagataggctgggctgcagtggctcatacctgtcactccagcactttgggaggccaaagtaggtggatcactggagcccaggagcttgagaccaacctgaacatagagagacactgtctctacaaaaaatacaaaaaaattagccaggcatggtagtgggtgcccgtagtcccagctattcaggaggctgaggtgggacaatcgcctgagcctgagaagtcgaggctgcagtgagctgagatccttgcaccactacactccagcctgggtgacaggcagagtgagacctgtatcaaaaaaaaataaaaataaaaaaaaaggaaattcatggagaactttggactctccccagacttagctactaatagcctaccaaagaccagcagccttaccaataacacagtcaattaacacatattttgtatgttaaatgtattatatactatactcctgaagtaaagtaagctagagaaaagaaaacgttattaagataatcataatgaagaaaaaatatgttcactcttcactaagtggaagcagatcatcttaaaagtcttcatcctcgttatcttccattaagtaggcagcggagaaggaggaagaggaggggttggtcttgctatggcaggggtgtcagaggcaaagaaaacctgtatataagcggactcgcacatttcaaacctgtgttgtttgagggtcaactgtatagtatataatgcaatataatatgtaatataggccaggtgtggtggctcacgcctgtaatcccattacattgggaggccgatgtcgggcagattacctgaggtcaggagttcgagaccagcctgaccaacatggagaaaaaccgtctctactaaaaatgcaaaaaattagccgggcatggtggtgcatgcctgtaatcccagctactcgagaggctgaggcaggagaatcgcttgaactcgggaggtggaggttgcagtgagctgagatcacaccattgcactccagcctgggcaacaagggcgaatctctccgtctcaaaaaaaaaaaaaaatatatatatatatatataaaatataatatataatagatatgatataatgtaatatgtaatgtagtactacataatactataatatgtaataatatagcatataataatattgcttagggagtagacttttagtgttcttatcgcaaaaacaaaagtatgtgagataatgcatatgttaactagctcaatttagccacttcacaatgtacagattttacaaaacacatacacaataagtacatctaatttttgtttgtcaatttaaaaataaaatgttaaagaaaaatatgccataaaacagaacagaatgtaatatcatctaatatgtgacatgatgatatgatacggtcatgtgttatgcaatgcagtaatgtgtaatatggtttagaataatacagtgacctggccaggcatggtggctcacgcctgtaatcccagcactttgggaggccgaggcaggcagatcatgaggtcaagagatcgagaccatcctggccaacatggtgaaaccctgtctctactaaaaacacaaaaattagccaggcatggtggcgtgcacctgtagtgccagctacgcagtaggctgaggcagaagaattgattgaacctgggaggcggaggttgcagtgagccaagatcaggccactgcactccagcctgggagacagagtgagacaccatctcaaaaataaataaataaatacaatagagtgacctaatgtaatttgttgggtggtggaaagagtagagcaggtggagggagtggggagtagtgcagaggcggctgatgtggtcagctgatgtagtcaggaaggctcctccaagcaggggacaactgccccaagacccgaaggatgtactcattctaccacagcaagattctgggggaactgcagagggaaccggaagggcacagtctccctgcagaggcacagaacatgctcagggaatggagggaagcttggtgtggtgggaatggagtgaacaaaggggagatgggagaaggtaagagtaggctgaagaagagcaatggatctcatgggacctcatgggacctcgcaggcacaagggagccgtctggatcttgttcccagcacgatgagacccttggatcttcttcaatgttgtgacgtctggtttctggatctggttgcccctgatcctcagtgtcccttggtttgcagccacagggctccaagctctgcctctaacatcacaaggcatgctcctccctgcatctctgcgtgtcctcttctcttcttattgggacacgagttattggatgtgggaccttccctcatctgctgtgacctcatctaaaataatgatatctgcaaaaattcgatttccaaatgaggccacattctgttctgagtggacatgaatttcgggggaccccgttccacctagtacagctaggaattggcatgggctggacggagtgagtgtgggtagaagtgagaaaatgctcactgacatggaaggaaaacccagagagtttgggatgtgcaaaccaaacgaggaaagattttagcagagaggacgaggtctaagttgtcatgtgtggtcaacaattggatctgatgaagactaaggactggattgtttctggcaaagtggagaatcctggggaacttgacaagagtaggtcagtgtgggttgggaatggaagccagatacccatgggctcgggagagagggaggggagagagttgaggggaaggagcagagagatgccttggatgtgttttgcctatgaaggggcagtggctagggaggaacttaagatctaaaaagcatttgtttttttaagatggaagacaacacagtatgtgggaatgttgatgggaagatctcatgcagagaaggaaatagatcggttgatgccagcaagagaagatgacaaactgactttccgatgagccacaagtgatgggatgcgctgttcagggggaggagttggaaagaggatttgccaaatggacaatttgccaaattatggatccactgtaaatgaatttctactaaatatttgtaaacattacacaaaatcatgccaccatgggatggtgttaatggacttcaagggtaactcttctctttcttttcttttcctttcctttcttcctccctctctccctcccttccttccttcctttcccttccttccttcctttctttcccttccttccttcctttcccttccttccttccttccttccttcctttcctttcccttccttccttccttttcctccattccttccttcctttccctcccttcccctctttctgtctttctctctttcttttttccaagacagagtcttgctctgttcctcaggctggagtgcagtggtacgatcatggctcctgcagcctccacctcctgggctcaagcaatccttccacctcagcctccccagtagctgggatcacagttgcacaccaccacgcccagcaattttttgtagagatggggtttctccatgttgcccagactgatcttgaactcctgggctcaagcaatcctcctgcctcagcttcccaaagtgctgggattacaggtgtgagtcactgcacccagccagctttgatgttttagtttcatttcagctgaaattaaatttggtttcactgtagattttgtttcactttggcagatttatctcagctctgtagctgatttgcaaatcaggctcaaagacgcatcagatttaggtgtaattctcattataggcactgagcatttctcagatgtcttacccatgttgaaaacatttgtgtgatcacactgggtaacatatctgttaagagaatttcaaaagacaggagtgaaaatgagttggataatagaaacctgttctaccttttgtattacgcttggtggaagcatcccgaaattctcattttaaatataaaaatcctcagaacacactgaacttcagtttggctacaatgaagcagctacagccaatgtaaagctaaactaaaatctgccaaaaaaatgaaacgaaaacttcaagtcagatcatttaaacagcacagaagtttccaggaactcccttacaattgggatcgctgtagctgtcacaaggagttaaaggaaacatgcttctgtcgctgttaactagctgcatccggtgaattgggcaaatttggccattcagggaattaaccatccacaaaagtaaataaataaataaataaaataagccagtcatttgaagaactgattttcagggaatttatttagcgttggtaatgtctaaaagttacatgtgtggttgttggttttatgattatctttaatgcattccgatgtatatttatatatacgatcttctccatgcctgacatatttcacggtaagataaagaaattcccgtggcttataaggaatggagactgaatttgaattcaagttgtttagaaagaaatggatgagcactgaacccacatatttgaattttttaaaagtccagctgacagatgttgaatcagcttatccccctgctggagaattttgccccaaggtaaaagcaagctttgatttcagcaccgtatgcatcgcagtgaagttgggcaaatgaatggtgtcttccatacacagcactacgtgtttggcatacggaatccctcccttgcccagcagtaaacagacttgaatacaccatctgtttgcacaccaactgtttgcaaggaaattttttttccttttctttttttctctgtgaagttaatgttgtgacaactttatattttctttttttaaaaaaacagaaatctgtgtttgtgtttacttagacctgggctaccttagatggttctcaggctcacttatacactttcatgtgttccattaaaaaatgtgatcgctttctttttcttctgattttggttgcaaaggctaagaactttcagaacagaattttgtttttgtctttaatacggagacgtttcgtgttgttctctggtttttcagatgggtggacacagaaaagacaactaataccctgaaattggttgaaacttgattattcattcttaaagtctgataattataactgtccagtaacttgataattccagttctgttttcctgtttagaacctctactttcttatttgagaaaaaatgtttgaggatgttatctcagtatgtgtttacttatcttagtacacattcccttgaacttttcgcttatcatgaccattgaaatatcttggaacatcagtgttagaaaagcaggaagaacgtgggaaactccccctgtgtgcacggtgggcccctctatgaattgcaccagacaaattccaaacaaagtgatggagaaaatcccccaagaaaattagcagtcttttttattcaaacttttttattcaaactttttgttgtactgtgtcaacagctctctggagaccaccgtgtgcccctcctgttccacagccaccccaaagcaactgttaaagatgttttgtgggctgggcacagtggctcacacctgtaatctcaacactttgggaggcggaggcgagcagatcacctgaggtcaggagattgagactagcctggccgacatggtgaaaccctgtctctattaaaaatacaataattagctggttgtggtggcaggcacctgtaatcccagctactcaggaggctgagacaggagaatcgcttgaatccaggatgcggaggttgcaatgagctgagattgcactccagcctaggcaacaagagtgaaactctgtctcaaaaaaagaagaagaagaaaaggaggaggaggaggaggagaaagaagaagaagaggaagagggagagggagagggagaaggagatggagaaggagaagaagaagaaggaagacgaagaagaagaaggagaagaagagcagctaccttgacagggacgtccaccttggaaggtgacatgctctgggtgaaaaggaaagttggttttattccagaagtggcacccctggggaggcggtgaacagtggaggcgtgttccaagaccacctctccacgtgtgcctccggatcagggaaattaggggagcttaaatgatggtcaaagtgcttttgggaaacgtgcacgggctcaggcggacagttaatcgcggcttccttggtcaatgtccctggccttctgcaggaatgctcaagctgttcttatcagggcggtcagcacattcccagggtggctggtcagctgctctctcttttatctctgttgaaggccttgttctccggaggctgtttttaataaagaagctacaaactcgagcaaagcaaggattctatgcaagcaagcaagcaagcttttctctaacacggagtcagtactgtgacacaacttcactgtcttcatcctgtccaactcctcaccttggaaagcctcccctgcacccccattgtttaaaacaaccacaaaaccctctgcacagctttcttccccgagtcctcctggtgattctgcacctcctgggtcttctcattcactgaactgagtgggttccttctcaaaacctgacctttaaatacagacgtttctgaaggactctgtccggggctccttcccttccctctccacatcctctccttggtggatttcatgggccgcttggctttatatgccgtccatatgccccagactccctgctgtagactgactgtgtgcacccattccccattcttatgttgaactcttaccttcactgttttccacaatggctgaactaatctacactcccaccaacagtctgtaagcatgcccttttctctgccaccttgccagcatctattatttttttactttttagcagtagctattctgactggtgtgagacagtatctcattgtggttttgatttgcatttttcttaatgatcactgatactgagcttttatatatatatatacttcttgacccatcaatcccattactgggtgtacacccagaggaatataaatcattctatcgtaaagacacatgcacatgtatgttcattgcagcactattcatggtggcaaagacatggaatcaacctaaatgcccatcaacagtagacaggataaagaaaacgtggtacatatatgccatggaatactatgcagtcataaaaagagacaaaatcatgtcctttgcaggaatatggatggagctggaggccattaaccttagcaaagtaacacaggaacagaaaccaaataccacatgttctcaattataagtgggagctaagtgatgagaacacatggacacatagagggggaacaacacacactggggcctatggtggaggatgggaggagaaagaagatcaggaaaaaatagataatgggtactaggcttaatacttgggtgatgaaataatctgcacaacaaactcctgggacatgcatttacctatatcacaaactgtacatgtaccccaaacttaaaagttaatgaaaaagagaaagaaatgttgccctctaaggtgatggtgttaggaggcgccttccaggaccgtctactctaagaggatctcctgggttatttgctgtgtctgcttctgtggtctggccttcacaacacttagtacagttcctacttattttatttactggcctatttcctgttttttgtttctctctatgacataatatgaaatggccgggcccagtggctcacgcctgtaatcccagcactttgggaggccgagatgcgcagattgcctgaggtcaggagttcaagaccagcctaggcaacatggtgaaaccccgtctctactaaaatacaaaaagaaaatcagccaggcgtggtggcaggcgcctgtaatcccagctatacaggaggctgaggcatgagaattgcttgaaccctggaggcggaggttgcagtgagccaagactatgccactgcactccagcctgggcaacaaagtgaaactctgtctcaaaaaaacaaaaaaaaaaagaaagaaatacatatttggtttctgctcatgttctgggcacacaggttcgaattgaaaagtgtatttgtttgctagtggtgactgctactaggggctcccggacagcctcaggttgggggtggttgccggggaaatcaaccatgtgattagagggttggagctttcaggtccctcctcgccacgttgaggagaaaaggagaggggctgaaggttgttgatcaccaatggccagggatgtaatcaatcatgcctacataatgaagcctccataaaaccccaaaaaggacagggtttggagagcttccaggctgctgaacacgcagaagcgctggtggggtggttcgcccagagaggacatggaaacgtctcaccccgtaccttcgtaactacagcctcatcctcctgatgcgatttcactgttatgcttataggacttaacacgttaatcacagccctttactctctgtacacactaatcaccacacagcaaggaatatttacataccacatcaacaatattaaatcctcattcatgcaagaaaataccccaataccgatacacctaacaccccttctcctattatccttaaaccccaaaatgattttgagttttacatgctgttgttatagtttaaccaaaacattagatcgtggatctaataacagaagtctacaatttcttatctaccgagaaagtatgcaagaactggtaactcatgccccaatatataacaatatggcattctcaacttttaaaggattagagttaaccattggtctaaggaaccaaaaacactggtgcaactccaaataaaagtaacaagtacattttcctcccatactgtaacacccctaatatcactaattttaccaactgctgctaccttaactgacatctactgtagtgatttgtaccccaattacgtaaaatcatccattgcatgcacctttgccattagcctcatcccaacaacaatattcatatacacgagccaggaatctgtcatctctttataataaatggatcatctaagtaacgtggtttcctgagttctgtgagccgctgtagcaaatgatcacacccaagcagggcatcgtgggaaccctgacttataggccataggtcaaaagtacaggtcccaactggggacttgcaattggcatctgaaatgagggcagacttgggctgagctctggcctgggcctgtgggatctgactctaactccaggtagtgtcagaactgaatttaggccaggcgtggtagctcatgcttgtaattctggcattttgggaggctaccttaggcaggaggattgcttgagctcaggaatttgaaaccagcctgggcaagaaggtaagaccccatctctataaacaaaactaaaaaaattagccgagtgtggtagcacatgcctatagttccatctacttgggaggctgaggcaggaggatcccttgagcccaggagtttgaggctgcagtgagctgtgatcctgccactgcactccagcctgggggacagaatgagactctgtctcaaaaaaataaaaaaataagaactgaatttagttacgggacacccagttgatgtctgctggaaaatatagagtagaaaaaaaaaaccccacacatttggcgtcagaagtggtctgtggtgagagtacagtaggagaataaacagttgtacatgttcccttcctggaaaagttatttccctgcactgagggcctgcattaattaggataggctgatagcactgcggtacaaacaatacccaaacttcattgatttcttattcactctatgttcattttgagtcaacagagagctctcatcattacagtcactcagggtcccaggttgttggcacatctaccatctcagtgtctactttatggaaaatccagcctgccacactagacttgccaaccagagcttctaccatggtgtttccatgtggcttgggcttcctcacagcatggcagcctcaaggttgtcaaacttgttacatagtggctccagattccaagtatgagcgtcctagtaaataagacggggatgcatggacatttatgaagcaactcagaagtcacatagcattacttcctaccctgtgggtgaaggtagtcatgagcccacccagagcgggtacatagaccccacttctcaatgggaggaacgtcaaagtcacattgtagcagagaatatggaaagaaagatattgtcatggtcgtttttgtaaaaccgtctgccatgacccctgtctctcctggctctctccctcagcttcgctggccttttttttttcttcacttccttaaatgccctaagtgctttcttacttccaggactttgctcctgctgttcgttttgtgttgtggtgctttttttccaggagcacttcttcccaacacctaaagcactcagcttcctcatcctccttcagtccttacaccatcagagaagacttccctgaccgccatagttgggcctgtgtcccctgatactatctttctcagatactgatttgtttccattgtaacacttagtgtaatttgtaactttttttaattgattatttgcttttctgtattatttccaacacgcagaaaaaaatatatagggaataatatagtaaacacgacacccagatttatcaaatctttacattttgccatatttatttcagagcattttttttaaattaggcacaaatgtaggtgaaggtccttgtgctctctttgaaataccacccacgttcctccaacaccgacatttggaattgatcattctcatgtctgttcttcctacattgctgctgaaagtaagaaagggtgttgtaacatgttccaaacctgtgtgagtggcattgttctgcaaggaggttgtaatgttctacccttttatttttagcattttgttaagttgtgtggctccgttcacagcaggtgcaccaccatattccaatttaggaattcaccctgttttacacatccatctcctcctaagcacatttaggttggttcttggttttactactgcaaatgaagccacacacccccacagccttgcacagtccctggcatgcagtcagcactcaaataagatttgtcacatacatgaatatcgtgatgaacattctactctgtatctctttgcccagatgtggggaatttctctagaaaacatttctcagcacagaactgctgaggggttgaggatgtgcttctccacctgcctagatattgtcaaattacattctcaagtggaagtttctttatgtctttctcccatcaaaatgaaatttccagaattcagaaaactcgtctttctccccgccccccgccatatttctgggtctcacagtgttcttgatgtgtagagttgctcaataagatttctagtcctgtgttgtccaatacggtgtccaccagccatatggagctactaaacccttgaaatggggccagtgccatatgttgaaataatattttgcatatattgggttaaacaaaatatatcattaaaattattttcccccttttttacatttttaaatatgactactagaaaatttaacatacgtagcttgcattacatttctcttggacatctctagagtatgtataaatgaatggatgagtgtattattttgactcaactttgggattagaatatgtttttgaggtctttaaccatggaaaattttgtctcccccggggacattgggccatgtctggagaaatttgtgattgtcacagctgggaagaggagggctgtcagcatctagggagtagagaccagagatgctgcagaacattctacaatgcacagagtggccccccccagcaaagcgtgatcagaccctccgtgtccacagtgcgcaggctgaggcactctggtctatatcaaggcttatattcttattcttatcccattaaatatatcatgattttaaatgttcttcgaaaaccaaatttgtttgtaaaggaagacacttacttttgtttgacagtaaaatgctatcccatctttgccattaatgttcttgtgtaggcattgtatataatttttttcacattttcttaattcacatcgcaatggtactctacagacacgtgtgattttttatgtatttatgtagaccagaagtgggcttgtatgtgtttaattctgctgtgtatttagctctgaagccttcctagttctctagaaaagctgcgtcaacacatacctgctgttaactcagggaagtgtctgtatcttcaccctttcaaccaccctagatatttcatcaccagatttttcatctttctgagtcttgtggaaatagatttcatcacattttggttgttatatccaacttttgtttctgttgttgttattttgttgtttggttggttggttttttttttgggttttttttttgagatggagtctcactctgtcacccaggctggaatgcagtggcacaatctcggctcactgcaacctctgtctcctgggtttgagcgattctcctgcctcagtctcccgagtagctagaattacaggtgcgcaccaccactcccagctaatttttgtatttttagtagaggtggggtttcaccatgttggccaggctggtctcaaactcctgacctcagatgattcacctaccttggcctcccaaagtgctgggattacaggcatgagtcacagcatctggcctatatctagcttttggagctcaaacattatgatgcatttttttcaacatttctattttcttttcttttagtttcttttattttcgtgtgtgtgggcgggggggggggctgtgtatatacacactctttgtctgcatttctattctgaagttctttttattttcctttatgacctactgacactctgtgtagtgcctgactttctttgagtatatattttgtatttttactcggctgtccatcaagtcttattcatgatggggtttccctgtaacctaactttttagtatttatggagatggatttatcagtattttcttttatatccactggcttgtttgttcattttaatggaaagtttcccaccgtatgattatagaaatatccacctatattgtcttatggtgaggtgagcaaagaagttctctacatgctctgaatattccttctgtcctcaactcaaatgcatcctcagagtccttcagcaaccaatttcagctgctaaaagcaagatatggaccaaaaccgaacatgatagagggttctactggagctgattatttctgagaaagagcaaatgatctctgaaaactagctgttaggatgttcagcttggtccagttgccaaacaaaaccccagggcaactactcaccacggaattttcccccaattaataacctacgaatgcccggcttgagtccaagctccatatgcactgacacccaactcaggaaggcaacggttttcccagaaacagcacaacatagccagtagttgggagacaaccatttctaaaccatagaaaagacttcatactagctatctgtttatagattgtgttcctgggtcatgtccataactggattttctctggtgttctgggagcaaaaatcttctgtcttctttttgaggtgagtagagtcttccaaatgtccttcatggccccagcccaccgttttctttatgtaggaaggttttagatgttggcacatattgacacctacttgcagacaggtttgttgaattacattatataaacgttgaaataataactcaagcagtgagtacattttcactcttactcccctgcacctagctttataaatcgctaaatacatgcattcagagaatctgtgtgcttttctcaacagctatgttgtgtaatggtgaacatcattatgcaaacacagctgcaaggcaagttccctagctcccagcctcagatcagaccttcattcccaggtcccttctacgtggaagttctggagtccacctgctcacagatgctcacaaagcactggcgggacatctaaagagtaataggaacccacaccgatgttctaagcaaggatgggacgtggccagattttcctttgataaatctactcagactcacacgagaaaaattaactgaagaccaggaatgatgaaggaggagcccagtgtagaaatagatggtcgcaggacacaggagagagacgatggagacagggatgaggtgggacagtcagggagagggagagatgcatccacgaataaagttttattggaatacagccccattcactcattctatattgtatatggctgccttcacactacaagggcggcaatgagtagctgagtcaggtgccgtatggcccacaaagactaagacatttactacgtgcctctttacaggaaactttgtttacacccagcaaaattgttccacataatgattcagaaaagcctaatgattcagaaacttttgttgacccagcttcgaggaaaattccacagagctcacttcctgcatagctggcactctcttgggtcatcatcactggtaggcttctgtgagaacagcggaatttatcctaagggcaataggaatggctgaaagagtcagcaggggatggcttgactccttgacctgtatgttccttcaaggagaaagagtagttagagttgtttttgcagtaacttgaacaagagatcagaagggcaggctgatgaaaaaccgatttctaaggcagaatggacaagtcttcgaaaattgattggctacagggctgcggagggagaatctagcacgggtttcatggttttgtttttgtttttttacaagacagagtctacgctctgtcatccaggctggagtgcagtggcacaatcttggcccactgcaacctctgcctcctgggtccaagtgattctcctgtctcagccgcctgagtagctgggattacaggcgcacgccaccacatctggctaatttttgtatttttagtagagggggtttcaccatgttggccaggctggtctcgaactcctgacctcaggcgatcaacctgcctcaggcctcccaacgtgctgggattacaggtgtgagtcactgcacccggccaggtttcatgtttttgcaaaagcagatgagaaacagctctcaggcatggatagtactcctatctctgggaaaagagaccctgtggatgtggatggacaaagattttctagaaagaggatgagtgaagggtgctgacctccaatggaggaaaaacacaattccaaaaggaaagaaaggctgaccaggcctaagcagggcgtctctcctttcctttcccccaggattcctttaatgggaagggcagagtccccaggaagcaactcttggggaggaagaagaacgaagctcccaggcagctttctaaccactcacctgactccacctatccctgggaggagtccctgtctccatcccctaaatggagagcagaaaaacctacggctaggctgggcgcagtggctcacacccgtaatcccagcactttgggaggctgaggtgggtggatcacttgaggtcaggagttcaaaaccaccctggtcaacatggtgatgccccgcctctactaaaaatacacaaaaataaatggggcatggtgttgggtgcctgtagtcccaagggaggctgaggcgggagaattgcttgaacctgggagacggaggttgcagtgagccgagatcgcaccactgcactccaggctgggtgacagagcaagacttcattaaaaaaaaaaaaaaaaaaaaaggaagaaagaaaaaaaagaaaagaaataacaagtattggcaaggccatggagaaattggaacacttgtgcactgttggtaagaatgtgaaatggtacagctgtttcagaaaacagtatggcagttacacaaaacaattaaaaataaaatgaccatataatccaacaatgccattgctgggtatacacccaaaagaattataagccgagttttgaagagatatttgcacacctgcattcatgacagcaatattcacaatagccaaatggtaaaggcaacccaagtgtccattcatggattgatgggtaaacagagatgtggtatagccatacaatagaatattattcagccttcaaaaaggaaattctgacacatgctacagtgtgggtgaatcttgaggacattatgctatgtgaaacaaatcagtcacaaaaagacaaatattgtacgattccacttacaggaggcacctagagtagtcaaattcataaagacagaaagtggaatgctggttgccaggggacaggaggggggaaaatggggagttgtggtttaatggatacaacatttcagttttgctagaaaagagtcctgaagctgaatggtggtgatggtcgcacaacactgtgaatgtcctcaacactactgagctatatatttaaaagtaattttgatggtaaattttaggttatgagtactttaccacaattttttttctttttttgttggagtctcgctccatcgcctggccaggctggagtacagtggcacgatcttggctcgctgctatctccaccgcccaggttcaagcagttctcctgccttggcctcccaagtagctgggattactggcattcaccaccacacccagctaatttttgtatttttgtagagacagggttttgccatgttgacctggctggtctcgaactcctgacctcacaagatccacctgccttggcctcccaaagtgctaggattgcacgcatgagccaccacacccagcccacaatttttttaaaatgtaaaacaacaacaataacaactaaaaaaacctgcatccatgagatgaacctgaaaagaaaatatctgttgcaacacacaaagccagtcaacactcttagatatggtggaggcagctttttctctgctgaaattaagggaatgagtgtcctagagaattctcaaagatgtgtcaatgtttctaacaggagttgcagctttttgcctcaaagttaaggacagctgcaccgtcaaaccttgaccatgaatgtttagggtgggttacatttgcccagtatttgtttgactctgttgaataacatcgcagatagatggttttcaacaggcagaagagttttttgtttgtttgtttgttttatctcttgtaggtttttccataataacaaacccaagtaaatcacgacccaaccagtgactggcaaatttagtgcaaactcttcaatgctggttccacatttggcacctggcttggattgatttgccactgagttttgtaaatatttccctcagcttttaattcattctttataaacaatgttgtttaaataaaggatatttgtgtttctcattctgacgttttcttttcaacgtccacttgatgagtataatgtctcccatgaaatttttatttgtagagtaaatattcctttctgtctggtctagtgcatttttatttgaataatgtatcatctgagtaaacatagccttctgtgctctctaaagccttcatcacgttggagggcccttaatatatttattcagtttaaaacttgtctgatgtaagtaatgtcattctggttgaaaagcatttacaaacaaaacaatgatatgccaagctttaatgtttacaaagattagcctggatctcataatagattatttattgtcattgcatattcagtggttttttttctgtaaatattattgagattacactttggaaaagaaaacattactagttttttgagtgttgaatggaatattgcccaactcagcagatcacaatgaaacctcatggttcttatcaaaatcaacaaatctgttgaaatgaatttaatgctaatgtctttgtatgtgatttgctgacctacaaaatgtgttttagttgcttttatttatcttttctttctgcttttaatttcttatttggaggagtcttggttctttttttagtttgtttgttttttgttttttgagacagagtctcgctctgtcagccaggctggagtgcagtggcgtgatcttggttcaccgcaacctctgcttcccaggctcaagcaattctcctgcctcggcctcccgagtagctgggattacaggtgtctgccaccaagcccggctaatttttgtatttttagtagagacggggtttcaccatgttggcaggctggtcttgaactcctgacctcatgatccgcccgcctcggcctcccaaagtgctgggattacaggcgtgagccaccgcgcccagctgagtcttggttcttataattaaaaaaaagtcttctgcaactgttttcattttctacatcttaatttttttggtggtcataattatttttcttatcatcatgactttcttccacatcaatttcgattatttttatattttgaagcacctaccattcttttttcagactaaaatttggcttcctaggatacttcctttttggcacatttgaattctgatgtgattgatatttttgaaaaaaaaaaaaaaaagaaagaagaaaaaagacccagaaaacaaaaaatctgaaattagatcatacacaaatgctttttgaaattgccatgacattgtatttggtggtgctgaaaaattgtgtgatcagagtactcttttgctatcatgattgatgaattgatgggttgaatgaatgtgtacaggaatttagtcactggagcatctgcttcttgttccactcttcagcatcagagggaaattcttatgtgacattttgcctggaacccccagactccctcaggaccgggcaccttgtgacatcttcatcaacaggtgtcctcactctttgtagaactccaccaagttggtctcaagtgaaacagggatgcagctaaattcgaggttacagttttcctgggatgttatcatcacaaacaccatgctagtgagttcattcctaacagaggagaacttgcatcttgactaagcattagtgatcatcaaatcctctgcttatgatttttaaacttctgatcttcagaatatttttccatgagctagctctggctttgtgcatctcaaaccttgtttctctcccatggctgtcatacttctggtgccctgagatgcagaatttatttctacttgatacacacatttgggtattgatgtagggttagtacagcaggtaggttgagaatttctggagcctccctccctccctttgttccgacctttccttagtcatatcatcctagaaagatcttccctggcttcgtctaaaacatggcctctcatttcattctctccctgacaaccctgatgtagttttcatttcaggactcatcaccccaacatcctttcctgtttacagcccatctcccctgctagaacacaagctctgagaggtggaaggcctctattgtgggttttggcgaatccccaatctctagatggtgtctggcatgtgatagagattcaacaaacacttcaacaaataatgaataaagttaaatttttcagagtgcaatcatgcctctcccttcctctgccagggcggaggctgtgcctggtttgcgcggcttctgcagctccagctccttgtactgagtctggagaatgatggagctcagtccattttaatcccatgaacattaaatgcgtggatgtgtggatgctgggatggatggatgacgctcctagcacggcagcttgcaggggattggcgatttccagtaaggtgtgctaagactcgaggaagcccattttctcttcatttgcaaggaccctgtctgataatgcaatttttcacacatcaatgctgtgcatgaggtgttgatggggtggctgtctgctggttccttcccccagcccatcccatcctccaaacagactattttgttgttagctgctctgctctgttcatccctcaagagctctcaccctctgccattgcaggggctgtctccatggaaactgtagccagcgtttccatggagaaagagcccgcagagtctggaattttccaggctctaaaggtgactgcaaaaacatctcagcacatctccagaactgggctgcccaacatggcggccactggccacaggtggcgactgaccacttgaaatgtggccggtccccgaagagacatgctgtcgtggcaaagcacacagtggattttgaggacttggtacaaaaaaattttttttaattgaaatatcgctaataatttttgtattgattagttttacctatcttttttttttttaaacagccgttgctagaaaacttagatttacatacatggttcacatttgtggctgaaattttatttctgttgggtggcattcttctagagtatgagtaactgaatacatgaatgaatgattgatttttggtcaaactgggattattatccataaaccgtcactttcctgcttttcttcttagatgatttgttttttaaatagttcattaagtatcttggttgaaagatttttttttttttgagacggagtctcactctgtcacccaggctggagtgcagtggcgtgatctcggctcacggaaacctccacttcccaggttcaagcgatttttttgcatcagcctccgagtagctgggattgcaggcatgtgccaccacgcccggttaatttttgtattttcaggagagatggggtttcaccattttggccaggctggtcttgaactcctgacctcgtgtgatccactggcctcctaaggtgctggggttacaggcgtgagccacacgcccagctgaaaggtttatagatataatttttagtattgaattaggctaggagttaattacaattctttgaacagccattgaaacaccactaatttttttttaaggaaccatctcctcctgagtgtaagacactgcatcctactgcagatgacgtcttgtacgtagattctacccatcagcttccaacatcttgctgtccttcacaatgttgtcatggctcccatgtagataggcaaaccttcctgattttcatgctgaccagatgcccagaaacaggatcgcggaggcaaagggtgtgtctccacactcggtgctttgataccaatgactcaaatacttaccagaaagactgtgcctacctactttcccactggcttcatctgaaggggtctgtctttatcacagcgatgattttttattttagttttgacttccagattttaaaaacattatggtgacatacacataacacaatatttaccaccttagctacttaaaagtgtgcagttcagtggcctcgagcacattgacattgttgtgcaatggtggtgttatcaccgccacccatctccagaactcttgcaaaacggacagaaagacaaacatggcatgttctcacttatttgtgggatctaacagttgaactcaaggatgtagagagtagaaggttggttaccaaaaggctgggaagagtagtaggagctggtggggaggtggaatggttaatgagcacacacataagaaatgttagcaagaataagacttactaagacctattagataacacaacagggtgactatagtcaatagtaacttaattgtacattttaaaataaagactgtaattggattatttgtaactcaaaggataaatgctttaggggatggataaaaaaaaccttgcaaaactgaaactgtgtacccattaaacaacaactccccattttccccactccagcccctggcaaccaacactctactttttgactctatgaatttgactacttttggtagtggaatcatatagtatttccttttgtgtctggcttatttcacttagaataatgtcctcagggttcatctatgttgtagcctgtgtcagaatttcctttcttttattcatttattcatttttttgagacagggtctcactccgtcacccagtctgaagtgtgcagtggcgtgagcacagctcactgcagcctcaacctcctgggctcaagccatcctcctacctcagcctcttgagtagctgggactacaggcatgcactaccatgcctggctaaatgttgtattgttttttttgttttttttttgagatggagtcttgctctgtcacccagactggagtgcagtggcacaatctgggctcactgcaagctctgcctcctgggttcacgccattctcctgcctcagcctccccagcagctgggactacaggcgcctgccaccacgcccggctaatttttttgtgtttttagtaaagacgggatttcactgtgttagccaggatggtctcgatctcccgacctcatgatctgctcgccttggcctcccaaagtgccgggattacaggcatgagccactgcgcccggcaaatgttgtattttttatagcgactgcgtttcacggtgttgccaggctagaatttcttttctttttaagactggataatattgcattcatggagagaccacattttactcatccacccatccatcactggacactgggtttcccaccacctttgggctatggtgaatattgacttccaattttgctttatcagaagattggagcatcttttcatgtttcttgaaagtttttgctgggtgtggtggttcatgcctataatcccagcactttgggaggctgaggcaggtggatcacttgaggtcaggagttcaagaccagcctggccaacacggtgaaaccccgtctctactaaatatacaacaaccagccaggcatggtggtgcatgcctgtaatcccagctactcaggaggctaaggcaggagaattgcttgaacctgggaggcagaggttgcagtgagccaagatcatgcctctgcactccagcctgggcgacagagggagactcgaaaacaaaaaaacaaaacaaacagttttgctttttctctttcatgaactctcttttcagatccctttctggcttttccaatgtgatgttcagttttaccatcttgacctgttagcacaattgcttgacccgagcaattcctttgactttacaccgcaatgatttcacctggtagattgttaaaccacatttgtgacaggagtcttcatgttcccacatttttagtgtttggatggtcagattgaacgcccttttattttgtgactgttgatgtttggattgttttgaatgagtcatttcccatcacatgattataaacatatcctcccaaatcctattttactgaatatgatttcttcagaaaagaaccctcttcctgctgtgcacaccatgcccatccctgcacccagaaactccagtcctcatgaaggcctccagatcccattgctgcaggagggattggcaccagatctgaattgcacctaggggtccctcgggagaacatgtctaattggaaacgtgtggttcttggaaaggagccgaatggatattgcctcctggcctggtcatcagattatattttagttcaaagactcaccgtggttgatattagctcagtgctcggctggaaaccaaaccctacgtacatctcctctctagcagggagcggttggatttcttggaaacaacttaatattggcctctgtgctgaagacatgcgtttccgaaccctgaaaatatcaaataccaggcatctcctttccagacgacatccttccctcaccttcgttagcttttctcctagttttccggggtggaacctcggcctcgtccctctttgatggactgggtgcctgtgttgagtcctggcccaaagctggtgtttttgtgtgcacgctgcagatttttaaacagaatagccatctgattctggatatgcttggctaacccaaattacacaatgggttgaaatcatggataggtcaatgagaatttcagggtttttttgtgtgtgtatacacgttcccacactcacactttcgcacacacacatacatgtattaccaaatattcgaggaaactgttttcattttcctaaaggcattatttgagtcaaagcattgtgtaaatgaatcttacaggcagcctctccccaatctgaatgcatctcacccccagcccctcctgcctttgtagaaattctgcacagcaaactgcttgcgaatcatgatggggaaggaagttttacttacagagcaaagggaatccacggaagtgatttaagcacgggagagatgcagtcacactttcctttgaggcctgttaatctctaggggaggaaataatttgtatttatgtacatatatgtatatgtgtatacatacatgcacacacaaccaataattattggtcaaagagaaagaacacttctagggttctggacctcaaagatccaaatgtctccccatagtctaacagctccgtgaaaaacatggcttagagcttgctgcgtgtccaggctttttttttccatgcttatctccacataaagttttacataaaattgggataccttatctgcagttttccatcttcctttttatttaatgcatgaacatttcaacatcaggaagtgtactttaaaatatggctttattttgaaggagaaaaagagcttgcctatttgtctctttttcccccgcttttatattttatgttatttttattagagatgggggtcttgctatattgaccaggctggtcttgaactcctggcctcaagcgatcctcccatctcagcctcccaaaatgttgggattacaggcatgagccactgcacccagtctttattttgttttattttattttattgtggtaagaacatttagcatgagatccaccctcttaacaaatttccaagtgtacaatacagtactgttttgtttttgagatgaggtcttactctgttgcccaggctagagtgcagtggcatgaacatagctcactgcagcctcaagcaatcctcccacctcagcctctctagtcgtctagtagctgggactacaggcacacactataggcacatgccaacatgcccagctaactgttaaaatcattttttagagatgggttttgccttgttgccgaggctgggacaatacagtactgctgactccaggtacaatgtagaacagcaggcctcacaagtttattcattgcgcttgactgaaatggactctgtttatgattaggaaaatgccacctgctcactggattcaccattcttggtgaagacggtttatagacttgactgcaaatgtgcgtatttcgtaaacaagactgcccaagtctcagtgatagacattctttgtacatttgagcgagtttccattgaggataaattcctggttatagaattaaaaagtggggcaaagaaatgaaatcagacacaaattgaccgattgctcaccacctataaggaggtaggggctgggatcaacttgtgtttttaaaggagggtcatggctgcttattggagaaggaccttgagggctaagcatggaagcctggagaccagggtgggaatggtccagatggtggtagcttagactagggcagtggccaagggtgcaaaatgaccggtgggacaggacaaagccttaaatgggaacagacccagggatagtggggagagatcctacttcttgaatcccttagagggttccagggaaccaggtccagatgtcagccagcatccttcccgccagggtatccctgatgcatgagctaaacagagtccaaatatatccagttaagtaaggaagagatcagccatggtggctcacacttgtaattctaaaactgtgggaggtcgaggcaggaggattgtttgaagccaggagttcgagaccggcctgggccacataacaagaccctgtctctacaaaaaaataaaaatatataaaaactagccaagggtggtggggcaggcctagagtcccagctactcaggaggctgaggttagaggatcacttgagtccgggagtttgaagctgcagtaggctatgatggcaccactgcactccagccaggacaacagagtgaaactctgtctcttaaaaaaaaaaaaaaaaaaaaaggcgtggtggctcacacctgtaatcctagcaccttgggaggccgaggcgggtgggtcacctgaggtcaggagtttgagaccagcctggccaacatggtgaaacccctatctctactaaaaatacaaaaattatccaggcatggtgtcgggcgcctgtaatcccagctactcgggagactgaggcaggagaatagcttgaacccaggaggcggaggttgcagtgagccgagatcgtgccattgcactacagcctgggtgactcaacgagaccctgtctcaaaaaaaaaaaaaaaaaaaaaaagagaaaaagcagatacgtgcggattcaaaaaccatcccagcacagagcagctgcatcatatatgtctttttgtacaaatggataaggatacctcactccccgccataattctatcagtaatagattgttttcggaggacagacaatgtcatctgggaaaaaccgctcctttagttcttcttatgatttcaattctgttagtggctctcaagagaaataactaagaacggtgaacaagaaaggaaagaggattctttcagctggttgtaagggcactggggagattgagccgcgtgatcacgtagatggtgactgggcgtggggctgcaccgaccgtgcccagcctcccctttagacatttattctccatgcagtaacttctattctttcatttgcagtaatgtagcaatcactgtgtgaatacatcctcgtcttagtctgttcgggctgctatagcaaaaatactatcgattgggtggattagaaacaacagatttttatttctgacagttctggagggaaaatccaaggtgcagcagatttagtgcctagggaagggccacttcctgctgtcttcttgagggagccctctggggtcttgttaaaaattaattaatcaattagtttttaaattgacaagtaaaatcgtgtatgtttatggtgacgacatgatgttttgaaatatgtatacattgtggaatggttatgttgatctaatcgatatatgcctttctacctccccccttttttttatggtgagaacactaaaagtctactgttttagcaatttttacattgtcatgaactatagtcaccacattgtacaatagaccttgtgagctctagggcctcttgtctaggacaataatcccatgatgagcctctaccctcatcatctaatccactcccaaaggtcccacctcctaatactatctcactgggagttaggatttaacatcaattgtggggggaggtggggacgcaaacattcaatctacagcaattatccttcatttgctccgtctcctcttgaggggcattctggctgctccccaccctgattttttattttggggatcagagtcactctgaatgtctcagacagtgcctcacacatcgcctcacacatcactctcaccttatcaatatttactgattggttgaaggttgcagtggacaaccttgtgtatgttcccttgcccacatgatggagaatttcttcaggtgatgtagataggggtggagccatggagaaagcacagtttttttttttttgtttgtttgtttttttgagacggagtctctctctgtcacccaggctggagtgcagtggctcaatctcagctcactgcaacctccgcctaccaggttcaagcaattctgctgcctcagcctcccaagtagctgagattacaggcacgcgccaccatgcctagctaattttttgtatttttagtagagatgggtttcaccatgttggccaggctgctctcgaactcttgacctcaagtgatctactggcctcggcctcccaaagtgcagggattataggcatgagccagcatatttgtttgcaaatagtgcagaatgtctttctaaagaggcattttccttgttttctcttggcagctctgtaagcaaggacctgctttacttttgctctctgccatctccccagcacctcacaccaagtctggtgcatacaaagtcctctatttgtctgtctcaaatatacatgagtgaatgaatgaattattttatgctccaaattggcattgaagtggatagatatatatctagcctgtctttctcatagcatatgttaccatgacatcaaatattcctccagaaatacttgttttgggaagaatttggtttgtgcatcaagactgcaggataaaaggatactcattgtatacacttgttgccaacttcttgctaatgtagacaaaggtgtgctaactcctctgtaccttcctgaatgtttgtgaatgtctgcagacagcagattcccagaagtagactggctaagtcaaagcacacatactttttaaattttggcacctctccccaaaatttggtcactagcatttgagaatgtccattttcctacaaccttccttactctaatattattcttgttttcgatacaaatagaagtcatttcgacaaaacaagtcattttgtcgaaatgacttctatttactttgagtgtctgttttggtattagaagtagggtagactcacgcctataatctcagcactttgggaggccaaggcaggcagatcacttgagcccagcagtttgagattagcctgggcaacatggtgaagtcccgtctctataaaaatatgttcttttttttttttgtattttaccggggcgtggtggtgcatgcctgtagtccctgctccttgggaggctgaggtgggagaattgctagaccacaggaggtcaaggctgcagtgggctgtgatcatgccactgcacactccagcctgggcgacagagcaagactcagtctaaaaaaaaaaaaaaaaaaaagtagtagtagggtggactgtctcttttatgtttattgcacctaaacatactctctggtaaatattctactcatagtctttgcccgtgtttctatcttggtgttcaacttttcctgagtttatattacatttatttatgtatataatttctatgtatctcatatgtttatgttagtgatacaaagttctggatcatcacctctatttttacatatttgacctgggcttgccatttaagtcttgtttgtggtggacgttttccttacacacaacacacacattttcaatttttgtgaagtatagatttattattttatattcgttaacttttgtgtcatatttagtacatctttcttcatcccatagcttcaaaaatattctcttcggttttcttgccatgactgcagaatggaggccacgagcccacttccttgccccaagccctgttccctactcacacggcgcgagcgctgccccccctactcagacggcgcgagcgctgccccccctactcagacggcgcgagcgctgcccccctactcagatggcactctagaactggaatgtcccacagagcagccgcaaaccacagatggctgttaagcacttaatatgtggctgctgtgaattgagccttgccacacgatgagtttcaaagacttagtattaaaaaagaatgtaaaaaatattattacaatttttatattgattacatgttgaaatgataacgtttttgaaacatggggtcaaacaaaatatatcattaaaatgaatcccatctatttcttttaaaagctgatagaaaataaaaatagtaaataataacaatgacttacaaaaatagaaatatctgcccaggcgctgtggctcatgcctgtaatcccagcactttgggaggccaagatgggtggatcctgagttcaggagatcaggatcatcctggccaacatggtacaaccccatctctactaaaaatacaaaaattagccggtgtggcagcgcacgcttgtaatcccagctactcgggaggctgaggcaggagaatcgcttgaacccaggaggcagaggttgcagtgagtcaagatcacgcaactgcactccagcctaggtgacagagcgagactccgtctcaaaataaataaataaaaaaaataaaaaatatataatatatgtattttatatatattatgtatataatagaacacttaaaatgataaaaatggctcatattataatctatcagactcaggtcctgcaagaagaccttggttactgcaggaagaatttgggctcaaataaatagaagttcagatggtagaaatctttctaactggagactcttggtctttgagaagtagtttgaatgtcaacatctcacccagttgccagataaaacctcggttcaacaacccaccatggaatttttccctgattaatgagctaaattctgtactggaatccaagcaatatatatgttgccatccaactcaggaagagactggctttctcggaaagagcacaacccacccagtgttctggagacctctatttccaaaccataaaaatattaaatactagccatctgttttgcagatcgcgtccctgatttccatcattcatcagtttcttttttcctccctctcgtttcctggggtgaacatcctgccccctcattttctgggttcccctcatgaggatctgttaagggacctggcatgaagctgctggttgtatgtgatgcataatgccagcctacttccactgaacaaaattctgttatacattcagagcaaaactaaacaaatgagaattcactaaaatttaataacagctttgttgagatagtcacatactatacaattcatcgtttaaagtacttataagtcaatggtttttagtatactcatagagttgtgaaatcatcagcacaatcaattttagaacatttagaattttagaacatttagatcatcccctaccaaaaaatcccatgccccttagtcgtaactcagcatttcctcccagtgttccccagccccaggcagcacatgaatctacttcatgtatctgtagatttttgcattttgaatcatatgatatatgacttttgggtaagattttttcacttagcttaatgtttttgagctcatctgtgctgtaacatgtatcagtacttaattcttgtttatggcagaataatatttcattgtatgggtgtgccacattttacatatgtattcataagttgatagacctttgggctgttttcacttttggctattatgactaatgctgctatgaacatttgtatagaagtttttgtttgtgtagatgtatgtttccatttctttggggtatatatctaagagcaggattactgtgtctcagggtaatgctatatttaaccttctgaggaactgctttccaaaacagctgcaccagtttacatccccaccagcatttatgaggatttcaatttctctgtcctcaccaacacttgttatagtctgtggtttttgactatagccatcataatgggtgtaaagtgacatctcactgtggttttgactcacatttccttggtgcctaatgatagtgagtatcttttcatgtgcttcttgggtatttgtgtatctcatttgccataatatccactgagaacctttgctgcttggtcacgctacacccaaccattttcgaaacatctgggctatccatgatagtttggatactgagtttatgtgggtacagtggaatcagaaaaaagaaaagttaccagagaatttagttggtaacgacaaatcctttggagagaaccttgacaggacttgctaatggacaacgtttgctgtacctgatcaggtcaactttgaagttaacagaggctgaagtgccggaatcaatccattccagaatgatttctaattaagggtgcaatataagatcactctggctacagggaaggaggcagaagaagggaaagggaaagacagggagatgccaggagacctagctggccactcactaaatctagatagaattagttaattcttccaatatgcttttattaatttatttataaatgagatacacagaaaaatgttaggtgcaaaataaaacacggaaaatttttcagaggataagatttaaaaaagtgaaaatggaagctccaataatttatttgcacacatgacccgttctgagacctcaaaggggtcgcagcatgcgatgaagttgggccagggtaacgacagaagatgggaaggttggggagttacgtggggtgagtggaatggctgaaggtagactctggagaaggatttgatttgatgtgctgatggacttggtttctcattgttggaaacgatgtgagaccaattgatggctgtagttgagaaggaaatgatttggaatgctcaggagggaggtctgggctgttggtggagggggacaaaatcatagagaagtgagttcgtgagtgtggccaggggactggaggagatgtcagtggggattaaaaaaaaaagccaagagctaacacggagtcccgaaagctcaacctggagacctggatgtgacaggagagcccccaggcctgggtctgcagctttctcagagcctgagatctacccagcaccctttcagcaatacttcttgtagatgccagccaccgctagtttctcttgatgcaactaagaattccaatgcaaacaaaatgcagcggctcacacgccctgctgtgctcccctctctgaggacctcatccaagaacatattttaagatatacaggacccattatctaagcacggatggagaaaactgcaggcttgagcccctcccccttgctgcctcaggagcactgattttctgtgaaggacagatgcagcctccagctgttgccatggaaaccagggctgcagagagtgaagttttccaggctctggagtccgttgtgtgtgggtggatgcaagatcccagcctggcatacagcaggcaactaataaatgtctgtagaaggactgaatgtttgtctcctcgactcccaccacacctcggcattctgtgctagaacaatcatcttcttgtgggcctgaaatctgtgaggttgaaattttgtaaaaactccctggatttattgagttataatttacatataatatgatttacctattttaaatatacagtttgatgcattttagtggttgtatacactcatgaaaccaccaccacaatcaataagcagagcatttaattagtctaaaaagtttcttggcccggcaaggtggctcacacctgtaatcccaatgctttgggagtctgaggtgggaggattgtttgaggctaggagttcaagaccagccttggcaacaaagcaagaacctgtctttacaaaaaaaaaaaaaaaaaaaaatcagctggatggggtgacacctgcctgtaatctcagccacttgggaggctgagatggaaggatcacttgagcctaggaggccaaggcttcagtgagctatgatcatgccactgcactccagcctaggctacagagtgagaacctgtctcgaaaaaaaagtatgtatatatatatatatatatatatatatatatatatatatatatatatatatatatatatatatatatatatatatatataaatttaaaaaaaagttttttattagtctgttctcacattgctgagactgggtaatttataaagaaaagaggtttaattgactcacggttccgctggctgtacagggagcctggctagggagaccccaggaaacttacaatcacggcagaaggtaaaggggaccaggcatgtcttacgtggcgggggcaggaggaagagatggggggatgtgctacacacttttaaacaaccagatctcgtgagaactcactcactgttatgagaacagcaaggggcacattccacccccatgatccaatcacctcccaccaggccccgcctccaacactgagaattacaatttgacatgagatgtagggagcggagtggatacagacccacaccatagcagacttttctgtgctaatttgccttggatcccttccctccctccaacccactaccacaccaccccgatctacttccagtctctactgttttgtgactttctagaattttatgtaaatagaattatgcaatcttttgttcaacttttttctcctaatgttttgagatactccatgttgttacatgtattaagattttactgattaatattaattattaaataattatattttattcctttttactgctcagtgatattccataatatggatatatcagtttatttattttcctgttggtggctatttaaactgtttccaatttgagggtcagggggtgcagttacagaattatacagctatcaacattcctttctagcaacattttaagatttgtcccaggtatttgcaaacctaaagtgttgtgcttttctcacaaaaacaatagacatcggtgtggatatggtgaaaagggatcactatacactgctgatgagcatgtcaattagtacagcctctgtggaaaacactatggaggtttgtcaactaactaaaagcagatctaccattccttccagcaagcccacgacggggtatgtacctgaaggtgtctttcatataaaagagacacctgcattcatatgtttattacagcataattcacaattgcagagatatgacatcagtctaagtgcccatctacagatgagtggataaagaaagtgttgtacatatacagcatggaatactactcagccattgaaaaagaatgaaatcgtgtcctttgcagcaatttggatggaactgaaggcccttactctttttcttttttctttttttttttctgagacggggtctcgctctgtcacccaggctggagtgcagtggtgcgatctccgctcactgcaacctccgcctcctgggttcaagtgattctcttgccttagcctcctgagtagctgggactacagtcgtgcaccaccatgcctggctaattttttgtaattttagtatagatagggtttctccatgttgtccaggctggtctcaaactcttgacctcatgtgatccgctcgccttggcctcccagtgtgctgggattacaggcgtgagcccaccgctaaaggcccttattctaagggaagtaactcagcaatagaaaaccaaataccgcatgttctcacttataagtgagagctaagctatgggtacacagaggcagacagagtggtataatggacagtggagactcggaaaggggacaggaagggagaaagggagggataaaaaaactacatattgggtacaatgtacatgacttgggtgatgggtgcactaaaagcccggacaacaccactatccaattcatccacgtcatcaaaaatcactggtattcatagagctactcaaataaaaagatttaaaaaacaaaacatagactggcacacacacaaaataatgtcttgtactttttgtttcattcttgccaattggatagaaggaaaataaatggtctccctgttgacatggctgcccaatttttggattacaaatgagatgaacaatccttcatcgttctttgaagtgactttctctctctctctctctctctcgtgttttttgtttgtttgtttttgtttgttttttttgaagtcttgctctgttgccaggctggagtgcagtggtgtgatctcagctcactgcaacctccacctcccgggttcaagcaattctcctgcctcagcctcccgagtagctgggactacaggtgcacaccaccacacccggctaatttttgtatttttagtagagatggggtttcaccgtgttagctgggatggtctcaatctcttgacctcatgatctgcccacctcagcctcccaaagtgttgggattataggcatgagccaccacacctggcctctttgagttatttttaaatgtacaaataaattattattgactatagtcacccaattttgctatcaaatactaggtcttattcaccctttctaactatttttctgcacccatttacaaccccacttgccccccaacccccaacccatactgccttgtgctgaagaagaagatgagaccattggcccctccctggcccaaacaccattcccccattccccccacattgaagcgcccagacctacaaggaggctttcagctcccggtcctgcatgaggaatttggaccaaatccaaatagaaaatggggtcagaagggaatgacatttctaactgaatagccacggtccctgagaagaagcagttacaacgtcagctgccagataagacgtcgggtcaaggacccaccgtggaacgtccccttggttcctaagccaaatgcccagctggaatcccagcaatacacatgttgccttcagcaagggaatgattttctcataaacagcacagcctggccaaggttctggagacctctgtttctaagccatggaagtattttatcctgggccaggcgccatggctcatgcctgtagtcccagcacttttggggtccgaggtggttggatcgcttgaggcctgggcaacatagaaagacctcatctctacaaaaaaaaacaaaaattatccgggcatggtggcacacccctgtggtcccagctactctggaagctgaggccagaggatcacttgagcctagcaggtcaaggctgcagtgagctgagattgcgcccctcgctccaaactgggcaacagggagagacactatctctaaaaatatatataaaataataaaacaaacaaacaaatattttattctggttgtcattttgcggattatatcccctggtcccgtcagtaatcattttggggcagttttttttgttgtttttttgggggtaggtgtgaaaatctttccgcttcataatattccaggcatcactgatgttcagccataactccccccacccctgaatatgctcatggaactaaatttccataacttgttggattccgtgaattaccaaaatcagtaagaatggacttttaacacttcatcttagtctgaattaagttcacacacatagctgtctgcacagggttcgtctgccttttcccataacaattatgtcagcacgacctcacagcaaagaccacattgctccctgtcatgggctgaaatgtgtgcccctaaactcacgctggaaccctactttccagcacctcagagtgtgagcatatttgaagatggggtctttacagaggtgatcaagttggaacaagatcattagtatcatctgtgtctcctgattcactatggctggagcagccaggtgtggtggctcatgcctgtaatctcagcactttgggaggcggaggcaggcagatcacctgacatcaggaattcgagaccagcctggccaccatggtgaaaccttgtctctactttaaaaaatacaaaaagtagccaggcgtgatagtgagtgcctataatcccagctacttgggatgctgaggcaggagaatcacttgaacccggaaggtagaggttgcagtgagccgagattatgccattgcactccagcctgggtgacagagcaatactccatctaaaaaaaaaaaaatggccaaagccctgatcaagagaggagatgaggacagaggcacatacaaagtgatgaccatggaaggacactgggagaagatggctgtgtctatacgctgaggaaagaggcctaaagagaaaccaaccctgctggtaccttgatctctcagccttccagcctccagaacagtgagaaaatgaatttctgttgttgaagccgccccgtctgtggtgttccgttgtggcagtcctggcaggttaatgcacgtacccaaccagagtgccccaaacccttcctacgtagcaattctggagcttagacagtctgtggatcatagtaaggaactaggtctttatctgacagtgacatgaatctgttgacgtgttttagcccgggcagtggtcacggatgccttttcttttaagacagtccatgttggctccactatggatgaaagccagggctggtgcatggcagagacacacacagaggagatttgggggacacaggacagagaggataggtgcccagacgaggtggggtagggggaatgacggagacagagctggctcaggggatgtccaggaggcagaactgacgaggcctggacgctggtgggattcggtgggtggcttatttcatgtgtccacctggccaggctccaaaccccacagtttccgtcaaaccctcatccagctgtggctgcgagggcattttacagatgcagttaacatctacgatagctgactttcagtgaaggagatgatcctggaggatgtgggtgggcctcatctcatcagttgaaggccttacgagcaaaaactgagttttccctgaggaaaaataaattccacctcaaggttgcagcattagctcctgcctgagtttccagcctagcgtcagtcagccccacagatgccatgcctcccagacttcaaaatcgtgtgagcgattgccttacaatgagtctcttaaaacagtggtttgcaacctttttggcaccagggatcagtttggtggaagacaattcttctgcagaccagggtggggagatggctttgagatgattcaagcacattacatttgttgtgcactttatttctattattattacactgtaatatataatgaaaaaaattatgcaactcaccagaacatagaattggtggggagccctgagctcattttcctgcatgctcccagctgggagtgatgggagacagcgacagatctctaggcattagattctcataaggagcatgcaacctggatccctcacacacgcagttcacaacagggttcgtgctcctatgagaacctaatgcggctgctgatttgacaggaggtggtaatgtgagcaatggggagaggctgtaaagacagatgaagcttcactcactcactcgctcacccacccaccctcacgtcctgctgtgtggcccagttcctaaacaggccataagccagtatgggtccatggcctgggggttggagacccccatctttaaagacaaaaattatatatatgacatatgtgatatatatatgatatatatacacacatatgcgtgtatacacctattatcaatatccccccacacatatatacatataaatatgcatgtatttcaccccatacacatatatgcttatccccccccacaaatatacttataaatatgcatgtatccccccacacacaaatatacatagaaatatgcagtattccccccaaaacatatatgcatgtatcccccacagacaaatatacatataaatatgcagtatttcccccccaaaacatataaacatgtatccccacagacaaatatacatataaatatgcatgttatgtcctacttagtctgctagggctgccataacaaagttccacgtaccgagtggctgaaacaacagaaatgtgttttttcacaattctggaggctggaagcttgcgatcaggtgtcagcagggctggtttcctcggaggcctttctctttggcgatcagacggccgccctcccggtgtcctcacgtgggctttcctcggtgtgtgtctgcatccacacttcctcttctgttgaggaaaccagtcctattagattgaggtccatcctagtgacttcgttttagctcagatgcctctgtgaagaccctatccccaaatacaatcacagtttgcggtgctgtggggttaggacatcaacatatgaattcagggagtctacagttcagcccatagcactactgggtttgtttctctggtaggactctgacggctacaggaacaggcaccatttctgccttaaggaactaggtggacaacctcaatccctgagaaagggaaggatttttgaaagcataatgggttcaacttagctgggtggagacctcctaagaagaggtaagagtcttgttctttctctgtaaaaggaaaatggttttctaacgttttactgttccagagaaagacaaaacgcccaacctccatttacatctgtctcagcgcgcctcattaattccctagaaagaactgctggaagttgaattactgggtcaaagaggataagaggtcctcgtgatttggttatgttactgagttttgttccaagtcaggcagcttggccataactcctgtttatttatcactgcatttctgtttaatcattttcactgcacagatagcatatcaatttttacttggaaattgaaactatatatatttttacaatttatcatcctgtattttccctcatgaggctgtccccatgatgtaaaatgatccaaaattttgattgcattgtccggaggaaaggcatttgttattttctcttaatcattttagtactgacttttcatacgcccttcttgtgctttatagtcttgtttccaagcacttcattttacaaacatgccgtgatgttccccttctatctgcgccctgtgcctttgtgtactgggactcattttttggggggagacagggtctcactctattgcctaggctgatcctgactgctggcctcaaacaatctttctgcctcagcctcccaaaatttgggggttacaagcaagagccatggtgcccagcttgagttacattctttaaaaatcaattcattgcatttggccttaatgggaagaccaaagcgagatgtatcatgaacttgaaaactacagtattgacaacctgtttatcagaaaggttcagaaaaattcctctcccaccatcagtatctcaaaccatccccacctcaactttgcttcctggtggtattagcaaattcaaaggtggtgaacatgaaagacatgtgaaatgttacagtgctgtggagatacggtatcgctagtcatttatgaatccacctaccatcattcatccattccacccatccacccactatccatccatccattatccattcatccatccatctatccatccatcctctgtccattacccattatccattcatccttccatccatctatccatccatcatcccttatccatccatccatccatccatcctccatctatccacccatccactcatctacccatccatccactcatcctccaactatctactatctatccatccacccatcaacagaggagccacagagggaagtactggggctggtcaggaagcagagggagtgagggggaaatgtgagcaggagccttttcgttatttccaagggagggaacgggtgaagcagagtgggcaggcttaggattggctcctgtgagtgatttcagtggctctgggtcacaggcactgtcctggttgtctggttcccaaccctgggtgatgaaggcatgcacacagaggccctgagtgtgggagcccaatggacggggtgctgggtgtgggctctggatggggtggtttgcatgtgaaaggcaccatctcaggggggttgtttatcatctttaggaaaatgtaaagaatcaaagtacagaaatttacacaggcgtggttgatgcaccggggagtggaatgggtcagcccaggcgaggatggggcatgttggacagacgcagctgggtgtggaggcaggacactgtcagaaaaggctcctcatggctcctctctccttagcggccctcccttcagcttctcaatctttaatgtgcattctaccccactctgggtctgatttagcaggtctggctggtgcctagtattctgcatttctctctcttttttttttcaagacggagtctcgctctgttacccaacctggagtgcagtggcgccactgcaacctccacctcccaggttcaagtgatcctcccacctcaaccttccaagtagctgcaattacaggtgcccgccaccatgcctggctaatttttgtatttttagtagagacagggtttcaccatgttggccaggctggtctcaaactcctgatctcgagtgatctgcctgcctcggcctcccaaagtgctgggattacaggcatgagtccccgcacccggccattctgcacctctagaaagctcccgggtgttgagaatgacagactttgatggtttgcctgagacgctctccattttagcagggacccaaggagcccccggccccgggcaaaccaggatggttggtggcttcactggtgacgctgctggtactggtactgggccacattttgagcagaaatgttctgttggagtctgcccttcccaaggcaggagctcagagaaaaaggagaaaattttcactctgttccctgctctgctcgggctgacctttcctcctggtaaacatcgtgttttctcctttacgcaacatgccctcaacccacctgaggccacgtccagtgtctggacatgcttggatatttttccctctggacagttcctgaccttctagatacatttcaacatgacctctgtctcaggttggggctcgccaaccgtgcatgtgaaggcatgtgctgtctctcggccgcccaaggcatggtctttgcattctgtccgtagcctgaacaatcattaaccatgcaattgccctcttttctgctcatcatgggccccaaacccctccgtaaccactggaagccatcgctctctgctctccacaaggcaaaagggtgaaatattttaataatcatacagtgtgaaacatctcaccgaaaaaaacacagcaacaaccaacacatgtaaaagacaagactgatgaatctgactctatatgtacagaaaatatcagcagctggaaaaaatataccaccaaaaaaaaaaaaattgaacagagaaactggcaaaagcagatatcacagagttaaactttacaggttaatatataaagcgtataaagaggtcagaaagacacaagtggaagaccaaaagcgaagagtgggcagaggatgacaacaggctgctaataaaagggaacatttaaacgtttaggaaagatgaaaagatattccactttatttatagtctactaaacttggcatcgaaaatcaaaatgagatatcactttctaccactcagacagaacaaggtttataaaatagcacatggagtgggcaaggtgtggcatgtggaaacggggtcatccgctggctggcggtgaaggcgtggattggcacatttctgatgcgtattttagcaataaatctgcaaaagagccagtcaacagagtcccttccagcagaacaaatatagggaagctgccttcctactgggcacttcaggttagtaatcggagaaaagcaaacaagcacgaaagaaatagaagagcgatttggcattatctagaaaagctacaatcggtggctctccattgtgggatgatttcaccccctccactccgggaaatatttggaaatgtgtagagatgttttttactgtcacatctggggcgtgagtagggagtgaactactagcatccagtgggtagagaccagagaggctgctaaccatcctgcaatgcacagcacagccctcatcaacaataaagagttaccagcccaaaatgttaatcacatcaaagctgaggaggctgccgtattgcccagcaattctgttccaagatatatgtcccaggggagctccctccattcccacaaggaccaagcataatcgtgctcattgcagtactcactcactcagtgcagatctgttgaatgtgaactgtagcccagtcactttgccgtgatgggggctattcacagttttttgggtttttttttgagacagggtctcgctccgtcacccagggtggagtgcagcagtgcaagcctggctcactgcagcctccacctctgagatcaagtgatacccccacctcagcctcccaagtacctaggattacaggcgtgtgccaccatgcccagccaattttgtctatctttttagagatgagtgaggtcttgctgtgttgcccaggctggtctcaaactcctgggctcaagcattcctcctgttcttggcctcctgaagtgcagggattacaggtgtgagccactgcacctggtctattcatattctttgtagtgaaaaaaagtgggatgctgggagaggaacaactgaaatgtctattgaaaagagaatggataaataaattgtggtgtattcgtaaagtggactgcagtacagaagattaaagaatgagaggtacatgtgtccctgtggaaagagcgcaatggatgagagcaagttgcgctgatagaacatccaccctttagcctggcgtggtggggcttgcctgtgctcccagctactggggacactgaggtggaaggatcacttgagcccaggaggtggaggccacagtgagccatgattgtaccactgcactcctccctgggtgacagagtgacaccctatctcaaacaaacaaacaaattgacaagagaagaaggaagggagggagggagggaggaaggaaggaaggaaggaaggggagaaagaaagaaaagaaaagaggaaaggaaagaaaaggaaaggaaaaaggaagaaagacacccaccctgttaccaaccaccctcccagatctgtctgttgggttgcactgatcccttgcagggaatcgtcttcttactttgtgagtttacagctcagctccgtgtcattattcagagttactgtaacaatgcaattcacgagaagccctgaatgaatgccgttgtggctaccatcaaatgttgacacagcgttcaaccccatcgagaggagatgcattactcaagacatctgtagacagggatggaggactggaagaatgaatgaagtcattcattctttcaacaaacttgaagcacctgaggggttcttgcctggcactttgaaccccctcctttccacccccaaacacacaaacacacacacacacacacacacacacacacacacacactgatatcagagcccagaaaattccagtctccgcagctccttcttcagccctccccttcccgcctccagctgctgtgtccatggtgacagtctgagcaggcctgggttgccgccgaacaggtgattgctcttgaaggaaaacaacaccaagccactggggggatgggaggcagtggaaatggctcaaaccctggccccacagctgtggcctgtgcaggacccgcatgtccctgaaaatgcatccttgagagctttgcaaaagatcacgaaatcggccatgagggcctccctgaccctgtcagagataatacatctcttaagcatgagtgacattggcgttagctttttttctacttgttcatttattcatatattcaacaactatgaactgactgtcctgggagctggtgatacaagaataaaacaaacagacaaacaggaggcacactctgatctgatagagacatttgctccttcaaagaagatttttttcattcattctggatggacttacggaagagccgctgcatgctggggccatgctgggcacagaggatgcaccacaaagagagagagagagagagagagagaggaagagaggaagggaggaagatgggaaggggggaaggaaggaaggaaggaaagaaggaagaaaggaaggacggaaggaaggaaggaagggagtcaaacaaagtccctgctttctgttaaagaacaaagcattcgatgagacttgttaaagcatgggaaggaacaagatttaggaccatagtgatgggcatagacagactgcgacaaggggattttgcagtgggggagagaaacagggtgctcagctctgaatgcagcatgggcaagagagaatctgtagccaagaagcagggtgggggtcagtggatggaaaattactgagaggaacatctggggtttcctctggctgagaactgacctaacaggattcttgttgaagacaggctcagggtgagttgcccgggggaggctgaggatgagggacgtgaaagaacctgtcactccacagggattgtcgtctagttggggagagacatggtaaatcagtatatatttttgttttcttctgtatcctcactgcctagcagaatgcttgggatctagtaggatcttcacaatcatttttcagattgtgaacaaatgaacaaataaatgggttctgtggagttcacaattcaaattctggtgcctttattcatgtaccacgttcatagcatcctttctcctgagagtatccaaggttcctttcttgggtggatggggagttggctggatatggggcatcccggacaaagatgcaactgcctttgcaaaaactatatcagtgagaaaattctgacagtgaaagagatctgagctaacccacctcccatcttgcctttcccttagttattcctgggctattgggccaagctgactttggaagacatttgcgctacagtgtaaaagaataataggctttgcccaaaactcaactgcttttgtaaagctaatgggaggctggccagtgtggtggctcatgcctgtaatcccaacactttgggaggctgaggcaagagaattgcttgagcccaggagttggaggccagcttgggcaacatagtaagaccttgtctctacaaaaaatataaaaattagccagacatggtggtgcacccctgttgtcccagatactcaggaggctgaagtgggaggatcacttgaacccaggaagttgaggctgcagtgagctgagatcacgccactgcactccagtctgagcaatagagtgagacttgtcttaaataaataaataaataaataaataaaaataaaaagctaatgagaggtcagccggtctcactgtgttgcccaggctggtctctaactcctgggctcaaggaatcctcctgcctcggcttccaaactgccaaaattacaggcatgaaccactgctcgcagccccaggcagaaaattcttgaagcaatatctgaccattcatctctctttcttaaaaaactttaacgggcctggcgcggtggctcacggctgtaatcccagcactttgggaggccgaggcgggtggatcacctgaggtcaggagttcgagaccagcctggccaacatggtgaaaccccatctctactaaaaatacaaaaattagccgggcgtggtggcaggcgcctgtaatcccagctacacaggaggctgaggcaggagaatcacttgaacccgggaggcagaagttgcagtgagccaagatcgcactgctgcattccagcctgggcaacagagtgagactctgtctcaaaaaaaagaaaaaaaacctcaacatattccattgctctttagattaaaaacttaattcttaatcaagacctaccagaagttgcagctccagaattcccacatggaagggacttggagggaagttttgggtcagagtggaggccactgtggggtttgccgtgttcacaatgccattcatttgaatcaatgctgtctgccatgaaaagtgtacaagaaagtgaaggcatgaagaaatcaatgtccaactggcattgacttctttttatttcaaattagtataagaaataggccaagaagcacattaggaaacagaggatatgacggttaattttagatatccacttggccaggctgtggtgccatgcggtttgatcaggcaccagtctagatgccgtaggtgctgagtcgatgtaattagcatttacagtcagttgacttcaagtaaagactagtctccatcgccttgatgggccttatgcaatcagttggagatggactgttttttccaagaaaaaagaattctgcctcaagactttaacatagaaaccctgcctgaagttccagcttgctggcctgccctgcagatttcagacccagggagcaatatccactgttccctcagtccccagcctgctgccctacccatcgggcttgccaagcccggcaattgcaggagctaattctctaaaatagattcctcccctcccctcctttcccttcccctcccctcccctcccttcccctcccccctcctctttccccctcccctcccctctcctctcctctcctcccctctcctgtcctttcctcccctcccctcccctcttctcttctctccgcttctcccctgtcctgtcctcttctcctctcctctcctctcctttcctcccctcccctcccctctcctctccgcttctcccctgtcctgtcctcttctcctctcccctcctcttctcctctcctctcctcctcgctcctctctcgtgtctcctctccccacctctcctctcctctcccttcctctcccctcctgtcctctccccttccctcccctcccttcccctctcctctcctcccctctcctctcatctcctttcctctcctcctctgtcttcccctcctctcttcttctctcctcacctctcccctcccctctcttctcttctctctctcccatgcatgtctcctcttctctctatacttctccatcttcctctgtctctgtccctctccctccctaccttcctccgtatctctctgtgactctctctctctctctctcacacacacagacacacagacacacacacacacacacacacacacacacacacacacacactgttggttctgcttttctgaagaaccctagcacagaagggtattgtgcgcacaagctgacaacatagacacaccaacatctgctgcctgccaggccctcaggacaggagaccagaccagtctgtagatatcaagggagtgagacccaccccaaaatgtggagaaaactggttaacaacctgatacatggacgtggatgacagcagaatggctggtagtcaatattcttaaactctttgtatgattcggaaacaaacctctctaaagctctgtctgtattgtgctgtttctgagaaaattgttccctccttgtaccctgggctcttgttgaacataccacggtggatctttgagctgaaactttgtttgggtcctgggccagatatgaacattttagccacttctccttcaccaccaggagcatccccgtggcaatatctgtcccatccaaaccctctttggccctcatccctcccttggcgttggtgctgtggtccccggatggtttagactctatcagaggaggagaaggaggcacatccttaggacagggagacagctcgtggcctcgacttccctcccacaccaggacactcaggagaatagtttcataatttgggtgcagaaagtcttagtgagcacaattcttaaaagcttacaatcattaaagataagaagaattaaactgactccataagagctgaaaaaggcctggcacggtggctcacacctgcaatcccagcactttgggaggccgaggcaggtggatcacctgagatcaggagttcgagaccagcctgagcaatatggtgaaatcctgtctctatcaaaaatacaaaaattagctgggtgtggttgtgggcgactgtagtcccagctactcaggaggctgagacaggagaatcgcttgaacccgggaggcagaggctgcagtgagccgagatcatgccactacactccagcttgggcgacagagcaagactctgtcaaaaaaaaaaaaaaagctgaaaaagtaggcacagaataacaaaaatgtaaaccagaagaaatgataaaaatgggtgaaactattttcaacctaatgagattcaaagaaactatatagtttacatgtgaattgtgtttacaagaaaagaatttaaaatacggggtaacataaactttaaaatccatcaaaagagcaacaggtaggaacagaaaagccttaaaagataaaataaaatgtgccaaataaggaaaatgatgtttcgacctttcttgtactccaaaaaaatgaatatgcaaaccatactgggaagtcattctttctcttgtcagatggacaataaggaaatagacaagcagagttgactatggggtgagagcggacgccttctcaggctgctggggagagcgagttgctgtgacctttctggcaagatcttttggcagtagacttcaaagtttaatatctgcatgccctttgacccagcaaatccacttctgggaacccacctccccacagacatacacaaaagcacaccccacacacacacatggtcatggcagccttgccagagcacgatcagccgaaaagtccatagaacgtgcatctgggttgtgtgaagctcaacactgatgcagaattttacagtccaaagacatcagccccttgttagacaaatgagctgtgttttgaaggtcatctaatgttaagatgtatattacataagcaaaagttggattaaaaaacaaaaatgcatcattatccaagtttgagcaactgtaatacatttatgcatccatttatttattcagcttctaaaaaccattgatgctgggcatggtggctcatgcctgtaatcccagtactttgggagggtgaggtgggcaaatctcaaacctgggagtttcagaccagcctgggcaacatggcgaaaccccgtctctacagaaaaaaaaaaaaattagctgggtgtggtggcgcctgtggtcccaggtacttggggaggctgtggtgggaggatcacctgagccagggaaggttaaggctgcagttggaggttgaggatcacctgagcctgcgaggttgaggctgcagtgagccatggggatgccactgcactccagcctgggcgacagagtgagacccagtctcgattaaacacacacacacaaaaacaaacaaacagaaaaaccattgaacactcacgctagatattctatcagggagagaggatgtggcagagctaaaagaaaacagagtgtgcctgctttcacacaacgtccatttcactgggtgaaaatcacagaagaatataagtacaagaccattttggagagcaatctgccggtgtctaagaacgctgatcctatgtgttcccctatcgcccagaaattccagtttgagatttgtgccctagagaaactctcacacatagggcaaggaggcaagttcaaagatgttcattgtgactttcattgatttggcagatattgattgagcagaaactgtggactgggcactgctctgggctctggggagatgtagcgttgcttgtgatggccaggaaagcaggaggagaggttacatcccaagtgcctgccaatgcgagaatgggtgaataaactgagtggaacgtgaagagcggggagagattgggatcaagttgcagaaggatcagtccacagaacagtcctgcgcagaccctctctcagagacctggttaatgtgctttgtggacctctcaactctgaaattatttctgtcctctccttttttcccagtttttaaaattgtggtaaaatacacataagcaggccgggtgcagtgactcatacctgcaatcccagcattttgggaaggagaggcaggaggatcatttgggcccaggagtttaagaccagcctgggcaacacagtgagaccatatctctaaaaaaaaaaaatttttttttaaattagccaggcagggtggcgcgtgcctgtagtcccagctactcagaaggctgaggcgggaggatcgattaagcccaggagtttgaggctgcagtgagctgtgatcacaccacacactccagcttgggcaacacagcaagaccttgtctcaaaaaaaaaaaaaagccataatataaaatttgccattttaactatttttgagtgtacaactcagtggtattaaatacatttataatcttgtgcaaccatcaccaacatacatccccagagcttgtttcatttgtaaaactgaagctctgtccctgttaaacataactccaccgtcccccttccccagcccctggcaaccactgttccgctttctgtctctctgttatttgcctactccaggtaccttatagaagtgaaatcctacaagatttgcctttttttttttttttttttttttgtggcagagactctctctgtctcccaggccagaatgcaatggcgcaatcttggctcactgcaacctccacctcccaggttcaagcgattctcccacctcaaccacccgagtggctggaattacaggcatgcgccaccatgcctggctaatttttgtatttttagtagagatggggtttcccatgttggccaggctggtctcaaactcctgacctcaggtgatctgcccaccttggccgcctcccaacgtgccgctaatagaggcgtgagctaccgcacccggccggattttcccttgcgtgactggcttatttcacttagcctaatgtcctcaagcgtcatccacgttgcagcacgtgtcagaacttctttcctttctaaggctgaataatagcccatgttccgtttgcccatcgttcgttggtggacaccggggctgtttccacgttttagcaatcgtgaatattgctgctgcgggtgggggcagagctgtctctctgagactctggtttcaactctttggggtacgtggtgactccagttttaattttttccagctttcccttctctttgtgccttcagctggagtcattctggatccaactaagataactcatctgagcaggtggactgactgtgtggctcccacggacacagccacaaggagaaagttctcttggctcagatagaggtggggagggggtgcagggctgttcgttttctcagaaaacttgtaggaagcacctgcgttgcactaggcgggcattttgatctcagcacacttccagctccagacctggacatttgcagcctcctgggccttcactctggttcctcagcccctcccctcctctttggctatggtttccacggcaacagccttggcccgggcctgcctggggcctgcatatcagaggacagtgcttgagggaaaacatataacaaccgcccccgctcttccaaagaccgagaccggctggggaggcgtggacttgcggggcagggggctcacgctgcagctccgcctcccccatcgctgggtcagtctgaccccgttagctctttcctgtgaatcctgagaggcggtccctgagaagcgaaagcctcctgcaagagccggtgatgtcagtctcagcttttccacaccccttggttcattccacacatccattgagcaccactgagtacctgacgctggtcctgaagacaggggcgcaatgctgggtgttctcagcctgagactttcacatcccagacatttgtctgccagacacatgcattgaatcactcgaccaatacggactgagggctcagcagggcaagggtgggtgccacaggaaccagccctaggcagagatccctgcctccttggggtttccattctagtggggagtacacatggtgagcacagaacacataaagtcacagcacgatgagcgtggccaagaaacatcaatcgggggagagacggagtgacctgggcaggctgttttaggtaggcgtccgggagggcctcgagaccatgacgagaagtgagggaagggagcagagggacgagcattccaggagaggaaccagcaaggccaagagcttggaggtgggagtttgtggggacatgcctgtgtgagggaagccagtggcccctggcagcaagggctcacaggaggtgagggctgagtcagtaaggggcaaagggcatcctcctcctactcctccctgcttttcctcctttccctgcctttcctcctcctccccttcttcctccccctcctcttcctcctctttctcttcctccccttcccctcctcctcattttcctactccacatcctaatcttcctccccttccctctcttccccctgccccctctttctcctccttctcctccccttcatcctcctactcttccgccccctcctcctcattttccttctcctcctcctaatcttcctcccccttctgccccccttcctcctactgatcttcctcttcttcctcttcctctccttcctccttctcctccctcctcatcctcctctttgtcctctcctttttctaaaaagccttttaacttgcctggccaacacagtgaaaacctgtctttactgaaactacaaaaatgcaaaaattagccaggtgttggggggaatgcctgtgatcccagctactcgggaggctaaggcaggagaatcgcttgaacccaggaggcagaggttgcagtgagccaagatcactccactgcactccagcctgggtgacagagagagactctgcctcaaaacaataaataaataaatcttttaaaatgtgaaaagcattcttagcactctaactgccatggttttcacactcctgaactacagtatgattccgatagcacgtagtacattttatgtatgcatatatgtgtatttacaaggccaagaaaataaatagcaaaataaaaatatgattacttccagactgtctgaatatgaagtaaaaactggtattttaaattaaaagcgttaacaccttttattctcttggatccaataattctacatccaatctttttatctttttcatttctctctgaggatttcatatgatgtggtcaagttagtgtataaggctgttgttctacctttctgtggaacagtgaaatactgacaaccttattctctcttcccagaagaacaccatggcttaatcaaaaacttcttggctgggcacagtggctcatgcctgtaatcccagcactttgggaagccgaggtggggagatcacaagatcaggagttcaagaccagcctgaccaacatagtgaaatcccgtatctaccaaaaatacaaaaaattagctaggcatagtggtgggctcctgtaatcccagctacttgggaggctgaggcaggaggatcgcctggacccaggaggtggagcttgcagtgagcggagatcatgccattgtgcactccagcccaggcgacagtgcgagactctgtctcaaaaaaaaaaaaaaaattctttcataggaggaacttccagaaaaccaacacctagtgtatatttaaatattcctcccggctgggcacggaggctcacgcctgtaatgccaacactttgggaggccaaggagagtggatcacctgaggtcaggagttcgagaccagcctggccaacatggtgaaaccccgtctctactacattcaaaaaattaggtgcagtggcgggcgcctgtcatcccagctactcaggaggctgaggcaggagaatggcttgaacccgggaggcagaggttgcagtgagctgagatctcgagccaccgcactccagactgggcaacaagagtgaaactctgcctcaaaagaaaaaaattatatagatatattcctcttctcaaggaaagaagcccccaccacccagtcccagttccctgagacagaaactggggaatccctgactccctgtcacaccctggacatccagccgccggggctgccaggtacttctccgggtggctcctgagtcagctgagactcaggagtgtggttctccctctgcccaccccttgtgctcttcccccgggacccatttcccgccacctgcacccactatgcttgactttcatcagttgtccacacagaacacggactggaatttcttacaggaaaatctgaaccatggccctcccttgcctaaaacacctcaaagaatacactttgcattttatataaatactcgaattcttctcaagattcacaagctgttggagctctagaatttctacatgggagggagtaagagtagcaattgagccacaatagggatgcttggaggcttgccttgaagctgtgttcacaaaatgttgtcaccagttgtgggagggaggaaggaaggaaggaaggaaagaaggaaggaaaggagggggaaggagggaaaacggcttcttttacagtatgtttctgtgggtacacacacagaaagcaaggttatgaaatcataaaggttattcttacatgttatatctcacttattatacatatgttatatatctcatttattttaatcctcattcatttttactttaattcaacactatacagaattttggaaatgggtttgcaaggcccccataaagtcacttagtacaggaactaaaaccaatagaaattagagccaaggtttttaaccccaggaaaggagagagaaactcatttacaactggagccagggacataatctaggaaacagacacctagtattaaatatgtttatgaacatattgaaaatgaacaggcccagaatcctggccacattttactctttccgagaaagccattcccttcctgagtgagaaggcgagagagggagattcagagagattttgggcttcaccctggcattcgggacattaatcagggaaaattccaagtaggttgatttatctggcacttggctgaatgttgacattcttacagcctcgtccaaaaagccgtgagattccgggagaaacttccctctcatgggagccctcctttcagtttaagtctggcccagattcctctgtgagcaactggagccaggaccctgctgaacagagtttctctgtgggcacaaagtgcactcaccattgccttttctcagcttggtgtgagagggtgtaagtgttcttatcatcacagacaggcaagacattccgtttttaaaaggtaaaaagcattcttagccctctaactgccatggttttcacactcctgaactacagtataattccaatagcacgtacattttatgtatgcatatatgcatatttataaggccaagaaaataaatagcaaaataaaaatgtgatgacttccagactgaatatgaagtaaaaactggtattttaaattaaaagccttaacaaattttattctcttggatccaataattctacatccaatcaagtatgaaagaaaaggtacatgcttcttaccacatagagacaatgagataccacctcggacccatcggcagggctactgtcaaaacaaaccaaccaaccaacaaacaaacaaacccagaaaatagcaagtgttggagaggatgtggagaacctggaaccctgtgcctggcaggtgggactgcgcttctgatagggtattcataaagcagaaaaatgccagagcttgggcaacatccacaaagctctcacctcacttgtaatccaaaaactggatgccagaccaggtgtggtggctcatacctataatcccagcaatttgggaggctgaggcaggaggatttcttgagcagaggagttcgagaccagcctggacaacatagtgaagccccatctctacaaaaaatacaaaaattagccgggcatgatggtgctcatctgtggtcccagctacttaggaggctgaggtggaaggatcagcctaggagtttgaggctgcagtgagccaagattgtaccactgcactccagcctgggcaacagagtgagaccctatctcaaaaaaaaaaaagaaagaaaaaaagaaaagaggatacccaaaccgaattgaaccacagtttccactgtatcctatgggtgaagatgaaaatgcagttggcaggggctggggcaggcacgtgtgtgacatactgcgtctgttcagcattttggggaatgagttcagactttaaaatatgttcactctttgacccagcggttctgcccctgagtgcacaggacccctagtccccaccttgtggtcattacagtgatgtttatgaggcgactcattaaaagaagggatgtcgtggctggcagtcaacagaagaaagcaattttgtataaaacaacgtgtgtttcttcagcatcctgaacgccatgggtcggggtccccaggggcacctccaagtttcatgactcactggaaggactcacagcaaaagaatgaaaagcaaagtcagcgagggggaatggcaccgagagccctcttcgcgggagtcacacaggaggcaccgattcctccagcaaggagttgcaacaacacctgtgaaatgtcatctgctgcggaactcattagagactcgatgtccggggcacttacttggggctggtcacacaggcacctgctgcctggcatctaccagaattccagacgcccagtaggaaggcggctatttagcataaaccatgctatttgcataaacagtgtggacacagtgagacaccagcccaagggccaacctgctacataaaatctttcattgcccgtcgtaatagcaagataaaccaggataaagacttatgtatagacttaaatcccaacgctgagtaaaaatattccatttactcatttttttcttcacaatctagtgatgcttgatgatggtcacatgaaaaagagcaaacatagtggatgcccctgccttcctgaaacctccctgatttatttatttatttatttatttatttagagacggagtcacgctctgtcaccaggctggagtgcagtgctgcgatctcagctcactgcaacctccgtctccccggttcaagcgattctcctgcctcagcctcccgagtagctgggattccaggcgcatgcgccgccacgtccagctaatttttgtatttttagtagagacagggtttcaccatgttggccaggatggtcttgatctgttgacctcgtgatccacccgcctcagcctcccaaagtgctgggattacaggcatgagccagcacgcccggcctgaaacctcccttttaaaccacaatttgggaaagcaatttggtcccatctagaaaactgtttatggtttgaaaatgcacgtacccagaatcctggccacattttactctttctgagaaagccattcccttcgtgagtgagaaggcgagagagagatttagagagactttgggcttcactctagcatgtgggtcattaatcagggaaattccgagtaggttataaatctgtgcttttcctctcccccagcagctccattcctagaagtttcaccagagcaaagtctcccacgtttgggcgaaggagagaagtacatgtagcaagcaccagctctgtgctgtttcagggttgtttgtaacagcagaaaatcctggggccatcgacaggagaagagatgagtggatcctgctgtgttcccctagtcggatactctgtagccatttaagtggatgactgagtgccatgtgcacccgcacggatacgcgtcaaggcagtgatgatgtttgaggatgacacgtctcaataccgcgcagctagtctcaccacccagtcactctctgtctcagtcgactcaggctgggtctcagtctgtttgtgctaacaaaataccacaaactgggtaatttatgaagaacagggatttatttctcacagttctagaggctggaagtcccagatcgaggtgccagtggctcagtccctggtgggggctctcctcctggcttgcggacggcctccttctccctgtgtcctcacatggtgggagagacttagtgtctggagaactcactttcccttctcatagagacatgaaacctgtcatgggccctaccctggtggcctcatttaaatctaatcattggccaggcacggtggctcatgcctataatcccagcactttgggaggccgaggcgggtggatctcctgatgtcagcagttcaagagtggcctggttaacgtggggaaaccctgtctctactaaaaatacaaaaattagccaggcatgacgatgggcgcctgtaatcccagctactcaggaggataaggcaggagtatcacttgaacccaggaggcagaggttgcagtgagccgagatcgcgccattgcactccagcctgggtgacagagcaagactctataaaaaaaaaaagaagaagaagaagaaggaggaggaggaggaggaggaggaggaaggggaggaggaggaggaggaaaatctaatcgccttccaaaggccctgcttccaagcaccatcacactggggctttgggcttcaacgtatgattttggggggtaaacaaatgcaatccatagcactgtctatgttcctcattgtatgaagaactgaaattgtttcctgacagctttgcaattcctgacagttttgagctttatccaccaaaatctacctggcaaggagagctaggtgcatgccattctccctagaatcgaacactgatcagttctggttttgccttgcaaggaagaaacattccttacagcacagagagtgcaggtggggatgggaaacatgttttgttcttttcctgagctcatgttgtgttccttgtatgctgggacattttcaaacccacgcatgctcacctctggagcctggacattgcccagccctgagcctctctcagcagccccttcctggctcccacacaagctgcagtttccatggcaacaggcagagctggcctttgtccttggagcctcccggtgagaggtctttagggaaaacaggctggagcaatggacaacaaaattaaacagcatggggccccgaggcgtgttctttcctataattaaactgcacccttggacatttgtagaatgccataaattggctgtaccctgctcagcattccaagtcccctgcaagcatcataatcaaccattatctgctttcatcatttgtttcttcatttgtctatgcattaaccattgattttaccccaacagtagtagcagacacgcttctagaaaatggagatcttgcagaggtttctaaccagggaccattttgcttacaaagaggcattcggaaatactttcagtcggcacagctggaaggggtgggttctattagccttgagtgggtagaggccagaggtgctgctaaacatcccatagtgtacagaacagccaacccctgccgaccccgacacacaaggaggaatgttctggccccacaagtcaggagtgccctggccgagaaaccctgggatacagtgatttgcaagaacccacaatgaaaacccttgaggcacgtacgctctagggaaggagacagctcatgaaatataatgcatgtgccataatgaagaatcagagatagtaggagagagagcaacgggggcgaaggagatggagcagccagggctgtcttctcccaggctgtgataagtgaagagagacgagtaaggggaggaagcagtcctggggaaagaacactggggagtgggcacagcaggtgccaaggccctggggcagaaacacacggagtgcattctgggaaggatgaggagaccaagatggctgaagtcctgttagggagagtcaaggagagaaggaagggatgttggatcaagaaggtccttgtaggtggtaaggacttgggatttataatttagctgttaaaattaggaattatgagcatcatcaatattaactgagcatttactccatgccgggctttctgtagagcactgagattcctagggcctggaagccggcttagctaatgggagagagtggaggaggtcaaacagacagtcacgtagagataaacttcaaagagaacaaatactttgtccagggacactctgggctgtgtggccactagggcaggggtggacatgagaggaggctgcgattagggcactagccagggagagaggcagcatggatgtgttttggatggtggaactgttaactgagacaaaggatttttgtatttttagaatcagcagtttcaaatttaggatggggccagggttgccaatagatacaccatcaacattatcattacaatcattacttatttttattttattttatttatttatttattagaggcagggtctttctctgtcacccaggctggagtgcagggctgtgatcatagctcactgcagcctcaaactcatgggctcaagccatcctcccacctcatcacgactatgataatgaagtaattaatatgtattatacttgttctgcacgtagctttctactggatgcccgtggcacggcatatctgcagggcaggcgtgatcaccttcccacattcctgatgaggcctctgaggcacagagaggaaaggggtggcctcctctcattctgtctgactgtggaatcagactagcctggacagaatccatcacaccacggccacctaatcctctgagccacagcttcctcatttgtaaaaaaaaaaaaagaagaagacctcgctcccagggtcggcatgagaattaaatgaacaagggaataatggccacacagcaagctcaataaacaacagcacaaaacactcagtcatcaagataaacaatattttcatgcagtatttgaaaaaaaaattcatgtacaaaaaaacgtgataaacaaaatattaaaaatttaaataaagacaggaccctatgagactgtgctgagctacatcagaccctcaggcaaaaggaaaagtgcgtatgaccctaagcatgttgctactgtttttttttttttctttgagacgaagtctctgttgccaggctagagtgcggtggcacaatctcagctcactgcaacctgcaactccctggttcaagcgattctcctgcctcagcctcccggttatgtattttttaatggttattttccagaaatagattttgaaaatattattgatgagtctgcttccactgaggccgggaaaataaaattataataaattctatttttaacacataaaattaacataagacattgcgagtttaatatagctatttttccttttttcaacatttttaaaactaatattctgtgggggtggggagtgaaccattaaataattacaagctgcgtgagagagctcacacctgtaataccagcatgttggaaggctgaggcgggtggattacttgagaccaggagttcaagaccagactaggcaagatagaaagactctatctctacagaaaatttttaaaaagtcagaaatggtgttgcatatctctagtcccagctactttggaagctgaaatgggaggcttgcttgaggccaggaggtcgaggctgaagcaatcttcaagaacaaatatttgctcagggacttctctgggctgtgtggccactaggtcaagagtgggctgtggacatgataggaggctacgattagggtaatagccaaggacagaggcaggaatggatgaattttggatggtaatactattcaccgagtcaccactgcactccagcttgggcaacagagcgaaacccagtctctaccaaaaaaaaaaaaaaaaaaaattgcacaatcacacggatatagggaatcacacttttttttttggcctcgggcttcagtacagctcagcacacattgggtttgatttaaattttgagtatttgttcatccattatggggggttgctttctgcgttcattttggttttcaaaaccattgtgttaaatattatttatcttaaataaaattaaccatactcaccatgtggtataatccccggaacgtattcctccttcatgactgaaattttgtgtctttggaccaacatctcccgtccctgaacccctcagctttctggatgactgtgcacctccgtaagcctcttcctaatccccaggtctgcctttgaggatatgacctttgagctgaaacgtgaaaattgggaaagaaacagccatggggactgtggggaaaggaaattccaattagaggaaaggcaagagtgaaggtcttggggcaggaagctttttcagggacagtgaggacagcatggccagggggtggtgggtaaggaaagcagcagacaagagccaggttgccaccgaccttgtgggccaaccacgggtagctttccttttaatccaagtgttctagagccaccgatctaggctcagttggcatggaaggtgggtgagagaatgacattatctgactcatttgcagaaggtctgcagcttgatttttttggaggatagacttatcatggggacaggagtgaccctcatcatcaagatgtgatagttatctagggagaggtgttggtacctggacgaaggtgaacagaagtggattgaatctcattacgtcatgagagtgagaagcacagaggatgacagaggatgatgtctacgtttcgagtttgggctcttgcagactgggtagtgccttttatagagactggggagacttgggggtgaggagtagaattttgagggggactgacaattttgatgtgaacgcgttggctgaagatgccaatttgacatccatgaagaggacctgtcccgaagcctcacattgctaaaccccagaaaatatcagttttgccagcccaatagataacatcaggggattctattttttgcatgttttctcctcaagagtccaaggataacccactgagtccgctcctgatctgaacctctaaggtattgccaggcctggtgtcctaaacatcagcccatgaggaaatcagccctgggccctgtaccaccaacacaacatcatgtcctgtatccccaaaacatgcaaaagtctcatgaacatgcacatcctctgtgcttccctcccctgaaccaccctcatcctcctttctaggtccttactgccacgcacgcgtgcagtctcatgaaaaaggggaatactgtgaccgcccctgtttccaaacggatattgggcctcttttcaagcgtacgttttcagtttacactttcagagtttgttgatttgtgagttcaaggccctctctgccctgcggagagcacggaaattcctggaactgggggcgtgtgtgaaggggacgttgtcaacgctaggacagagaagaaagccgctcattttgatgtgtcagagcggtggggggtggggcttccagcccctggcatctcagccctatccttccttcctgcactgtgcttctcacaaacagcaggggcttgtgttactttgagtcgatagcctcattcacgacactctcacagaatagtgcccgtctgtgctcagcacatgcccgtaaaacaggattccccaaacacgtccataggtaactgtaaatcatttagaagaatctaaagtgtgaattttgtaaactgaagctacgtgcatgtatacacgtgtgtgtttgtgtatatcatatatacacattaatgttattattattatttgcaatacccagcatcgcataataggtgggataatgcagatgccactccaagccaaatctcctggccccaccggtcataagcttacctctgtagggaagaaaaggtttctttttggcagtggtttgttgtttgtttgtttgttttgagacagggtcttattctgcggcactggttggaatgcagtggtgcggtcactgaagcctcgacctcctgggctcaagtgatcctcccacctcagcctcccaagtagctggggctacagatacgcaccacaacgcccagttaatttttgtattttttgtacagatggggttttgccatattgcctaggctgatctgtaactcctgagctcaagcgatctgcctacctcagcctcccaaagtgctgggattgcaggcatgggccagtgtgcctggcctctttttcctcaccaattgctaggttcatgactgaggcccctgtaacacaagacagatcaaccaaaaaaaaaaatcatacagatttatttagtataagttttatgtgacacgggagccttccacaaggaaataaagacccaaagaaacagaaaaacgtgtatatttgatgctggtctgatgaagaagtggatggctgtggagaagtatttgacagaggcagtgtgctctcatgctacaagagtgagagagtgaggggagcttttcaaggcctgtttgttcagattcagtgtcttcagagataaggatgctcctctcctacgggtacagagagggcacgctggaatgacagtcttacaattgcttcagagagaaggacgaggaaagctgagacaggcatttctgctcatgctgttttctcaaatgccaacgtgccatatttcagggtaccatgtcccgagccccaccatctcctaggtaggaattcaggattttggtgtttgtcctactagtaatgggaacccaacaggaagggaattccaagtgtgagaattccagccaaagcccagggtattccagggacccctcagtaagctgttgcaacactcggagccaggagatgctggtggccggtagggggtggtggccaggaccttagatggatgggccaccctcaggggaggttctgtggtacagggtggtggccaggacctcagatggatgggccaccctcgggggaggttctgtggtacggggtggtggccaggacctcagatggatgggtcaccctcaggggaggttctgtggtacggggtggtggccaggacctcagatggatgggccaccctcgggggaggttctgtggtacggggtggtgcccaggacctccgatggatgggccaccctcaggggaggttctgtggtacagggtggtggccaggacctcacatggatgggccaccctcaggggcggttctgtaggccacctcgcgggactccatgacagacgttaagcatggagcctggagaggaggaccccaggtggaggccctggtcccgcctttacgaatgggtagaaagggcttccgtctactgagacaggggtcttgctcaatctcactcacatggatgctccaggaagaaggagcccactcttcccacaaagaaaagaaagatggctgggggtgatggctcacgcctgtaatcccagcacttagggaggccgaggcgggaggatcacctgaggtcaggagtttgagaccagtctgggcaacatggtgaaaccccatctctactaaaaatacaaaaattagccaggcatggtggcgggggcctgtaattctcctgtctcagcctctcaagtagctgggattacacgtgcccaccaccacagcctggctaatttttgtctttttagtagagacagggtttcaccaggttggccaggctgctctcaaactcctgacctcaggtgattcacccgactcggcctccaaaagtgctgggattacgggtgtgagccaccgtgcctggcctaaaatacattttatagcctataagagtgtctcatttcaagcacagaccacaggcctggtatacagtaggtgcttactacagccttgtcgatctgaattctatcagctcttctcaacagttctataaatcaagaacaatgggtgttcaggactctaaacttccatacaaattctctggacatccccttccagcaaggtgctgttcccacccctccagaaaaacattctgtagctcctactgattatgggccatgagaaggagtgggagttttattctgagaaaatagtaagaactgattgcagagttaggcacgggaggcggatgctccgattttcctttgaaaaggatcagggcctttcgaaaagcaattgcggactttcaagggcagacgatctctggtcacggggttgtttgtgcagcggggccttcaggacgagatggatgggacgtgtgggctgcggggcaaggccgagccaggctgacgtcgcggaaagcagagaactgatgaatggaggctggctgtcttccttgagaccgggatcgtattttcaagtgtttgggtggcagaggcgttttagagggagagagagccaagaataaccagtccatgggcagagaaaaaggcaattcctgaaagggagggataacaagctcacacacacagagctgggagtggtgcccagacgcctctcccattcctggacccttagttgtcttttatttatttatctatttatttatttttttgagacagggtcttgctctgttgctcaggctggagtacagtggtgcagtcacagctcactgtagcctctgccgcccaggctcaagcgatcctcccacctcagcctactgagtagctgggaccacggacacatgctgccacacccagttaacttttttgcattttgtcggtagacacatggtctcaccatgttacccagactggtctcaaactcctggactcaaaaatgatcctcctgcctcggcctcacaaagagctggggtacaagtgtgagccacccaccagccctcagttgtcccatccatctcatcctgaaggccccgctgcacaaacaaccctgtgaccagagaacgtctgtccttgaaattccgcagttgcttttcgaaaggccctgatccttttcaaaggaaaatcggagcatccgcctcccgtgcctaactctgcaatcagttcttactattttctcagaataaaactcccactccttctcatggcccataatcagtaggagctacagaatgcttttctggaggggcttggaacagcagccttgctggaaagggacgtccggagaatttgcattagcgcttagagtcctgaacacccgttgttcttgctgtatagaaacgttgagaagagctgatagaattcagatcgacaaggctgtagtaagcacctactgtataccaggtgggaatgtaaaatgatgcaattactgtggaaaacactttgcagttcctaaaaaattaagtggagaatttccatatgacccagcaaccctgcctctgcatagagaccccaaacagttggaagcaaggactcgactcagactgatatgtgtacacccatatccacaacagcatcatttacaagagccaaaaggtgggagcagcccaaatgtccatccatggatgaagagaaacaaaatgtggtttgtacacagcagaatgtacaagctgagcatccctcatcggaaaatctaaaatccgtaatgctccaaagtctgaaaactttttgagtgcagacatgcagctcaacggtcgtgctcaaaggaaatgctcattgaagcattttggattttggattttcagattagggatgctccaccagtaagtataaatgtaaataatctggccagaggccgtggctcacgcctgtaatcccagcactttgggaggccgaggtgggtggatcacttgaggtcaggggttcgagaccagcctggccaacatggagaaaccctgtctctactaaaaatacaaaaattagctgggaatggtggcgcatgcctgtaatcccagctactcaggaggctgaggcaggagaatcacttgaaccagggaggtggtggttgcagtgagccgagatcgcaccactgcactccagcctgggcgacagactgaggccgactccatcccaaaataaataaataaatgtaaataatctgaaacctgaaaaaatctgaaatccaaaacactcctggccctgagcattttaggtaagggatactcaacctgtagttcagctgtaaaaaggaaggaaattctgacacatgctacagcatgggggaaccttgaggacatcatgctaacttaaattacgcagtcacaaaaatacaaagactgtatgatcctagttatatgaggtccctagaggaggcaacttcacagagacagaaagaaggtggcatggtggcagccaggggcttgggggagatgggatggagagttcatgtttgatggatgcagagtttcagttgggaaaacgaaggcgttctggagatggattcactcacccatgtgaatgtatttaaccccacagaactctacactttgaattggttcattttatgttacctatattttaccataatgaaaaaattaaaaataaagatgtacatgaaccactggtgaggtctctgcggggttaatcgtcttcatctccgcttccttgcaggtctgacatcagtagcgcttccatttccactcagcaacatttacctggtttttcatcataaagggcttaggctgttgccatggaaactgcagcaagactgggaaaggggagggggctgcgagggagcaaagagagagcttggagactggaattttccaggctctgagctcacgctgtatgcttcctttgtgataagtcactgagtgaaaatgtgggtctttgtccacaatagcatggtcgctcttcattcctcagtgagactctctcatggaggtgatgaacacacagcagtcagcccagtgccaaatctcctaagagccaggtttctctgtgggtcccctctggattgacacttgcgtatggaccttgggaaagagattctcatttcctcttcttattattttttaacttttattttaggttcaggggtacgtgtgctggtttgttacggaagtatattgtgtgtcgtgggggtttggtgtacagattatttcatcaccaaggtaaagagcatcatacccaacaggtagctttttgatccactccctcctcccatcttccaccgtcaaataggccctggtgtcttttgttcccttctctgtgtccatttgcactcattgtttagccctcacgtataagtgagaacatgtggtatttggttttctgttcctgtgttagttcaataaggataatgacctccagttctatccatgttactgcaaaggacacaatctctttttcatggctgtgtagtattccatagtgtatctatgctacattttctttctccagtccactgttgatgggcatctagattgagtccatgtctttgctattgttgatagtactgtgatgaacatacacgtgcatgtgtctttatgatggaatgatttatattcctttgggtatataccccataatgggattgctgagccaaatggtacttctgttttaagttatttgagaaatctccaaactgttttccacagtggctgaactaatttacattcccaccagcagtgtgtaagtgctcctttttccccccagcctcaccagcatctgttattttttgacttttcaataatagtcattctgactagagtgagaaggtgtgtcattgcggctttgatttgcatctcacaacccctttcagaagtgcttaaagtatatgaacagatattttttcaaaagaagacatgcagatctgggcatggtggctcaggcctgtaatcccagcactctgggaggctaaggcaggctgaggtcaggagttcgagaccagcctggccaacatggtgaaaccccatctctactaaaaatacaaaattagccgggcgtggtggcggacgcctgtaatcctggatactcaggaggctgaggcaggagaatcacttgaacctgggatagggaggttgcagtgaaccgagatcttgccattgcactcaagcctgagcaaaaagagtgaaacttcgtcaaaaaaaaatatatatatatagaagaagaagacacacatatgaccaacaagcacatgaaaaagacatcgttatttaaggcagactctctccaattatttaagtttgaaagtctttacaaaaggagcaaaaccatttctactctcctccttagcatgttgacttctaaaaacaggctttgtgccactgaaacgtgagtcaagtacagttttgggctaattgtttactagctggtttatataacagtaactctaactgtggaccagcaaccacaataacaaaaagcacttgctgggcttaatgactcacacctataatcccagttctttgggaggctgaggcaggcagatcgctggagctccagagtttgagaccagcctgggcaccatggtgaaaccctgtctctacaaaaaaattaaccaggcatggtggcatgcacctgcagtcccagctacttgggaggctgaggtgggaggatggcttgaacccgggagacagaggttgcagtgagctgagattgtgccattgtgctccagtgcaggcaacagagtgagagcgtgtttcaaaaaaacaaaaaggaattatttattcagccagtcacttcatgtatgagttatctattgctgtgtaacaaatcatctgaacttagtggtggaaactacacatattaactgagactctgtgtgtctcatgaggctggagtcaagacctcagctgggcagttcctttcaggggctcagagtcctcctccaagttcaccaggttgttggcagaattcagtcatttaaggctgtaggactgaggtcccacatttttgtcagtagttttttgctgtgtggcctcctcgcaacatggctgttcacttcatcatgtgctgatcattgccttttaaaaaatcatttgtagcttgcacagtggtgcacacctgcagtcccacatacttgggaggatgaggtgggaggagcgcttgagcccaggagctcaaggtttctgtgagctatgatcacacctatgaatagccactgcactgcagcctggccaacatagtgagacctccgtttcaaaatgattacttaaataattaaaaaatcatttgtgactccagctgatttagaaatatgccatctgattcttttcttattgcaataaaatatacataatatccacaattttgaccattttttagtgtacaattcagtggcattaggtacagtcacatcgctgtgcaaccatcaccgccatccatctctagaactgtttcatcttcccaaatggaaattctgtctctgttaaacgctcattcccctttccccctcccccaggtcttggcaaccagctttctactttctctctatgaattcagcaactccaggtacctcgtatcagcagaatcatacgatatttgattttttgtgtgtctggtttatgtcacttggcatagtgtcctcaaggttcctgactgacacaggagcctaatttctggccaatgtccttctccaggggaagatggccgctatcgggtctagagtagacaatggatgaagagaactagaatgacttaagattgatccagatggtgggagatgctcaaagcttttgtgagaacgagaaggaaagcacagggaggaggaatactgtaactgaagctggtgcattctgaaaacaagagtcacaatgtgagcataacaccagccccgccaagtgccctcctgattcatgagtaaaatgcccaacgaagcccaagagctatgaacggaaccatcaatcaaagagacttaatggttttcttggaagcagctcagcatagcgaatgatgttgagacacccatttccaatatattaaaaggtgtcaaatgttcacagtctttttggcagatagtgtctctggaacattctttaacaagctgtctgctaattttaagagcatctgatcttattctcatggtttgaggcatggtggccacggttgggaacggccatcactgtgcctggctcagcaaacaccacctcgggtggtgccgcagctggttctcgcatttcaagtctatgagatcctctctcaccacttgcgtgaaaatagctccctaccccaatcctccacattaatttgggacttaacttttctcaccctctgacagttttttttcctgtttctgtcactagaatgaagcctttcggagggcatgggctcaccggaatcctgtgtgtagcaggatgcctagcacagagtgggaatgctaaatacttgttaaaggagtgaattaatatttggaaggaatgaatgactcttctgattgcctaagtcctggaggagtagagatggtgcccgttttaacttcccttttatcctgcatgcttagaacagcatctgatgcacaactggtgtctgttgactgactcgatgagtgaatgagggaacaagtaatgtctagaccaccggagcctgcagtagagtagtgggtcccggagacgtccacaggacaagtggggccgcttccccgacctcgctcccattccgcaacgctcctttgtatttgaacataaatgaagtaggggcgagggcctgcaggctggagaacctcccctggtcctttcatcccctcctaacccaggctgggttaacgacagcggccccatcttggtccttcctcggggctcttgtttcttagcaacccaggcaaactccatctgttaccatggaaactgcagccgggatgaggaagtggaggtggctgaaaatcagtagacagaacctcagaggatggaatattctggaatcttgtatcagactgagtgtgcacttaaaatttttagcttagaaccgactcgtttctcatttatttttgtgaataaataaaactgtgtgttcttgggcaggtgtttccatctctccgaggcatgagccaccaagcccggcttttttttttttttttttttttttttttttgagatagggtcttgctctgtcacccaggttggagtgcagtggcatgatcagagcttgctgcagcctcagcctcctgggctcaagtgatccttatgcctcagcctcctgagtagctaggactatgggcacacgccaccactcctggctaatttttaaagtttttgttgagatggagtcttgctatgttgctcaggctggtctcaaactcctggcctcaagcaatcttcccgccttggcctccctaagtgctgggttcacaggtgtgagccaccgtgcccagcctacctgggattacaggcatgagccacgatgcccagccgactaattcagtttctgaggaccccaccctcatgatctaatcgtctccaaaggctccacttctaaacaccatcgcacttggggttaagactttgacacatgaattttgggggcacattcagaccatagcaaacccttagctcgggatccgtgcttgatacgtgttaatgattttgaacttcattaagatgaaaataagagaagacgcgatgaaggcagctgtcactggtctcggtgttcactgtcctgggatctgcccagccgaggggcttcattactcatcggagagaaaagtgagtgggggactcccactccttggggctcagttctttattctttcaataaatgcttcatacaggtctactgtgtcagaggtcatggttaagaaccaactccaaagactggaaaattccagtttccggggccctcccggccccttcctcagctccccccacctttccgccctccagctgcagtttccatggtgatagtctgagcctccctctgttgctaagggcagataaacggtcaggagagggagcaggtcacataggttgattaatctccctgagagatggtggtgggcatgggaggggaggggaaggaaagagggaaagagacccaaggggctcaagtctgcaaacccccatctatcattcatgcacagcctttgcgtgcctttgaataggggtttgcagaagaagagaaatgtgcctgtggagagaatattttaaatgtattctctgaaccaggcggggtgggtcacgcctgtaatcccagcactttgggaggacgaggcaggtgggtcacctgagatcaggagttcgagaacagcctggccaacatggtgaaaccccatctctactaaaaatacaaaaattagccgggggcggttgtgggcacctgtaatctcagctactagggaggctgaggcaggagaattgcttgaactgggaagcggaggttgcggtgagccaagatcgccccactgcactccagcctgggcaacagagtgagaccctgcctcaaaaaataaataagtaataaataaaatatataaaataaaataaataaaaaataaaatctattctgttagcaatttgaaaacacacaatacattgtgtgaggtgatagctgtgttaattagcttgagttcatcattccacaatgcacacgtatattaaaacatcacatcgtactccataaatatgtacaataagtatttacctattaaaaataattttttgaaaagatctcacatacatacaaacaaaaaaaaaacccatgcatgtgagggtctctgcagagtcagttagaaatcacgtatctcctgcatcttctggcaataacagcattatctatcatcagaattcaagttatctgataaacattgactgagactttctgcaggtcaagcccttgtccgtgggcagaaaataaatgtccggcaaatggggccgagcctgccttcctgcgctctgtttgtgtgggaggtggatccattcattccaaaagttagatcatttatttttaaaagatgttgattttcttctaggaggcaggtatcatgctagacattggggaaacagcaaggagtaagacaggccttgcaagggctgccttgcagcaaaggagacagaaaatgaactcacatatttcacgtattataccatcagaaagtccattaggcctatgaagaaaaatacagcagggaatccaaagatattaacacggcaggactgctttagatgcaggatgctaaggaagtggtgatggctgagcagaaagttgagtgagggagagagtcacattctcaggactctctggggtaggaagagggggacagatgggagtgcaaaggccccgaggcaggaagaggtaaagcaggtgcaaggaattccatggcaaggaattctttgcacaagaacttaaaacagaactaccattccacccagcaatcccattgttgggcatatatccaaaggaatacgaattgtcctaccataaagacacacgcgtgtatatgtccatcacagtattgttcacaatagcaaagacgtggagtcaacctaggggcccatcagtggtggactggataaagaaaatatggtacctgtgcaccatggaatactatgcagctataaaaaagaatgaaatcatggccttttgcagcaacgtggatggtgctggaggccattatcccaagcaaattaacaggaacagaaaatcaaacaccacatgttctcacttttaagtgggaactaaacattgggtactcatggacataaagattagaaaaatagacactgtagactactagagggaggagggagggggtaaggattgaaaaactatctattaggtactacgctcagtgcctgagtgacaggttcagtcataccccaactctcagcatcatgcaatatatgcatgtaatagacctgcacatacttgtttttctgatttcaccagtttttttcctcgaggtatcattctatgaaagtgtatctcattcatgtgactatcatcatatccgaatacagaactgttctatagccacatatacaaacaaaaaataaaaacaggccgggtgcggtggctcaaacccgtaaccccagcactttgggaggccgaggtgggtggatcacccgaggtcgggagatcgagaccagcctggccaacatagtgaaactttgtctctactaaaaatataaaaaattagccgggtggggtggcggcgggcgcctgtagtcccagctactcgggaggctgaggcaggagaatggcgtgaacccaggaggtggagcttgcagtgagccgagattgcgccactgcactccagcctgggcaacagagcgagactctgtctcaaaaaatatataataaaataataaataaataaataaataaataaataaataaataaataaaaaggagagagaaaaatggattagtgcccttataaagacagcctagacagaaaatccgtttctctaccatgttaggatgcagtatgaggatgatgatgacctgcaaaccaggaagaggcctcaccagaaacagaccatgctggcatcctgatctcagaattccagcctcccaaactgtgaggagtaaacttctgttgttgataagccatccagtcagtggcattttgttatggcagcagcccaaacagactaagagctttcatggattttctcaattagtcattccaccaaccctatggcgtatgctataattatctccatttaacggatgaggaaactgaggcttggtcgggaggtccaaggtcagacagcttgagaacggcagctcctggagtcagatccaggatggtggcatccgaggcagaggatgagaactggaggtcacggggagagcttctgtggattctggatgggagagaggagcggtgacagtctgtgctgcagggcgagccttgcctgacctcccttggatgcctcaatctgcttctgcctgctgcttgctctctcatttcatcctctataaaataggatgcagcagcaacaccactttttttttctttttttagacagggtcttgctctgtcgctcaggcaggggtgcagtggcacgatctctgctcagctgcaacctccgcttcctgggctcaagtggtcctcctggctcatcctcctgagtagctgggactacaggtgtgcaccaccacaccacaccacaccagcctaatcttttttttttttttttgactcagggtttcacctttgttgcctacgttggtctcaaactcccaggctcaagcatttcgccaaccttggcctcccaaaatgctgggattacaggcatgagctaccacccctggccagtgataccacttctgtacagaagtgtatttcttgcaaaatttacagaagtatatttgttgcaaggtttgcaaaagtgtattacagaagcgtatttgttgcaaagtgtgcagaagtgtattcatcgcgaggggttacaggagtgcatttgtttcctagcactgctgtgatgaagtactacagactggatggtttaaagcaacagaaatgtattctctcatcgttctggaggccagaagtctgaaatcaagttgttggcagggctggttcctcctgaggactttgagggagactcttttcgtttcttgctttttccctagcttttggcggtttgctggcttgtagatacatcatcccaatcccccatctttacagtgtgcctgcgttcacctggctgtcttctcctaaaggcatctgtcctgtgggatcagggacccagcctactacaggaggacctcattgtaactaattgtatcagcagtgaccctgttttcacattctaaggtactagtggtcaggacttcaacatatgtttttgtgggatatgaaatccaacccataacgaggaggtagagtgtgtgccagtgttcatcactgtttgcagcacatataatagtaaactctccatgaaagctctatactaggctcagaagggccctgaggacaccacgattatacacattcatttgtttttattttgtagttctgatgaaggagctggacacccttgccccagcctccagtgccatctgcccagacggaaggatgggaagagtgtagacatgaaagttgagtctcagaaaaggtagaacccaggctgggagtggtggctcactcccctgtaatcccagcactttgggaggccgaggtgggcggatcacctgaggtcaggagttcaagaccagcctggccaacatggtgaaaccccatctctactaaaaacacaaaaattaaacagacatggtggtgggtgcctctagtcccagctacttgggaggctgaggcaggagaatcacttgaactgggaggcggaggttgcagtgagctgagatctcaccactgcactccaggctgggtgacagagcaagactctatctcaaaaaaaggaaaggaaaggaagaaagaaagagaaagagagagagaaagaaagagaaaagaaggaaggaaggaaggaaaagaagaaagaaggaaagaaagaaagaaagagagagaacccaggtgaggcacaggacatgtgtggtgaccaggcttgcccagcagtgtcctaatcccccacccagcctttggcacacagggcctttaacagagggattggaggtatgaagtgggaacaggaccccaaggtggggccgttgtaattggctatgaaaaggcaatgggtggtgacggcgggactggagagaaggggaatgattgagaggttcatggggagagggtggatgcaaaagtggaatcattgagaggttcatgggaagcaggtggacgtagaagagatagaatcgatggtggtattatgggttacagtgtatcccccaaagagaggttggcatcctatcccctggtacctgtgaatgtgacctccgttgaaaataaggtcttggctgggagcagtggctcacgcctgtaatcccagcactttgggaggccgaggcgggcagatcacgaggtcaggagatccagaccatcctggctaacatggtgaaaccccgtctctaccaaaaatacaaaaaaaaaaattagccgggcgtggtggcgggcacctgtagtcccagctactcgggaggctgaggcaggagaatggcaggaacccgggaggtggagcttgcagtgagctgagatcgcgccactgcaccccagcttgagcgacacagcgagactccgtctcaaaaaaaaaaaagaaaaaaaaaaagaaaagaaggtctttacgggaggtagccacattaacatcaagtcagttgggtgggctttcacctgacatgactgatatcctcataagaagaggagaggactcagacacagaaggaagaccatgttagatggaggcagagattggagcgatgtggccacatgccgaggggcactgggaactgccaggtgctagaagatgccagaaaggactctcccttcaagccctcgcaggcagcatagactcgcaacgccttggtttcacagcttgagcttccaggactgtgagagaacaaatgtccattgttttaaggtgcctggtctgtgatgctttgtcatgagagctgcggaaaacgcatgtgggtgggtgtccaggagaaggagtgtaggattctcccaggggacgaagtggtcagagaacaggttacactaggtggcaaagggaattaaggatacaggtgggagtaaggttgctaatcaatagaccttaatatcgggagatgatcctggattatccaggtggaaccattgtcatcacaaaagtttgtttaaaaggcgttaaagaagccagagggatggatgtgagaaggactcagccaaccacgctggccttgaagagggaagctggagccctgagccagggaatgtgagtggggtggtccccacaagctggaaaaggaaaggaggcggattctccccccacaccagagactccagaaggaacgcagctctatggacaccttgatttcatcccagtgagacctgggcgggatttctgacctccaggactgtaggatagtgaaggggtattgtttttagtgtccgagtctgtggcgatttgttccagctgtgacaggaagcccacggcggcgtaagcaatgctgcgtggtttccaagactgggtcagaaatggggtaaaaccacgtccagactgtcctgggaacgttcctttgcagctggggtaagacgtccagctgggcagaagtggccacgcaggaaaggctgtttgggaggaccacccagaggtagagatgctgggtgtccagccatcccagtgcccagtgcccacctcctcccaggtcgggcatgacacgtgggcgcagacgccttcaaaaggactcagccctgagcgtcatcactgaccgcagccactggagagggcatgagcgagaacagaggtagctgagcccagtcacaaccaagaaacagagagagaatagcagatggtgactgttgccttaagccagggtgcgagctgagggctggctgctttttgcaatttaaatttttatttaattttaattttaattgtttttttttttcagacagagttttgctcttgtgtcccaggctagagtgcaatggcacaatctcggctcactgcagcctctgcctcccaggttcaagagagtctcctgccgcagcctcccgagtagctgggattacaggtgcaccccaatatgcttggctaatttttgtatttgtagtagagatggggtttcaccatgttggtcaggctggtctcgaactcctgacctcaggtgatccgcccgtctcggcttccaaaagtgctgggattataggcgtgagccactgcacccagcctaaaattttatttttaattgacaaattgaaaccgaagggttaatctgaccaggtctgccagctccgcttgctttcaggcatttgttttctgttattttttgttcctctttccacaaagctgaaggccatagtagctgaaggccgcaccgctgactgctcagatttaaccttcactggctattggatagataacattcattggtcaccatggtaatggttgcttctgttgttcaggaacctgggaaatctcccatcaagttcaaaccggttgagaccaccagccctccaagtgggcccctgcaaatgcctaagagatggctgggttttttttgttgttgtttttgttttttttttatttttatttcagtagcttttgaggtacaagtggttttttgttacatgcatcaattatatagtggtgaattctgagattttagtgcacctgtcactcaagtcatgtacattgtacctaatatgtagttttttattcctagtaccactcccaccctcttcctcctgagtttcttttctttctttctttcttttttctttctttcttctttctttctttttctttctttcttttcttttctttctttctttctttccttctttctttcctttctttctttctttcttttcttttctttctttttttactgagacagagtctcgctccgtggcccaggctggagtgcagtggcgcaatctcggctcactgcaacttctgcctcccaggttcaagcgattctcctgcctcagcctccagagtagccaggattacaggcacacgccacacgcacggctcattttgtatttttatttttagtagagacggggtttcatcatgttggccaggctggtctcgaactcctgacctcaggtgatccacccaccttggcctcccaaagtgctggggttacaggcgtgagccaccgcgcccggcctcctgagtctctaaagcccattccatcactctatatgcctttgcagactcctagcttagctcccacttacaagagacagtgtgcactttttggttttccatgatgtggggaaagggagtgtgaatacactgctggagagatggccttttgacctaagcggccaaaaactccaccctcagatcatgccagcactgccatttccagtacacgtgtcctataaaatgccatgaagcccgacgatgcttgtgcagtacgcaccagtcacttcattttcgccactgtcaatcacctttccgcaagcctcaggccaatccactcccccaacccatacatctcccaaagactcaccttcagggatgcagatctgagagatgttctcccacctccttccttggtgctcttgcaaataaatcttttctcttttgcaaagcctgtgtcagtgattgatttactgtgtgtgcacagagtggacctggacctgactggtaacagaatgaaacgtgtgtgtgtgtgtgtgtgtgtgtgtgtgtatgtgtggtacaatatgatgttctgatctaggtatacatttggaatggttatatcaagctaattatccatcacctcacctacttaccatttttgtgatgagaacatttaaaatctactcttagcaattttaaaatattcagtacaggccgggtgcggtggctcacgcctgtaatcccagtactttgggaggctgaggtgggcggatcacctgagttcaggagttcaagactagtctggccaatatagtgaaaccctgtctctactaaaaatacaaaaattagccaggcatcgtggcggacacctgtaatcccagctacttgggaggatgaggtatgagaattgcttgaacccaggaggcggaggctgcagtgagccaagatcgtgccactgcactccagcctgggtgacagatcaagactccgtctcaattaaaaaaaaaagaaagaaaaagagatagaaaaaaaaaggttgatcaaagggtacaaagtttcactcagacaggagaagtaagttttagtgatctatcatacagcatagcagctgtagtgaataataacacatcgtgtatttcaaaactagaatagtagattttaaatgttttcgccacaaaaaatgataagtaggtgaagtaatggatacgttaattagcttgatttaatcattccacaatgtatacatatatcaaaacatcacgttgtacccaataaatacatacaattattacacgtcaatttaaacatttaaaaaatctaatctaaaatgctgtggaatatttttccctaacagtaataatcaattggtattactcaaatgtctatattaactatctcgttcatttgttgtttttccgttttttttttttgttgttgttgttgctgtttttgaggccatggatttttttttttttttttttttgagattcgagtctcgctctgtcgcccaggctggagtgcagtggtgcaatctcgcctcactgcaagctccgcctcccgggttcacgccattctcctgcctcagcctcccgagtagctgggaccccaggcgtccgccaccacgcccggctaatttttttttgtatttttagtagagacggggtttcaccgtgttagccaggatggtctcgatctcctgacctcgtgatcctcccgtctcggcctccccaggtgctgggattacaggcgtgagccaccacatccggccgaggccatggatttttaagatgcgtattattcgaggcaccatgataaaagaaaaatgctgtttactaaattatgacaaacgttttaaaatctaaaaaatatgtcagaataaatgagatccattattctcttcctcaaacacctgttgcttctttctttgttccttgtctagaaccttattctgtggtgttggtaacgtctttatttggaaaatccatcccggactcagtgcagggcctgcgggttagcaggaactcacagatcccggactcactgcgtggcctgcggtttagcaggaactcatagataactgccgaatgtgcaaatgcacaagggatgcatttcacttctgaaaaatgtggatcactatgtttacaatgtctggcctcctacctcttttagaaaattttaaaacttaaaaatttaaattaggggccaagcgcggtggctcatgcctgtcatctcagcactttgggaggccaaggcagatggatcacctgaggtcaggagatcaagaccaatctggccagcatggcaaaaccccgtctctactaaaaatacaaaaattagccgggcatggtggcaggcgcctgtaatcccagatactcgggaggctgaggcaggataatcacttgaacccggaaggcagaggttgcagtgaaccgagattgcaccgccgcactccagcctgggtgacagagtgagactgtcacacacaaaaaaaaaaaaaagaaaaaagaaaacaatttaaattaaaaattatattataagcatatcacagaacatcagctggcctggtacttagcaagcatttaagaaacacttgccactattattaatactgttcttgccactttttaaagtcaccagattgagcaaataaaaattcaggctgcccagtaaaattcgaatttcagataaacaacaaatactttttgtgagattgcatagtttactgcccattgccaacatggatgcatagagttgatgcttaaaggtatgcaaaatttttatactaccaatatttacataagtattttgtcaaaagaaacaacaaattcttcaattaatttctgaagagtctacttacacaggcacgaaaacttattttaaatgtcttcagagtataggaatacaacaatttaagaataattttaccacaagagaaggtataaatagatcaaacaattttcttgcacagggtaataacattttaacaatacacaacatttttaaaacaaagattgtcttaagtggcaacccaattatgataattagagagataaatctgtaacaaatatcataaataatttttgaacacagagtgctgattctctttttatcatggttttttttttttacataaaagaaatttctttatattttcccaccattgacaatttatatacttgggaatgagcctgtttaaaaaaacaaaaataaagagtatttgccatgaatcaaatccgagtaacctggaaaaaaatctgaaaacttgtaatcaatatatttttacttttatgattttagactgtggtaaaaaccttatgcattctgcaataggcatcttgcccattactacaagaaatgatccttacatttggataaacacaaaatacccctcgtaatcagttcaaatacagtctaatactatatattatgaaaagtaggaagtatggtaagcaaagctagtacagttctttttcaaacctcaggcaagctgaacaaaagcttttaacctcagagtaatgaaggacaggcatcagtttcataaaatgatagatggctgtgacaagcaaagatttgtgcagtttttttgtttcatttaagaatgtagtgcaatattaaagtttaaagtttgttcaaaatgacagatcatctggaaactaaattgtagcaattgacatcttttagctggaaacacttaggaaaaatcaggtttgcttgtttttagttgaaaatgtcaagatttacagccatggagacattggatgaatctggaggtcagtgtgccctcaggatgtgtctttatgagcaattgttcaagattaaaagaaaatttatgctagaaaattgtgtttttctcggactaaaaatactacatcaggatgggcacagtggctcacgcctgtaatcctagcactttgggaggccaaggcgggcaggtcactttaggtcaggagttcgagaccagcctgaccaacacgttgaaaccccgtctctactaaaaatacaaaaatgagccgggtgtggtagtgcgtgcctgtaatcccatctactggggagtttgaggcaggagaattgcttgaacccagaaggtggaggttgtggtgaactgagatcatgcctctgcacttcaacctggatgacagcgagactccatgtcaaaaaaacaaaaaaacaaaaaaataccacctcagtttataagcttcctgtacaagttggaagaccctgctgggctgtatccctcccctgccccatctgctcctctccctgtctgcattgttcctttgcatcgcattgaagatctcaggccctcccgtaggatggagcaggaaagattcaggctagacatgtccccatcaacccccacccctacccactgaaccctggaactatgagcagaaaccacaccgctccttccccaacagaggtttcctgctgctatgtggccaaaagagagtggggaggaattctcaggacacccagaggtggtacagtccaacctgaccacagggagggaaccccggcccacacctgccctgcccaggtgagtgtgtagaggggcgtgagaaggaggtggtccaagtcctccctgattcaagaaagctctgaatttcccctgcaatgagcttagtagaattcagagacctacctgtgacaacagagactcagagtgctctgagaagctcttcattcattcattcattcatgccattgatatttaccttgctaggcactgggaatacgtgggtaaagacacgtattcctgccctcatggggcttctattccagcagatgagaagccgaccagaacaaaaatcaatcagagtcattgctaatagcagtcactcactacacaccatttgacatgtaaagcaagctgacatgatagtggttgtgggagaggtggggagaatttctctaagaaggtgacatttcagcaaacctttgactatcaagaatgacctatcaggaagaatccaggcctgggaaaatccagagagagcgagacaggggagggaaacggcaaactgccaaggttcagaggtgggaacgagcgtgcacatccaaaggactgggcgaaggctggtgcctctggggagcagggttacgtggggagggtcggggactggagctggagcgattgtttggagcccggtaggcgctatgtgtgtttactgactgtactagagatttttttttttttttgagatggagtttctctcttgttgccccagctggagtgcagtggcatgatctcggctcactgcaacctctgcctcccaggttcaagggattctcctgcctcagcctcccgagtagctgggattacaggcatgcaccaccacgcccggctcattttgtatttttttagtagagataggggtttctccatgttggtcaggctggtctcgaactcccgacctcaggtgatccaccaacctcaagtgatctgctggcctcggcctcccaagtgctgggattacaggcatgagccactgcacccagcccttttttttttctttaatcaagatctctgtcccacaagactcccatgggaacatgggctgtatgaattttccaggggctgacatagcaaagcactgcatgctgagaggcttcaacagcacggatttgttttctcagagttctggaggctggaagttcaaggtcaaggtgtagcagtgttggtttcccctgaggcctccttggctcgtgcacggggtcgtccctctgtgtgtgtctgtgtcctaatctcctcttcttataaggacacacacccgttgaaagagggcccacacttaaatcctcattttaaggtaatcacctctttaaaaatccagccccaaatacaatctcatcctgagatactgagggtcagggcttcaacatatggatttcttttgagggagtaggacacgattcagcccataacaaggacagagctggcttgcgtttgacgatcattgcgttctgcgtaccttgaaccgttcctggcagaaggcaaggactccagcaatacatggagtgggcgggtggagagagcagataatactgatttcagtaccactcagagggcactgtgaccgccaaccgtttgcagaggcgtgcgcaactgtagttctgcagaccttggctcaggacgtgctttagtgtgcccggaagaggcacctgtgtccccggctgaggcacagcaggcctggcctctcaatcctcctctgccatccgtccaccctgtcctcccctagggagcacctacctggtgggaccactgaggcgggctcgggctgtcaccagggaaaccgcagcagggtgcggaaggcgagggggttgaggaatgaaaagaggaagtccccaaaaccagacttggagggtggggactcaaaacttcagcttggcacaagtaggtacttaataaacgtttgttgaaaaaagcaataagtacctttcaaagcattacctgtcccaagtgtgtctggactgaaacaagaacgtcttttgttgcaaagcaaaatgctctgtgaccagctcgtacggatgccaggagaatggggatcttgtttgttctctgccaatagaaatgtattagtgaaagtaagactttaaaacctcagcactaagtggtttcggcattgactgagtgcccagccgctgtttgagccacgtggatgtgctcgttttattcttagagttactgtgtgtgcattctgggaggccagcggggaagtttccagaaattgtaagaaggtaatggcgaaatggatggcttaggaacacaggcaacacctcggctgagtttgaggccacggtccgtggctccggagctcggcgtccagccaggatgctggactgcagaatatgccaaccttcttctagacccatttccagtgttttaaatgctgatagtacacgctacctcctattccctacatgtcctaggtgggtgttcataggcacataccataaaataaaaaataaatatcatgaaattaaaaatcatacaacaaatcataaactaaaaataacattaataataataagacccacgtgcaaagaggggggaaagccttcccgcagggtccttgcgcattgcttcctcccacgtgaccccagacgagccgcctcacttctctgagtctctttccacttctgatgcagacaatgacgccacgcgtcccaccccacagggcggctggaaaaaggaaatgaatccgtgcgtgtggaaacgcttgggatagtggcaacacatgctccttatgacatcgtgtcagagaggtgtttgcacatcaagcttacccaaatcttcactcctgttttcagcagagctgcccaaacctcaagacggtccttccttcccctcctcctcttgcagcccctgcattccatccctgactcttccgcgagctgcagcaggaaggattcaggccatacacatgaaggagcaaggctacccctggggccaaggccacccctcgcccacccccgtctctcccaccccgggtagccgtcactgccgcagagcagggggaacgtgtcccaggtcactgcaccctctgctgtgtagggactggggtcatttctgaccgaacatcttactctagggcctgagattcagtgtcgtgggggactgagtctgaatccttcccgggcagggctcaccagcagaattcagatggaaactgtagagtgctgtcagcaggggtgtgctggagccagcttctactggaggacaggaaccaacgcgtcaactcgcaggaagtttgtgagatgtttaagcacatcgtttagtaaacaggacactccatgcactttcaaaattaaataaatgacgtaagccgggcacggtggctcacgcctgtaatcccagcactttgggaggctgaggtgggcggatcacctgaggtcgggagttcgagaccagcctgaccaaaatggagaaacccccgtctctactaaaaaatacaaaaattagctgggcgtggtggcgcatgtttgtaatcccagctactcgggaggctgaggtaggaagatcgcttgaacctgggaggcggaggttgcggtgagccgagattgcaccattgcactccagcctgggcaacaagagcgaaactccgtctcaaaaaaaaaaaaaaaaaaaaaaaagacgtaaagaacaaaggtaggaaacaccctaaacatacgctttcctagttatttaaatacattttactagcgtctgtgtttgggggtgattgacatccattgtgtctgcagtagatgtgggggctgctgacctcctcccacctccatgcccagcgagcaggccggctcctgcagctgcccatgctggggaggcatttgcaccatggaagctggcaaacaccaccgggcacgccaccccggcctccagagttggctgtccagcattcaccagctccccactggctgcaggaatccaattctttactctttcgggtgtaagtgcttatttaggaagccctccggtaggctggtctgtgctccacgcatcggggtacaacggtgagcagaactgcaaagagcctgtctttctgcatcttccattttgtgagaatgaaaagaaaataaacataaaactcaacccaggaagaagataatttcagaagattctaagtgcaagaaagaaacagagtgaggtgatactaacgggcaaatgttactttcttttttttattattatactttaagttctagggtacatgtgcacaacgtgcaggtttgttacatatatatacatgtgccatgttggtgtgctgcacccattaactcgtcatttacattaggtatatctcctaatgctatccctccccccctccccccacaacaggccccagggtgtgatgttccccttcctgtgtccaagtgttctcattgttcaattcccacctatgagtgagaacatgcgttgtttggttttttgtccttgcaatagtttgctgagaatgatggtttccagcttcatccacgtccctacaaaggacataaattcatcattttttatagctgcatagtattccatggtgtatatgtgccacattttcttaatccagtctatcattgttggacatttgggttggttccaagtctttgctattgtgaatagtgccacaataaacatacatttgcatgtgtctttatagcagcatgatttataatcctttgggtatatacccagtaatgggatggctgggtcaaatggtatttctagttctggatccctgaggaattgccacactgacttccacaatggttgaactagtttacagtcccaccaacagtgtaaaagtgttcctatttctccacatcctctccagcacctgttgtttcctgactttttaatgatcgccattctaactggtgtgagatggtgtctcattgtggttttgatttgcatttctctgatggccagtgatgatgagcattttttcatgtgtcttttggctgcataaatgtcttcttttgagaagtgtctgttcatatccttcacccactttttgatggggtggtttttttttcttgtaaatttgtttgagttctttgtagattctggatattagccctttgtcaataggaagaatcaataacgtgaaaatggccatactgcgcaaatattactttcaaaaggaggtcaggaagacttcctggaggaggcgaatgcacggtagcactcactcccaaagggtcggaagtacccagtaatgggaagatctggggaagaagttgtgggcaggtgcaaagtcaggaagaagcctgaggtgcccagacaacacagcggcacataatgagtggtggggagagagataggaggggaggctgctaggtgctcagcagaggctgcgttacagatggaccctgaagatgggggtgaggagacttgatggcttgatactgtttgatagcactgacagctattggagggtgatgactcaggaacttccctcaccaataagcgtttcttaaaaaaaattactctgactctacaaatatatatgtatatataatttaaccacattttactagcatctatgtttgggggttactgacatctctctatctatctatttatctatatatttggaggatcagagtaatttttaaaagaagtgtctatatataatgtatgtagaaataatatataaataaatacctatataaagtaattatatatttttatatttttatttatatatttcacttaaaatatacatttttaaatatatatgttttgttttgtttgagagagtcttgctctgtcaccttggctggagtgcagtggcaccatctcggctcactgcaacctccgcctctcaggttcaagagattttcctgcctcagcctaccaagtagctgggattacaggcacctgccaccatgcccagctattttttttttttttttttttttgtattttagtagaggcagggtttcaccatgttggccaggctgttctcgaactcctgacctcaggtgatccacccacctcagcttcccaaagtgctgggattacaggtgtaagccgctgcacccagctgaacccacctttggaacttagtgagtgtctcgccctaagtgcctgtcagctggggcacttcctctgtgccctacaaatgttcctcaaactgaaattctttagaacaatgcaggaagaatcccatgcaatggcataaagcactgtaaactatttcacttttattactccggaaatttatattgctttttattttccgtaacctgaagatatatgtgctagttccttggggctgggacattaagataagttgtgtggtccttccttccaacacagctaccaccctgggctcctcctctgggcacactgtgggcgcctgctgctcgcaaactgtgataaggaaggagctgttttttctaagatcactgggatccattaagggctccgcaggagaaagacagaacttctctttaggatgatgaaagatgagggtgtcacaggtggtgactcaaacaacaattgagaggcaaaggggtctgaacccatctgcaaataaatatcatttgaatgaatgaacgagtgtatccaggggtgaagcgggaacagaagtcatggtgaaccactgacaggaggaccgtggtgggaacccttcctgcgctatgaaggcagagttgaggtgctgtagcctagactgtagggaatcccttttgccacatcaggtgacacccactggttctagatactaagatgtggatatcactgggggaccatcattcagcccaccacagatggatgagtagagaggttaatggatggaaggatggtaggtgaaaggatggatagtagagtagatggatgaatagtaaggtggatgattggatggaagagtgaatggatagatgggtatacagattgatgggtggtgggtggatgattcctgtgatccctgcctcgcttctcagctaagctactctgatgtccatcactctgacctgtcccccgacagacactctcacttggtacagacctcagaagcaggctctggtggtcaccatggaaatgcgattggatgaggaaggtaagttgctgaggagtgggcagagagactctcagatgctggaaatttccagactctggagtgaaattaaggtgtgtaaaagggactataggggaggggcaagagtgagaccacggaggaggatgttgcaatcgtccaggaatcatggtggtggaggtcactaaggttgtgcagcagacactgaaagaaaaagaaaatggctcctgacaaaggagggggaaatagcaggaacagataggaaaggcatttctgactggagaccttatacacactacaaaaccacaaacatacctttaaatactgggcacagtgtctcacacctccaatccctgcactttaggaggccagggaaggaggatcgcttgaagcaggagtttgataccagcctagactacaaagtgagatcccatttctacaaaaataaaaattagctgggctcagccgagtggggtggcacatgcctgtagtcccagctactcaggaggctgaggcgggaggctcgcttgagcctaggagttgggggctgcaatgagctatgattttgccactgcactccagcctgggcaacagagtgaggccctgtctcaaaaatacacacacacacgcacacacacacacacacacacttaaaaaacaaaaggttgaaaatgaaacacatagtgaaataaaagttctgatagtatcttcccaattgctccacctcactttagagtcaggtgagggaggatggtggcggaggctgcaacacagtggctgagacatcgctctcagcgtgtcaccgtgaggtctcccagggagggtgtggagaaaacagtgcccaggacagagcctgagaaacctcaccgggaagatggagcataacaaggaaagcattactcaaccattctgtgtcactgaagtgtgtacacaattagcccatctgttgctcaccctcctcattcaccaacccctattccaagaaatttaaatgcccaaaataggacttcccaccagtgggaggtgttggcagccaacacagaggagcagctccagaatccagggagtttgtttgaaataaaactgacctataacaaagagagacaagtatctcttcaatccctaccatccctccacctacccacccatccatccacccatccatgtatccacacttccatctaatgcacacaactatccaactgtccatccattcagccacccatgcaacaacccacctaatgcattaattctgtcattcttccaattatcaccacccacccatcacttcatacacccatccacccaccacccatccatccacatacccccatccatccatgcttccatccaatcatgcaccctacacctgtccccccacccatcacttcatacacccatccacccaccacccatccatccacatatccccatccatccacccaccacccatccatccacatacccccatccattcacccttccatccaatcatccaccctacacctatccatccacccaccacccatccatccacatacccccatccattcacccttccatccaatcatccaccctacacctatccatccacccatcattccatacatccatctacctacccatcaatctgtatacacatctatccattcacccttccatccaatcatccaccctatacctatccacccacccatcattccatacagccatccacccaccacccatcaatctgtatacacatctatccattcactcttccatacaatcatccaccttactattaatccatctactctactatccatacttccacccaccatccttccatccattaacctatctactcatccatctgtggtgagctgaatgatgaccccccacgtcttagtttccagaatctgtgagtgtcacctgatgtggcaaaagggattccccgcagtctaggttacagcaactcaactctgcctttatagcacaaaagtggtcctagacaaaacacaaatgatggatgtgtctatgttccagcacaactgtattgtacaaaagcaggcaggccatagtttggcaatcagccatcttgttctgaatgatcaggcccctacttcactttccgacaaatctctatccactttttcccttgctctctccaccgtagccacactggcttcctcgatggtcctcaggctgggcagtcatcagcctcatggcttttcaagacatacattcttctgtctggactgtttttcttcttgatattcccataattgttccctccctccattgagattcaaatatcaccacctccaagaaggcatccttgactcccaatctaaaacaccccacccctgctctttgaatctgacttattgttcctgataacactcgccaccacctgaaatcttacctatgttcccatgtatcacccctgctagaatactcatgtcccagcatgtgaatacatctgttgcgttctctgctgcacccaccacgcttggccagggtataccactaagtatgcgcccagtaaataccagctgaaagacaggatggatggatgcgtaaatgagggcatgaacagctgtctgtcctaagagtccccggctccttttttcacattatttcactctccgtgtctaaagcagtgtctggagggatgggggggctcgatgaatatgtctgactgaataaggacgtgaaatgctgctgcttagaagatatttgggatttctgtccacatccacagtggcccctgaagccatttttctacgttttgcggagacgctgctgctgctgacgcatttcgatgtgtgcaaaatacgcacatgaacagccgatacggacacttttgatgtccgtccctctgccctgttccctgctcactcggtgctcccaaccttctagcgaatggtgcaggagctcaggttgttgccatggaaaccccagctggaatgggggaggcaagtgcgtggggaaggtgtcgagagatccgcagaggatggaattttccagactctgcagtaagatgtgagctccacattgaaggcctggaccaatcgtctggcctcacccacatctctactgacctcaggactctctgtgtccgtagcccctttgggtctcctcatactctttggcagtctggagttccgggtctatttctcctgtgagtcctttagaaaggctgtctgctccttgcatctctctcttgctctctcgctctctctcttccctctctctttcctctctcctcttcttcttcttcttcttcctcctcctcctcctcctcctcctcctcctcctcctcctcctcctcctcctcctcttcttcttcttcttcttcttcttcttcttcttcttcttcttcttcttcttcttcttcttcttcttcttcttcttcttcttcttcttctcgatctcagctcactgcaaccttcacctcccaggttcaagcaattctcctgcctcggcctcccgagtagctgggattacaggcgcccaccaccatgcctagctaacttctttgtatttttagtagagatggggtttcaccatattggccaggctgctctcgaactcctgacctcaggtaatccacccaaagtgcaccctcgccctcccaaagtgctgggattacaggtgtgagccactgcgcctggccctcctttcttctttctctctctcttttcctcctctctctcctctctctctctttctgttctcttgcctctctctctctctttcctctcccctcttctttctctctctcttccctcctctctcctctctctctttctcttctcttctctctctctctctcttattcccctctctgctctcactctctctctcacacactccctcgggcaaaataacaaccctggatcactccagttcccactgccccagatcctcatttttgtttcagctcttattgtcagtccagggggtccatgctcaggtttgttaagtgggtatattacataactcttaggtttgaggtataaatggccatcagcactgtacccaataggtggcttttcacctcctgccccctccgtccctctcccctctagaagtccccggtgtttattggtcccatgtttatgtccgtgagtacccaatatttagctcccgctcataagagagaacatgttgtatttggtgttctcttcctgtgttacttcgctgaggacagtgggcagccttgtgcttttagccataatcagcaacttgattggaatgaatttccagctgggtcccttgtcataggagggctcgtggtaccttctgggaaacattcctgcatgcctgtctgttcccatgtctgccaaagttgagtccactccgtgatcttaaaaattatgtattatgtttagtttaataaacagtattatagcacttactctgtaccattcagtcactgaggctcatttgaggtatgttctaatattatctcaattttcgtatgaggaaatggaaggacaggaatggcagtaagttgtgcaccttcacccagctggtcagcagcagatctggggttcaatgtcaggcagcaatcccccatagtctgtgctttaaaaagaccagggctgtgcccttgcttgacacatctctgagggtggcccatgctctgatgtccgttttagagatgaggcagctgaggtaccagcctatgaccttagaaacgagttagtcattctctgactctatttcactcaactattttagtaataacattttcaacagagtcttcaaggagggttagctagttatttgtaaattgcatgctactgcagcaatgtgacacacacacgcgtgcgcataagaaatacatcatttttaaagacaaaatttaaaaaatagaaataattttctcacaatgtcccacttaggaccccattgggccaggcaagagggagtggtggcttaaaacagggtggtgacaatggagattggggaactagggatgatttgaaacatgtgggtgagagctaacctgtgcaaaatgtatcttgggattcttgacctgtgggtgatggactgggtttgctggcaattcgatcagctctgacttgcactgtctgtactggatgctgtcccacgggagcagtggatgggtggatatctgtttctggagctcatgagggagtctgggctggggatggagatttggggacccattgacacagggggtcattggagatcagatcacagtgttgtgcattgcacaactccagggggcaccatccaggggcaccatccacggggcacaactccaggtggcaccatccagggaataccatctgggggcaccatccaggggataccatccagggggcaccatccaggggataccatccaggaggtaccatccaggggacaccatccgggacaccatccagggggcaccatccagggaataccctccaggggataccatccagggggcaccatccaggggataccatccaagggataccatccagggggcaccatccagagggcaccatccaggggataccatccagggggtaccttccaggggataccatccagggggcaccatccagggggcaccatccttgcggatgacgctatgagtaggacctcaccaagattgccctgggagtgcacggggagaaagaggagcattcaggacttgattaactaatcagaaagacgagaattgatgatgaaaatatcactcaacctcccccaggtcttgggagcccaccccttgcatgagtgtgccctggatgtggaacacggagtcaaataagattattttggagctttaagatttagtgactgccctactgggttttggatttgcatggggcctgtggcccctttcttttggccaatgtctcccttttggaatgggaatatttacccaagacttgtacccccattgtatcttagaagtaactaacttgaaggctaataggtggaaggaacttgccttttctcagatgagacttgggactctggccttctgagtgaatgagttaagactttggggacttttgggaaggcatgattgtatcttgcagtgtaagaaggacatgagatttggggggccaggggaagaatgaaatggcttggatctgtgtccccaccaaatctcatgtcaaattgtcatccccagtattggaggtggggcctggcgggaggtgactggatcatgaggatggatttctcacggagggtttaacacaatccccttgggctgttctcacggaagtgagttctcacaagatctggtcgtttaaaagtgtgtagccctccccaccctctcattcctgctctggccatgtgatgtgcctgttcctgcttcaccttccaccatgattgtaagcgtcctgaggcctccccagaagctgagcagatgccagcaccatgttttctgcacggcctgcagaactgtgagccaattaaactttttttctttataaattacccagtctccagtatttcctctttttttttttttttttttttttttacggaatttcactcttgttgcccagcctggagtgcaatagtgtgatctcagctcaccacagcctccacctcccaggttcaagcgattctcctgcctcagcctcctgagtagctgagattacaggcatgtgccaccacgcccagctaattttgtatttttagtagagatggggtttctccatgttggtcaggctggtcttgagctcctgacctcaggtgatccacccgcgtcggcctcccaaagtgctgggattacaggcatgagccaccgtgcctggcctcaggtatttctttatagcaatttgagaatggactaatacacaacctcacaagtgttttcatacaaaaaggaggccatcttttgtaaaatgtccatcccagaaaataaccatcgattatccttgtagattcactgttacttccaaatatctgtgtgtgtatgtgtgtatgtgtatatgtgtgcgtatcccaaagtcatgatattcacatgggggtggtgtagacagaaaacagggactactagaattcaaaattaaccctaatccttggagaagaaaaaaggtgtctattctatttgtagtattcatccaaccaaccatgtaaacatttatttacacatccacacatctattcaccccacgttgatccatctgcccacccacccatccttccacatagtcacccatccatgaatccattcaaccacccatcaattgatccatccacccatctattcatccagcaaagaaagaaaatatatctccaagaaaaaaattgtgagctccgtaatgatacatttattcatgtatttattcactaaatgtaagctgaaagtcactttccagcccctctctgaattcgcctccacccattctcttccttgctcactcctcttcagacactgtggcctcctgtgctgttcaaacggacaaaaatcttcatctccaggtgtttccaggctctgttccctctgcccagaatggttacttccctggtaatccaaagtttcccgccctcccttcactcaggttgactcaaataccgccacctccaggaagacctccttgaccggctgctctgaaagatccctccttcactccacatctcacctgcttacgctttgtagaacttaccacgatctgttattttaagttaaacttattgactgataaacccccaaagataaaggattcataagaggagagttgtcttggcttcaaccctatccatcacatttaactcagtgctgacccatagtgggatgtcaggaaatatctgcagaatatacatacatacacttttttttctttttgtttttctttttgagacagagtatcaccctgccacccaggctggagtgccatggcatgatttaggctcactgcaacctccacctcccgggtacaagtgattctcctgcctcagcctctgagtagctgtaattacaggcgcccacaaccacgtgctgctaattttcgtatttttagtagagatggggtttcaccatgttggccaggctggtctcgaactccagacctcaggtgatccacccacctcggcctcccaaagtgctgggattacaggcgtgagccactgcgccccgcccacatatacttttgaatgaagaaaggaatgaatgaataatctacctgagcacagagattgggcatttatttatttatatttattctatggttttgtttcccagatgcagatggagcgtgtaaaacagaaagtggctccatgcaggctgctaggtctgctcacctatctcatgatctacacgcacacacagcgcatacggactgagtcagtgcacgctagaacataaactgcttctgttgctggtgctcagaatagattcatgattttactctgagtcagtgaaggctctcgcagccgctggtaaatttgtttttctccttcttcaaagatgggtagcaatgacgcacttcagcgcgcacaagatccgcagtcgcacggctgaggttgagacggcgccaggcaggccgcgtccccagtgatgcgaatccgaagccccccgaccgctgcccttcccacgcaggaccccgcgatctgcggggacagaggcggcgcaggctgctgccatggaaaccgaagctgggggagggagttgggggatgcagaagggcctgacagccccttagaggcccgaatgtccacccctctgcagtcaggttgtacccagtcaccaatcccagcctggcacacagtaggcctgcaacatagagtggaaagccacagtctgcgccccccatcaccccgggggagggggctccctccagcatcctggagcctggccttccttgaatccgttttccgaaggcgtttctatcccgggccccacgtcgcggggtggcgcaacgtgagccatgtatacaaagcacctcctgggctgctttgtggaaaacaggctgggcaggcagcattgctgagaacagaggctgaggcttctgcggacacccaggaaaaagccagagtgacttggatgccgttgaggatgaggaggatggacagagtgatatgaaaattgtggatggaaatagttatgccgaggcagaaaagagagacatcctggccacgcagcgccagcctgtcctgttttattatttgaattttatttgaacccagaagagcagaagctaatcactactcagccttgagtgccgcgtgctagtcctgccacacagatgatctccatgcatcctcacaactccccacggctgagtgcggcatggtagtcaccaccacagaacgaataaggaaactgagtctgaaagaggtgaaggcaactgccctaaatcagaggactggaaaacacggagctggatttaaccccaaatctgacaccttcagagcataaacgtggtgcacccacatcattcaagcttgaagttgagtcgggtaatccattcaaacagaaagacgcttaaaatattgtggtagcccttggaccacttctcttctctccttccctctcctcccttctgttcccttctcctcccctcctttgtctcttctttccccttctctcctcgtcctctcgtctccctcctcctctcctcatcctctcttctccgtccccttccctcccctctcagcccctcttctccctccccttcttcccctctcatctcttctccctccacctccctcccctctttatcccctcatctccctcctcttccctcccctcatcccccttctccctctgcttccctcctctctcatcccctcatctccctccccttccctcctctcatctcttccccctccacctccctcccctcctcgtcccctcttctccctctccttccctcccctcctcatcccccatctccctccccttctctccccctcatcccccatctccctccccttccctcccctcctcatcccctgttctccctctccttccctcccctcctcatcccccatctccctccccttccctcccctcctcatcccctgttctccctccccttctctcccctctcatccccccatctccccccttccctccctttcatcccctcttatccctccacttccctccctctcacctcctcttctccctccccttccctccctctgatcccctcttatccctccacttccctccctctcatcccctcttctccctccccttccctccgtctcatctcctcttctccttcctcttccctccctctcatcccctcttctccctccccttccctccatctcatctcctcttctacatccacactccttggtgctgttatccaatctcacaggtttaaatggagtccatacactgatgactctaaaatctgtacctgcagagtcctgacactcacctgaatccactgcctccccttcccagtcctgactcacctgaatcttctccctccccttcccagtcctgacactcacctgaatccaccacctccccttcccagtcctgacactcacctgaatcttctcactcacctgaatcttctccctccccttcccagtcctgacactcacctgaatcttctccctccccttcccagtcctgacgctcacctgaatcttctccctccccttcccagtcctgacactcacctgaatccaccacctccccttcccagccctgacactcacctgaatctgctgcctccccttcccgagcatctcatagctttcccaaactcaactaatattccctgagtttgtatatgcaccaagcactcttctaattgttttacagttgttaacatatttaattccttcaacagctgtaacgcccattttacagatgagaaatctacggcccaatttaccaaaggaactcactagaggaaacagtgagtgggagactccagtttacatggagctcctccatgatgcctggtctcagccttccgtgtgccacctccctcgttccagggtccttatgaggctccgttgtcctctgggcctttgcacatattgttcccctgccttgaacactgttccctgagcttgattccaggctcttcatcatcaacctgccccactgagggcaagttagtaaactcccagaaactctgtgtttcatcagtcattgatgttgggcatcttaggacatacctcataagggtattgtgaaaactaattacaacaatatgctggccgggcacagtggctcacacctgtaatcccagcattttgggaggccaaggtgagtggatccttttcttgttaaattgatagctagattgattgatagattgatgacagacggatggaagatggatgggtcgatgggtacatggcagaatagtcaggtggatgtgtggatgaatggactgggtgagtggaaggatgggttgatgggtggataaatggatgtgtttgtggatgaatagatggtcggatgtatacatggacatgtggttggatgaatgtttggttgagtggatgccacacataaacacttttcttttccaagggtgagttttgagttctagaagttccctttgttttctgtctacgttaaccacatgtgaatttcatgacattgggacacacacatccccactcagaaataaagtagcaggggatgaatgaggaaaatggaaagatggcctcctgtttccctgctaacacctgtggggttgaatgaggttttcatcatcaatttccatcttcctgattcatgagtcaagtctctcttcctacaccctcctgactatctcggtgagatttgcattcacgatgtcatacgcaaggatggtgcttctttgagttcatctggaccagagacatctgtacagtagctggtatgctcatctctgcctacacttttttatttcatgagacagggttttgctccatcaccctgggaagaggctggagtgcagtggcatgatctcggctcactgcagctttgacctcctggggtcaagcaattctcccacctcagcctccctagtagttgtgactacaggcatgcactaccatgcctgactaatttatatatatatataaaaaatacacatattatatatataatatacatatataaaatatacatattatatataatatacatatataaaatacacatattatatatataatatacatacacatattatatatatataatatacatatacatattatatatatatttgtttgtttgtttgttttgagagggcgtctcactctgtcacccaggctagagtgcagaggcgtgatctcggctcactgcagcttcaacctcctgggctcaaacgatcctcccacctcagcctcccgagtagctgggactacaggcatgcactaccatgcctgactaatttatatacatatacatatattatatatatatatatatatatatagagagagagagagagagagagagagagagacagagacagagacagagacagagtctcactctgtcacccactgggctagccctctttctaagcttcggtgtgcacgtgaatcccgtgaatatttattaagtgcacattcggattgagtaggtctgggatggagcctgcaattctgaatttcaggcaggttcttaggggctgccaaggctgctggtcttcagctcacaacgtgtgcagtgagttcatgctctggttgacctttaccaatgtttagttatacccagaaaacatttgtgagctaaatataaatatatacaatacttatagaaaatattaaatatatttagtaatacatttattacatattcaatttagtatataatattattattatatcaatattatacattataacatatatataattatatgaatttagtttatattgcataatataaataatatgtaacattatatatagcataatatatattatgtatcatcatatgtgttatataagatatatcatttgacatatgtattatatataatatattatataaaattatatataataatcatatgtgattctataataatttaatacatttaatatacaatatacaataatttaatatataatacatatttaatcctatatttatatatttagtaactatattatatatatttaataatataaaatagtatttatataattcatatgtatagtacatgttaataaatatgcatgtttataaatgaataataaatatacttgtttataaatcatacaaaccactgtaatgtataatataaaacaagcacaaaatgtaagaattttaaaagacatgacaacataacacatagaaactgaacttgtaatggtatcattcccacctcagacatcaccattgtaaacgggagatgtagcttagaactgagggaagaaacggaagtaaagagaacaggaaaatatagaaagttatctaatctgttgagggtctcctgaagatacatttctgagaccaacttgatttgctgatcaactagacgggtgacaaggatgaggttgatttttaacaccactgtacctgaagctccaggagattgggagccgccacccacgtgtgtaaatgcgccatgggccacacgtccagtccatgtcccttccattcttccttctaaacagcttgctgataaccctgcttttcccacatttccttcctaaattactgcagcaaccccgtccatttcttcagcccctcaaagtgaaatctaaaaagtcctcttcattccgtagctcttcttggggttcctgcagctcaggataaaactcgactcccctacaaggaccaaagcagtggacactctttagtttgaccctgggaggagcttggtcagggaaggccgacagccaatgggacttgtcttgaagctgctctttgcttcaaattcttaataagcagtctttgcaccacttatgagtgtgtgtttgtgtgtgtgtgtgtgtgtgtgtgtgtgtgtgtgtgttctggtcgctccataacaaacaccccaagcttaacaacatgcaacaacaattattttgttatgtttgcagattcataaagtgcaaggtgcagatggcttctttctagtccagtatgtctggggctagaattaggaaggaaggaagtcagttaggaatattcgatggctgggaaaagcccaacatttagaggggtgtaaagtgaggttagaaagtactaacagtgaaagctgtatcattgcctgtcttataaactatggcggtagttctcaagctgggatgctcttatcccccagtggacactggcaacgtctggacacagttttgattgtcactactggggaaaggaatgagttctgggcatctaatgggtggaggccagggatggccttcagtgcagaggacagtccccaccacacacacaacaaagaatcatccacccagctccaaacgtcatgctgtagtttggaattgccttcaacaagcatatctgaaaacaggtttgtatcgtggcaaggaaacgtgaaatgtgctcacataagagccagctgtgcgctgcacccctttacaagcatgtaggacaggaattcattatgtcagacaatgagaagaaaagacagccagccccaggaaattaaagaaaagctggctatcaacagcatctaggggcacaatctgcaaagcagacagctgcaatttgaatgtttggatggttcagaaatggacagttctgcactgctggccatgatgagctgtttccaagagctactcccttcctgagtttcctggagatgcatatatttcctggacctcagctgaaccctgggtttgtctcttggagggaacaatccgtggtgggtcagtgagctgagcttgagtcgcaactggactgtcttgactttctaactgcatcttgttggataccatggacttcatgttgtaacaataagtatctagtcaggcatgtgcaaggtgggagggggctctcccgaccccaccaagaatgtcaggtgaccatcaggtgatggccagggagttgtcacactgcctttctaaaataataactggtcacagccagtgctcggtaaaagcagtttcccaattgataaaaaacacctgaaactggtgattggcagcttcccactaagatatcaagagtcgggcgagtgggctggagcatgcccatgaagagacaaaatggtggagcttaactggtatttgaccttctaggggcattccaccgggaaggggaagagcgcctcaggtgagcgtgcacataactccagtaaacacgctgcatgtgtggcccctcccaagtgctagcaggccaccgagcatgcaggcagctcatgataagaggagaatcaagggaaatgggatgcaagatgctggaagtatgccagcatataaaaccctaagtccacggtcaaccagggcactggtccttcaagttgcccacttgggcctcttccaaaggtactttccttcctttcattttttctgggggggacccacaagtcattttatttaggagaccatctattctgcttttcttttggctactttttttctttatttctaaacaaaaacaaaaaacaggacacatgtgcacagcgtgcaggtttgtcacataggtatacatgtgccatggtggtttgctgcacctgttgacctgtcctctaaattccctcccctcatctctcaccccacaacaggtcctggtgtgtgttgttcccctctctgtgtccacatgttcttaatgttcaactcccacttacgagtgagaacatgcggtgtttggctttctgttcctgtgttagtttgctgaggttgatggcttccagcttcctttccttttattcttgcctttcattctaaagctttttaataaacttccactcctgctctaaaacttgcctcactctcttcttctgccttatgccccacagtcaaattctttcttctgaggaggcaagaattgaggttgctgggcacccataaggattcgcctctggtaacgtattttggtgctgggtcacttggataatttgcattgctaacaatatcagaatgttccctccaactgaatcttctttttcatgcaagactggacacatccattctgtgaggtgtgtttttagagaaaaaattaatccatgatacttgttaaagtggtaaggaacactttcttcaggaccatggagataggtataggggccacagcaatgggatttcacactggggcagagaaactgggcttaactctgaatacagcatgagcaagtgcgaatgtatagcccaagagcagggtaggtgtcagtggatgaaaaattattgagagaaaatcaaggtggtagcctggctgtgttcactgttccatgctcagtgttcaagagatgtacttttctgaatggtgaaaaatggtatctgagtccattaagattgtcagggaattcaggctaagtagcctctcagaatccttgctgaagacaagccaggttggtcagatgttatgtaggggttcacagagggtgaggaacccaatcaggcatcgaggaaagcacaaacctgaggaaatagacacttctgggaactttacaatggcaggagtacctgcaaattggattttctgcagagacacatttgccaggttacaacaaagtcacctgaacagatatacactgctttttaaatatataattcaattttgtgaaggtagggcctcactccatcactcaggctggggtgcagtggcacactcacggctcactgcagcctcaacctcccaggctcaagcagtcctcctgcctcagcctcccaagtagctgggaccacaggcacatgccaccacactcagctaatttttgtttttgtttttgtcgtttttgtagagatagcgtttcaccatgttgtccaggctggtctcaaacccctggctcaagtgatcctcccaccttagcctcccaaattgctgggattataggcatgagtcatagggcttgaccttataattatatatttttagagctgttttaggttcacatcaaaattaagcagaaggtacagagtccccatagctctgtaccacacatgcacagcctcctctatggtcagcatcccctctggagatgtaaatacagactggatgccccaggtgcattggttacagtcgacccacctgcactgacccatcgcccagactccatagttcacatgagggctcttggttttgtacattctgtgggttcagacagatgcatactgacaagcatctaccattgtcgtatcatacaggactgtttcactgccctgaaattcctctgtgctttgcctattcatccatctctcccccgcttacctctggcaaccacagatctttttactgtctccatagttttgccttttccagaatgtcatgtagtgggaatcatactaaactaaacacactctcatgatccagcagtcatgctctttggtatttatccaagggagctgaacacttatttccaaacaaaaaccttcacactgaggactatagcaattttattcataattgcaaagacttggaagcagccaagatgtccttcagtcggtgaatggataaacaaactggtccctccaaatgacagaatattattcaggactaaaaagaaatgagccatcaagccttgaaaagacatggaagagatttaaatccatattgctgagtgaaaaaagctaatcagaaaagtctttatttttttaatggcagcttgatgtcccattggacaggtacaccactacttattttaaaatcccatttggggatgacttttaaaataagactttgagacaattaatggataactaatctctagctatgaaaggtctactgcactgaagaactttattggtgaatgtaagagttcaagaaacaggaaagaaacacacaaagatgctcaacagtcaaagacatgtttattttggagaataaacctgagaggggcttctgacccatttcagtcaggtgcattctctctcttacagattaaaagtatttatgggttcagagcgagagaacctgtcataggcttggaacatttgtgtgtggcggagaagtttattgcggggttggaatgcctctggttggaggtgaggttatctcgtggctgacatctctccagtcagaggggaggttatcttggggctggcatgtctctggtcggggagaggtttatcttatagttggaatgtttctggtcggagatgtcatttgtggtttatggtcatgctgaccttcaccattaggctgatgccctttggatttaggagatttttgatcaaggtgaacttttaaatggtggtgcttgtccaagatggcgatactcctgctctgtcagtgaatattttaaacgtgtgcataatctctcagatagatcaagctggggcaccaagaaagatcaccataggcctctataggatggattttttaatgttcctttcatttagaaacatgtgctcggcttcccctaaaccctctctcaggatattttacttttgttgatgactcaccccactcaccacatctacttagggccatgatattggagagtcagattctataccgtacatttttttaaatggctgtttatccgtggaacacactggaaacacctgcccatgccttgacgtggacttctagcctctacaccaagataataaatttctgttgtttcagccactcagtgtgtggtaatttattttaaggcagccctagcttaaataaagtactcataactcattcataacaccccatttttttcacatttctgccaagactctaattaagaataaataaagctgtgcaaaataagagcgtaacaaaacaatggtttcatcctcattcctagactcccctcccccagcctagcttctcagtctgcctctggggctcccacctgttgtgagacgcaggggagatgtgatgaggggatcccctggtgctgccatggaaaccacaccaggagtaagggagaggcgtggctgggaacaagggagggaaggcctcagagagagctctggaaagtgtctgggtaaggttgccccaaattccatcctagcacacagtatatgctcaataaatatttatggagcaaattaatgaaattaatgaaattctgcaactttttttttttttgaggtggagtcttgctctgtccccaggctggggcacagtggcatgatctgggctcactgcaacttcctcctcccgggttcaagtgattctcctgcctcaaacacctgaggagctgggactacaggtgcccgccaccacacccggctaatttctgtatttttagtagagacgaggtttcaacatgttggccaggctggtctcgaactcctgacctcaagtgatctgcctgcctcggcctcccaaagtgttgggattacaggcgtgagccactgcgtccagcctgaaattttgcaacatttgtctaaagacttcgaacatggatgattgtggttcctaggtcatgggtttacataagattctacttataaaagtacattaaggtggttaaaaatttgttttaaaacctttattaaaatttcttgtcaaataattgttttgtttaataagtgttcaaagttgtgaaaaagcgtgctaacattgttaacagcacagactctggcccctgcaaacagagcctttctcaagcagcttcccccagctcccctctctggctctctttccctttgtctcctcatcttgtttctgtcaccgtcatccgtgtttgaacttacttggcttatttattcattttgtttgttcactggtttttttgttgttctctgggtgaactggtaaactcctgagcactgagaccttgtctgtgtgttcacctcgtgtttccgggacctgaacagtattgggtcattaccgatgctcaacgtacatgttttgaataaatataggatgtgtcaaaggttatttcaaagatgtatatttcctttcactcaacagtatcacttctagaatataccctgcaggtatgcccaaataaatgccaaatatgatatgcatggcgttattttctgtagcttttctagaccagaagaaaagaatggaaatgacttcattgtgcatagaagggtagctggctaaataaaccttagtatcctcacactttggaagattctacacaataaaagagaatgaagttcttaccgtatagatagagaacaatgcccaggatgaattgtcacatggagaaagacaagtgccaaatggtatacaccatcactttgcagaatgtgcatgagagtgtaattatgctcagtagtttatgaataacccattatgcataataacatgggcataatagattgtgcatgataatatttgcataatatattagaacatttttgcatgcatacgtatgtatgtaaaacttcactctggggcaaaacacaagtaattggcattagaaaaattgccactggaggccgggcgcggtggctcacgcctgtaatcccagcactttgggaagccaaggcgggtggatcacaaggtcaggagttcgagaccagcctgaccaacatagtgaaaccccatctctactaaaatacaaaaattagctgggcgtggtggtgcacacctgtagtcccagatactcaggaggctgaggcaggggaattgcttgaacctgagaggtagaggttgcagtgagcctagatcacgccactgcactccagcctgggagacagagcgagataccatctcaaaaaagaaaagaaaagaaaagaaaaattgcgactggaagggagaagtgaaagaacaaagctcagaggtggaagagagaattctttttgttctgcttagcaatttgtactttctttgaaatgaatacatagatttgcaagagtaactaaaaacaactatttatatgatattaagagttctattagtgtgccattttataaatgtcaccataatcattatcgaatgggctagaggttaacatttataagatatgtgcattaaggtgttccaaaatattataacagggactggaaagaaaaaaacattaataaatataagattatttacaagtttaattcatggaaaaaataagcaaacgttggaaagcaaccagtaaacaattggaaatgaaattttaaaaataccaatcacatttatatctaaaaatatgcactatctattgcaaatctaacaaaatatacagaagatgtgtactttaataaagcacacatcattgctaagagaagttaaataagacttaagtaaatagagacacatgtgatgttcatggattaggagacctgacaatgttaggatggccatgaccccagggtattgtaatcccagtcaaattcccagtgccatattttgtagaaattgacccattgattctagagtctatgtggaatgacaaaagatctacaactggccccccaaaaattaggaaaaccaaaagaaagaacaaaattggaggactttatctgatgtcaagattgtataaagctacaataatcaaggcagtgaggtatcagcacatagagaaacatacatcaatagaacagagtccagacacacatccacggtcaattgattcttgacaaagaccatggaacttgacaggaaatggaaagtcttttcaactaagcattctggaacacatatataacttaatttaagatgggattatagacctaaacattgaaaccttccagaaggaactatagaaaaatatcttcatgatgttggaataggcaaatattaggagacaaaaaaagctcaccattaaacagtcagtaaattgaattacattaaaaaaaatttctgttcatcaaaatattctgttaagacatgaatatgcaagccacatggtgggggattatatttacaatacatatgtctgcaaaaggacttataatcagaatatgaaaaaaatgcctacgtcaataataaagggacaattcaattaaaaatgagcaagaaactcgaattggaactttacaaaagaaaatataggccaggcgtggtagctcacacctataatcccagcactttgggaggccaaggcaggcagatcagctgaggtcaggagttcgagaccaccctggccaacatagaaaaaccccatctctactaaaaacacaaaaattagctgggcatggtggcaggtgcctgtactcccagctactcgggaggctgacgcaggagaattgcttgaactcgagaggcagaagttgtagattgtagtgagccgagatcatgccattgcaccccagcctgggcgacagagcaagactccgtctcaaaaaaaaaaaagaaagaaagaaagaaaatatgcaaatggacaataaacacatgcaaagatgtataagctaattagctgacagagaaacgcaaattaaacccaaaataagataacatttcacaattactaggatggttaaaatacaaaagactgaaatactgaatattggtgagaatgtggagcaactggaattctcacacatcacagatgagggtatataatggcgaaatcattgcagacaaacagtctgagtatttctgagaatatcaactgtataaataacctttgactggctcatttcactcctaggtatttgcctcaaagaagtgaaaacctatgtccataaaaagaattataggccaggcgaagtgactcgcacctgtaatcccagtactttggaaggccaaggtgggaggaatgcttgagcccaggagtttaagaccagcctgggcaacatagcaagaccccatctctacaaaaaatacataaattagtcaggtgtggtggtgcacgcctgtagtcccagctactcaggagactgaggtgggacaatcacttagcttgaggaggttgaggctgcagtgagctgtgatcgcactactgcactccagcctgggtgacagagtgagaccctgtctcaaaaaaaaagaaagaaagtttaggtctgggcatagctgtgcagagagatgctagcctaaggcacccaggcctccttttacctggtaaatgcagggaccccataatctgtgcgtttgaaaacctctgcgtgggtcatctcaggactccctgaatgtgtctgtatccctacgtgttgctctcagtcaatccctaaaccttctctgaggatgtttgaagcccccaacctcccttttcaaacaatacaattagctcagggctatgatatttcaggtacaggaagtggcctatgtcatcctaattctgcactggtatgaggaataaatacggtcgttaatccctggaatatcctgaggaaaacgtattcagtttattgagaagaaaatctaatatatgataaagcagctgtttgaaaccgtatgtgattttctcatcaatctctttcctgggttactgagtgggcacgcatgttctttttttcccagtaattgctattttactgtgacattccggtttaagactttgacatttaaatgataaatgtcgtgtctcgaatctcagcacaaaaacacttttctacggaattgctaatagcagtcttcatttgccaattcccaacctgagctgatcctcacacggctacactgttcatgtaatttgagaaatgactcactatccctgagtcgtgattctctgcaaggcacgactctctaaaggtgccacgagacagagactccctccccgtttccaacaaggcgtcttccacaagggaaataaatgttcacctttcttgtctttcaaatgtcaaagaattgttttttcttacggcaaggaactgtccacaggttaaaatttgttatccattttcttattgtgaagtttaaaatacgggtaaaaaatgtgcatgaagttcattggaacaggtgaatacatgacagtaacaacttcctgcgttaggaaagactagggttcccagaacccccaccccttcccatctacaacccccttcctccctctgctgcccccgtccaccccgccagccccctggacataaccactattctgacttttcttttgtttttctttttttcttgacttggagtctcactctgtcactgaggctggagtgcagtggcacaatctcagctccgcctcccaggttcacaccattctcctgcctcagcctcccgagtagctgggatcacaggcacccaccaccacacctggctaattttttgtatttttagtagagatgagatttcactgtgttggccaggctggtctcaaactcctgacctcaggtgatccgcctgcctcgtcctcccaaagtgctgggattacaggtgtgagccaccatgcctggcctattctgacttttctaataatttattttcgggtctttatcccttcactgcctggctaaaccactgtttatttttatttgtaaaatagtaatctttgtatttgttaaaatgttagtaatgctcgctctattttgttttgtttttcactcccccacatctccgtcttccccacattgatagctggttctgtttggttttaaatccccatctactgtggggatttaaggttttttccttaacaattttaattgcggtaaaatacatgtatcataaaacgtaccatttgagggccaggtgttgtggctcacgcctgtaatcctagcactttgggaggccaaggcgggtggatcacctgaggtcaggagttcgagaacagcctggcaaacatgactactaaaccccgtctctactaaaaatacaaaaattagccaggcatgttggtgcgtgcctgtaatcccagctagtcaggaggctgaggcaagagaatcgcttgaaccccgggtgaggcagaggttgcagtgagctgagatcacgccattgcacttcagcctgggcaacaagagcgaaactccgtctcaaaaaaaaaaaaacaaaacaaaaaacaaaaataactgtagcatttgagccatgttaaaatgcagagttgagtagtattagtctattcccattgttgtgcagccatcaccactgtccatttccagaactttccatcatccaaaactgaaactctgtagcccttaaacaactcctcccagcccctggcagcctccattctactgtttgtatgtatgaatttgatgactcaagacacctcgtctaagtggaaccaggcagtatttgtccttctgtgcctggcttatttcactgagcatcatgtccccaaggttcacccaagctgcagcgtgtgtcagagtttccttccttttgaaggctgagtaatattcccccgaatagatggaccacactttgttacccactcccctgtcaatggacctttgggttgcttccgcgtcttccttctgtgaacacgtgactgcccacagcttcattcctaggccatgcaggagtgaacggccgatacagagatattaatcaatatcttcataatgagggcaggaataaaggagaagataagtgaatgatgagaggatgtctcagacacctgcacagctgactagaaaactaagatttctggccaggcatggtggctcacgcttgtaatactagcactttgggagaccaaggagggaggatcacttgagcccaggagtttgaaaccagcttgggcaacacagcaagaccctatctctacaaaaaataaaaaattagccagatgtggtggcacatgcctgtagtcccagctactcaggaggctgaggcaggagggtcacttgagcctggggaggttgaggttgcagtgagccatgatcgtgcccctgcactccagcctgggcgacagagtgagaccctgtctcaaaaaggaaaacgaaaagaaagaaagaaaaagaaatcgatttctgagcctgtagaggctgagcacaatctggtttttcccttccataaagtccttatccacggacgtgatttaacacacataaatcacagtcaccggcagtggataaaaacctcggcctcaagtcctcgtctctgcctttctatccctccagctgggccaatttctggtccattatttcagggctcaatcccagcccctccccagctctcatggccatgggaaattgaggtaagctcagactgctgtcatggaaaccagagtaattgggagaaaaggcagagcgctgaagaatgctgtacaacgttattagtattcgtatatgccagatcttatacaaatatatgaaaatgctatcatttgttgtaaaaaaaattatagttagaaataaatgcacataaagatgctcacacaaacaacaactctggaaggacacacaagaaaattattaattgaggccgcgcgtggtggctcacacctgtaatcccagcattttgggaggttgaagagggtgggtcacctaaggtcaggagttggagaccagcctgaccaacacggtgaaacctggtctctgctaaaaatacaaaattagctgggcgtgatggtgcatgtctgttatcccagctacttgggaggctgaggcaggagaatcgcatgaacccaggaggcagaggttgcaatgagctgagattgcaccattgtactccagcctgggtgatagagcaaggttctgtctcaaaaaaaaaaaaaaaaaaaagtgactacaaggtttgaactaactcaagttagaggcctactttaaaccttcagccaaaaatccgttaaaaatacacaagcagttagtatttataagagcttctactagaaaattcttccaaaagatcttcgcagaggcagaaaacaaataacaattgagagacagggttgtaagggggtgctatggtctgaatgtaagtacctcctcccaccgaattcctctattgcaaccctaacccacaaggtggaggtattaggaggtgggggccccaaggaggtgatcagggcatgagcgccttcgccccccgaccattcgaagatacagtgagaagaggccacctgtgcacctggaaacgggccttcagcagacactgcccctgctggtgccttaaacttgaacttctggcctccagaaccatgagaaatcaatgtctgttgtttataagccactcggtctatggtattttgttgtagcagcctgactgggctaaaacacagggtttaaatactagggcaatgaccgataaacaacaatcacgttcataacaccctgaaaatgaacacttgcaaataacgtgagaaggaacgaattttgctttatcacacgatgaactataacatttcacaagtcaacaaaaacgagaaaagtgcacacagagatgaacgggcgaggcttctcacgaggaatgcagacaggaaaaccttctgtgcttttcccagtaatctgagaaattcatgggaaacgcacacatgaaatccaattttctcctaatggatggacagacagcagaaaggatggagcaattaggcattgccatggaaacctgattgagaaggagaaggggaggagctgagaagaggggccgagagcacccctcaccctcaggctctgcagccagacagtgaagggccagccaggctgcagggtatatgcaggtgtatttgtgggtggataattaaaatgagggacaggccgggtgaggtggctcacacctgtaatccccgcactttgggaggccgaggtgggaggattgcttgaggctgggagtttgagagcagcctgggcaacacagggagatctgtgtctccaaaaataattagccaggtgtggtggtgtgcacctgtggtcccagctactcaggaggctgaggcgagaggattgcttgagcccgggagattgaggctgcagtgagccataactgcacaaatgcactccagcctgggcaacagagtgagaccttgtcaaaaaaaaaaaaaagagcagaggtggcttctcaatttgggagaacaatctcttctacctcgttgggtcactgcgagaactggatgatgtttgtaaagcatgtggcccgtttctggcgtgcatgtgctgggatttccacagggacaggtagaggtgcagctaggagaatccccaggatgtgggggaagctgggcagagcacagatccctggggtttaccccagttgaatgaagatctcttgattggaaaactgcacttcctctcacaatatgacagaggtccgtgttagcctgctatatttatttgtgtgtatttgtgtcctttttttttttactatttattatttgctgaaatattctttttatttattattattattattattattattattattattattttgagacagagtctaactcttgtcacccaggctggagtgcagtggtacaatcttggctcactgcaacctccgcctcctgggttcaagcgattctcctgcctcagcctctagagtagctgggattacaggtgcccaccaccacgcccagctaattttgtattttagtagagatggggtttcatcgtgttggccaggctagtctggaactcctgacctcaggtgatccaccccccttggcctcccaaagtgctgggattacaggcatgagccaccacacgtggcctattctttttaaaaacaattttttgttctcctggtaactgtggttctccattcatcccagtgtgttccctgaaagcagagatccttctccaaattcatgttgaagtcctaaaccccagtacctcagaatgagattgtattttgagatgggcctttacagaggtaattaaggttaaatgatattatcagggtaggccctaatccaatatggctggtgtccttatagaagaggagattaggacacagacacacacagggggatgaccacgtgaggagaggagggaagacggccaaatacgagccaagcagagacaccttagcagaaaccaaccctgcccacaccttgatgttgacctgcagcctccagaactgtgaaaattttctgttacatgagccacccagtctgtggtactttattatggctgccagagcagactaagacagtcacccatttaaggggaaaaaaaaggaagttcaggttgaagaaacaggaaacattctgaaaacatgcatataatcaacaagaaaacaaagaattatttagcatattagaaatggaaaaaaagtccgggcgcgatggctcatgcaggtaatcccagcacttcgggaggctgaggcaggcagatcacctgaggtcaggagttcgagaccagcctggccaatatggtgcatccccgtctagaatatgaagcaggcagaagaacgtgaaaaactagactggcttagcctcccagcccacatctttctcccatgctggatgctccctgccattaaacatcagactccaagttcttcagttttgggactcggactggctctccttgctcctcagcttgcagatggcctattgtgggaccttgtgatcatgtgagttaatatttaataaactccctaatatatcctatcagttctgtccctctagagaacactgactaatacacccagacttgcagaatcaccctcaccttcaacaccagcattctggcctgggggctggacatgcaggctggcctgttcctttgcaatcatcccagcatcacagaggccactgtggctgcatggacctatcactcctgacctgttgttactccctctcctcatcttccctgtcctgccccttgagacggctccacttcctgaactccccaaatccaacttccacattccatcttcattgctaacaccctggaccagggcactgagatctctaccctacaagaccacggcaccctcctcatggggctccccacctccacaccaggccctgggtcctccaccttcccaacaggagccagagggagagctttaagtcataaaacagatgatgttgcctctccttgccattcggacttacaactttccagtggcctccaatgaacctacaatgaaatccaaaatccccagcataagagtatgtaggagaaggaatttgaaaacatctagaaaaatcgcatgcacatgttccctctggcccagaggtgattggtcaatacttatctaaactgcaaacacacataaccttgaattaaatactgcaattaaattctcagagttcatccagaagtcagagcaagattcgccaacataacatctgtgtaataagactgttcagtgtaccagactattattattattgtaacagaaactcatcaggaaacgtgtccatgaaattgtcagaaatctgcaaatgcaatgttctatggacataaataaggatgtgtaatgtctttgtgtattgatgatataaggtcgtcaccaagatgtggcgttaagtgataaaagcgaagtagcacacgatgcaatcctgggtttcttgctgtgtttttaaaagaggagaagggagtaaggctaagggtatatgctggtgctgatatatgtacataacagctctgcaaggaaacagaactggaaattggatttgtcgctagacttttgtgcagacttttcttctaaagaacctagtactcaactcagccattgtgagggcaaaagcagtcacagacaattcataatgaatgtgcttgactgtgcccaataaaactttatttacaaagatctgtagagccagatgtggcctgtggaaaggatagttttctgatccctggtccagagaatgaaaactcgggatggggaggatagatgaggatcaaaatggaaaaagaaatgtatcatcccaaaatcaatgtacaaaaatgagtagcatttctatgcaccagtaacattctagatgagagctaaatcaagaacacaatcccatttaccatggccacaccaaaaaaaaaaaatacctataagtatttctaaccaaggaggtgaaagacctctacaaaaacctctacaaaaaaaacaaaacagtgctgaaagaaatcagtgataacacaagtaaatggaaaaccattccatgcccatggttaggaagaatcaatattttttaagtggccatacttctcaaaacaattttacagattcaacgctgttcccaccaaactatcaacatcatttttcgcataattagaaaaaactattttaaaattcatatggaaccaaaaaagagcctgaatagccaaaacgatctgaagcaaaaagaacatagctggaggcatcgcattacccaactttaaactatactacaagattagagtaaccaaaacaccatggtactggtacaaaaatagacacatagaccacaggacagaatagagagcatggaaataaatctacacacctacagccatctgctcttcgacaaagtcgacagaaatgagcaatgagaaaaggacttcttattcagtaaatggtgctgggataactggctagccatatacagaagattgaaacaagacacctacctatcaccatatacaaaaactaactccagatggattcaaggcttaaatgtaaaatctcaaaccataaaaaatcctaaaaggaaataccattcttgatattggcctcagcgaagaatttacagctaagtcctcaaaagcaattgcaacaaaaaaacaaactgacaagtggacctaattaaactgaaaagcttctgcacaacaagagaaactatcaaggcagtaaacagacaacctacagaatgggagaaaacattaaataactgcgcatctgacaaaggtctagtacccagaatctttaaggaatttaagcaaatcaacaagcaaaaccaaaataatcccattaaaaagtgggtaaaggacatgaatacacacttgtcaatagaggacattcaagtggccaacaaacaaaagaaaaaatagcatcactaatcatcagagaaatgtaaatcaaaaccacaatgggataccatctcacaccagtcagaatagctgtttttaaaaagttaaaaaataacagatgctggtgaggttgtggagaaaaggggacagttatacactgctgggagtataaattagtccagtcactggagatttatcaaagtactaagagttgaactaccatttgaccaagcaatcccaatattggatataaatccaaaagaaaataaattattctaccaaaaagacacatgcacccaaatgttcatcgcagcactattcacaatagcaaaaaaggactcactattcacgatagcaaaaatggtgcctatcaatagtggattgtggtggccaggcgcagtggctcacacctataatcccagcactttgggaggctcaggcgggtggatcacaaggtcaggagttcgagaccagcctggccaacatagtgaaaccctgtctctactaaaaatacaaaaattagctgggcatggtggtgtgcacctgtagtccaagctactcaggagtctgaggcaggagaatcaggtgaacctgggagacggaggttatgctgagctgagattgtgccactgcactccagcctgggcaacagagtaagactccatctcaaaaaaaaaaaaaagaacatgtggtacatatacaccatggaatactatacagccatgaaaaagaatgaaattttgtcctttgcagcaacatggttgcagctggaggccttgagctgctggcccatcacacaagcccaacctggcctacctggtgcccattgatccaacctgaatcctcttgagagcttttacctgttgtgatgagggaggaagtctcaggattggccatggaagctgcagctgaagcaagggaggagaagggccggcagaatagtccccaaagtatatcgttaagtaaaaagcaggccccaaagaggatatatgagatgctctcattggttgtttaaaataagaggggaagattatggtttggatatagatgactgaatagatacatagatagatagatgatcaatagatggatatatatatatatggcagataggtagataacacagatgaaagattgatagatggatagatatatatgtaatagataagatagatgattgatagatacttgataaatagctagatagatgacagatagatggatagataagatatatagatgggtgactgatggatgaatagatatacacacaatagatagatgatatgtactgatagacaatagattaattatagaaagaaagaaagaaaaaagagatagggagagagaaggaaggaagagaggaacgaaaaaaggaagggaaggaggaaggaagagagggaggcagaaaagagaaggaaaatgtgtgaaatgacaaaagggagaagtaagaggatgagggatcaaggctgagagaaaggttcttctctgtatcacctttggaactgtttgagcatgtattacttctccaaaaaacaaattaagatatgaagtccacaatcaggattgaacaaaaaatgctagccacgtaaataccgtcctatcagaatctgccctcacactttccaccataaccaatttcaagtggattggaaatgaacaccaatgtgacctctgtacccaggctttccaaaatataacagcagacttagatcacacggaggacatgatgacacaagtagcagcaagcagcttttgaaatcttcctgatatcacacctctgttaagtaatttgcaaatattatattgatcagtctcaaaaaagggagttgtgtttgcaataacagcagcgttaactgaccacttactatgtgccaggcactctcgtgacttatatttttctataaatctatattttaatttatatataattaaatactttacatataattatattttttaaatttatataaaattctttgaatcctcacacaacacctgtgtgagaggaactgtttttatcttcaacacacagatttggaaactgatattaagggaattgcataagtcaccagctgagaggtggaaaagccaagatgcacactcaggctgtgtgactacctcctctccttccccctcctcaccctgtccatcaccacttcccgttcgttccacttccagaacactccaaatccatttatctcaatggccaaaactgacaccagaccctgtctctctccctccaatgaccccaaagcaaccgcttcaaggatctctctaattccatgctagccactttgctattttcttcatgttacttcccacatgtgagcaatgggataaaaataactactattgagtgtgtgtgtgtgtgtgtgtgtgcgtgttttcaatgaatgaagcagtaaaccaaaaacaagattctaagcccccaaccatctgaatggactcctcccatccacagggcattctaaagttaacctgaaaaaagtcgtttaggccatgatagtaaagaggaaccaaacatgcctcattctaccctcctctcttttgaaattactcatagaacaagcttcttaagtctgataacaaaactttgcaatctattttctgaagcctgctacctggaggcttcatctgcatgataaaactttagtctccataacccattattataacccagacattcctttctattgataataactccttcaaccaattgccaatcagaaaacctttaaatctacttatgacctggcagcacccacctcgagctctcccacctctttggattaaaccaatgtataccttgtattgattgatgtctcacatctccttaacatgtataaaaccaagctgtacctcaaccaccttgggcacacgtcgtcagtacttcctgaggctgtcatgggtgcgtccttaaccttggcaaaataaacttcctaaattgattgagacctgtctcagatactctttcattcacaaatctgtacatattgtcatgggagcatctggcagtagtcagtgctttatggtcattggttattaagttcaatcatgtctcacataacgactgcatatatgacggtggtcccataagattatcataccacagatttaccatacattttctatgtttaggtacactgatacttaccattgtgttacagttgcttacagtattcactacagtagcttgctgtccaggtttatactctcagaccagccctgtaccttgtagcccaggtatgtagcaggctctggcatccaggctggcgtaagtgcactccaggatgttccacaataaagaactcacctaacgaggcatttctcagaatacatttctgtctttagtgatgcatgacagtacatgcaccataataaagaaatattaataggctgggtgcagtggctcgcgcctgtcatcccagcactttgggaggccgaggtgggcagactacgtgaggtcgggagttcaagaccagcctgaccaacatggagaaaccccgtctctactaaaaatacaaaattagccaggcgtggtggcacgtacctgtaatcccagctactcaggaggctgaggcaggagaattgcttgaacctgggagatggaggttgagatgatcatgccattgcactccagcctgggcgacaagagagagactctgtctcaaaaagaaaagaaaagaaaagaaaagaaaagaaaagaaaagaaatattaatataagccatgaccaattcacactgtttatatagtaacataaatatcagtacatattcagtgctcaagccgccatcatctctcccctggatggcagcagctgcagcctctcactgactctctgactccacgccagcctctctctcatccctcctccactcaggagccagaaggagaattgacaacactcacagaccacatcacctccacaatcaagactcagtgtcttctcagaagagcactattcacatttcttatcttggttctggaaggtcctgcctttctccccttgccttcctctcccaccccattcctgccactggccctgaactcaccctacccagcccacctcagcctattccatttccttctcacctctgggcatcggcacctgctggctccccaaacatctctatggcaggctccttctaaccagtcggacctcagccctggtgtcactgaccacagatggtgttcccagaccctcctgactgacctctgacacacatctgtgctacctcctgtagagagtccattctttttggagatcagttctcgtgtctgttaagtcgtgtatttgttgtccaccttctccacataaattgtagcttcttgaggtccaatgtctcatctttcttatctggggcacataggtggtactaaatacattactgttcatctggtattgttttatgtaactttctggttaatgactgctttacccattcattctaaccatcagcaaggaaggagttgttcacatttatgatctcagtggctacaatagctactggatggatgaatgcatgacagatggatgaatgcatgacagatggatgaatcatggaaggatggttgattggaaggatgtctgggtgggctgatgactagttagataaatgcacaaatggatggtttgttgaactgatggttgcgtggatgtatgtatgttatggattgatgggtgatcaatgggtagacgaatgaatggatggctggttgaattgatggttgcgtggaggtatgtatgttatggatggatgggtgctcaatggatagatgaatgaatggatggtttgctgaactgatggttgtgtggatgtatgtgtgttatggatggatgggtgatcaatggatagatgaatgaatggatggctggttgaattgatggttgcgtggaagtatgtatgttatggatggatgggtgatcaatggatagatgaatgaatggatggtttgctgaattgatggttgtgtggatgtatgtgtgttatggatggatgagtgatcaatggatagatgaatgaatgatggctggttgaattgatggttgtgtggatggatgatatatcaatgaatggatggctcgttggatatatggacaggtgcatgggtattagatggatgcataaattgctgggtggatggatttgtggatggatcaaaacgatgggtggataaatggatgtatgaatagatggataggttcctaatgagaaatgacaatgtctgtgttactcacactaacagaatggaatgtgaattgaaacctgatgatttccttgagagtcagaagaggatttcaaacaccctacccaagacatttagcactgacaaaatccatgtggtgacctctgctggggtccccagattgcccctccacagctgcgctgctcttgcttccctccaccaccctattctgcccaaggaggctcccacctgccatagggatgggcccccagatccactgttgccttggaggtgaggcaggaaagagctgaggaaggggcagagagagccgggagactggaatgttcctgactctgcagtcagtgtgtggcttcagtgtgaaggcccaggcacacagaggccagagaacagaaatattttgggaacaaatacgtgaatagaagtgactgactccacctcactgagcctatgcttaaccttctgaaatggggaaagcaatcatgtctagctcattgagtcatttgagaattaaatcagagggtgcttataaggagctcagcccctcctgacaggagacaggtgtcactctaattgagccttagagatccctgcaccaggatcccctggtgtggagggatggctgctataaatgcaggtgcccaggcccatgccagacctgctgaaggaaagtgcttgcctaagaaaacctaccctccctgccacttgctgctttgttcactctctatatatattttattttcaaatatcatgcagagtttgttttctaaaaaaacattaaatgtcacagctcatttaccaatatgctataaaatgcagttataaccatgcagaggcaagagttgcagaaaaaaaatgcaattgtaaatcattaacatgaaacaataatagaatgaataaaaatgtaaattttgtaatatttcctttcatccctcacaggttcacaaaatattcagtttcagcaacttttaaaaaattaataggctttatttttaaagcaattttaagtttatggaaaaattaagcacaaactacagagagttctcatacggcccacaccaacccaacttccctattatcagcgtcgtgttttggggtggtacatttcttataatcgactaaccaacattgagacgttagtattgactcaagtccacctttctcagtatttttcttccacttatcagaatctgagctctctgtatttgtttctttcgaattagtctcactgtactgcaacaaaggtccctaaagcagtggcctatccatctcgtctacctgcatccccatcccctgggaggagcagggcacacaaggaaacatgaataggtgcccagaggtgcaaagggtcgtttagaaaaagcgcagattcatggaggtgtgaatgaccaagaaatacagatgatggccacaagccaagagaccaaggaagattgcgacccttgtccagaaaatgaggtgtcaggtgtgggagaaagggctggcctcccaaacacaggtggtaggagacttgcttgcctgaaccagaacaggcatagggaccagaatgaccagcggattaattagagaaatgtctttgagccatactatgttcctcgtcctagactaaattacttttagtcctagactaaattactctgactcacttttcctcttaattatatcaacaacctttgaagtgggcataattaataccctgattttacaggtaggaaaactgaggcacagagaggtgaagtgacttgcccaagaatgcaccgctgatcactggaagaaccagaaaatgggaacccaaccagctcacaggtggagaggagggcccccttggactgacctttaaaaatatatagtcattacatgttctgagaaacagccccaggcaatgtcctggaatctgattgctaagagactccaagtggcctggattgtacccaacccagggcctttgcacctgctgttcccttccccagacatttcacttctcatcattcaggtctcagctccaatatccttatctcatttccagagcatcctgtctaaaagatcacgttcttttattttaaattcttcacagagcaaattcctctctgaaatcatgtctttgttaattaatgtattgtctctttcttccctgagttcaggtgcttgtttgtatttggtcaggctctgcctttatgcctaaccttagacctgtctcccaacctcgttctgcacccctgaatgtttgtgacttcttcatcttctcactgtactgccctgcagaagagacaaataacacttacttgtcacatgaaataatgaaaagaacaaaagtgaaatctgagaatagactttaaaaaaaaatgacaaccaaaagattagagtcatggagattctcttctcctgagaaaataaatactgcttttgctcaaatccttacccttctctggttcctggagaaattgtctgtacaatatcaggttagtgagagaaggtttcctggagcccctaaaataaggcagtgtgcaacagccagactccaagatggtcccctctgaccctagccaacaggtattccttcctttgtggttccctcccacattgaagggggctgtgcaaccagtaagatatggcagacatggctgtgtgactcctgaggctgggttctatgagatcttgtggcttctgccttgctttctcttgggtcacctcctctaagggaagccggctaccatgatgtgaggatgttcaagcagtcttatggagaaaccaaggcctcctgccaacagccagagctgattcatcagccttgtatgtgggccatcctggtagtggattctttagccctagcccagcttttaaatggctgtagccctggtccacatcctaaccacaatgttataagagaccctgagagagaaccacccagctaactcacttccaaattcctgatccacagaaactgagatgataaatgtctgttgttgttttgagccactaagttttgaggtggtttgttacacagcagtgggtaactaatacatcaagctgtcagtaaccaccaacattgttcttccaagcccacatagttatcagagtcagaaaaaaatcctctcaatggcctatgacatgacctcatgagagctggctcctgctacgtctctcctttgcttcatactttttcccgcagagtggctgttgatttcagccactatgactctccagcacatttgctcaggcctgctccctctgggggatttggttttgttgtgctctcatcctggagtccttcctgcagtgagcctcatttccagttctctcactccttcagcgcttcctgttcaaatgctctctccccagagactttcctgacctcccttcctaaaatagctgcctccctccaccttctctaccatctcaccctgccttgttcttcttcctaatacctgacacagcatacatttatttttgtttattacctgtcttctcttattagattgtaagctccgaaaggacttggcaatcacctattgggtttcctgctgatgcacaaccacctgagcagtgtggggcaccctcaaaaatgattggttgacactatggaaaacagtatagagattccctaaagaactaaaagcaggacttccattctgtccagcaatcccactactgggtatctacacaaaggaaaagaagtcattacatgaaaaagacacttgcacatatatgtttatagcagcacaattcacaattgcaaagacagggaaccaacctaagtacccattgaccaaagagtggataaggaaaatgtggtatagacacaccatggaatactactcagccataaaaagaaacaaaatgatgtcttttgcaacaacttgtatggagctggaagccattattctaaatgtagtaattgaagaatggaaaactaaatatcgtatgttctcacttgtaagtgggagctaagctatgaggattgaaaggcataagaatgatatcatggactttggggacgcagagaaaggtcgggaaggaggtgagggataaaagactacatgttgggtacagtgcagtcaatgtgccacactgtacattttgatgggtgcaccaaaatctcagcaatcaccaccaaagaacttatccatgtagccaaaatccacctgtactccaaaaactattgaaatgtaaaaacaaaacaaaaacaaaaacaaaaaaagcacaatacttaatgattggttaagtgtggcatggtggctcatgcctgtaatcccaactactcaggatgttgaggcaggaggatcacttgagcccaggagtgtgaggctgcagtgagccattatcacatcactgcactccaccctgggtgacagaacgagaccttttctcaaaaaattaaaaaaatatattggtggccgggcgcgatgggtcaggcctgtaatcccagcactttgggaggccaaggcaggcggatcatgaggtcaggagatcaagaccatcctggctaacgcggtgaaaccccgtctctactaaaaatacaaaaaaagagaaaaattagccgggcgtggtggcgggtgcctgaagtcccagctactcaggaggctgaggcaggagaatggcatgaacccgggaggcagagcttgcagtgagccgagatcgcaccactgcactctagcctgggtgacagagcaagactccacctcaaaaaaaaaaaaaaaaaaaaaaaaaaaaaaaaatatatatatatatatatatatatatatatatatatatatatatatgtaatgttgaagattaaaaatggccaaaaatcacttgatgctccagaagggtagaagggtgtctgtctcccatgtttcctggctctggcctggctctgcaactttttttttttgcaacggaacgtggtagaaacgatagcatgtgcctgccgccgtgaggcccatgaagccttgcagctttcctttccacactcttggaatgctgagaccacagtgctgtgaggaagcctcgcctcgttcactggcccaggaagaggggagtccacatggaggggaacccagaccctggtggagagtccacacaattgctaaatatataagggaaggcatctcatgttcctcccaccccaccccatcctccagctgaatgaggccacacacgtgggcccaggcaaagacagcatggaaccaccagacaacccatgtaaaaaggaagcacactgattttctgtatgctctcaacactcctgacaccaaatatgtgggagattctctcacaccatccaatgctccacttgtcagcagacatggactgggtgtcccacaagttagctcaattatgacactgagtgcccaaaattagtgcagactccagtgattaagggctcaattccacaagactgtccccacccagcttcaaatacccatcataactccccggttgtgacctgtgcttctgacaaagcagctgtaagctgggagttccaataagaacacatggacacagggaggggaacaacggacaccagagcctatctgggggtagcaggcaaggcgggggagagcatcaggacgaatacctaatgcatgtggggcttaaaacctagatgacgggttgataggtgcagcaaaccaccatggcacatgtatccctgaacttaaagcaaaataaaacataaaaaattacaactacctccaccaaaaaaaaactgggggtttccacggccccctcctcaggtttgataatttgctagaacggctcacagaactcagggaaacactttccttactattaatggtccataataaaggctgcaactcaggaacagcccaatggaagatgctgaaggaaaggtgtgcagagagggtgcggcgtttccctgcctcatcaggtgtaccacccgtgttcacctacctgaaaactccccagatcctgtttaggtttttatggagattccattatgtaggcatggttgattaaatcattgcccattggtgatcaattcaacctccagcccttttgccctccctggaggtcaggagttggggctacaaattccaatcctctaatcagatggttggttcccctggcaaccagcccccatcctttggtgtttttcaaaagctacttcattaacataaacttagatataagtgaaataggatttgttatgaataatagaaagacactcctctcacctctatcactcccaggaaattacaagggttttgaagaaacgtgggatgaagacatttcttatcataccatgatagcataccatggaaggtgagaaacaatgagttgttttatatgtcactgcattttgggggctgcttgttacacagcaatagataactgatacattccacgagtaagtagctgtctgacagaccttccttcatctaccctcagcccctccaatccatctccacactgaagccaggacaatgttggaaaatacccatgctggtgtcactgcccagctcactgggaacaatgcaaaggcacctattgctttggggataaagagcaagagccatagatgatgaaccctttcctattccagcatctcctactgtgctgagcctcatcatcctcccctctaccttccagaacttctgggatgtggccagttccctaagaccttcgtatgtcctgccactgtggggtacttgaacacgctatttgatatggtttggttctgtgtccctacccaagtctcatctcaaattgtagtctccatgtgtcaaggccaaaaccaggtggtgagaatcggaacataagggtggtttcctccatgctgttctcgtgatagtgagtgagtttcatgagatctgatggttttataagcacctggcatttcccctgcttgtactcactccatcctgctgccctgtgaagcggtgcctgcttcttctttgcctgccaccatgattgtaagtttcctgaggcctccccagcactgtggaactgtgagtcaattaaacctctttcctttataaattacccaatctcaggcagttctttacagcagtgtgagaacggactaatagagtattcctctgcctggaatgctctctccccactcccacagctaggcaatgccaacacaaccttgagacaccagtttcagtatcacctccacaggaaagcacttctgtaatgctgacatcttatgtaacaatggtccacacacaaatatatttttaatttcacgcacatacacatgcacacatgtacacacatagtgagactccaaaacaaacaaaactctcttcattctaacacatccacgagtggaacttctcagtgagcatttattgagcaacaaccagcttcaagacaccacgaagagtccttaggtccttattacttcttctgaaaataatgttataaagtgatcagttctgaaatggtagaggaaaatctagttaaaaacagaatgtagtcgtagatttgtcaaacagatggttagtgttaaatattttttggacagggttgcctccaacatgttgtctgtgctgtgctgtatccaagaaatccttcccttcctcaattacagggatgcgtgtcctgcttggaatccagcctggcctttggctcaatagaaactccacagacagcaggagagctgaggctccactgtggccatgcagccttgtgtgaaaattctaacggcttctcctcccttggaaatgtttccaccatctgtttccccatacccaggggccaggatgggtgaggtgctcagatcagggccaaaatctaaggaggcagggtgcaaacatcaagtaatcgaggtaattcatattttaatgtaatgtttatttaacatttctgaattaatgcaaaaaaatagacaatgcagaaaataccaacattttaactaaagatgggatctgatgcagttggcattaggaaaagggagggatgtaagtctcgcaaaatactgccttaaaatactatttataggccaggcgtggtggctcacgcctgtaatcccagcactttgggaggctgaggcaggtggatcacctgaggtcaggagttcgagaccagcctggccaacatggtgaaccctgtctttattaaaaatacaaaaattagccaggcatggtggcgggcacctgtaatcccagctactcaggaggctggggcaggagaattacttgaacccaggagactgaggttgcagtgagccatgattcagacactgcactctagcctgggtgacagagagagactctgtctcagaaagaatatatatatatatatatatatatatacacacacacacacacacacacacatacatatatatacacacatatatatacacatacatatatatacacacatatatacatatatacacacatacatatatatatacacatacatatatatatatatatatatatatatatatatatatatatatatatatatacacacacactatctggaatattgaggttttccactgccctttaaattttgcacctgaggccaatgcctcacttgcctgcccctggccatgccgacaccatgtgaattgctcttgggtctcctctccctctccacggccaccaccctagtgttttctattgtatctggcttgaacaaccacagccagctcctaaccatcccctccacgccccagtcttgtccaactcatgaaatgtcactaccacttaacaagccactcaagaccaaattgaggattcattcttgcttcactcctttcctctgaagcctgagtcccacccacctgcaagtcctatcaattccaccttcatctcctactgtctagaaatcgctagacatcaccccctcttccccgtcccacgccatcacctgcggctcagattatcgcaactgactgcatggattttctcagctcctttccgtcctctgcccagactgtcccggaatatggacagattgcactgtgggaatgccatatcagatgcttcggtgctaaagataactgagtctcaccatgataatgttattcgcttgccaagtctttctagttcattcaaagagacgttcctcgtaggtgctggtgtgccttcaacatttccgtcacacttgctaattactttttaaacaaaggagagctttgctcagatcattggcaggcgatggcatctaacccagggtttccagtctcagcactgtggacattttgggctgaataattgtttggtgggtgggcaggagggctgtcttctgcactgtaagctgataagcagcacccctggtctctaccccctggatggcaggagcaaggccctcttccccacgtgtgacaactaaagacatctccagacacttccagatgtccccaagtagacaaagccacccctgtttgagaaccactggtttaggcacacttgtgcatgttgttgttgttgctgttgctgttttttatcattgttctttcttttactctgtcttccacttaagggaggtgacgctggctttccatgcatattcatgatatcaaaactttaaaatgattctcactcgggtgtttaaagttaatgttataggccaagtgcagtggctcatgcctgtaatcccagcacttcgggaggccgaggcaggcggatcatttgaggtcaagaccagcctggccaacatggtgaaaccctgtctctaccaaaaatacaaaaattaggtgggcctggtggcacacacttgtagttccagctactcaggagactgaggcaggagaatcacctgaacccgagaggcggaggttgcagtgagctgagatcacaccactgcactccaacctgggcaatagactaagactttgtctcaaataaataaacaaataaataaaaataaaagtttatgttatagaacaacggtaaatagcacctcatggcctagttcttaacacagatggggcaaaatttctgaaaagtgaacagacaggtaacatctatcccactgatcacttctcccattaaatgtcaagtaaactttctaaattgcaaatctgaccatgtcactctgctattctaaaccctgctgccctctggaaaaagtttttttttaagcatacttaattcttattctgaagcacatttaaaagaaagagagaattgaaaatgaaaaattttgcttaattctcagtatactcagagctgcaaaaatctactggtttcttgggaagagcataaaatattcataaagcctataattatgtctttggtccctttatctaagagcttccttccgtggtaagcaaagcttacaggcattttcccacctagaatcgttttattgtaagcacccatctttgaattacgagtgataaatatgacatctcagaaatcaccagtaatatatttgaggtcaaccacctaaaggagccttcacctagaaattcccaaactaacagctctttatgacgtatagagcctatctataatttcccattcaagcttgtgttcggattgggccaaatatctgcaccacttgtagctagatgtggccatgcaaccaaggtctggccaataggatgaaagcacatgtatggagtgtggactaagagaagccttaaagggaatattgggggtggaatctttctttgcctcacctctcttcctcttagctagaaggcagaaatgctgcctgaattcagccagctctctagacagtgaggtagaagccacctggtgaagaattcagaataacaagacagaaggagcctaggtcctgtgttcattagctccagctgccataacaaaatcacacagactgagtggcttaaacaacaaaaatgtattttcttacagttctggaggctgcaagtccaaaatcatggtgctggcaaattctgttcctggtgaggactctcttcctggcttgcagatggccaccttcttgctgtgtcctcacatggcagaggtggtggggtaggggaagagacctgaactggtgtcccttttcttatgaagataccggttatattgacttaaaagcccacccttatgaagcttatataatcttaattacctctctaaaagcactgtctccaaatacagtcacattgggggttagagcttcaatgtaaattttggtcaaggagcaccattgaggtcatagcagcctctaacagcatagaaccctgaattagactaagatttctgctacacaagagcaagggatgattaaatcccattcagtaattaggatcacctctcaccgactcacattcacacacactctaagacacacaactcccagccacatgccgagcatggtaaccccatttcctactttaacctttgggggagcctgggaggtgggaatcattcttatcccctgtccaaagtggagaaatggaggtcctgaaagagcaactctcttggcagggttggagagtgagtctgtgctgtcaaatgcctcatgtgtgcatttctgacaagatacagagtaatctgagggtggaggaggcgtgaaggtgaatggcaacctagacaaagaactgggaagagatcgacggaaatctgttcctaaaagccccatgcgtatgtttattgcagcactattcacaacagcaaagacatggaatccatgtaaatgcccatcaatggtagactagataaagaaaatgtggtacctatataacatggaatactacacagccacaaaaaagaaggaaaacatgtcctttgctgtaacatgaagggagctggaggccattatccttagcaaattaatgtaggaacagaaagtcaaatactgcaggttctcacttattagggggagctaaacaacaagaacccatagatcccaggaggggcagacctgagggtggagggtgggaggagggagaggatcagaaaagatacctatcaggtactaggcttactacccgggtgacaaagttatctgtacaccgaacccctgagacacgcactttacctatataacaaacctccgcatgtatccctgaacctaaaataaattaaaaaaaaaaaaaaagaaagaaagaaaagaaaaagacccacaagccattcttgctgctggagtcttctggagtttgggttgttgttgttgttgttgttgtcgtattttgttaaaacattcctgttcttctgaaaggatacctggaggctttatctggattcctagggtcctctatccacaaaaagtcagtaaagccacgtctctaattttgggaaaatgtgggtgtgtgtcctaagaccctcatggtgggtggaataatttgctatagggcaagttggagagtgaccaaggatgcctcaaataatgtctcccttttcattacgggggagtgcctttcagaattacacagcaagggtgaattatacgttgactcgtcatctgtgacaaatttcatgcagctcaaggctatcaacagcagctcccttgccaacagcttgcagcagctgccgctgatcaaggcagtcagctcgatccccgtagccttccgtgaaggaccacgggctggtcagaagcagtctgacaggtcacagagccagcccagctgttggggggattagctgtaaggaaagctgatcctatgacacatgctttaggtatgtccgcccctgggaaacgtgaccttcaaggtttgcgttatagaactttattcgcttcaaaagatggagaacacttttgttttctgagtccctggagaatcatgatgcagacagctttggaggtacccaaagaaatggaacacagaatcccaattacatataggccgcacacatgataaacaactgctggtttgggaattgctgggcgaagcttcctttcggcagtttgctcagaatatattgctgatgatttctgagatgctcaattcatcattcacaattgctttgcagtaaaatgcttgcagaagggaaaatagctgtgaacgctgctccccaaggaggaaagcctataactgctggagccaaagatgtcatcgcaggttttatcagtatttcattttcttcccatgaaaccgataagcattcgaagccctgagtgtggtgagaattaagcaagatttgcctctttctgattctttccacaaggtagtgggaatttgaaatgggagaatgatgttgtcctatctgttgtgtggaaagattaccttggctttgcttgtgagaagggatggacgggggggcagtatcatggaaaaagtttgagaatatacaaaggtaggcaaaatagcataagaaatcccttctactcattgtctgcagtcatcagctcatggcccaacctgttgtgtctatacccccatcacatcactggcattgtttgtaaagcaaatcccagacatgataccatgtcctccataaacatttccatatctgtgttttgtaaagactcttgcagaaagctgacttctgaaccaaagccccatgcatatgtgcccttggaaggtcactacctgatactgtctattgctggaaaaagagcagcttgcataagcatttttacccacaaaactgaagctatagaatacactagggaaatgcagctcattgcttgggagttatgcattagatatgctatgatctggttctacaggcatttattgattattgactctttgctaggaactgttttgggcattaggacatggtccttgcccctgagatactcaccatctaatggaagacacagaccaaaaaacaagtaatatagtcaatgtcatgtgtggtatgtaatagcaaaatgtatcccgtactgaatgctccagactggtggaaaaatcataataaaataagaagcaagaacggcagcagaatagctggggtttactgagaacttactgtttcgagcacccaagatacaaagcaacacgttagagaagatggtcattgtttggaaattagagaaaagctgctggaaaagaggatttagagatatagtttggaggaccacaaccagcttgcacatgtttttatggtttagaaatggcaactccagaatttttttttttttttttgacagagtctagctctgtcgcccaggttggagtgcagtggcgtgatcttggctcactgcaacttctgcctcccaagttcgagcgattctcctacctcagtctcccgagtagctgggactacaggcacatgccgccatacctggctaaatttctttctatttttagtagagatgggatttcaccatgttggtcaggctggtctcaaactcctgacctcaggtgatccacccacctcggcctcccaaagtgctgggattacaggcgtgtgtcaccgtatccagcccagaattctgaccgcgtggttctcagtccaaaaacattgtcccccttcctgagtcagatggcaacacaaaaatgccttgggaaccagctgggccatttcatgcagcagtaattctctggatcagtctcctcgtgtgactgatcctggttttaagaaacttgcttctatttcctggtcagaaaagtctctccctcctgcctcatcttttctacccctgtttagacaccactcctagttcaaagcaccattgcctcctgcctggatggttgtagtggtcactcacctggtttcctttcttctactattgctctaccatcatcagctctccttagaaatcagaggatcagtggggtgtggtggctcatgcctgtaatctcagcactttgggaggccaagacaggaggatcgcttgagcccaagagtagttcaagaccagcctgggcaacatagtaagaccctatatcttaacaaaaatatatattttgtatgtatatctttttatatatatatttgtatatatatttatagatgcatctttatatatatttatagatgcatctttatatatatttatagatgtctttatatatatttatagatgcatctttatatatatttatagatgcctttatatatatttatagatgcgtctttatatatatttatagatgtctttatatatatttatagatgtgtctttatatatatttatagatgtctttatatatatttatagatgtctttatatatttatagatgcatctttatatatttatagatgtctatatatttatagatgcatctttatatatttatagatgtctttatatatttatagatgcatctttatatatatttatagatgtttttatatatatttatagatgtctttatgtatatttatagatgtctttatatatatttatagatgtctttatatatatttatagatgcatctttatatatatttatagatgtctttatatatatttatagatgtctttatatatatttacagatgtctttatatatatttacagatgtctttatatatatttatagatgtctttatatatatttatagatgtctttatatatttatagatgcatctttatatatttatagatgtctttatatatttatagatgcatctttatatatatttatagattttttatatatatttatagatgtctttatgtatatttatagatgtctttatatatatttatagatgtctttatatatatttatagatgcatctttatatatatttatagatgtctttatatatatttatagatgtctttatatatatttactgatgtctttatatatatttacagatgtctttatatatatttatagatgtctttatatatatttatagatgcatctttatatatatttataggtgtgtctaaaatatatatatgttttatacatgtataaaagaaaccagaggatccaaaaaaatagagcctgagggtggaaaaaagaaatcagagaagccatgaagaagaaaataagccagacagaatggcgtgcacctgtggtcccagctacccaggaggatcccttgagcctaggagtttgagtccagcctgggcaacatagcaagtgtccgtctctaaaacaattatataaataaataaaatttaaaaaataaattttaaaaagaaaatataatttcatccgtctttcttacacacacacaacttttaaaaaaactttcatggcttcagatcatgcacacagtaacacttgggcttcttaccagagtctgcaagaactgtgatattccagccccaaaaacccctctgctcccgccgcccagcctccatccaggtccctgaggaagccagtatcccccatggctcctcacctcggcacacggcattcccacctctttccctcgtgccactggccccaccaccctcccctgctccagtctggttcctattctccttctttctgttgccacatcaggtgtcactaccttcgtagagccctcaattcacccacaggacagctccctcttacctgcttctctcacacccctcctgtagattttaacgctgggcacactttactttaccctcttttgtccactctaagatccacctcctcctgtccccactctctcacatctctgaaatcaggctgtgtcctacatgggtggcagtcatgcttaagttgtgggcatttttctgtttcctgtgggtatataaagtaacagtacatcttacaatccataccaccatcttggagtctacagaaagcaccatgtgtttgcacaaagtctgttttccttgcacagagctggaggatgagtcccatggctagtcccggggccaagcacagctcctggtacaaagtgaggctctgcccagaacagggccagacacacccttgatgcatcaggtcagattcaagaaccaggtggttccaaacagcagagatcgttttgaagggtaaagagataatgcatttgtgttacaagttaataaatgatattacagtcattcgtgggcaaagcaaggcaaaggggccagaggacttagttatcatggtccacagagaccttggaagagaaaacatttgaattgaagcctgaatgggagaaggaaggagccatgcagagagctctctggcagaggagacgtctcaatagagggtttccagatggagggattctcagccttggcactcttcacatctggggccatgacagctacgtgagtgcatgcggtggtcccagctacctgtcccactgcactccagccaggatgaaagcacaccctccctgaccaccctcaagtgatctggcacctgataagctctgacgtggcctcctgtcccatccttcctttctctctctctctctaatttttttctttttgagatggagtcttgaaagaaggaaggaaggaaggaaaagggaagagagaaagaaagaaaaagaaagagagagtaagaaagaaagaaagaaaaaagagagagaaagagagagacagaaaagaaagagaaagagagagagagggagggagggaaagaaagaaagagagagatgaaagaaagaaagaaaagaaaagaaagagagaaagaaagaaaagaaaagaaagaaagagaggagggaaggaaggttcttaggatgctataggtcaaggtttcaacctcggaactattgacatttggggttggaccagtccttgtggggccgtcccatggcttgcagggtgtttagcaacattcctggcctccacccactagacgtcagtagcactcccctctccagtggcagcaaccacaaatgtcttcaaacatttctaagtgtcccttgggaaaggcaaaatcaccctggttgagaaccactgctgtggaagacttcaaccatgatgaacattaagccccatcactccgttcaaaccaaaaagtgataaagtctagagtttactagaggtcagtggtatgccaggaaccatgcttcgcttgggatgcaccctttaaccatccagcaaccccaccaggtagagcatggcatctccctgtgttacactggagaaaactagagactctgagggtttagtcaccttgctgtaggtcatgtgtagcaggggcagaccttgcatcccaacaggaggttctgctggctctgggacctgggctctgccctgtaccgtctccctgcttacagactcaaaagcagtatctcctaacatctcagcctctgcacgtgccattctccaggcttacatacagctctgctaactccccttctttctttattgagttccaggacactctaaagaggtcacttcctgctgggcacagtggctcatgcctgtaatcccagagtcttggaaagctgagacgagaagataacttgagtccataaattcaagatcagcctgggcaacatagtgagacagaccctgtctctacaaaaaattttaaatattagttgggccatggtggcacacacctgtaatggcagctactcaggaggctgacgtggggggatcacttgagcccaaaagtttaaggttgcagtgaaccctgattatggcactgcactccagcctgggcaacagagagacagagtgcctctattttttttaaagaggccacttgctatcagaagagtttcctgagcatcccccgcaacctcaccctactcccatttttgctatctccatgggccctacttctcctctcttagctccaattatgctataatgcagcacatgcatttttgctgatctgctgacttgcctcattggtgtgaagcaacagctgggacagcaactgctccacattcccccggatcctccttcaacttctcccactcctgggccaaaggtgtgcatttagctccatagcaaagtgtcatggcttctgcagaacactctggtcaccaaggcgagaggcaacacaggtggacacgggtttcagtccatctttgtggggctcctgcttgtccttgctctacctggctctacatctatcttctcttcttgacttcctgtcctgtggacttcaagcaccaacatcagaaacaaataaatttccttgcagaatcttcttaaccagctgcacaactgcttaagatcaaattctagagttcctgcctctctgcttgagcactgacatactttggtatcagactatatagttattgcctgcttgctttcctgtcttctcccaacctactcctccaaacctaggaattgctcccccgtttcctagaacctgccactccctctctgaaattctgagctccgaagggcaggaaccccaccttattcagttaaaactgctttcatctgaaaaaaggtcatctaagttttcttcccactgattcatcttagtaagatggtcaaatgtcttagcagtggagtaaagactttggaatctgaagtaaaacagacctagacttagttctttgtttcttcccttttcaagctatctaaccaagggctgagccttagtgccgtcaagagtaaactgggagaagaagattactacatgcagtggtgttgtggagaagaactgagagaagccatgcaaacgcttcagcacaatatctggtatcagtaggtgctaaatcttggctctcagctgtcatgattttgagtttggctgcagaattcagctcagagggaggcccacacgatttcgatttgccccagattcaaattccaaatgcacagagctctactgatccaatgagaagaaagtcattcggtgcagtgattcccaaattcttccttgatgttcagctattccttccttcagcactcggtgaccatcttctgtgtgccagaggtctgtaatttttgtctttgttgttgttttgttttgttttcaagatggagtctcgctctgttgcccaggctggagtgcagtggcgcaatctcggctcactgcaagctctgcctcccaggttcaagcgattctcgtgcctcagcctcccgagtagctgggattacaggcatgcgccaccacacctggctaatttttgtgtttttagtagagacgaggtttcatcacattgtccaggctggtcttgaactcctgacctcaggagatctgctggcatctgcctcccaaagtgctaggattacaggcatgaggagccactgtgcccagcctgaggtctataattttgaatccacacgtcatgtggctgccacgtctggaaaatcccatctccagggctctccttgactccatactcagtcccatcctttccattcaccagcctgagcctgcccctgttccccaggcaaatgggagctctcctggaggcaggtcagtgattccgaaatgacttcaatgggagagatggaggacagtgcaaggggtgcaaccacaggcttttgcatattcatcatgttgggttgctacaggagcatgcacatttggctgtgtaaacctcgatagaccttattagaaattacaatgttcctgcaaaccctagtgatataaaaaaactcttcccccaagtcaacttttttttttttttttttgagacggagtctctctctgtcacccaggctgaagtgcagtggcgtgatctcggctcactgcaagctttgcctcccaggttcacgccattctcctgcctcagcctccccagtatctgggattacaggcgcctgccaccatgcccggctaattgttttttttgtatgtttagtagagacggggtttcactatggtctcgatctcctgacctcatgatccgcccgcctcggcctcccaaagtgctgggattacatgcatgagccactgcgcctgactgagtcaacttttattttaaaaatactaacccactctctcctccagtcacataagatgcaaaaaaaaaaaaaaaaaaatgccaaggagaagaaggtggccccagtccctgctgtcatgaagaagcaggagaccatgaaactggtgaatcctctgtttgagaaaaggcctaagataagaatcttggcactggacaggacatccaacccaaaacggacctcacgcgctttgtcaaacagtctcacgttgcagtggcaaagaaccattctttccgtgagtggctgaaagtgcctcctgcaatcagccagttcacccaggcctcagactctcacgcagccacccaactgcttaagctggcccagtacacaccagaggtaaagcagaaggagaagcagagactgttgtcctgggctaagaagaaagctgtcagcaaagggaacacccctacgaagagaccacccatccttcaagcagggttaacactgccaccaccatgttcacacacagcaagaaggctcagctgatggtgactgcgtgtgacatggatcccagcaagctgtctgtcttcctgcctgccctggattgtaagatgggagttcctgactgcattaatgaggggaaggcaagactggggtactgagtccacaggaagaccagcaccactgttaccttcacgccagttaacttgggagacaaaggagctttggctaagctggtggaagctaccaggaccaattaaattaacagatatgatgagatctgtagtcactggggaggcaacatcctgggtccaaaatccctggcttgcattgccaaagctggaaaaggcaaagactaaagaacttgccaccaaactgggttaaatctacactgctgagttttctgtacataaaaataattaaaaattctcctttaaaaatatcaagtagctgcttctttagagctaggcaccggattacccactgggaatacaattgcgagcaattctcttaaaaaaaaaatagatatggccaggtacagtggctcacgcctgtaatcccaacagtttgggaggctgaggcaggtggataacctgaggtcaggagttcgagaccaacctggccaacatggtgaaaccccgtctctactaaaaatacaaaaaattagccaggtgtggtggcacatgcctgtaatctcagctacttgggaggctgaggcaggagaatcacttcaacccaggaggtggaggttgcagtgagccaagattgcaccattgcactccagcctgggcaacaagagtgaaactccgtctcaaaaaaaaaaaaagaatcagctcaaaagaatcctgatgtcaaagagacacatctggggacagcatattctggtcccctacacaggaaatgcacagatcttgaacacatcggcagaagcaggcttctcttgtctcctggtagcatcattacccccaactgtcttcacgctcattcaccaaaaattatttatttcatcaattcatcaatttttgcttgtcaaaaattggatatgatattggcatgcatctatggggtactgattaataataataatagagttttttttttaaaaaaaaggaaggccaggcaaggtggttcacgcctgtaattgcagcactttgggaggccggggtaggcagatcacctgaggtcaggagttcgagaccaacctggccaacatggtgaaaccccgtctctactaaaaatacaaaaattagccaggtgtggtggcgcatgcctgtaatcccaggtacttgggaggctgaggcaggagaatcacttcaacccgggaggtggaggttgcagtgagcacagattgcaccattgcacaccagcctgggcaacaagagcgaaactcagtctcaaataataatgataataataaataaaagatggaatactacacagctacagaaaaggaacacaggagtgcttaagttccaaaatggcatgatctctaaaatatatttttgtgaaaaaacaagatacaaaacaatggatttaatgtgccaaattttataccacaggggagaaatgtataagcacacctcctgtgtgtccacagacacctctgttttcttgcttgtatcattggttgcctccagggaaggaaaccaggtgcccacaaaactgagaagagagtcttcacgaaatctctttctaaaccttttaaatgtatcacctattcagaaaatgaatggaattgaatttacaataaaaatagcactaaaatataaaataaagtggaaggatctgttgtccagagagatagagacagggagagggagtgaggcctgtgccaggctgtagatgcagttgttgtgattgagttttctggcgccaggctcgtgggctgaagccccagctccacaagttactagctgtgtgctctcaggcaagttacttaacctctctgggcccgggccacctctgtaaattaagcatcataaaattacccccttcatgtggttgttaggcaaattaatgaatatggtaaaatgcttgaatacagggtctggcccagagtaggttgtgtaatcatttctacagctacttttctccatcccgggctgctaatgacatctgtatgattagcagtactctgcgctgagccctgaggatgctggggaggtagtgatgcccaaggaggaactctccaccccatagcataggaatggccatacatcctagtagggtgaggactccaggctgggccactgcagagaaaggcgccagccccagttaggaagacgtctacacgatgtgttgcctgagaagagtacaccagcctctctatgccgaagcctggttctactccatcctggctactggacctcagataagaagtcattgaactgccctgtgcctcggtttccccatctggaacaacagtatattgatagtgtcaacctcggagagctgttgtaaagatcaagtgagatgatcctatgaaactctcagcacaggcagctattattattattgctgctgttgttgttgttaaggagcgaggctctgaggagtgggtaaggataaggtgggtacagataagcatgggatggtgcacgcgagaagcaaagtttagtgtttttggaaagcagaaaagggctcagcgagtcagtgtattaattttctagagctgccatcacaaagcgccacacaccaggtggcttctacaaccgaaatcaaatttctcatggtcctggcagctggaagtctgagatccacgcgtcagcaggattggcttctcctgaggcctctccccttggcttgcagacgccatctttaccctggatactcacgtggtcgtccctctgtgcgtgtctgtatcctaatctcttcctataaagacgtcaatcatattgcatgaggcctaccaccctaacaacctcattttacctgaattacctcttcaaggaccctatttcaaaatacagtcatattttgagggcctgggggcgaggacttcaatatatgcatcttggaggacacagcctcgcctgtaacagccccaagcccaggaggtgggctgggcagtggtaagaggaggctggagggtttggtaaaggctggatctgggggtctattttacaccacagtcagcagcctggcttccaccctgagtgcggtaggagcccccatgggtcacaggagggcagggtcacactctgtgtccaggcaggacggcaatggctccctgtgggcccaactggatgctagaggaggctgtgtggaaatccaggcaaaggctggagacacggctgggtcagtggggtagacaggtctgggtggaagagagtttgcacccatgccatcaacgcatgagcatcttggcttccacctcccctactagcaacaaagctcgtaaatgagctcgcacccctgcctctcccctccgctccccttctccatgggaggaaaagggactgggtctaatgccgtttctttctcaagctctgcctgtgatttctttcctgttgtagattttagactaactctgtggcgccctctactgaccaggtgcgtctcgcccagagcgctgtccagccccttgaggtccagtcccgcggtctgaggccaccgtgactacagacgcttgaagaggagctaggggaattgaggtgggctcaaaggaaaagcacacgccggatctcagagactttgttaccaaaaagcactggaaaatatctcgttaacagtgttgtgcaatggctgcatgttgattacatcatcgtattttgaatatattgggctaaataagatacagtctttttttttttttagtcggagtcttgctctgtccccccaggctgaactgcagtggtgcgatctcggctcactgcagcctcctcctccctggttccagcgattctcctgcctcagcctcccgaggagctgggattacaggtgcacgccaccacgcgcagctaatttttgtatttttagtagagacaggatttcaccatgttggccaggctggtctcgagctcctgacctcaagttgatccacccgcctcagcctcccaaagtgctgggattacaggcatgagccaccacgcctggccaagatacagtcttcaaattatttttacctgttcttttttactttattaacataggtaccagaaaactttaaatgatatttgtgactcatataatatttctttatttccccctgctttagactattataaatgtaatgtatacataccagggattcgcaaattcggcactattggcatttggggctggataactcttggtgatggctctgtgctgtgcatttgtgggatgttgagcagcaaccctggcttctacctatgaaacgtgagtgtccctgcctctcacccaattgtgacaaccaaaaatgcctccaggcattgccaaatgtcccctggggcacaaaatcactcccaatctagaatcattgaaatatatatgtatatgaaaaagagacattgatgaaatgaaaaaccatgaactctaaggacttttgactcttacagagcaccatcctgtgtgagctccgtgttgcatgcccacctgtgtttccctctcagtcctcataatgaccctacagggtggacattatcattatgccctttttgcagatgaggaaactgaggcactgggtggttaagtgactggccctgaggtgcactgctaatgggtggcccagcccagacccaaatccaggccacgtccccggtgtaagagaggcgagcgtgtgcctggcacctgcagacccacggtgagaacccagatctccactgagtgccccatccctgacgtggaacctgagtcctccctttggggaggaaggtgaagaagtgggtaggagtcacgattaactttacctcccttggtggccaaaagaaaccagaaaataagctccattccaaccccttcctgtggaattatgatagagcaggaaagcatagcagagcacggtggctcacacctgtcatcccagcactttgggaggctgaggagggtggatcacttgaggtcaggagttcgagacctgacctggccaacacagtgaaaccccatctctactaaaaatacaaaaattagccaggcgtggtggtgtgcacctgtaatcccagctacaagcaggagaataccttgaacacgggaggcagaggctgtagtgagccgagattgagacactgcactccagcctgggagacagagcaagactccatctcaaaaaaaaaaaaaaaaagaacaggaaagcaggaatccattcattcattcattgcagtcaggtcgtgtgtatggaggccctgctgtatgccaaagtctattgaaggcagtgagagtgcagccatgaagaaaacaacacagctctgctcaggaaactcaccgacactgaacaaggatggggaatcacagaaaaaggaatttaaaattaattaattaattaaaaaaaggatttcaggcctagacaagttatttggagaaaataagacagagaaatgactagcatgaggacagacgtgaaagactccagaaacatttttctaaggtgtctcccgggagtcacatgtttaatccgcattgcgggtgattctgcagtgagggagggggcttagggcatccttggcaaaccctgccttggacccagcctgggttagcccccctaggcccatggggggttcagggtggaggagaagcagcctccacccagaccctcttctgtgtacccaacccccaagtctttagggagtccccgcggtgaggccaggctgggatctgaacccgcaggcatgcacaggctaagccctgagcctagaaaattccaggccccgcatccctccagcattggcacagcccctcctcttctccgcggtttccatggcaacagctgtcgccaggtgagatctctcaggggactgagcctcccaggagccaggtggggatggggagggctgggcgcattcatagtccactcttgactttgatgcagttaaacgcatcctcagacaggggtctttgcagaacagggcagaaaaacaggcctgtgcgggtctctgcagcctctggtagaaatcccagatcgccagaaatgactagtgacagaaatgatatctgtccgccctttcactccttcattcattaaaccacttaatttttgcataaagatcaattcgatcagtatagatgattaatatgagagttttatgaatctattaatgctgtatctatttcgagctgctggcattgttctagggagacagtattgatgaagaaaatacctgcagtgcttccttaacagggttggcttagatggggctgccgcacaaaacaccgcggaccccgatatgtaatatgatggcaggctttgaaaagttctgtggagacgagtaaagcagcccgtgttgtttgggatttaatttccttcattgtgaagtggtgatacattcgcagagtcaaaatgacattttaagatgtgattttaactctgcgactggaataatttctggggaaacattgtgtaatgaaaattaaacctcatgccctcatcccaaggcacccgacacccctcccggaagccacgtctgttccacgttccacattccttcttgaataattctgagcacaccgtattgtcagctgccctccccaccattttatttatttttattttttaatttttttttttttgagagttttgctcttgtcatccaggctggagtgcaatggtgcaatcttggctcactgcaacctctacctcccaggttcaagcgattctcctgcctcagcctcctgagtagctgggactagaggcacctgccaccatgcccagaaaatttttgtatttttagtagagacggggtttcactatgttggccaggctggtctcaaactcctgacctcaggtgatccgcctgcctgggcctcccaaaatgccgagattacaggtatgagccaccacgcccgaccagtctgtgtatttgtttgtttgtttgtttattgagacagagtttcactcttgttgcccaggctggagtgcaatggcacgatcttggctcaccgctgcctcccaggtacaagcaattctcctgcctcagcctcccaagtagatgggactagaggcacctgccaccacacccagaaaatttttgtatttttagtagagacggggtttcaccatgttggccaggatggtctcgaactcctgacctcacatgatccgcctgcctcggcctcccaaagtgctgggattacaggcataagccaccgcgcccggccggcatactcacttttcatatacaattagagcatcccattgtgtcattgtcctataactcatttaacctatctcctcctcatggatgttcagattgtgttcaatctttcatcataacaaatgctaatgctgctgcagtggattaccacagaagcatgttccttcacacatgcgtaagtaaatccgtacaatatatttctagaagtggaatttctcagtaagaaagtacaggcatccacattttgctaaagtgcccaccataaaggttgttccacgttgcacgtccaccaataacatatgaaaattcaagcgccattgaaacccataaaatatggattttcccttgaaaaattagaagagctaacaacactgggtttgatttcagcttgggaacaattgggtggtgtctggtggtactgcccacttcagcaaaacacactctctcccttttttccacactccccacccctccctattacttcccaatgcccccactctgtatcagtgtctgattaggatcatgcttgaggtgaccattgccatttcataggtgacgttactttacaaccttgagaatattgaggccaaaagagtcacttatttgaagaaaatgccagaccctttccaaccaaaatggttgtgccattttatactcccaccaacactgtgtgctccttccagccaccccacatcctcaccaacatttgatgttgctaatctcttcatttttaccgttctggtgagtgtgtcgtggcagaatcacttattttaagaaaaataaagggccaggtgaggtggctcacgcctgtaatcccagcactttgggaggccagggcaggtggatcacttgacgtcaggagttcaagaccagcctggccaacatgatgaaaccccgtctctactaaaagtacaaaaattagccgggggtggtggcaggtgcctgtaatctactcaggagtctgaggcaggagaatcacttgaactagggaggcggagcctgcagtgagctgagatcgtgccaccgcactccaacctgggtgacagagcgagaccctgtgtcaaaaaaaaaaaaaaaacaacttgcatttggcccgggcgcggtggcccacgcctgtaatcccagcactttgggaggcagaggcgggcggatcatgaggtcaggagatcgagaccatcctgactcacccagtgaaacctcgtctctactataaatacaaaaaattagccgggcttggtggcgagcgcctgtagtcccagctactggggaggctgaggcaggagaattgcttgaacccaggaggcggaggttgcagtgagctgagatcgcgccactgcactccagcctgggcgacagaacgagactttgtctcaaaaaaaaaaaaagaaagaaagaaagaaaaagaaaagaaaaaaaagaaaaatgagccaaggaggggaggctgtatctttatggaaatggagacattccacattgttgaatacacacaagccccgcccactctctccccctgcaggacctccccagcctctggggtggaagtctttgccttgggcttcagaaatgtctgagaacacgggagtgagctcttcatccaggtaagtcatgtccccacgggttgctcctcccactttactgttcccttcccttgattctgggtctagacagagacattctcttactacctggggaggttggggcagaggtgggtcctttaccttccagagtctggagagtaaccaggatttgcttttttttttttttttttttgtcggagtcttgctcagtcacccaggctggagtgccataatagctcactgcagccttcaactcctgtgctccagcaatcttcccacctcagcatcccgagtagctgggactacaggcacgtgccactacacccggcaaatttttttttttttttttagatggagtctcactctgtcacccaggctggaatgcagtggcacaatctcggctcactgcaacctctccctcctgggttcaagcgattctcctgcctcagtctcccaagtagctgggactacaggcatgtacagctacgcccggctaatttttttttctctttctttcgtagagacaaggtcttcatatgttgcccaggctggtctcaaactcctgagctcaagtgatcctcccatctctgcctcccaaagtgctggaatgacaggcatgagtcacctcactcatttttgcattttcaatcatccatctccctaatcctccccatttgatgcaagtgaagttggggacacattgaaaaaaaaatcctggctatgctgtggcaggcatagtgcccagtgattcacaagcagcttcccactgtcatcctcaccacaacctacagattcaaaaaaaaaaatgtttacccagttttagatgagaaaacaggctcagaaaagtgaagtcactttcccatgattccgtactttattttgttttgttttgttttactttattttttgagacagagtctcactctgttgcccagcctggagtgcagtggcacaatcttggctcactgcaacctccacctcccaggttcaagcaattctcctgcctcagcctcccaagtagctggaattacaggcaccctccaccacaccccgctaatttctgtatttttagtagagacagggtttcaccatgttggccaggccggtcttgaactcccgacctcagatgatcctcctgcctcggcctcccaacgtgctgagattacaggcatgacccgccatgcccagctgtattttcattcacgctcctaacacacacacacacacacacacacacacacacacaaatcattataggcactcattcatatggcagctcaggattctaacccacacacagcctggaaagttccatcctctgagtgcctctcagcctcctccccatctcctcgatgcagtttccatagcaacaggcagagcctgcctgcatcccagacccccagcgaaggctgctaaggaccagggcagggcgatgggggagaagccgagcagggggagggagcaggcctactgtaccccatcggagattcaggttgggcatattaaaacttaaaatgtgcacatttaaaatgatgtccttgacgaagggcaaaacccagccatgtgtgctttgccaacaggcgtggaaatcacaggtttctgttccgtggcagccgccagcaccgatgatacaaacagcctttgttgtctaaagattagtcatttgattgactgattataccaacaaatatttgttgattgcctactgtttgccagaccttgtgcgaggcggcagcatccaacacagatgtagtctttgttctcattggagttgacaacttattgagacagataataaatagatattgaagtggatatagctatagagctagggctggagactgaggaaagaaaagaacttctgtctgaggaatgtgagggctttcaaatgatcggggccggagaagcattaaaatgacgcagcagtcacaccctactcccagctttcagaatctcttgaaactgcttgctattgccataagtagctgcaaattaaacagtccccagtgggacactaaaacccataccctatagcttaacaattgtcagcagtaaaaaccagattctgccaaatatttaaagaggtttattgtgaaccaggatgagtgaccgaagcctggggttacacagtctccagaggtcctgaggaggtgcgcctgaggtggtcatgttccggtttggttgcacacatttcgaggagacaggaattgcaggtaaaatcataaatcaatacactgagggtatacatgagctcggcctgaacccgtggacatcttgaagtcaggggcttacaagtcatagtaggttttaaagattcttttttctcactccttcctgcatactgaaaacgtttcttgaggtgtgtgtgtgtgtgtgtgtgtgtgtgtgtgtgtgtgtgtgtgtgttttgacacagttctcactctgttgtgcagtggcatgaccatggctcactgcagccttgacctctcaggctcaactgatcctcccggctcagcctcccaagtagctgggaccacagatatgcaccaccacccccgcctaattttattttactttttgtagagacgggttctcgttgtgttgcccaggctggtctcaaacttctgggctcaagcaatctgcctgcctcagcttcccaaagtggtgggattataagtgtgagccactgagtccagccttaaggattctttagttggcaatttgaaagagttacactttgtttaaagcaactcagtagaaagaaatgctgaagttaagggggtctggtctccatcacacgatgctataccagagatgggttggaagtcagccacctgatactgcgttaataaaagaacctgcttaacaagattttatggtttgtagagtgtgactacctgggccacctagataggaatttaggtaagagagaaaaaggtcgcagagtcctcacaatgcacacctaatcactaaccaatgttatttctgtaaattgtaaacaaaaaaataaaattctaagccccccaacctactgatggaccctcccctcagccaggggcattccaaagttaacctgaggctgggtgcagtggctcatgcctgtaatcccagcactttgggaggccaaggcaggaggatcacctgaggtcaggagttcaagaccaacctggccaacatggtgaaaccctgtctctactaaaaatacaaaaattagctgggcatggtggcacacacctgtaatcccagctactcgggaggctgaggcaggagaattgcttgaacccaggaggcaaaggctgcagtgagctgagatcgcgccattgcactccagcctgagtgacagagtgagacgccatctcaaaaaaaaaaatccacttgtggctgggtgcggtggctcatacctgtcatcccagcactttgggaggtcgaggcgggtggatcatttgaggtcaggagttccagaccagcctgaccaatatggtaaaaccccatctctactaaaaacacaaaaattagccagcatggcagcatgcacctgtagtcccacctacttggggggctgagacaggagaattcctcgaagctggaagacagaggttacagtgagccgaggcaacagggcaagacaccatctcaaaatacataaataaataataaaaataaataaaaattaaaattcacttgtaactgctgctaatcagagtgtgaatcaggggaagtcaaatctgtgctcttgggttgtaatcctcaagcttggcccaaataaactcttaaattagttttgcctcagcttcttccttttaggttgaaaggatagagacacacacatatatgcatacgtattttaccataatctatatgtacataggtagcaccatatagaacaaaattttttgtagttttgtcttttgacattggaaagcacagctctaaaaactactaagaaaaaatatatcaggataaaaataaaaagagcagcagattgtgacggtgaatgaatactttgcacaaaatattttgtttcaggacgtccaggtcgtagccaggaattgacatttcgacaagcccctacctgaaccaggtgaccaccttggtagcagaccccaggcaggcaggcaggcagggagtcctcagatcctcccaacagccctgctagctaaggatggtgatcacacctgctgcagaagagtggaccgaggcttcagaggggaaagcagtgaccaaagatcagattgtgcctctccatctcttcccaaataataaatacaggtatttattgtacccctgctctgtgcccacacggggcttttacatccacgcattctgtgctcaagggcatggaaaattccagcctgaaagccttgcttgccccatcctgtcccccacactgcagtggtttccatagcaacagtcttggtcgcaaacatcccttgagtcccctgaaggggaggaggagtggttgatgtcagaatagcctgggctgagggtggtgggacaaggggaaggattgaattctgcaattcccaccccaccccatattcctggttcactcaagcctttagggttcattcaaggtctccttgaatggggttttcgtagaagaacgaaaaaggacctgggcatgcaagtggctgctggctcaaaaaaaccaaacaaatagaaatcccaggttctccatggagcagctgccgcaggtgcctgtgacacccccagcatctatgcccacctttcagtcgcgcctcattcctcctccaacacaagttgacagagagcatattatgtgccagggataatgttaggcacttgagcataatttcaaaaacctgctatgatgaataaaaactggtctccaaaagcctcaagtgtctccccaaaaaaacacaaatgcatgaggtcctcttattctcatttcaaaagatgtggggaccctgttttctggcacgtgggaaccccaaacacctggaggaactaagaggaaatgaatgaaactcaagactcaaccatcacccaggacccaaattacattacttttgagctcagcagagtggggaaaggtggccagtggagaccgttaagggagacacattcagaaattaactgctgttgattgcaagatgctgcgatgattcaacccaactcaaaaatctcaggacatgtgcttcccagttgaacttttgatggttggagagattctcagtaattgtgtatggcagaaaaagaagcatatggtatatggaacacacagcactgaacatctgcttgagcaaatgtttgtttcttttttcttttccatgaaactgcataaactgtcaacgttttattctaatgattatgggccttttcatgggttatgtttttttcaaaagcatgcccatcctggctctaaaatatcacggtcctcaacagatggtggcagtttagaagggagcgtttgtgcaaaaggccatggagaataaacttaaggtgtttgtcttcagagagagaacacaggctgaagaattaaaagagaatgacaaaaacccacacagataggtgttctgaaatataggccaggtgcagtggctcacacctgtaatccatgcactttgggaggcccaggtgggtggatcacctgaggtcaggagttcgagactagactagtcaacatggtgaaaccctgtctctaacaaaaaatacaaaaaaaaaaaaaaattagccaggcgtggtcgtatgtgtctgtaatcccagctactcaggaggctgaggcaggagaatcacttgaacctgggaagtggaggtcgcagtgagccgagattgcaccactgcacaccagcctgggcagcagagcaagagaaagatcgtgccactgcactccagcctgagcgaaagaaagaaggaaggaaggagggaaggaaggaaggaaggaaggaaggaaggaaggaaggaaggaaggaaggaaggaaggaaggataaaagaaatatacagggtataggggagttagcaccagcctgggccacattatttattccttctggcatccctctgcctggtcacaagcaaacttaaaacattgccagctctgtgttttaataataccatgtcttgtaatagcaaatgactggggaaaaaacctcaatttccctccagagggggctggccaactaagttctgataaatgcattcgatggaatgttatgcaactgtgtaaaattctgaagaagttctttaggggctgaacaagcagaatatacagtgaaaggatatataataatgaaaagggttgctatgattgtgtaaaaggaggaaaagagaaataattacattgacttggtccagaaggaacctgaactgtaaatcacagttccatgaggcaagggggtcagattttgtagcccctaacatcaaacattggctgcccccaattgtggggagagatgaggtaacctcccgggtgtctgtggatgaggtggttccaggggcagctcttcagaggacaaggtcattagctgcgcctcacccacactgcctgcccaagtggggttggggcatccctgtgtatgtgctttcagaatttcaaacttccttccccatgaacggagtcctgtatttcatccgatggacgatgctgtccactgtggaggcaccattatttcctagccaggaagaacaataaagcatggtcaattaatgcaactgactgtaaaaggcagcccaattcctgagactgtgtaatgagtggaaaaaagtgagcaaagtggggaagaaagcaaaagcatcttaaagtgaaaaacatgcattagctgtcgtaaacaaacacacacaatgcccagggcactcctcccacagtggagcactcactaaatgaatgaatgacaggccctaccacaccccaacacacacacacaatctacccagtgtgggggggctcttccccagaactcctcccacagtggagcactcactaaatgaatgaatgacaggccctaccgcaccccaacacacacatacaatctacccagtgggtggtgcttactgctcagctgagtactgctaaaaattgccgacaagacttactctctgggtgatttgatgaaatccttgatgccagggggaccactgagtttaacgggcgtctaatctcctcacacacccccatccatgtcaaatgggaggccaggcagggcacagtggctcatgcctataatcccagcactttaggaggctgaggcaggaggatcacttgaggcctcaagtgaccaggagttcgagaccagcctgggcaacacagcaagaccccacctccacaaataattttaaaaattagccaggcatggtggtgcctgcctgtggttctagctacttgggaagctgaagtgggaggatcgcttgagcccagaagttggaggctgcagtgagctaggatggagccactgcattccggccagggtgacatggtgaaaccctgtctcaaataataataataaaatataaaagggaggccaacaggctctggcagagaccttctgggcaactccaccaagaaatcaagtccccatctccagaaaccccactttgaggtccagctcatggcttagctgcaggcgagataggatagacaaagagaccatgtgagtcagggtcctctggagacatagaagcaacgggacattcattcattcattcattcattcattctcaggaattggctcttgcgattacagaggctgagaaatccagacccaagagggccagtggtgtaaattccagtatgaatcttcatcccaaggcagaggcagtctgaggtcccaactcatgcagtcaggaagagaggaaggatcctttctcactcagctttttgttttatgcaggcttttgactgatgagacaaggcccacccacactgtgtagggccatctgttttagtcagggtatagatttgaatgccaaactcaaccagaaacatcctcacagacaccccagaaatgatgcctagccaatatctgggcaccctgtggtccagtcaagttgacacaataaattaaccatcacagatactttttcatacattttattattgtactaaatattcttttgataaatttggaatttagggtaggttgaagactgtgaggagggagtagagtggggaaaaggaggatttgaggtaagatatggttttgggggcaagatgatataaacttttattttgcaaaaatttcaaatttataaaagcaatttcaggaatgatgcaaataactcccatttaaccttcacccacattcaccaattgataacattttgccacattttctatctctctctcactctttttttttttttgagatggagtcttgctctgtctcccaggctggagtgcagtggtgagatcttggctcactgcaacctctgcctcccaggttcaagcaattctcctgcctcagcctccgagtaactgggataacaggcgtgcaccaccaagcccagctaatttttgtatttttagtagagatagggtttcaacgtgttggccaggctggtctcgaacccctgacctcatgtgatccgcccacctctgcctcccaaagtgctgggattataggcatgagccaccacacccgacctctctcactctttttctatctctttagtgtaagttgcagatatcatacccctctgctcctaaatttttccgtgtatattttctaagaataaaggcattcttttttcatagccacagtacaatgattacattgagaaaatttaatattggctgggtgtggtggctcacgcctgtaatcccagcactttgggaggctgaggaaggcagatcacaaggtcaggagattggctaacatggtgaaagcccatctctactaaaaatacaaaaaattagccaggcatggtggcaggcacctgtagtcccagctgctggggaggctgaggcaggacaatggcgtgaacacgggaggcggagcttgcagtgagccgagatggcgccactgcactccagcctgggcaacagagtgagactctgttatatattattatataataataataatattgaggcattatattcattttatgcatagcccatgttcacacacaaattattccaacaacttacttgatagcattttcccccaatcctggatcaaacccaccgcttgtttaaagtggtgtctggcactgtgaagttatttcccctcgggattaattgtctgtggaaactgctttgaggctatggacggctcctgcgtcttctcatgcttgtgcccacgaggcctaggatcctttgatggttcttagatgctttgatggtcctggatcagatccaggatgatgcattctgtttagccatcttgtctcttgagtctttctaaatctggatttgaaacctcagctgttcctcatcttcccgacactggcgtttttgaggaatacagagattccggagaaggtctccacaatccaggtcatttgtctgatgcttccctgttctttatttcagatttgcattttggttcaccagtgacttttttctttctcggcactatgttcaactcgtgatgacagttggttccaatggtggtgatgtcagctttgatctcttgttaaatgtggcgtctgccactgtgaggctcatttccccttgtaactagtcatctgtggggaactcccatgaaatgacaatgccctgcttctgctcatgctcatgtccacggggtctagggtctagggccctttaataattctctctctctccttttttttttttttttctggagacaaagtttctctctgtcacccaggctgggctgcaatggtgcgatcttggctcaacctccacctgcccggttcaagtgattctcgttcctcagctgcccaagtagctgagattacaagcacctgccaccatgcccagctaattttgtatttttagtagagacggggtttcaccatgttggctgggctgatctcaatctcttgaccttatgatccgtccacctcagcctcccaaagtgctgggattacaggcgtgatctctctctattttttaggagacaggtctcactctgtcacccaggctggaatgcagtgagttcgtgatcattgctcatcgtaacctcaaactcctgggctccagtgatcctcccaccttccctccctagtagctgggactacaggtgtgcaccaccacacccaagctattaaaaaaaattgtagagatggggtctcgctatgttgcccaggctggcctcaaactcctgggctcaagtaatcctcccatctcagcttcccaaagttttccaattacagtcatgagccactgtgccctgccctttaataattcttgcttgaaatagttaatactgtggtggttgctaggtgctaagtttctaactcaactcctccttctgtatttatttgttggaattcttagccagaatttagcttttgctgcccaggctggagtgcagtggtgcaatctccacccactacaatctccacctcccgagttcaagcgattctcctgccatagcctcccaagtagctgggattacaggcgtgagccaccatgcctgactaatttttgtatttttagtagagacggggtttcaccatgttggccaggctggtctcgatctcctgacctcaggtgatccgccctcctcagcctcccaaagtgctgggattacaggcgtgagccactgcgcccggcctgttggaattcttctgtgaggctctgcttccttttctcacacatttattgattcagtgttgattttagggattctgactttagtttatgggttataatttattacgagcagaatttattttcactgaaactgttctggttttgaagtgggaatcccttcaagctggctgctgtatcttttagacatttttttaaaagctcttcttactttcaggtacaataagacgttccagtctcctactgtcctttccctgcccagcccagcaatcagccacttctccaaggagccctggctcccctgagtggagaatcacatttagaaaccagcatctgagctctaagcgtgctgtctcataagctatgtttgggaaagtaggctttatcctgaagacagcaaagttttaactagaggagtgatataatcattatctgcatttttaaaaacttatttatttatttatttagagacggagtcgcccaggttggagtgcagtggcgcgatctcagctcactgcaacctccgcctcccaggttcaagcgattctcctgcctcagcctcctgagtagctgggattacaggcacccgccaccatgcccagctaattttgtgtatttttagtagaggtagggtttcaccatattggccaagctgatctcaaactcctgagctcaggtgatctgcccgccttggcctcccaaagtgctgggataacaggcgtgagccaccacgcctggtcattacctgcatttctaaaagatgactccagcagctaatgtggaaaatggattggagagcccagtgtttccagaaatacagcccttcaagatcagtcatttttcaacaacatggatgaccctggagaacattatgccaagtgagataagtcagtcacaggacaaataccacatgatctcccttctatgtggaatccaaaaggttgaacccatagcaacagagagtggaactgtggttacctgagactgggagatggggcgggttgaggagatgttggttaaagggtgcaaaatttcagttaggaggaataagttcaagaaatctattatacaacatggtgcctatagttaaaaacaatgttttgcattcttgaaaattactaagcgagtagatttttttttgttccctatatcttagtgctcagaagaaagcagattttaagtgttctcaccacacataagaaaatgacaagtacgtgcggtaatgcatacattaaatagcttgacatggtcatcccacaacgtccacatatatcaaaacataatggttgtaccccataaatatgcgcaatttttatttgtcaattaaaaataaataataaaaggaaattaaaattgtatttaaataaaattttattttattaaaaatatgaatatatggcacttcatgtcccatcttgacgaattttgccgtattggtgtctttactaggatattagacacaatattttttcctttaaaatcagtctctgtgatgaagggaatttaagaatcactatcatgaatggaaacactggtttcacttaccataagtggaaaataaaaatagacacaagagaaaaagctcacaaaaatgtgtgtgtgtgtatatatacacatttttaatatatatatacacattttatatatatatacacattatattagatatgtatatatatattagacagggtatcactccaatacccaggcaggagtgcagtggtaccatcatagctcactgcagcctcgacttcctgggatcaagcaatcctctcacctcagcttcccaaggagctgggaccacaggtgtgcaccaccacgctgggctgattcttttaaaattttttgtagagttaggctctcgctatgttgcccagactggtttcaaactcctgagctcatgcgatcctcccacctcagcctcccaaagtgctgggtttatagatatgaaccacctcacctagccaaaaatatcttttaatattgattatatactgctgccagccaaggttctgagcccaagacctcttttgattttgtggagttttttttaaattttgtttcattttgttttggttcacagaagatgttggcaataccgttaaagacgttcaaaccacaccaagacattatcctttatgaaacacaaaggttcaaaacatactgaaaaggggccgggcgcggtggctcatgactgtaatcccagcattttggaaggctgaggcaggcgggtcacctaaggtcaggagttggagatcagcctggccaacatggtgaaaccccgtctctaccaacaatacaaatattagccaggcgtggtggcgggcacttgtagtcccagctattcgggaggctgaggcaggagaattgcttaaacccgggaggcggaggtttcagtgagtggagattgtaccactacactccagcctgggtgacagagcgagactctgtctcaaaaaaagagaagagaggggagagggggaggggggaagggagagaagaggagaggagaggagaggagaggagaggagaggaggggaggggaggggaggagaggagaggagaggagaagagaagagaagagaagagaagagaagagaagagaagagaagagaagagaagagaagagaagagaagagaggaagaaactggaaagggtttctttgttcttttgtgatttgagcatgacttttttttttttttgagatggagttttgttcttgttgctcaggctagagtgcaatggtgcgacctctgctcaccacaacctccacctcctaggttcaagcaattcttctgcctcagcctcccgagtagctgggattacaggcatgcaccactaggctcagctcattttgtatttttagtagagacagtgtttctccgtgttggtcaggctggtctcaaattcccgacctcaggtgatccacccgcctcagcccccgaaagtattgggattacaggcatgagccaccacacccggcgattcaagcatgacttaacgccatctgtctggcatcttaatttaatcacttgagagcagccatggggataggtcacatcctggaaagaggtgcaaaggcaagttaataattcagtgagtcattcagtcccgaatgtgagcagagagagggggcaacgtggagggagctgcaggcagctcttgggaaggtgaagtccacaggacctgggatgggattggacgcttaggcgagcaggtgagcaggagggacttggacctgagtaacttggtaggtgagggtggcctttggaggcaggcagggcagggaatctgggtgggatcctgggaggtgtccatggtcatcctcggggtgcaatggtgggctggacccgggagaaggcaaatggtttggagaacaggctgaacaggttttttagtggaggaagacaatacgacttgggtagagcttgataaagacagaagggttagaagctcatttcttcgtgagcatgcgtgcagggaaaacaagccatgaggagttgacacaagtttcagtggctgctcagaacctctgccctccagaccccacggaatttccagagtggggcagtgcgtacatccctgtaatcgaggaaggccgcaggacagtggaggcgccatctccacacctaaaacacctaagtaatattggccagtttcacacattatcaaccctagtttttcttcttaacttgcttctccctaaactgaaaacagtgggggcagtgatttgcggggttttttgtttgttttgagacagagtctcactctgtcgcccaggctggagtgccgtggcgcaatctcggctcactgcaacctccatctcccaggttcaagcgattctcctgcctcagcctcctgagtaactgagaccacaggcacctgccaccacagccggctaatttttgtgtttttagtagagacagggtttcaccatgttggccaagctggtctctaactcctgacctcaggtgatctgcctgcctccgcctcccaatgtgctgggattacaggtgtgagccacggtgcccagcagttttttgtatattaccttttcttcttcagttcttatcatggtgtcaagcacacagaaagtgtccaaagatttagccaggcacagtggcacatgcctgtagtcccagctacttgggaggctgaggtgggaggatcacttgagctcgggaagcggaggctgcagtgatctgtgatagcaccactgcactccagcctaggtgacagagtgagactccatctcaattaaaaaaaaaaaaaaaaggaagtgtccaaagaagtcggtttgccagagtgatttgcctaacacattcaggcaaagtagtgagcattttgctttctgtttttgtctcactctgttatgggctgaattctttctcctcccaccccatcaatccataggttggcatcctaacccccagtacctcaggatgtatttggagatggggtctctacagaggtgatgaaggtaaaatgaggccactagcgtgggccctaatgcaagctgtctggtgtccttataagaagaggagatgaggacacagacacacacagaggggagaccttggaggacacggagggaagacggccgtctgccagccaaggggagaggccttgggggaagccagccccagatcttggacttccagcctccaaaactgtgggaaaatatatttcttttgtttaagccacatggatcgtggggctttgttaaggcagctgggcaaaccaatatccactctgtgtttatatcaatgtgtattttcatacaattatgtacagctacaaataggaatgcactcacgcatgtttattggggcatcagtaaagcaaggaggttggagtctatgtcttcaggaactaacgggaaccttacggctctactgtagggagggcccctggctggggtaggtgggtggagagtcacagctcctgtctccacagctttccctactcacatgggcagcttttcaccttctctccccagatatgatttccatggctacagggcgatgctcaaatgagtcctcttgaagaagcaaggacaaacagcttaacaaatctcaccactgtactccagcctgggcaacagagcgagactctgtctcaaaacaaaaagcaaaggagccagcccggggatggggaggacgggggcagggcggcctcctatcccccgcttccattaatagactccctcttaccttttctttcttcagtagagacagggactcactgtgttgcccagccttgtctcaaactcctgggctcaagtgatcctcctgcctccacctcccaaagtgctgggatgacaggtgcgagccatggcacctggccctttgtgtcttgtatccaactaaaatgcatcctcagatagggtctttgcagaagagtgaaggttgtctgggtagggcctctagaaatcacccacatctggcaagggcatgacctgttctctccctgcggatgcactcattccctgaatcccgggtccaagattccctccaaagaattccaggctctgggattaaatctatgaaccatctcttaccctccaacgaaatggggtcagcacaccacacattcatcagtcaaataattatgagtgtctgtatttccctagcaagaattattgtttttgtatctttcgttttttgtttgtttgtttgtttcgagatggagtctcgctctgtcacccaggctggagtgcagtggcacgatctcagctcactgcaacctccgcctcccgggttcaagcgattctcattcctcagcctcccaagtagctgggattacccgcatgcgccaacacgcccagctaatttttgtatttttaatggagacggggtttcaccatgttggccagactggtcttgagctcctgacctcaggtgatccacctgccttggcctcccaaagtgctgggattataggcatgagccaccatgccggccaagaattctttactgggcactaaatatatgccagagacttggtggataaattcttatggaggtaagggtctggtgagggagagagatgataaaaaagtaagtgacaaggaaagaagttatctttctgaataagtcagataaaagcagtgtttaagtcaatcaaaacggaggccaggcctggagaatccctgtgcagaccacaccagcctcttgagtcacctcaaccctgctcgatttgcatacataagtgaaacttaacttgagctatttcttgcaaaggcgtacgttaaagaaaaacagtttgagctcactggaggtttaaactcttggactcaggtgatcctcctgcctcggtctcccaaaacactgggattacaagtgtgtgccaccatacccagcctccagtgaccatttacaaatttacaactcggtggcattgagtacattcacagtgctgtgcagccgtcaccaccatttagttccaaagcattttcagcacctcatgttagtctattcaggctgttacaagaaaattccaggctgggagcggtggtttaagcctataatcccagcactttgggaggccaaggtcagaggatcctttgagcccaggagaccagcctaggcaacacggggagaccctatctttaaaaaattttttaaaaaattatctggccatggtggcacacacctgtagtcccagctacccaggaggctgaggcaggaggaacgcttgggcccaggaagttgaggctgcatggagccattattgcattaccgcactccagcccgggcaacagcaacacccagagcaagcaagcaagcaagcaaagaaggaaggaaagaaggagggaaggaaggaaggaaaaatataccatagactgggtggtttataaacaacagacattggccgggcgcggtagagcacgcctgtaatcccagcactctgggaggccaaggcaggtagatcaactaaggtcaggagtttgagaccagcctgactaacacggtgaaaccccatcttaactaaaaaaaacaaaaattcgctgggcatggtggcaggcacctgtaatgccagctactcgggaggctgaggcaggagaatcgcttgaacctgggaggcagagattgcagtgagctgagattgtgccactgcactccagcctgggcaacagagcgagactccgtctcataaataaataaataaataaataaataaataaataaataaataaataaaattgttagggaaacaggagcacaggagagccagactgacaccatttttaaatcaaccccaccttaaaactagcaggggaccttccttgccagtcatgagccgtggtcctcagatgtttacagctaagggagcagctagcggcttaataatgcctgcaaggacaaacgtctaccacaacaaaatgtccagatgtcctgatatcacataacagtatttgctttaaaatgattaaatgctgagacctgggctttaaaaaaaaaagatgattatagttatgttttgatgtgctttcacactaaaatgccaaggatatcttcctttaaatcaagaaagtatttaataatacattttgtccggctgtcagcccacctgcctgcagacatagcttagcttttagacaaggctgctacatcagaagagtttaaaacaaagacagcgagttccttctcctgttttctgaggacgccctgccgtgtaactgagcagctttcaataaacaatctctgctcactgcactctgagattcaccttgaactttcccaccacagatccacgaacactttcttggggtctggatcaagacccctttctctggcaacaaaatcacacagtgtgtactccgttgagcccaggcgccttgagctcacaatcatgtttgtgaaatcgatgcatgtggccgggcgcggcggctcacgcctgtcatcccagcagtttgggaggccgaggcgggcggatcacctgaggtcgggagttcgagaccagcctgaccaatatggagaaaccccgtctctattaaaaatacaaaattagccaggcatggtggcgggcgcctgtaatcccagctactccggagactgagacgggagaatcgattgaacctgggaggcggaggttgtggtgagcctagattgtgccattgcactccagcctgggcaataagagcaaaactccatctcaaaaaaaaagaaaagaaaagaaaaagaaattgacgcatgcgattgtgtgtgactgtggggttgttccacgtcgttgggaccgtttgattcattgtgtatctttccccggcatgaatgtattttccatgtatttatctgctctacgtcacagatactcttttgaggactagtgatctcaaatccacagtgttgattctttacattttatacacctgtgtcacgaccagcggataaggatacagaacatcccagcaccccaccaatttccacccacctctccccgtgctgtagccctttgctccctcagcaccagatgcaacgtctttctgatttctgtcgtcactgattgctttgcctgttctaggacttcctctaagtggaaacatacgctatacatacactatacgtacttttgtgtctggcttcatctgctccacgtggggtctgtgaggttcagccctgtggttggctgcagccatgcatccttccttcgcaacgccctgtagaatctcatgggatggacacgctacgcatttgcatatccatcctactgtgcctagtcctgtgagtactttccaaatctgctgagtgctccttttccaacaaatattttgttcggacccttttgaccttcctgaagtgaaattcatagatatgaaaatgttctgaaattttggccgggcgcagtggctcacgcctgtcatcccagcactttgggaagccaaggcgggtggatcacgaggtcaggaattcgagaccagcctggacacatggcaaatccctgtctctactaaaaatacgaaaattagctgggtgtggtggtacacacctgtaatcccagctacttgggagattgaggcaggagaatcgcttgagcccagggagcagaggtcacagtgagccgagatcatgccactccgtcttaaaaaacaaaaatggccaggtacagtggctcacgcctgtaatcccagcactttgggaggccaaggtggatggacctgaggtcaggacttcaagaccagcctgtccaacatggtgaaaccctgtctctactaataatacaaaaattagccaggcatggtgacacatgcctataatccgcctactcgggaggatgaggcaggagaattgctggaacctgagaggcggaggttacagtgagctgagatggcgccactgcactccaacctgggcaacacagcgaaactctgtctcaaaaaaaaaaaaaaaaagatgttctgtaaacataatgtaaaaacttacctgtaatttaaatcagaaataagggagacatactctattataaaacaatatgtaatttagtcaataaatgctcagttatgatcactgtagaagatatgatgaagccaggcacagtggctcacaccaattatcccaggactttaggaggctgaggcggaaggattgcttgagaccaggagttaagaccagcctgagcaacagagcaagaccccatctatacactaaatatttttaaaatattagccaggtgtggtgatgcacacctgtagtcccagctactctggaagctgaaacaggaggatcacttgagcccaggaggatgaggctgcagtgagccatgatcgcaccactacactccagcctggatggcagagcaagatcttgtctcaaaaaaaataaaaataaaaaagatacaatgaagcaattagatgatgcttccatcagtggtaatgaattgttggctattatttgcatgtgtgtaaatctctgtatatatgtgagaataaatccatatatatttatgtgtgatacatatgtatgcattcttgtgagtgtataagaatatatttgcacagtccaggagcagtggctcatgcctgtaatcccagcactttgggagactgaggcaggaggatcccttgagcccaggagtttgaaagaccttgtctctatcctaaaagataaaaaagaagatattcagccgggcacggtggctctcacctgtaatcccagcactttgggaggccgaggcgggtggatcatctgaggtcaggagtttgagaccagcctgggtaacatggggaaaccccatctctactaaaaatacaaaattggccaggtggtgggcatctgtaatcccagctactcaggaggctgaggcaggagaatcgcttgaacccaggaggcggaggttgcagtgagccgagattgcaccacttcactccagcctgggcaacagagcaagactccatctaaaataaataaatcgcgtccttttagggaataccagggggatgtatcccaagggtggaagccctgctgaggttttccagggtggtaggaggtgggtcggagtctctgcagtgccccaggctgtgaagcttgacttcaggtgtccaccagagtgtcctgttcttttgtcaaacaccagcctcggtgtcactgggaaggtatttttcagatgagattcacatttacgatcacttcaatcaagtaaatcaagtaagagagtgtgccctccacaatgtggtgggcctcattccgtcagctgaaggttgaaagagcaaaaactgtggtttcctggaaagaaagaaattctgcctgaaggctgtagtcacatagaaatcctgattgaacttctagcctgccagcctgctctacagatgttggacttaccagccccacaatcacaggagccaatttcttaaaatacatgttgatagatggatagatggataattatctttctatagatatagagatatagagacatgtacatttccttctccaagggagaccaacatccttggagaggctctctctctctctctctctctctgtctctctgtctctccaggtcaccattaatatagacagaaaacctattcagaaagagagataagtatgtagaccatattttttgagccctgtctctctgagagagagagagagaacctattggttctgtttctctggagaaccctgactgattacagaggcctaagttaacagtgatctggtctagggcagataaatacaaatatgtgcacgatatttttgagaaatatgtaggcaacaggggaagataaagttgactccacgggacttgcagagaggggagtacgtgaggagttactcgtaggtttttgtcttcagaactagacggaccttgacagcatttgctgagacaggcaagccttaaaggcaagagagagaaatggaggtggttcctgtaaaaccatctgcagggtatgtgatgggggcactgggaaaggagaaggaacaggagaggaattggtaagaggcgacgtgaaaagaataaaagtacagagaacttgtgctcaaggagaaagagcagctgggatgtttaccatctctccagcggccagatgaaacctcagctctcaagtccgcaacggaattttccaccaagctaaaggccaggaggaattccaagaattatatacatcaccgtgtaattaaggatgggaagatttttctcttagacactaaacaatgtggacagtgttgcagagacgtctgtttaaaatcacatttctctaaatagccatctgtttcacagattattcctggattcagtcctccacaattttcattcaaattttgagagctgacaacatttaattttataatctgcaggttttgtgtctttacaagtttttagcgtagtgtctggcacacaataagggctcagtggaattattgtgaaatcatatttcctgacatagtcaataaaggaacaaaacattccacattacctaattcgtactctcttctttaaaaatttagagatgtattataattatataaattaaatttataaatgtataatttataatttatttatatattatacatttataaattatatattatgtaacatatattaaacataaaaaaattaaatacattatatataaagatgtactgggcttggtggctcatgcctgtaatcccagcactttgggaggctcaggaggttggatcgcttcagcccaggagtttgagaccagcctgggaaacatagcaagatcccatctctacaaaaaatacaaaaattagccaggcgtggtggcacacacctgtagtctcatcttatctactcagggggctgaggtgagaggatcgcttgagcctgcgaggtggaggttgcagtgagccgtgatcgcaccactgcactccagcctggatgacagagtgagacgctgtctcaaaaaaaaaaaaagccatattgataaaattataccaagatatatttaaatacagaattaactgtgtatctatactttatatacatgtatgaatatatttgaacattaaattataattatgaacataaatttgcatcatatattctacttatgtctccctgggcacatgtctgtatgtgtatctgtggacacacgtccatgaagaaattggatgggatgaactcgggagtaagttaactctgtctgcgtcctgtgcacctgatgcagcaataaatactccatcaaaggcattgcatttcccaaaagcccgtgaggcaggcgtgattctagtgtccattttacagagaagagtactgaggtgtggagagactaagtcggccagcagtgaacaccctcagccactgctcggacagctctcgctcacctccctgcatctccggctccagacgccatggtctccatcactctccctcactcgggatctcatgccggctcccggcttggatcacagacgctgatggctcaaaaacgtgtgtctgggttagagaatccacctgtctcccttagctctgcactggggttgcccaatttaataaataaaaatacaaattgcctggttaaatatggatttcagataaacaataaaaaagaatcaacttttattttagaatcgacttagatttggcgaaaagttgcaaagagaatagaaagttttccttgttcctgcacccagcttcccctgttagtagcgtcttacacgagtatgatttatctcaatattagtgaactggccaggcacggtggctaacacctgtaataccagcacttttggaggctgaggcaggtggatcacttgaggtcaggagttcgagaccagcctggccaacatggtgaaaccccatctctactaaaaaatacaaaaattagccaggcgtggtggtgagcacctgtagtcacagctactcaggagactgaggcatgataattgcttgaacccaagaggcagaggttgcagtgagccaagattttgccactgcactccagactcggcaacgagtgagaccctgactctaaaaaaccgtaaaaataaaaataaataaataattgccaagtgtggtggctcatgcctatctataatcccagcattttgggaggcagaggtgagcagatcacttgagcccaggagttcaagaccagcctgggcatcatggcaaaaacccttctctacaaaaaatacaaaaattagctgggtgtggtggtgcaggcctgtagtcccagctactcgggaggctgaggcaggaggattgctcaagctggggaggctgcagtgagccaagacagcgccactgtactccagcctgagccacagagtgagaccctgtctcaatagaaaaacaaatacataataaatacataaaacgcccatggcagggacacacacgctggtttgggttggagccagcccgtaaacccaaatttgggggcccgggctctcggctgctgcagcactgactaccgttaaggtacaataaaactgacacatgggcagtgaggggaatttgctctcctgcctccctccctaagttcatctgctgagaaaaatgctttgagataaacctggagccacagctctctgcacagtcagatcgcaggaacgcggcctagctgcttcagccacgttctcgcggcgccacctggtggccatggaccgccatcgccgctggacgtcagggccgccaggcccagcgagatgtcacctcctctgaggagccttccaggatcgcacccggcacgcgctccacgcctcgttgtctgttcttcggagcaccgaccatgatcacaaatcagctcgctcgctgtgtttcctgccgggtcgctaccgccatgatccgcacgtagtggtcaaggctgaggttgtatgaatgtggacgttataaccctggctccctctccctccctatgctgggctcccctcgatccccaggcggtggggtgcccctggtttttcctttttaaaattataagtctggccggacgcggtggctcaggaccgtaatcccagcactttgggaagtcgagggagggtgtatcacttgaggccaggagttcaagaccagcctggccaacatggtgaaacaccatctctactaaaaatacaaaaatttgccgggcatggtggtgtgcgcctgtaaccccagctacttgggaggctgaggcaggagaatcgcttgaacctgggaagcagaggttgcagtgagccgagatctccagcctgggtggcagagtgagccttcgtctcaaaaaataaaaaataaaaaaaaggttaaatcaatttaaatgtcaatgtccacaggagctacagatggtaccaatagctcccagctggggctcgtgtatcattggtcagggcttcatcaggattggctactgccccacccttgttaaacatttttaatatcttccttgtctaccagggtcaggcacctcaggtagatgaatgaaggatgggggggatgggggagggagatggaagagggaagggaagcagagggaggaggagtgagtgggcagccctgatcggaggtccctccccatcccatctaaaggggctccctggccgggcgcagtggctcacacctgccatcccagcactttgggaggctgaggcgggtggatcacctgaggtcaggagttcaagaccatcctggccaacatggtgaaaccccgtctctactaaaaatacaaaaagtagccgggtgtagtggttcatgcctgtaatcccagctactctggaggctgaggctggagagtcgcttgaacctgggaggcggaggttgcggtgagccaagatcgccccactgcactccagcctgggcgacagagcgagattccgtctcaaaaaaataaaaaattaataaaataaaaataaataaataaataaataaaggggctccctgctcttctgctccaacctgtggctgccgcataggaacatgggtcacaaaacccagaaatctggattcctttaagtgaaatcttccaaattttatgtttaagaaggtcatgtatttattccttcctaaagaccatgctgaccaaatcaaatgagtctgtggataagtgtgtccaggcttcagactactcccttttggagcctgtggtgtaaagggaacagcttaaagtccctcgccccagtcaacaggggaatttaatgtcttgggttccctggcagaacttttctgttttttttttttttctctttatctaacacttccatgtgtcttactgaaagccagctgcagagttagagcagcgtttggcagaatcaaatatggactagcgcttgcttctgtacggccctcaggttaagcatggattttatatgttcaaattgttgaaaataaatcaggccaggcacagtggctcacacctgtaatcctaactctttgggaggtcgaggcaggagaatcgtttgagcccaggagttcaagaccagcctaggcaacatagtgagaccccccacatctctacaaaaagttaaaaaattggccgggtgcggtggcttaggcgtgtaatcccagcactttgggaggccggggtgggcggatcacctgaggtcaggagttcaagaccagcctggccaacatgatgaaaccccgtctctactaaaaatacaaaagttagctgggcgtggtggtgaatgcctataatcccagctactttcgggaggctgaggcaggagaatagcttgaactcgggaggcagagtttgcagtgagccaagatggcgccattgcactccagcccgggcaacaagagcaaaactatgtcttaaaaaaaaaaaaagttaaaaaattaactgggtgtgttggcacttacctatggtcccagctactcaggaagctgaggtgagagggtcatttaagcccaggagatcaaggcttcagtgagctatggttgcaccactgcattccagcctgggtgacagaacaagaccctttctttattcaaaaaagagagaaaagaaaaaagagagagaaagagaacagaaaaaagaagagaaacaaagaaaagaaaatgatatttcataatatgtgcaaattatatgaaattcaaatcttggcttccataaacaaagctgtgttggcccatggtcacgccttcattgacatcacctggtggcagctttgtgttacatcagcagagttaagtagactgtgtggcctgcaaagcctcaaatacttgctgttctgggccaggcgcggtggctcacacctgtaatcccagcactttgggaggccaaggtgggcggatcacccgaggtcaggggttcgagaccagcccagccaacatgctgaaaccctgtctctactaaaaatacaaaaaaaaaaattagctgggtatgctggcaggtgcctataatcccagctactcaggaggctgaggcaagagaatcacttgaacctgggaggtggaggttgcagtgagccgagatcacaccactgcactccagtctgggcaacagagcgagactccatctaaaaaagaacaaaaaaaattgctattctggccctttcctgggggcatttagagaaaatatttacccacccttctaggtactttgcgtgcattaacttatttcatcctcacagagcatctatgatgaaggcgctgctattatcccatttcaaaggtgagaaaagtgagtacgaaaggtgaagtccatggagacacagctgtgtgaggcagagccaggatttaggctcaggaagcctgaacctagattctagggtgttaactgctacatgaggctgcctctctttctaagcattttcacttgtgtttctctccacatgctatgttctaccataaattggcttccttgaatgggagggccacactgaatcccactgtctctacaactgtgacatcatgtaatgctgactcctttagctttattaaactcaggttctaaccttagccacaggctctccttctgccaagctgtcagctaaatcaaaccatgctctcttatccccagcctgctcctgccttcatctccctcgttttctttttaaagattaattatttttaggctgggcacagtggcttacgcctgcaatcccaacactttgggaggccaaggcaggcagatcacctgaggtcaggagttcgagaccagcttggccaatgtggtgaaaccgcatctctactaaaaatacaaaaattagccgggcatgcggacaggtgcctgtaatcccagctactcgggaggctgaggcaagagaatcgcttgaactgaggaggtggaggttgcggtgagccgaattcatgccattgcactccagcgcctgggtgacaagaatgagactccatctcaaaaaaaaaaaacctgtcatattggattagggtctaccctaatgaccttgtcttgccttaattactcgtctaaagaccctattaccaaatacagtcacatttctaggtgctgggagttaagacttcaacatgcatttggggggacaaaattgagcctataacaagctaattacttaatgttttctgggagatgcctcaacctgtcccaaacgaagcttatgacatcttcccctcacctgctcaccttccagagttgcccatctccaccaatggcaccattatccacctggttacactgaccagaagccaatggcgcccttctcattacccctctcatcggtcaccacgtcctgccgtttgacgctgatcaacctgctcatttccccccatctcctctgccgccactgaaaaccaacccaccaccgtcatctcctgcactgcggaaagttctaaatatccccatcccggacccaaactgcctctcctcacccaggaatcatttgatgtggtcagagcgagattcaaactcctcccaactcctgaaactgtcaaagctggacttgaatacggagcagagccggcgtcctgttggagtgcttgtgagctcaccagtgctccctccctccaccgtcactctaaatcaggactacccagcctggcaccctcagcatttggggttggaggattctttgctgttgggggtgggggaaggggttctgtcctgtgcattgtaggatcttaagcggcatctctggtctcaccaactagaggccaggagcagcccctcacccagctgtgaccatcaaaaatgcctccagacactgccaaaggtccaccggttcggggaagaaccacctctgattgagaccccttccaccatcccgctctaaataataatgatttctcccattatgcagagaaatactaaagtcatccacatagggaggtgagtttaaaagcccatcaggacatgtgcattttactaagccattaatgtccctgcgatttatgagagaacagtaactgcattccggaagacacaaatggctccttccacgatttcattatctgccttgcatgagtgagcctgagtttctgtagcagttgccacgtgctgccactaggtggtggtggaagccaagtcataaagtagtttggggcccttttctgttgctttggttttggggggtttggttttgttttgttttgttttgttttgtttttcgttttgagttttgctgtagccaggctggagagcagtggcacgatctcggctcactgcaacctccacctcccaggttcaagcgattttcctgcctcagcctcccgagtagctgggattacaggcgacttcaccatgcccagctaatttttgtatttttagtagagacggagtttcaccatgttcgaggccaggctggtctcgagctcctgatctcaggtgatccgcccagctgggcctcccaaagtgctgggattatgggcatgaaccactgtgcccggcctttttcggtttttagatctttattttaaaattgacaagcaaaaattgtatatatttatagcatgcaacatgatgtttccatattcttatacattgtggaatggctaaatgtagctacgtaattttctttttttctttttttttttttaagacggagtctcgctctgtcgcccaggctggagtgcagtggcgcgatctcggctcactgcaagctctgcctcccgggttcacgccattctcctgccgcagcctcccgagtagctggggctacagatgcctgccaccacgcccggctaattttttgtatttttagtaaagacgggttttcaccgtgttagccaggctggtctcgaactcctgacctcgtgatccgcccgcctcggcctcccaaagtgctgggattataggcgtgagccaccgcgcccggccctgattttctacatagctttttttttttttcttttgtggtgagaacataaaatctactctgagcaattttcaaagacactttattttttattttatcttttctctcaaattcgtcgctagtattacttgagtagtttctaatacagtcatgtgcctcatagccacgttttggtcaacaacgagccacatacgtgatggtgggcccgtcagatcataatggagctggaaaagccctaccgcccagtgatgcggtagccaaagtaacatcgtagcacaagtactgtacttttaaaatataacttcagtgtagcctaagcttagagtgttataaagtctacagcaatgtcccaggctttcacattcactcactcacaccacccagagcaacttcccatcctgcaagctgcattcatggtaagtgcactatgcaggtggaccatttttttaatccttcataccacatggttactgtacttttttttttcttttcttttttttgagacaggatctcactctgtcccccaggctggagtgcagtgacacgatcacagcttactgaagcctcgacctctcgggctcaatcgatcctcccacctcagcctcctgagtaagtagctgggactacaggcatgcaccaccatgccaggctaatgttggcggggggcgggggatgctgggggggtggggtgtgtgtgcagagatggggtttctccacgcccccaggctggtctgcagctcctgggctcaaggaatctcttcacctcagcttcccaaagtgctaggattacaggtgtgagccatggcgccccgcattactacacctttctcaggtttaggtccacaaatactttcctttgtgttacaaccgcctgcagtactcagtacagtagcctcctgcacaggtgcgaggctaggagcagcaggctattcatgtagctcaggtgtgcagcaggctgccccatctgggttgctgtgagtcactctagaacattctcacaatgaggagatcgcctaaggatgcgtttctcatactgtgtccccttcgtccatcgaggcgtgactgtacctggggcctcagagcacctgcagtccccccaagggccaccttcctgagaccacagtctgggcagccggcctccctgcatcccggagcgcactggggatgaggactcacccaggagagcccgagacacctgagcggccggcacaaaggccctagggaagtgtgggggtacccttggtctcaaagcgctgatccgcctgtgccccctgacctgccagggccggcccccgcttgggtcttggagggcgctgcgcaagcctgcgccccgcactcgcccgggaagggaagggcagggaaggggcgcgcacagcctggcacctgctgtgcaccaggggagacgcgcggcgctccaggtggagtcggcggcggccgagctgcgcggggctgtgcggggctggattctagcctgcaggacgcgaaaacggcctgggtccggcttcctcctcccctgaagcagcgaaggggcgtcactggcgcgctgttaaacgtcttcgccatcggttccctgcatcctccctcctgcctgggtagccagctcctgggcgcgcccaggcgcacacgcttccctcgctcctcctgcagccacaacgcccccaccccccccgcccgcccgccttgtgcggcagcggtgaccgccttctcctgctgccaccccctccaccccctgttcaaggtctgtcaccgtagggggcgggggggcgcgtggagccgctgggggttcggcccaccccgcgaaccgagctcccggccctgtgcgccctcagctctgccgcgggcgttggcctgggcgggcgcaggactgcctggtcgccctggagctcagggtcggggccccgcgtttaaccaccaggcggaggcgcaggcggagcccggagaggacgcgacccctctgggcggccttgggcccctggacgtgccagactctggacccctgcgggggctgccgtggagagcagaggcaccgcgtcctgcccagagctccgataggcgggccgcgttgggggattgtgggggccggcgcgcaggggaaccgtccactcccagggtggcaccaggatgtgactatttccatacccaaatgagggttggatttccatctcctaatatttccacagtttgggggtttcctcaccaacttgtctgacatttctcggccttccttagtgatgacaacactaccgttggttaattttcttcaaaatgtgtgcaaaccacttcatgtatctgtagttaaaatatggaaaggagacatttaatttcttctctttttatttatttattttgattttttaattatttatttatttatttatttattgagacggagtctcgctctatcgcccaggctggagtgcagtggcgcgatcttggctcactgcaagctccacctcccaagttcatgccattctcctgcctcagcctcccaagtagctgggactacaggcgcccgccaccacgcccggctaatttttttgcatttttagtagagatggggtttcaccttgttagccaggatggtctcgatctcctgacctcgtgatccacccacctcggcctcccaatgtgctgggattacagccgtgaaccattgtgcccggccaagacatttaatttctatagcattttatgaagaccagttgctgctgaaatagtctgcctccccacacgcccctcatcatgtttataatgttttcacaaggctcttttctccagatcattttcaacttatttctaacatattatgtgaactcgacacaatatttattttgtttcctccaataatgtagagaccatactttttggttatactcattcctaagcactttacattttattaaactatttgcatggaataatttcccatttcattctaattgtagttattctggaatattatttatttaagtgttattgattaaaatatattcctgtgtgcttggtcatattactaaatttatgacttttcaattattatttcttgtttctttttggttttctaagcagtcatttcttctgtaaatattatgacatatctttcttcctgtccactaggtatactggactttctagtgatatgaaccaataaactttctattgtggcttatatcagtttgtgtgttctgtcatttccaacacaaagaatcttaaccgatacagatttagaagagaaaaagtttcaggcctgtaatcccagcactttgggaggctaaggtgggaagatcacttgagcccaggaatccaagaccagcctggacaacacagtgagaccctgtctctataaaataaaataaaataaaaattagccaggtgtgggtgtgcgcctgtagtaccagctgcttgggagactgtagtgagaggctcgcttgagcccaggagttcagggctgcagtgagcatgattgcactactgcccaccagcctgggtgacagagtgagaccctgtctcaaaaaaaaaagcaagttttagaagcattcttgctaaagaaattgtccctagaaaagtatttattcactaaaatgaacgacttttacttacttttacaattttttataagtcagagtaaaatttaaacacatcgatatagttcatgaaatgattcccctgaacctgacatatactagctttcttcttagagcctcagtgcctaggcagaaacttggcagttcctgagatgacactgtagatatagggagggaaaaagaagaggaaagcaaagcagatgagacagaaaagataacttagtaaggaagttctgtgaccataaaatagtgttcattgttctgaacatcattcaaaaaaaacaatactcactttgggaggctgaggcgggtggtcaggagttcaagactagcctgatcaacaagatgaaactccgtctctactaagaatacaaaaattagccaggcttggtggtgtaatcccagccagcctgtaatcccagctacttgggaggccgagacaggagaatcgcttcaactcaagaggcggaggttgcagtgagccgagatcacaccactgcactccagcctgagcaacagagggacactccgtctcaataaataaataaataaataaataaataaataaataaataaaatgtaaaaggaagattaaaaattcctcttgtgctggaataaaatgatatagatacagaagatgacaactctgaaggataagacctgtgacccataaaataacttttattttatggtcatttcaacttatgaccccaaacatcatttaaaataaatatttagaacatgaaaacaattaactttttaatgaatgaaatgttcttgagaaaactgatcagagccagtgtagtatgcatcggtgcttcatcgtgatctatgcttatgaagattcagttctgcttttacataatatcaagcgacattgtagtaagaaaacaattaacattttagtttgtattggattaggcatttttaaaatgagatactcacacaactgctaacaggaatgcaaaacatctccatttctccactgaatcacctttacatgtaatgttctaaataaataataataaaaatatacacatttccttctgatttcttaaaaatcaacgtaagtattcattggccaggtgtggtggctcatgcctgtaaccccagcactttggaaggccaaggcaggaggatggcttgagcccaggagcttgaaaccagcctgagcaacatagagagaccctgtctttaaaaaaaaatttttaataaaaataaaggtagatactcatctaactgctagaaaaaactaaaaagatgtcataattgaccttatataagttgtatacaatatgagatacactatttaactgcatatattattttggcgggtttttttttgttttttcttacttttttatgtttaaacttttatattatacaaaacacagccctaacataagttttttctcatcttttttttttttgagacagtcttgctgtgccacccaggctggagtgcagtgctatgatcatggctcactgcaacctccacctcccaggctcacgtgagcctcccacctcagcctcccaagtagctgggaccacaggcacatgccaccatgcctggctaatttttttgtattttttgtggagatgggattttgctatgttgtccaggctggtcttgaattcctgggatcaagtgattggcccaccacagcctcccaaagtgcagggattacaggtgtgagccactgcacccagccagttttttccataaacctttaataataggcttttaggtctagaaagtaatttctaatataacagagtttgaaaatgtataagttccattaaattaaatttaatttaatttaattaattaaatttaatttaaatttaattaattaaattaatttaaatttaattaattaaattaatttaaatttaattaattaaattaatttaaatttaattaatttatttaatttaaattaattaattaaattaatttatttaatttaattaattaattaatttaatttaatttaattccaattaattaaattaattaattaaattaatttaaatttaattaattaaattaatttgaatttaattaattaaattaattaaattcaaattaatttaattaatttaatttaattaatttaattccaattaattaaattaatttaaatttaatttaattccaattaattaaattaatttaaatttaatttaattccattaaattactaacatataggctgggtgtggtggctcacatctgtaatcccagcactttgggaggccaaggcaggaggatcacctgagatcaggtgttcaagaccagcctggacaacacggcaaaacgctgtctctactaaaaatacaaaaattaggtggacatggtggcaggcacctgtaatctagccacctgggaggctgaggcaggagaattgcttgaaccggggaggcataggttgcgtcgcagtgagttgatatcgtgccattgcactccagcctgggcgacaagagagagactccatctcaaaaaaaaaattactaacatataatatgaactctttagtttctaataaatattgagctaattttgaaggcttgactcacaaaattttttgcctatatgagttcttgcacgttcactaagggatgaaatgtgagcaaaggcttttccacgcttattaaatatatagggcttctcttcagtatgagttctctcaaatagagtaatggctaaactattttggaaggcttcctcacatgcattagagacataaccatttctctccactatggatttcctggtgttgaataatgtcagtcatgcaacagaatgcttttccacatgtattatgtttgtggggatgtctcttcagtgtgagctctagtatgttgccttaaggaggaaaactcactaaaagccttcctacattcagtactttcataggattttcccctagtgtcagttttttgatgtaggatgagctgggaggtcttgtttcttgttgctttatcacattttttacaatcacaggttttctttcctacatcagttctgccatgctgcaaggaagctgagctgcatttgacggcttctccccattgcttgccttcacagggcttctctcctgggtgagttctcatatgtcgaaaaagagatgaactatcaataaagcctttcctacattgactataatcataaagtttctctccaatgtgaattttccagtgtataataaggtgtgcttttctgctacaggctttcaggcagagagtgcattcttaggattcctcacctgtatagaatcttatgtgtctagcataggatgggcaatcagtaaagcgttcctcacactcattgcatccacagcatttgtctttagtgcatattctttgatgtccaattaggtataaattctgcctgaatacctcctcacattcactacattctgacttgtatgaattttctcatgctttatttaagatgaattataactgaatgatttttcatctccattaaatccataaaggttatttcttctataattaagtaaatcaaaattatgcttcaagccccctccacttaacacatgctcatggagtttttgtcttgaggggatactgtttacaaaagcctcacgttcacagactttctgctcagtacatgttttctcatagatgaaattaatttgatttggaagtctctccttgaccaggcatggtggctcacgcctgtgatcccaaccctttgggaggccaaggcaggtggatcacttgaggtcaggaatttgagactagcctggccaacatggtgaaactccatctctactgaaaatacaaaattagccaggcatggtggtgcatgcctgtaatcccagctacttgggaggctgaggcaggagaatcgcttgaacccaggaggcagaggttgcagtgagccgagatcacaccattgcactccagcttgggcaacaagagaaaaaccccttctcaaaaaaaaaaagaaagaaaaagaaaagtcgctcttcattttcttggtgcatctctatttggttaccagcttcctagtcatttcctaaaagggaagagagaatttatcacttgtgaatcttcccattatcacactgtggaattaaacttctttacacataccccttggtgggtatatactcttattttgtcccatacatcatattttttttacttattggtttttacatctgactttcattaactgcgggcactttagagaccaggatcttagctctagacttcagggttttttttcttacttctgttttcctttgctgacaaccacgtacaataacttcgctcttcagcacaaacctacaatttctctagcccacaaaagcacagcaaatatgaaagatgaagtaaatgccagcttggcacccaatctcatgtcacttggatccacaccatgcacttaataatacacttttttttttgagacaaggtctggctgtatcactcaggctgattgcagtggcacaatcgtggctcactacaacctctgcctcctgggcttaagtaaccatcctcccacctcagcttcccaagtagctgagatgacaggcacgtgtcaccatgcttggccaaggtatttccaacaaataaccttctgctccattcaaaccagggtgccaggctcctcagcttgcagacggcctatagtggaaactcaccttgtatgcgtgtgagtcaatgccccttaataaactcccttttatatatacatctaccatattagttatgtccctctagagaaccctaatacacaggcaaatgatggagctcttggtcttgttcagattcagttccataaacaatatttcagactctatgagtgaaacatgcacagtgccaacccctcactgatcatcagggatgtgtgaccttcttgtgccctgtttgccagatgctcaggggctcacctggactaccctgatatggggttcctgtccccaacatccatggttcttctccccactctaaatgaaagatcacatatgtgccaggtacagtggctcacgcttgtaatccctacactttgggaggccaaggcgggcagatcacctgaggtcgggagttcaagaccagcctgaccaacatggagaaaccccatctctactaaaaatacaaagttagccaggcgtggtggtgcatgcctgtgatcccagctacttgggaggctgaggcagaagaaagaagaagtgcttgaacccgggaggcggaggttgtggtgagccgaggtcatgccattgcactccagcctgggcaacaagagcaaaactccatctcaaaaaaaaaaaaaaaaaaaaaaaaaaaagatcacacctgacatgggaacaggacaccatttttatgggaaatgctggggtctgggggttacaaactggagacaaagaccaaatttctattaacagtagtcctcctgctgtacattagatctctagatttattcatcctacgtaactgcacttctgtaccatttgaccacatctccccgcttcctcctcctccccacccaggtaaccaccattctgtatttgatgttgttgttttttaatttcacatatattcagacaaatttgagtttaaaaaatttttttaattttcacatgtaagtgaaatcatgcaatatttttatttctgtatctggcttatgtcacttatcatcccttagtataatttgagtttcataggctctcacctcattaaaatggcactacagaatcttgtcaaataaatatatctttcaggcactggaaaagtctcagaaagaaaagatatcctctctcctctttagctatagttcaataatacgatttaaataatccgatctgataaggtatccaatgaagaacatttatgggaccataaacttgttcttctctccaaaattcagtgaatatttgtaattgttagcaatctgttatgctctccactaatataaaccaactcttaaaagttattggaacaaaagaaccctgaaaagcactcagtctccagaaattgttgcattaatcattctcattaggtgccttactcaacaatttgttgcctgagttataatcacatccttgaatttccaacatattaacactttaaatatttctttatctcatcacaagatcagcactttcctctcctctgagaagtatgaggtagcaatgtcactgatttttattaaatgttttggagtcttgactcacttaaatgcatattatgtgccaaaatgtgacaggaaattaaatgagatgccaggcatttcagaggaaataaagaaaagaaaatcaagtttaacaaaaggaagaagggtgtccaatagtcatccttaaagaaagcacatttacttatgtatatctaaaggtgtaagggcatggggctgagagccaggttgacaaaggctagaggacagagaatcagagaaatcatccaaaaaagacgagcaagatgatccaaaggacagcgggctggccaccacatcttctaaagcccaaggcaagaatgaccgtggactccatttttaagtccactggtctatctctagtggacaatccagcagtacctatcaaagcttcagcaagtctacctctaagatccacctctactgtctacctctaagcaatcctctaagtctacctctactgatccagcaagtctacctctaagaatgtatcccaggatatacttgtgaagatggaaaaggactgagtattatgattaattactgaagaatggtttctaatggtaaaagattggaaacaacctaaatattcaccaagaaacatctggctaaatctacggtctatacacacagggacattgtgcagttatcataccacactttgtatgtatactatgatgtcaaagtcactcacggttaatgttctttttcaaaagaacattagaggtagattttctggaccagtgtggatctgaaactttaacagatactcccagatttcccactagagataaattggcagtcttaaaaatgggttcacggtctttcgtgcctttggctttagaagacacggtggccagcctactgttctttggatcatcccactcatttctgttgggtaatttctctaatttttcctcctctggctttcttttagcccctttatttatctaagttaaaatttcaaatatttttccaaattaccaaaaataattccattaagaatttgattgagactgggcgcagtggctcacacctgtaatcccagcactttgggagactgacgcaggtgaatcacctgaggtcaggagtttgagaccagcctggccaacatcgtgaaaccccatctctactaaaaatacaaaagttagatgggtgtggtggtgcacacctgtaatcccaactacttgggaggctgaggcaggagaattgcctgaaccagggaggcggggttgcagtgagcccagatcccaccaatgtactccagcctgggtgacagagtgagactctgtctcacgaaaaaaaaaaaaaaagaatttgattgagtgaaaatacctgggcaggagagacactccattctttgtgcctttgatgctctattgtacctttttcttttcttttcaagacatggggtctcactatgtttctcaggccggacttgaacttctgggctcaagccatcctcccacctcagacttctaagtatctgggactgcaggtgcaagccactgcacccaactcttaatgtaccttttacacacatttgtgtcacaacacctgtgccacacccttaacagttttgcagatgcacatcccaacgtttttcagttttgagaaaaatcacttttatttggtaaaaatcacacatgcttatgaaaataattacacattgcaccaaagtgacaaagatgaaagtaatcactccagatcctagttccgagaggttactatctttaacagtaggcaaataataaaatcccaggttttttgttttttcttttgagacggagtctcgctctgtcacccagactggagtgcagtggcacgatctcggctcactgcaagctccgcctcccgggttcaggcgattctcctgcctcagcctccccagtagctgggactacaggcgcccgccaccatgcctgggtaattttttgtatttttaatagagacggggtttcaccgtgttagccaggatggtctcaacctcctgacctcatgatccgcccacctcagcctccaaagtgctgggattacaggcgtgagacacggcgcctggccaatcccaggtattttttctatgcaaatatacagaaggctggatggataaacagataatacatgtaaatacttaaattagaatgtggcccaggagaacatgaactccatgaggtcagggatttttgttggctaggttcacttccacatctcctgtacctagagtaaggtttctcagcctgggcactactgacatttgggctggataactctttttgtaggagattggggtgggtggggagcgtgccatccactgcactgtaggatgctgagtagtgtccttggcctctaccctggcagaagcatccatgtgacaaccaaaactgtctccagacattgccaattgtcccctgggggcaaaactgccaccaagtgagaatcactaacctagaaaagtgagtgttcaatacacaataagtgcttgttaaatgtattacacaaccggaaaatgatgtaagggcaagttaaaaagtaatgcaaactggccgggcacagtggctcatgcctgtaattccaacactttggaggccgaggtgggcagatcaccttgaggttgggagttcaaggccagcctggctaacatagtgaaaccccgtctctactaaaaatacaaaaattagccaggcgtggtggtgggcacctgtaatcccagctactagagaggctgaggcaggagaatcaattgaacccaggaggtggaggttgcagtgagcctagatccccgccattgcaagtcagcctgggcaacaagagcaaaactccatctcaaaaacaaacaaaaaaaaaagtaatgcaaactcatctgggttttggtcatgtcctgcatctcctgaggaagggcagagggctgaggagcagtccttgggaagcacaaacatgtgagaatccaggttggctctatgccctacccagtaacgtagccccaaatctctgccttagctgacatgggggcacactgaagtcttgtgaagggtagaagggaccatgttgaggcagggacaaccttgcctacaggtgattcaggtaatcccacaagttcagccacagaaaacaagcatgaccatgtgcaaagacttccacgagaccacttgtcacagggttgttttaattcaagcaacatcaacatacaccagaaacttgtgaagaaaattatggcacatttgtataacttcagtgtcaagaagccagcggtattttgcagataatgcaaggtctgtagatcgaaaattaagttgggtgtcttcctttagtgtacaaacaccttggatgtttgaggaaatccaaagacaaggttctaggcattttatacgtgttaactcatgtattatgttaattctcacaataatcctttggaactagtacgatcaccatccctgccttattgaggaggaaatggggtacagagagcttaagcaacttgccagtgtcatgcagcagggaagcgctggaggcagggctccaacccacgcagccttgctgcatgtttgtggaatgaacacaggactcaggcacacaaccatctggctgaggctccatgagcagccaggagcctggtcccaatgcagtctccttataggcacaaatggggtgccccttgagacaggaataataaaggtggtcacaggagaacggaaaattccaggcaacagtttcacatgactagcaaaggaaaccgttgaaatcgctgcgtaagctaggggcggataagactctgaaaaccagggtgtgggccaagctggctaaagccgactggacccaacatggtgctggattcgacccgtttcacctaggacctctcattatgtgctcattaacatactaagtcacacacccactgtgacagctctggggaacacccgtatttagtataaaaatgtgtggcaccgcagtaccaagaaatgtttacctttttccaagaatcttcatgaatattccaccccttggttaaataaatatttaaaggtagctccaaaccccgctgggcgtgatgctctgtggtatgcctgcacttttctttcttcagtacgtacttattcccgtcgcaatgaatctccacactttgttctgctcatccatgaattccttctcacgacagtgtcaagagcctggacaccagtcagggtcgaggcctcaccagcatcttggggcctcactgggcacagacgcgtgagcgcccggcctgcagacctgactctggcagccgctcaggccctcagagggagagatggaagctggcaggacgcagttgctaccgcgcggacccggcccccgaccagccttggcccctcgcgcgccgggacagggccacaaatgactgcacctgggcttcgctggcccaggcaccacgcgactctaagcgcgcccaaagcgaccctctgcgcaaactacccccggggacgacgtcacccgtgaggtcccgcggcgcctcctcctaaagctcggctgggaaaccgtccgcttccccaagacttgggggcttgtggccgagttgttttagttttcctgtaggattcacgggtggctgaggcaaacacgcttgaaggcctaagacttttaagtctcttccgcaccctctcttctgtctcttccacctggaggatgaccgcttttttgggggttttgttgttgttttgagacggagtctcgctctgtcgcccaggctggattgtagtggcgccatctccgctcactgcaacctccgcctcccgggttcaagcgattctcctgcctcagcctcccgagtagctgggattacaggcgcccaccaccatgcccggctgatttttgtatttttagtagagacggggtttcgccacgttggtcaggctaatatcaaactcctgacctcaggtgatccgccctcctcggcctcccaaagtgctgggatgacaggcgtgagccaccgcgcccggccgggatgactgttattaacaattcccggcgtggtttctagcaccagcccacctaccacaccccacctcgcttgaggctgaatgggtaacaggatgaacccgcccctgggctggttttctctgaaccctaactcctgccgttacgccccaccagctctaggccaggaactctatgtgccccggccacgctagagcccgtacctagacccgtaggtcgggaggcctgcgcccggcactgcgcagacgcagcgtgctgtgcccagaactcttctgttcccaggagaatcaggggagtcggcgccggaaggggcgggtccgagctgagatttccagagccatgggagccggaagtccaaggaactgtacctccatcatgacgactccggttacgtaaaaacattcaaacagaaaatgctggccaggctcatgcctgtaatcccagcactttgggaggccgaggcgggaggatcgcttgtgcccaggagttggagaccagcctgggcaacatagtgagaccctccccccacccatctctacaaaaaattttaaaattagctagctgagatcatgccactgcactccagcctggacaacaaagtgagactatgtctcaaaaaaatttaaaaattacccacgcctgtagtgtcagatagtcaggaggcagaggttggaggatgacttgagccttggggatcgagggtgtagtgaggtatgatcgcaccactgcactccagcctgggcaacagagcaagaccctgtctcaaaaactatataaaagaaaaaagggctgggtcggtggctcacgcctgtcatgccagcactttgggaggccgaggcgggtagatcacctgaggtcaggagtttgagaccagcctgaccaacaaggtgaaaccctgtctctactaaaaatacaaaaattagctggccatgatggtgggtgcctgtaatcccagctactggggaggctgaggcaggagaatcacttgaaccccagaggtggaggttgcagtgagccgagatcacaccactgcactccagcctgggcgacagagcgagagactccgtctcaaaaaaaaaaaaaaaaaaaaaaaaacagaaaaaaggccgggcacggtggctcactcctgtaattccagaactttgggaggccaaggcgggcggatcaggagttcgagactgcctgggcaacatagcgaaaccccgtctctactaaaaatacaaaaaattagccaggcgtggtggcgggctcctgtaatcccagctactcaggaggcttaggcaggagaatcacttgaacccaggaagcagaggctgcagtgagccgagatcacgccattaaactccagcctcggtgacagagtgagactccatccccgctccgctccctcacctcccgccaaaaaaaaaaaagaaaatgcactgcaatagaaaaataaaagtactacactttggtcaaacagggtaactactagaacgtaaaatgatctttttgaaactatccacatttgttacacgtgttgaaaatgtaggatatatatgttatatatatacttatatatgttatatatacttatatatgttatatacttatatatgttatgtacttatatattatatatacttatatatgttatatctacttatgttatatacttatatatgttatatatacttatatatgttatacatacttatatgttatatatacttatgttatatacttatatatgttatatatacttatacatgttatacatacttatatgttatatatacttatatatgttatatatacttatatatgctatatatacttatatatgctatgtatacttatatatgttatatatatacttatatgtatgttatatatacttatatatgttatatatgcttatatgtatgttatatatgcttatatgttatatatacttacatatgttatatatacttacatatgttatatgtacttacatatgttatatatatacatatatgttatatatatataattatatatatataaaacaaaaagcacggttactacaaagaaaacaggtaaacattaagtggagtaaaagtatatcctgttatataagggacttgaacatgtctgggcatggtggctcaagcctgtaatcccagcactttgggaggctgaggcgggtggattactggaggtcaggagttcgagacctgggcaacatagcaagaccttgtctctattaaaaaatagatagatagatagatagatagatacatagaacatcaaaagagggagagagaaagcagacagatgtggcaaaatatacacaattggtaaatttgggtgaagggaatataagttatttctactaatcttgcaattcttatgtatatttgcaatgatttctaaataaaagtttttaattaccaattgaaataaagtaaaataagtcactatctagccttttctagacaaatattttaaactcttacacagagataagttaatcaagaaacgtatttcctggaaaaacccgtgatatgggtggagccacctgggaataaaaggtcggaacatcataatcactgtcagactcaacttccatcattctcctccaggcgctatggagtctaatccaggcactttggaaggctgaggctggaggatcgattgaggccaggagtttgggaccaccctgggcaacatagcaagatctcatttctgaaaaaagaattatcatccactcacccagaacagctctccaaactgtaagtttcattcaaggtttgcttgtttgggtgatgggatgtgtgtgtgtgtgtgtgtgtgtgtgtgtgtgtgtgtgtgtgtatgtgtgtgtgagtgttggaaggagggtctgtctaaacttaatgccctaaagatattgtcagatattgtgatgaggggaatttcatcttctaccctttatgaggttgaattgtaaattcgaaaatcctgattctgggtttttattttgaggggatagttttctgttttctgtggcattggatattggcattttcagaaaagagcatgcatccaaaatgaaaatgatgaagcctacctgtcttttgaactcagctcagggaaaagctgatgatctctaatttttgtgattcctcctttcattaaatttaaggtccagtgagggtgaagtttccctaaagaggcaataatttatcagcagcaacaggatgaaatggaggggcttttcttcacactctatatattatgttaggatctctcaggaaactgaggacacattaattataatcatggaagattttctgcttcccacatggtttgctgggtttggcatagtatagctcatgccctacattgaagaaatgtgggcacccatcaacagcagccatttctgattacacatccctgtttctttagctgagtgactcctaaaagtcccttaatgtattaataatgcatttggacctcagttttcttactatgttaaatgtaataaaattgaatatcatatggtcacttgcagaattaaatggtattaaggcatgtaaatcatatagagtgatgtagtacaacaaacaataaacctgtaataaaagtcactaaactcccttccctcccatgatggagccttaattttctctatatgaggcatccctgtagtttaatatattcttagaattagcaataggaatatgatgtcaacaattaattttgagccattttagcccaatgacttatcctaagaagtcgctattattgttgccatcccgttttcacttatacgaaagtaagactcaggagggttgagtttcagccttagtgttagaaaagcagtaagcggtgaagccgggcttggaatcctggaagttggaatgtacaatgtgtgatctcgatgcatcctctctgtagtgcctctttgtaacaagaaaaaaataaagatacttaaagttctaggtaagcaaagtcagaactagtctttaagttagagacccataaagtataaggtttctcaaacaacaaatgttgttagaaggtcttgttgtggcagagttccaagaaaaccaatgaatgtgaagtcagttgatatattaatctaatctgtgtaattggggaggggcacttttaggaatgcatttagagataatcccattaacacaggaggttttctcccagattaaattaacgtaaacgactttggaggaaggttggttttcccagtttctaagatataatgcaataaattaacatgaaagatggttgggactatgtgcagactttttaaataaacctcagtttcaggactctgacctttttgtttcttcctagtaacagccgtggcagtcagagctctgcctgcagtgtgaccatggacagctctccaaagcttaaacttcagtaaattgactcaagtttcttcggaaagaactgtgagtagcaaagggcaactttttctgttggtttcattgggatttcactgcttttcctgaaattggaatgttggaaggaagtaggcattcctcactgcctggggagaaatgggcaaatgagtaaggggagggagcaaattcagagagatattttttattttttctgaaacctgtttgtgttttgagatgtctttcccttcatgtttttttttttttcactcttcatatttccctttctctgtctctctccccacctcggttttgctaattagctagcacaacaactcgccatcttactccttttccttactccctgttttttgtggggttttttttttggttttcttttttgttttttttttgtttttgtttttgttttttgtttttcagacagagccttgctgtgtctccccagctggagtgcagtggcgagatctctgttcactgcaacctccacctccagggttcaagcgattctcctgcctcagcctccccagtatctggcactataggtgcctgccaccatgcccggctaatttttgtatttttagtagagaccaggtttcaccatgttggccaggctagtctcaaactcctgacctcaggtgatccacctgcctcagcctcccaaagtgctgggattacaggtgtgagccaccgtgcccagacagaacttctttatttttgccttaattttgttatttaaccagtagtcattcaggagcatcatatagagtgatgtagtacaacaaacaataaacctgtaataaaagtcactaaactccctttcctcccatgatggagccttaattttctccatatgaggtagtttaatatattcctaggattagcaataggaatatgatgtcgacaattaattttgagctgttttagcccaatgacttatcctaagaagtcgttattattgttgcagtcccattttcacttatgtgaaagtaagactcaggagggttgagtttcagccttagtgttacaaaagcagtaagtggtgaagccaggctttccatgtagttgtgtggtttttagtgagtttcttaatcctgagttataattggattgcactgtggtctgagagcttgtttgttatgatttccgttcttttgcatttgctgaggagtgttttacttcgaattatgtggtcaattttaaaataagtgctatgtggtgatgataatattgatctatctaatattaacaggggggtgttaaagtctcccactattattgtgtgggagtctaagcctctttgtaggtctctaagaacttgctttatgaatctggatgctcctgtattgggtgcatatatatttaagatagttagctattcttgttgcattgatccctttaccattatgtaatgccctctttgtcttttttgatctttgttggtttaacatctgttttatcagagactaggattgcaacccatccttttttttgctttccatttgcttggcaaatattcctccatccctttattttgagcctatgtatgtctttgcacatgagataggtctcctgaatatagcacatcaatgggtcttgactctttatccaatttgccagtctgtatcttttaattgggggcatttagcccatttacatttaaggttaatgttgttacgtgtgaatttgatcccatcatcatgatgctagctggttattttgcacattagttgatgcagtttcttctgtgtcattggtctttatattttggtgtgtttttgcagtggctggtaccggcttttcctttccatatttagtgcttcctccaggagctcttgtaaggtaggcctggtggtgacaaaatccctcagcatttgcttgtctgtaaaggattgtattttttcttcgcttatgaagcttagtttggctggatatgaaattcagggttgaaaattccttaagaacgttgaatattggcccccactgtcttctggcttgtagggtttctggagcaatccactattaatctgatgggcttccctttgtgggtaacccgacctttctctctggctgcccttaacatttttttcctttgtttcaaccttggagaatctgacgattatgtgtcttggggttgctcttctcgaggaatatctttgtggtattctctgcatttcctgaatttgaatgttggcctgtcgttctaggttggggaagttctcctggataatatcccaaagtgtgttttccaacttgattccattctccccgtcactttcaggtataccaatcaatcgtaggtttggtcttttcacatagtcccatgtttcttggagcctttgttcattccttttcattcttttttctctaatcttgtcttcacgccttatttcagtaagttgatcttcaatctctgatgtcctttattctgcttgattgatttggctattgatacttgtgtatgcttcacgaagttctcatgctgtgtttttcagctccatcaggtcatttatgttcctctctaaactggttattctagttagcaattcctgtagccttttatcaaggttcttagcttccttgcattgggttagaacatgctcctttagctcagaggagtttgttattacccaccttctgaagcctagttctatcaattcatcaatctcattctctgtccagttttgtgtccttgctgaacaggagttgcgatcatttggagaagagacattctgttttttggatttttcagcgttgttgtgctggtttttcctcatctttgtggatttatctacctttgatctttgaggctgttgatctttggatggggttattgtgtgggggtcttttttgttgatgttgatgttgttgctttctgttagtttttcttctagcagtcaggcccctcttctgcaggtctgctgcagtttgctggaggtccactccagacccttttcacctgggtatccccagcggaggctgcagagctgcagaacagcaaagagtgctgcctgttccttcctctggaagatttgtcccagaggggcaccagcctgatgccagccagagctctcctgcatgaggtgtctctcaacccctgttgggagttctttcccagttagaaggcacgggggtcagggacccacttgaggaggcagcctgtcccttagcagagctgttgtgctgtgctgggaaaatccctcttatcaggatcagctgctctcttcagagccagcaggcagaaaagattaaatctgctgaagctgtgtgcccacagccaccccttcccccaggtgctctgtcccagggagatgggaattttatctgtaagcccctgactgggactgttaccctttcttcagagatgccctgaccagtgaggaggaatctagagaagcagtctggccacagctgctttgccatgctgtggtgaactttgcccagtccaaacctcccaccctccttagcactgtccagggaaaactctactaacgcctcattaatcacggatgcgcctcccccaaccaagttccatcattccaggtcaacttcagactgctgcactggcagtgagaatttcaagccagtggttcttagcttgctgggctccatgggagtgggacctgctgagtgagatcacttggccccctggcttcagccccctttccaggggagtgaatggttctgtctcactggggtttcaggcaccactggtgtacaaaaaaaaatcaactcttgcaactagctcggtgtctccccgaacagctggctagttttgtgcttgaaacccagggccctggtggtgtaggcacacaagggaatctcctgatctgcagattgcaaaaactgtgggaaaagcgtagtaaccgggcgagtagcatagttcttcacggcttcccttggctgggggagggaggtccctggctccttgcatttcccaggtgaggcaatgccccaccctgcttctgctcgccctccatgggttgcacccactgcctaactagtcccgatgtgatgaactgggtacctcagttggaaatgcagaaatcgcccaccttctgcattggtctcgctgggagctgcagagcggagctgttcctatttggccatcttggccccgccccttttttaattttaaaaaattttatgtagcgatgaggtctccctattttgccatgctggttttgaactcctgggctcaagtgatccttccacttggcctcccagagtgctaagattacaggcgtgagccaccatgcccaaccaaatttgtattttctcgatgagcagtgatgctgagcacctgttcatatctctgttggccatttgtatattctttctcgcctaacagctcccttgaaaatgcgtgtgcctcagtctatgtcttctggagaactggcacagcttcagaatattagcaccccaaaagagtattttacttagagcataagaagactaaaaataaatcattattatatgtggatgaggtttttcataaaatataactgttaatatattcttggttaaaatgcatgtgtgcttttcttctttaggttacataaagaaaggatgatatctctaaaggtatgtggattcatccaaatttggagccagaagactgggatgactaagctgaaagaagctctcattgaaacagtgcaaagacaaaaggaaattaaactggtggtcactttcaaatctggaaaatttataagaatttttcagctgagcaacaacattagaagtgtggtccttagacattgtaaaaaaagacaaagtcacctgcgtttaactttgaaaaacaacgtgttcttgtttattgacaaattatcctacagagatgctaaacagttgaatatgttcctggacataatccaccaaaacaaatctcagcaacccatgaaatctgatgatgattggagtgtgtttgaaagcaggaatatgctgaaggaaattgacaaaacttcattttacagcatttgtaacaagccaagttatcagaagatgcctttgtttatgtcaaaatcaccaacacatgtgaaaaaggggatattagaaaatcaaggtgggaaggggcaaaacacactatcatctgatgtacagacaaatgaggacattctgaaggaagataaccctgtaccaaacaagaaatataagacagattccttgaaatatatacaaagcaataggaagaacccatcaagtttagaggatttagaaaaagatagagatttgaaactcgggccttcattcaataccaactgtaatggaaatcctaacctagatgagactgttcttgcaacccagactctcaatgccaaaaatggtttgacatctccattggaaccagagcacagccagggtgacccaagatgcaacaaagcccaggtgcctcttgactctcattcacagcaactgcagcaggggttccccaatttgggaaacacctgttacatgaatgcagttttacaatcgctatttgcaattccatcttttgctgatgacttactcactcaaggtgtcccatgggaatatattccctttgaggctcttattatgaccttgacccagctgcttgctttgaaagatttctgtagtacaaagatcaagagagaattacttgggaatgttaaaaaagtcatttcagcagttgcagaaatattttctggcaacatgcagaatgatgctcatgagtttttaggtcagtgtttagaccagctgaaagaagacatggaaaaattaaatgccactttgaatactgggaaagaatgtggggatgaaaattcatctccacaaatgcatgttggtagtgctgccaccaaagtgtttgtttgccctgttgttgctaattttgagtttgaattgcagctctcccttatttgtaaagcttgtggtcatgctgttctcaaggtagaacctaataattatctctccatcaacctgcaccaagaaacaaaaccacttcctttgtccattcagaattctttagatcttttctttaaagaagaagagcttgaatataactgtcagatgtgtaagcagaagagttgtgttgcaaggcatacatttagtaggctctccagggtccttatcattcatctgaaacgctatagcttcaacaatgcttggttgctggtgaagaataacgagcaagtttatattcccaaatctttaagtttatcttcttattgcaatgaaagcaccaaaccacctcttcccttgagcagtagtgcacctgttgggaaatgtgaagtcctggaagtctctcaggagatgatttctgagatcaacagcccattgacaccatcaatgaagctgacctcagaatccagtgattccctggttctacccgttgaaccagacaagaatgccgacctacaaagattccagagagactgtggagatgcaagccaagagcagcatcagagagacctggaaaatggctctgcactagagtcagaattggtccactttagagatagggcaatcggtgaaaaggagcttccagtggctgactcactgatggaccagggagacatttctcttcctgtgatgtatgaagatggagggaagctgatcagcagcccagacacaaggcttgtcgaggttcatcttcaagaggtgcctcaacatccagaacttcagaagtatgagaaaaccaatacattcgtagagttcaattttgacagtgtcactgagtccaccaatggcttttatgactgtaaagaaaacaggattccagaaggatctcaaggaatggctgaacagctccagcagtgtattgaggagagcatcatagatgaatttcttcagcaggcaccacctccaggtgttaggaagctggatgcccaggaacatacagaagagaccctcaatcagtctacagaattaagacttcaaaaggctgacctgaatcaccttggggcactgggttctgacaacccaggaaacaaaaacattttagatgcagagaacacaagaggtgaagccaaggaactaacaagaaacgtgaagatgggggatcctctccaggcctacagactcatcagtgttgtcagccatatcgggagctccccaaattcaggccattacatcagcgatgtgtatgactttcagaagcaggcctggttcacatacaacgatctatgtgtatcagaaatctcagagaccaaaatgcaggaggcgaggcttcactctgggtatatcttcttttacatgcacaatgggatttttgaggagctgttaagaaaagcagagaactctcggctacctagcacacaggcaggggtgatccctcagggggaatacgaaggtgactctttgtacagacctgcttgacagactcactcggcctcacttcatccttgcaaagagaatcctgtacttcatccttgcaaagagaatcctgtacttcactcagaatgaaggaacaagtatctcaggatgaaatctcaatgaaaaacacttattttgggggaatatctattttaactgcttcagacacctagatcccagaactcaggcgcatatgcatattttccctgcaagattagaatggtgctcttcacgttttgacggtggttttcaaaatgttgttcttcaaccagcaacagcaacagctagggactgattagaaatgcaaattcttgggtcactctctagaccaactgatgcagaaacaggaggtgtgagccagcaatcagatggagattctagtgctcatgaaagtttgaagaacactggtaatgtgtggagtatcttggtgtattttgctactgttgatatggattgcttatgttatataaacgattttcattaaattttttgcactcttttattttgtcccactgaacctaagactagatagagtcaccccaaaagtggcagcagggaaattccaacaagagagtgcccaaaaccattctgagatcgggccggttgggattccaaagaaagaagcaccaaacaccagagggatctttccggagcatttattagggggaacttagagagttctgcagcataccctcaggcggacagtgagagaaaaaagcatggtcaaccagctgggcaccgtggctcatgcctgtcatcccagcactttgggaggccaaggtgggaggactgcttgagcagaccagttcaaaaccagcctgggaaatatagcaagaccctgtctctacaaaaaataattcagcagccaggcacggtggctcacatctgtaatcccagcacttgggaggccaaggcgggcggatcacctgaggtcgggagtttgagaccagcctgaacaacatggtgaaactccgtctctactaaaaatagaaaattagctgggtgtggtggcaggcacctgcagtcccagctactcaggaggctgaggcaggagaatcacttgaacccagcagatggaggttgcagtgagccgagatcgcaccactgcactccagcctgggcaacaagagcaaaactccatttctaaataaataaataactttgccaggcatgtctcagctgctcaggaagccgatgtgggaggatcacttgagtctgggagttcaaggctgcagtgagctatgatcacactactgcactccagcctgggtgaaagaccctgtctcaaaaaaaaaaaaaaaaaaaaggcgggaggggggatggtctaccttggtgtgtctgctgcagtgagagggtcagggtatggggttatataagtttataaggaatttggtcaagggtggggactagtttcttttagtgttttgggcaacaacctaaacctaaatacctctatcagtgcctgggaatgtttcaggctctactttggattcaagccttctgggaaaagcctgcagcttggctggtcagagtggtcaaagcagtccatgattttcagtcacgacacagaaagaaagcagggggtgagtacttttcctttgtaaagttattaaaataataacccaacccatacatataccattggctagcttccacatgtgtttatgactggtgactagtaaaatttgctatgcagcaatcaactgttatttaccattttccaggaatttcagggcataacattagggttatatgcaaaatgcagtatactaaatatccgtgtgattttgtgaattcaaaagcactgcaagatgttgctcatgttattaatatgaataagacgataaacccatcctcataaatgtacaacatttcctggtggccaagccttaaacagcttataatgtacccagtatcagtgggtgatgtgttagactgtgaattcagcaaggagtaaagaacgatttttttaaatggccatgtgagtagacaaatggaaattgagaggattttttgggtaaaaagagataagagcctggtattatataaggaatggggcaaaattaggcagagtaggtgtgggaaagaagagaagagcaaccagaaacatacgtacgaggtttttaaaaatacattatttttagcatttaagaggaaaagaaggaaagtactatgaaaaaagaaatgtaggccggtcacagcggctcacgcctgtaatcccagcactttaggaggccaaggcaggcggatcacaaggtcaggaaatcgagaacatcttggccaacatggtgaaaccccgtctctactaaaaatacaaaaatgagccaggcgtggtggtgcatgcctgtcgtcctagctactactttggaggctgaggcaggagaatcacctgaaccagggaggcggagattgcagtgagctgagatcacaccaccgtactccagcctgggtgacaagagtaaaactctgtctccaaaaaaagaaaaagaaaagaaagaaacgaggctgagtgccatggctcatgcctgtaatcaaagcactttgggagcctgaggtggaaggattgcctgagcccaagagtttgaggctgcagtgagctatgactacaccactgccctccagcctgggcaacaggtgacaccctatctcaaaaggaaaaacaaaaaaggcaaatggcaattgcagtgaagaaatgccaagataccttcatgctcaggagagaaagctgtacttcctggatgtggtttccagtcccctacacctctagagaaacctctccactcatgaattatagaaatcatccctaaaagtataaagtgctgtcttatttgtttattttattttatcttatttttgagatgaaattttgctcttgttgcccaggcaggagtgcaatggtgcaatattggctcactgcaacctctacctcccaggttcaagcaattctcctgcctcagcctcccgggtagctgggattacaggtgcccacaactatgcctggctaatttttgtatttttggtagagacagggtttcaccatgttggtcatgctggtctcgaactcctgacctcaggtgatgcgcccacctcagcctcccaaagtactgggattacaggcatttgagccaccacgcctggccaaaagtatagtcttttaaacgtttttaaagatatggataccactggtcattattcactggaataaaactccatcagggttttagcacatttggtttattgctacatcttcagtgtttaagagttcctggtacacaaaaggcatctaataaatatttatacttaataaacatttgctgagtgagtatgccgaatgggttttcaaaggatactgtgataataagtcctcgctaccttcaaaaatagcctccaaattagaggccatttcaacatggaattctggggtgacaattccaggcaaccatatcttcccatgtttttttaagtgcatggggctcctatctggagtgaattcttttctggtgcctaacaaggtatgacctgtcagcgaaggctttaccgcattcagaacatccataaggtttttgtccagtatgggtttttttatgcaaactaaggtttaatttccggatgaaggtttttccacattcactacatctataggtcctctctccgctatgagttttctgatggctatgaaggtttgacttctgaaagaaggcttttccacatctgttacattcatagggcttttccccagtatggatttttttatgttgaatgaggtttttcttctggataaaggtatttccacatagatcacactcataagctctcttcccagtgtgaattttctcatgatcgatgacattggatttctgggaaaaggccttctcacatatgctacatttatagggtttctctcccgtgtgtattctctggtgtttcacaagatctgacttgtaaatgaaagcctttccacagtccgtacattgaaagggtttttgtccagtgtgaacttttttatgttgaatgagggttgagttctgcctgaaggatttctcacattcattacactgataggatttcttggcattatgaattttctcatgattaatgcaggatgatttccaggaaaaggcttttccacatgtcttacactgatagggtttctctttagtatgcattttctgatgttgaaagagatttgacttctgcttgtaggcatttccacagttctcacatttatagggcctttcctctgcgtgagttttctgatgtttatcaagcttccacttctccccgaatgctcttccacagctatgacattcaaagggtttttgacaggcatgcctcctcaggtgactttgaaggcgtgactttgaactgaataactttctacaggcattacatttcagttgttgtcctacaaatttggatggattattgccaactaattttctgtatccattatcatcgtgagaattattttgtacatagtgttgcaaggaagatacatcatctatgcccagtggaagtattttcttagatccgtcacattctacacctttctgcgtagtcagcgtttccttattgattgatgggacttctcttgcgagactctctttcacatcctttggcttccaaatctgccctccaatgtccccatttttttctaaaatggaatacaaaaaaatgtcctgtgtaaaacgttccactcacatgcttgaaataaaatgccataaacaatctattgtggtgattattctggcttcaaacctaatgtctacgagaaaccaaagttaatataagctctgttagagttctatgtgagctaatgttacatgaagctatcacatatctgtctgtaaaggactgagcaacgtagacctagtgcacagggagcaggtgagagcctagggataccagggagagggagattaagaaagagagtttgccaggccaggcacaggggctcacacctgtaatcctagcactttgggaggctgaggcgggtggattgcctgaggtcgggggttcaagaccagcctgaccaacatggcgaaaccctgtctctactaaaaatacaaaaaattcgccgggcatggtggcaagtgcctgtaatcccagctactcgggaggctgaggcaggagaatcgttcgaactcgggaggcggaggttgcagtgagcccagatcgcgccactgcactccagcctgggcgacagagactccgtttccagaaaaaaaaaaaaaagaaaaaaaaaagagtttgcctgcaaaggaaaacccagataagaatgtaaagaaatttctgagtggagaaaaatacctggagatttcttccagcactcccaggaagtcacagctggctgccaaacgacttcctcatttagaaaagctgaattggcttccatgcaccattgacccacagtgctctcctggtcacctacctgcacggccacttcccagcacttcctcttcctccaaccatggctcctttccttgttccaacctcaagatcacatcgggtttggtggtttccccttgtcctgtgatggaagataccgcaaggcttggtgtttgtggatgtgtgagttgtttgtgcaagtgtatgagtgtatataagcgcttgcgtatgcttgtgtgaatatttgtgtgtgagtgtgagcatttatatgtcagtgtgtgggtatgtgccattggttggggggagttgtgtggatggatggtttgagggaatgcacctgagcagtcgaactaaacaaagaatgctttttctgggctgggtgtggcggctcatgcctgtaatcccagcactttgggaggccgagataggagaattgctagagcacaggaatttgagaccaacatgttacatgtaacatgaagatagcaagacccagtctctacaaaaccaaagccacgtgtggtggtgcacgtctgtggtcccagctattcaggaggctgaggtgggaggatggcttgagcccaggtcaatgttgcagtgacgccaggcgtggtggttcatgcctgtaataccagaactttgggaggctgaggcgggccggttatctgaggtcaggagttcaagactagcctcaccaacatggagaaaccccatctgtgcaaaaaatacaaaaattagccaggcatggtggtgcacgtctgtaatcccagctactcgggaggctaaggcaggaaaatcactggaacctgggaggcggaggttgcagtgagccgagatcacaccactgcactccagcctgggtgacagagcgagactgtctccaaaaaaaaaaaatactacagtgagctatgattgcaccactgcactccagcctcggtgacacagccagaccctgttaggagaaaggagataaagaaagagagaggaatggagagagggagggagggagaaaggaaggaaggaaggaaggaaggaaggaaagaaggaaggaaggaaggaaagaaggaaggaaagaaggaaggaaggaaggaaagaaggaaggaaggaaggaaggaaggaaagaaggaaggaaggaaggaaagaaggaaggaaagaaggaaggaaggaaggaaagaaggaaggaaggaaggaaagaaggaaggaaagaaggaaggaaggaaggaaagaaggaaggaaggaaggaaggaaagaagggaggtaggaagggaggaagggaaggaggcagggagggagggagggagggagggagggaaggaagggaaagaaagaaatgctttttcttcttggaggataaagcttttccaaaaatcaagaccaggagtagggtgaagggcagggcacccagcccacaaaacttacagaggccctcactcattctcccggcacttgccgaccctgagaatgggggctccttcaatacagcacttggtacacttcacttgcctcaccctagtcccggctctacaaaaacatatgcgaagtgaggagcacctctgtgccaaccctatttggccagccatggggtgtctgtgtgtttcacgccttaggttttgagtccccctgcccgggaagccgtccttacccacagagacaaggttgctgtaattctccagcatcacatccctgtacaagtttctctgttcgggattcagccgctgccactccccctgggtgaagttcacagtgacatcctcgaaggtcactcttccctgtaacaacagattcccgatcagtataaaaatgccattgaatcctgcggctgaggatacagaaacttgtttctgctgaaccaagctttaatcatgtccataattcactctactctggatgaaaataaattgtgcccagaggatcttgccaatgagccataaaccttagacctactcatgacactgccatctttctccaccctctagtcccaccaattttacttcctgaatctcaaacccagccattagtttccatcttctccaccattcataaatccaccttgtcatcttttacttagagtaaggcagaggccgagtatggtggctcacacctatcatcccaacattttgggaggccgaggcaggaggattgcttgaggccaggagtttgaggctagctggggaacatagcaaaacccctatctcaaagaacattttattattttggccgggcacggtggctcacacctgtaatccctgcactttgggaggccgaggcgggtggatcacctgaggtcaggagttcgagaccagtctggccaacatgaagaaaccccatctctactaaaaatacaaaaaattagccaggcatggtggcaggcgcctgtaatcccagctactcaggaggctgaggcaggagaatcacttgaacccaggaggtggaggctgcagtgagccaagattgcgccactgcactccagccagggcaacaagagcaaaactctgtctcaagaaaaaaaagaaaaagaaaaagaaaagaaaagaaaatgttattatattttttttctattttccatttttctttaagacatcctgcctctattagaaattcttttttaaatagaggcctggcatggtggctcacacctataatcccagcacttcaggaggctgagacaggtggatcacccggggtcaggagttcgagaccagcctcgtcaacatggtgaaaccccatctctactaaaaatacaaaaattagccaggtgtcgtggtgcgcgcctgtaatcccagctactcaggaggctgaggcaggagaatcgcttgaaccctgggaggtggaggttgcagtgagctgagatcacaccactgcactccagcctgggtgacagtgagactccatctcaaataaataaatacataaataagtagaataagccaatagccccctaattcttccagctacatctaaactgactgtaatctattttccacagtcgacattcagactggatggtgcgctcccctaatttatcagctttccttgcatttgggagaaacaggtgacacctgttacaggggccagcgtctggcatgtctaccacactcccactcacacagggtcacacagcactcccctgggtctctcctgcagccatactggacttacggcagcattttgcccctgccactcaacactcacagtgttggaagtcacacttgtaaagcgaattcctttgtcagaaactgaaaatctcacctctaagagccagcacctagtgtcctcttggacagataaattttttagttgtgtttgtgctctagctcgcttttttaaaattttgtttatttattaattttttttggcggggaaggggacagaggctcactctggtagcccaggctggagtgcagtggcacaatctcggctcactgcaacctccacctcctgggttcaagcgattctcctgcctcagcctcctgagcagctgggattacaggcgcgcaccacgacacctggctaatttttgtacttttagtagagacgggtttcaccatgttggccaggttggtctcaaactcctgacctcaagtgatctgcccgcatcggcctcccgaagagctgggattaaagggatgagccaccgcacccggcctttttttttaaatttttgacacaggttcttgctctgccacccaggctggagtacagtggcatgatcatggctcactgcagcctcaacctcccaggatcaagcaatcctcctacctcagcctccagaatagctgggactacaggcatgcaccaccatgctaagctcattttttattatttgtagacagggtctcactatattgtccaggctggtcttgaactcctggcctcaagtggtcttcctgccttcgcctcccaaagtgctgggattacaggtgtgagccaccacacccagccttagtatgcctttcctgtcaacaggaaattggtcaacaggcttaattttaacaattgcaaagaaactactatctgcctaactgcatacaacttatccttggtctttcagctatccataatttactttgattccgactggtactagttaatgatttttcagtttattgtgtggatttacagaatttgtttcaaatacacaccgaacaaagttgggagaggacacacattcaagacaccaatcatttaaaaaataggttggggtgaaacacacatgacactgttacatctcagggcttagcagtggaccaggtttgtaagagcaatggtcaaaagatgcttgaggctgggcgtggtggctcacccttgtaatcccagaactttgggaggctgaggcgggtggatcacctgaggtcaggagttcgagaccagcccgaccaatatggtaaaaccccatctctactaaaaatacaaaaattagccgggcgtgggcgtggtggcgtgcgcctgtaatcccagctgctcaggaggttgaggcaggagaatcgcttgaacctgggaggtggaggttgcagtgagccaagatcaagccattgcactccagcctgggtggcagagggagactgtctcaaaaaaaaaaaaaaaaaaaaaaacaacaaaacaaagatgcttgagctgaaaccagcccagtaatcccatagacagttgtgggttttttgttttttgtttttgtttttgtttttgttttttggataaacatagaaattgacccttccgctgttaaagcttgaaacctgtatttgttttgtctgagttccttcctcaggaaaagaccttcagatctctcaaaggcaggcagatcacctgaggtcaagatttcgaggccagcctggccaacatggtgaagccccgtctctaccaaaaaatacaaaaattagccaggagtggtggtgcgcacacctgtaatcccagcaactcaggaggctgaggaaggagaatcgcttgaacctgggaggcagaggttgcagtgagctgagattgcaccactatactccagcctgggtgacacagcgagactccctcaaaaaaaaaaaatcaactgaaactcaccacaactgaaactcaccacaacagatgtctccttgccccctccctagtcttgctttcttacacattgttatatttcttccatgctgtataaacccctagttttagtgagttagggagatggatttgaggctgagctcccatttcttcacctacggcagctgattaaagcttcttccttggcaatacccattgtctcagtcattggctttctgtgcagccagtagcaggacctagaccaaactcctggtgtttccgtaaccaagctttttttttttttttttttgagacagggtcatgctctgtcacccaggctggagtgcagtggcacaatcatggctcactgcagcctcaacctcccaggttcaagcgattctcccacctccgcctccagagtagctgagactacaggtgtacgccaccaccaccacacccagctaattttttgtagagacgggatctcgccatgttgcccaggctggtttcaaactcctgaactcaagcgatccgcctgccttggcctcctagattgctgaattacaggtgtgagccaccatgcccagccttgagctttacttgaaatgtttcagctttaataggaaagcagaaagtagagtgtgtgttaccttttaatagaagtatggaaggaaggaggaaaatatgccaaaaggttagcacagttaattctgagcaagaggaacgtgggtcatacgtttattcattatgagatttagatttttttgaaaagctcacctgggaattgttcatttcctgttcttcaccagtcagtaaagtcttgggaaggcagatctgagggaaaatggaaaagaaccatgaaatagcagaattcgctttggaagttggggatcatccagcatagaatgctccacaccctggataaaagctctccctaacccactcagaaaagccctgacttgtacctcagtgatccccttctgaaggtcttttttttttttgttttggtttttttgtgtttgtttatttattgagactgggtctcaaagaagaaagtgcaagccaggcacggtggctcacgcctgtaatcccagcactttgggaggctgaagcaggcagatcaccagaggtcaggagttcgagaccagcctgtccaacatggtgaaaccccgtctctactaaaaatacaaaattggctgggcgcggtgactcatgcctgtaatgccagcactttgggaggccgaggcaggcggatcacgaggtcaggagatcaagaccatcctggccaacacggtgaaaccctgtctctactaaaaatacaaaaacaaaattagccaggcgtggtggcgggcgcctgtagtcccagctactcgggaggctgaggcaggagaatggcgggaacccgggaggcggagcttgcagtgagccgagatcgcgccaccgcactccagcctgggcgacagagcgagactccgtcccaaaaaaaaaaaaaaagagagagagagaaagctaaacagcagttcaacagcacctttaaaacaagcctgtgcaaagacaatgaggcaagcatcagatcagctagagcacagtaaggaaggccgagagcagaaaccatgaatcctgaagcagctgtggtcgtgacgaataacgccgcagtgaacatgggatgcagatagcccttcagctttgccataagcgggacagctggatcattggtaattctttgccaaaagcgtagattttggccacgcgtggcagctcacacctataatcccagcactttggaaagccaaggtgggaggatcagttgagcccaggagttacttttttttttttttttttaagaccaagtcttgctctgtcgcccaggctggagtgcagtggcacagtctcggctcactgcaacctctgcctcccgggttcaagggattcccctgcctcagcctcccgtgtagctgggattacaggcatgcaccaccatgcccagctaatttttgcatttttagtagagacaaggttttaccatgttgttcaggctggtctcgagctgctgatctcaagtgatccgccggcctcagcctcccaaagtgctgggattataggcgtgaaccaccacatccagccaagcccaggagtttgagaccagcctgtgcaacatagtgaaacctctgtctcaatgtttaagtaataaagtttttattttttattttattttattgaggcagggtctcattctgtcacccaggctggagtgcagtgatgtgatcccggctcacagcagtttaaaaatccctggctcaagcaatcctcctaccttggcctcctgaatagttaagactatgggtgcatgctaccacatcagctaactttttattttttgtaaagaagggatcttgctatgtcacctaaactggtctcaaactcctaggctcaagcaatcctcctccctcagcctccccaaatcctgggattacatgcatgagccaccacaccagccaggaataaagttttaaataagtaaatatgtttttaaaaagaataaacttgccgggcacaactttaatgtttattaaagtttgaggagtccaattctagcacaaaaaatatatataattttaaaaaacagtaaattgtaaatgctttcaccacaaaaatagattaattagcttgatttaatcatccccccaatgtaaacatgtatcaaaacatcacattgtaccccataaataaacacaattattatttgtcaataaaaagtttttagaagtagctgtgggccagcagtaatgctaaggactggagggccacgaaaataattttgagtgtcctgggagcatcacttttcaatatgacaactaaaaaaaaaatctaaactaccaatgtaaaatatttagcttattccagcaaataggagaggtagaaaaatgaaactaagtaaaaatgcaaaacaaacaaacaaacaaaacccagacatttggttttcagggagaaaaaaaaatcagcttacctccagtggaatctggcataaattagcaagttgattgatttctgatgcctgtggtcttttcttctgaaagggactgaaaatgaaaaggcgtgtatactgaaaagctacactaatgactaaaacttaatcggccctctacccgctgtattccgcatcataatccagtcaagaaacaacccaaaacactcacttcctatcaaaagccccacctgatcctatcaggccacatcaaaatttcaattcccaattctttcctcgacttctccaaaactgaatgaactctcataaaaattgtgattgtgaaagcttaattttcaaatctgcccaatcagtttccaatggaattttttttaagttcatgcaagtaaaaattttttaccttaactttgaaatagaaagcatggaaaacattatccaaatgtcagaggatgaaaataaattaaaacaacaaaaattggctgggcacggtggctcatgcctgtaatcccagcactttgggaggacaggagttcaagaccagcctggccaacatggggaaaccccgtctctactaaaaatacaaaaattagctggtcatggtggcacgtgcctgtaatcccagctacttgggaggctgaggcaggagaatcgcttgaacccgggagacggaggcttcagtgagccaagatcgtgccactgcactccagcctgggcaatgagcgagactccatctcacgtctcaaaaaaaaaaaaagaaaggaaaagaaaaaagaaatagggccagcggaggtggaacaatgccttaaagtgctctccgcccgacagaaagaattcaggctccaacctccaactggcaaaatctcttcagctgtactaatactctcaaaatgagatcaacatgccaatccatccccaccctagtctgggtgttgaatttaaacacaggctacatgcccttgcctgcagacatggagaccttccaaaattgagcgtccaactgaattccaagagattaaaccagacttcatgggacaggatgcaccagactagacctcctcccaggagaagaggtatccaaagatcgtattagcaaatgacccttggcggtgtgcggtggctcaagcctgtaatcccaacactttgggagactgaggcagacagatcacctgaggtcaggagttcaagaccagcctggtcaacatggtgaaatcctgtctctactaaaaatacaaaaattagctgggcatggtggtacacacctgtagtcccagctactcagctactcaagaggctgaggcagaattgcttgaacccaaaacacagaggttgctgtgagctgagatcatgccactgcactccagcctgggcgacagagggagactccatctcaaaaaaaaaaaaaagaaaaaaaaagcaaaatgacccagccagcctgaatcccagccgccgtgtcggactactatagtcccagatacttggaaggctgaggtgggaggatcaattgagcccaagaggtcaaggctgcagtgagcaaggatcttgccactgcattccagcctgagagacagagcaagcctgcaggtgaacggaaaggggtggagtgattttatatatatatatatatatatatgtatatatatatatatatatatatattttttttttttttttgtctgagccgctgtgcctggccttttttatttttttttagagacaggctggtctcaaactcctggccccaagtgatcctcccatcccagcctcccaaagtactggtattacagatgtgagccactgcagttggctcaacagcagattttcaatgtagatgaaaaagccatctattggaaggagattccatctaggatttttatagctagagagaagtcaatgcctggcctcaaaacttccaaggacaggatgattctcttacatgaaactaatgcagctggtgactgaatttaatctaatgctcacttaccatttaaaaaattttaaagcctctaagaattatgctggccaaatgcggtggctcatgcctctaatcccagcaatttgggaagccaaggcgggcagatcacttgaggtcaggagttccaagccagcctggccaacatggtgaaaccccatctctactaaaaatacaaaaaaattagccaggcatggtggcccgtgcctgtagtcccagatactcaggaggctgaggcaagacaatcacttgaacctcggaggcggaggctgcagtgagccgagatcacaccactgcactccagcctgggtgacagagtgagactgtgtctcaaaaaacaaacaaagaaaagaattatgttaaatctactctatctgtgctctataaatgaaacaacaaagcctgggtgatagcacatttgtctacagtatggttttgattattttaagcccactgttgagaactatttctcagacaaaaagaaaaagattcccttcaaagcattactgctcttcagatcccaggtgttaagccagtaaacacaataaataaataaataaataagtaaataaataaataactgctcatcaaacctaaacacaaaaatagaaaaataataaaaaagcaaaagaccacacaaaaacaaaatatcactgctcattgaaaatgtatcgggtcactcaagagctgatggatgaatcttaatttcagttgaagaaaaaaactctgatggagatgtacaaggagatgaatgttgtttgcatgcctgctaacacaacatccattctgcagaccgtgggtcaagaagtaattttgactttcaagtcgtgttatctaagaaacacatttcataaagccatttctcccatagatagtgaatcctctgatggatcggggcaaagtccattgaaaacctccatgaaacagttcatcattctaaatgccattaagaacatttgtgattcatggaaagaggtcaaaatatcagcatgaacaggatttggaagaagtggattccaaccctcatggatgactttgaggggttcaaaaattcagtggagaccaggcacatgacttatgcctataatcacagcattttaggacctaaagtgggacgatcacttgaggccaggagtttgagaccagcctggcaacatagcgagactcccatctttatttttaaaatatatattaataattcaatggaagtagtgactgcagatgtagcagaaatagcaagacaactagaattggaagtggagcctgaagatgtgactgaatttttgcaacctgctggtaaaacttgaacagatgaaatttttttttaattaaaaaaatgttttaaatgaaagaccctttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttatcaaagaccagatagttgtagatatgcggcgttatttctgagggctctgttctgttccattgagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagagatctagaactagaaataccatttgacccagccatcccattagtgggtatatacccaaatgactataaatcatgctgctataaagacacatgcacacatatgtttattgcggcattattcacaatagcaaagacttggaaccaactcaaacgtccaacaatgatagactggattaagaaaatgtggcacatatacaccatggagtactgtgcagccataaaaaatgatgagttcgtgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaagtataataaaaaaaaaatagaaaaaaaagaaaaaataataaaattacaattcatgtttccataaaaaaaagaaagacctcatgaagcgggcagatcacgaggtcaggagatcaagaccatcctggctaacacggggaaaccccgtctctactaaaaatataaaaaattggccgggcatggtggtgggcgcctgtagtcccagctattagggaggctgaggcaggggaatggcgtgaacccaggagacggagcttgcagtgagcagagatcacgccactgcactccagcttgggcgacagtgctagactccgtctcaaaaaaaaaaaacttgacctgatgaggaattgcttcttatggataagcaaataaattgtttttttgtttgtttgtttgttttttgagactgagttttgctcttgttgcccaggctggagtgcaatggcgcgatctcagcttaccacaacctctgcctcccaggttcaagcaattctcctgcctcagcctcccaagtagctgggattacaggcatgcaccaccacgcccggctaatttttttttgtatttttagtagagatggggtttctccaggttgaggctggtctcgaactcctgacctcaggtgatccgcccacctcggcctcccaaagtgctgggattacaggcgtgagccaccgtgcccagccttaaagtgtttttttaaaggtactcaaatatgtcaattttattgtttctctatgtgcacatttatttgctactgaaaattgcaaaagcagtacatcatggcttcttattgcaatgcatcctcccacctcagcttcccaagtagctgggaccacaggcatgtgccacttcacctggcaaatttttttgaaaaatttttttgtagagatggagtctcgccatgttgcccaggctggtcttgaactcttagcctcaagcaatactcctgccacagcctcccaaaacgctgggattacatgcaatagccaccatgcctggcctacttcaagttcaaaaatttaaaccaaccttcatcccagtgtcttcacaaatgctcagcaaagaaaattcctaagacaattcagggacctctcataaccttactgagagacgttaataaagaaccttagtaacttgactctcaactctactaccaacccttcccctctagcagaagtttcaccccaacaacaggatagaagagaaacaatcttccaggacatcagagatggcttgccttacaggaggaaattagtaagaacattgctctctgtggggaaagaaaggatggtaaaaatcgagatacctattaatagattttctcagcttgaaagagaactgacactaggcttaagggagcgcagaatgaatcaagaagtgaaccattcaaatgtggctgcagtttttgtgtgtatcacagatgggatccttctgagaatgctagaaaagggaattatgacacagagcctattcagccataaacattatttttgtactttttctttcttgctggtaattttttcctattcttttgagatggagtctcactctgttgcccaggctggagtgcagcggcatgatcttggctcactgtagcttccggctcctgggttcaggcagttctgcctcagcctcccaagtacctgggattagaggcgcccaccactacgcccagctaatttttatattttgagtagagatgtggtttcaccatattggccaagctggtcttgaactcctgacttccagtgatccacccgcctcggcctcccaaagtgccgggattacaggtgtgagccaccacgcccagccttcttgctggtaattttttatatagtgggttaagaaagctactctatgctaggatagactatcgcaatatttttgatatctttttctgtgatatctttttctcatacattttccttcctacaatgacactggtaacttataaggaatctgtgtagtttgaatgtatttgaataatttcaatataccttagtgctactctttgatttaatccctaaagcaccaataggtcctaaatattctcatgtgttttagaagcctgaagtcagtgagaaaaacccacagagagcaatgtttttactaatttcctcctgtaagtctagccacctctgatgtcctggaagattgtttcttttctatcctgttgctcgggtgaaccttctgctagaggggaagggttggtagtggagttgagagtcaagttactaaggttctttagtaacatctcacagtagagggtatgagaggcccctgaattgtcttaggaattttcttcagtgagcatttgcgaagactcggatgaaggttaggttaaacttttgtcatgggtccattggcaggctagtcacaagtgcctcctggatctttgggtcctggcggaaaacgatgccagactctcaaattgccacaaggtagcctggaaagaacgccacagtccagaaggagcctcgaaagtggtttcatgaggtggaatttactcctggtgaagatgctgtgaacgctgtttaaactacaacagaggatttacaatattgacgcacgtagttaagaaagcagtggcagggtttgagaggattggctccaattttgaaagaagttctattatgggtaaaatgctatcaaacaacatctcatgttccagagaaatctttcgtggaaggaagcgtcagttaatgtggtaaatttcattgttgttttaacaaattgttacaaccacttcaatatttagcaaccaccacccttatcagccagcagccaatgacattgaggcaagactcctcaccagcaaaaaagattacgactccctgaaggctaagatcattattagtatttttagcaataaagtatttttatataatttctttttaaaaaataatggagcttcaaataagggcatcaggtattttttcttttaatagatggggttttgccatgttgtccaggctgagctcaagcaatccacctgcctcggcctcccaaagtgctgggattacaggcgtgagtcaccccacccagccagcatcaagtgttttaaaattaaagtatgtgccttgtttcctagacataacaccattttacactttattagactacagtgtagtgtagtgtaaatgtaacttttttttttgagagggagtctcgctcggccacccaggctggagtgcagtggcgcgatcttggctcactgcaagctccgcctcccaggttcacgccattctcctgcctcagcctcccgagtagctgggactacaggcacctgctaccatgcccggctaattttttgtaatttttttttttagtagagacggggtttctccacgttagccaggatggtctcgatctcctgacctcgcgatctgcccgcctccgcctcccaaagtgctggtattacaggcatgagccaccgcgcccggccataacttctttttttaaatagagacaggatctccctatattgcccaggttgacctcacaactcctggtctcaagtgatcctcccccttccatgtcctaaagtactgggattataggcatgagccaccacacccagccaatgtaactttatattcacaaggaaacaaaaccatttttgtgactcactttatagcaatatttgctttattgtggtgggctgcaacccaatccacaatatctttgaggtatggctgtactttctaagtgtttcctgagtcagcctactttttctccattttttggtcattattctatccggttttttttttgttttgttttgttgttgtttggaaacaagaacttgctgtgtcgcccaggctggagtgcagtagcacgatcatagctcactgcagcctcaccatccctgtgttcaaaccattctcctgcctcaggctcctaagttgctgagactacagatgcacactaccacacctggctcatttttaaaaaattgtttgtagagatggggtctcatcatgttgcccaggttgatctggaactcctggcctcaagcaatccttccgcctcagccttctgagtagccctgatcaatccattgttgaagaatacatggatgttactttgcagtctgtcatcctgaatttgtgttcacttgacattgcctaattattagtttcagcttacccactttttgtcactaacacgcagaagagactgtggccttcttactgtatcatatcaggaagcatctcacattggtttgtgccattactggtgcagtgactttcagccacttggttaaggtggagttggccatatttctctgctgcaaaattactgattttccttttgtaattaataagtgtgtgtgagtagattcttttgagatgaagtatatatcttgttcttccttgaacttaaaggtttttttttaagtgaaagcaaatttgttaagaaagtaaaggaataaaagaacggctactccataggcagagcagtgtcactttaaggttatgacgtcaagtgatttttgtacaaatcaataattactgtgatgattgaaaaaagattattaccaagtttattttcattgtctcaaggtcttctgaactctggatctaggctgtgtcaacagggtagtgtggtaccccctgtacccgtctctgcctcctacagtccttttcatttattttgtttttttataatagaggcagagtcttgctatatgttgtccaggctggtttcaaactcctgagctcaagcaatcttcctgccttggcctcccaaagtagtgggattacaagtgtgacccaccacatctggccaagtcctttaccatcttcagaaggcttagcttgcagtttcagcagaaggatagactcccaggaagaccgtgagacagatttggggtccagttgatattatcaagtacactgaatttgactgtgttcaccacgttctggctccagagaaatgagagtcactagtgaagttggtgccattttgtgtatcttctgcacctaaggaggaaaaaagatagaggaaagaatgtaagagatcagcttatattcacaaacatggacgtcagccttttcccaccttttctttttttttttttttagacggagtctcactttgtcgcccaggctggagtgcggtggcgcgatctcggctcactgcaagctccgcctcccgggttcacgccatgctcctgcctcagcctcccgagtagctgggactacaggcgcccgccaccacgctcggctaattgtttgtatttttagtagagacggggtttcaccgtgttagccaggatggtctcgatctcctgacctcgtgatccgcccacctcggcctcccaaagtgctgggattacaggcgtgagcctccatgcccagcccccaccttttcaatccaatatggaacctactacctcctgggaaagccatgcccccgctgcccctggcagaccacacctgaggattcattcctcctctcactcaatcacaccttcaacagaagtgtattgagcgtttcctttgtaccaggcactggggatacaacagtgaatttgtatccatggggttgctggaatccagttggaaagtgggcagtggattcttcagaaggttcataggcctgggaagagtctttggggactgtgagcaaccccatggtaccgtggagcacttgagtggggatatcctccacctcccaggaggagctgtcggctccaccatgacgaagcactggacatccaagggctccgcttgtgaaccacattggaaacaacaggctagttaccttgcagtccctcaggaatcttgccctgctcttcttgttctaaggacgccacaggttccctttttctctggagaagtaatctagatcttcgattttggaaccaaatctaagtggtaagacaaagaaacttaatttaaacaaagaatgttgtgtaaaactcatgattgctttcttctcttttttcttttctgttttttgagacagcggtctctctcagagtagctagtgccacagctgtgcatcatcaccttaggctaacttttaaactttttgtagagacgaggtttcaccacgtggcccaggctgatcttgaacttctgagcacaaccaatcctcccaagtagctgggactagaggcacacttgactgtgcccaacccaagatagatagatagatagatagatagatacttttttttttaatacggagtctcactcggtcacccaggctggagtgcagtggcacaatcttggctcactgcaacctccacctcccaggttcaagcaattctcctgcctcagcctcccaagcagctgggattataggcgccaaccaccatacccggctaatttttgtatttttagtagagatggaatttcaccatattggccaggctggtcttgaactcccgacctcaggtgatccacccacctcagcctcccaaagtgctggcattacaggcgtgagccaccgtgcccggcccaacattattaacattttatgacatttgtgagagtctataaggcctaaagagaacacccaaaattctgaaactcacacccagtccctttgtgataggttttagatcctgaaagttcacaggtccacctcattacaataccggtgtttctctaaagtgacatgctacattgcagctcttccttctgcctgaaatttttttttctatctctttttcttcccctcagaaatgcccattttacttccaattcccagaatagagaatgtctaggaaaacattcttcatcccacaagacaaacttaatttctgttccttctttgtgcccatagattatacacataggcatgtaaaacttatgcatatatactcacataatttgaaatagcagttcatatatacttgtacgcacacactcacaaaaatccctcaccttccagcagctactatatttttgagacaaaatctcactctatcgcccaggctagagggcagtggtgcgatcacagttcactgcagcctcaacctcctgggctcaagtgatgctcctgcctcagcctctcgcgtaactgggaccacagccatgtgccagcacacccagctaacttttaatttttttcatagagttgtggtctccctgttcctcctgcctcagcctctaaaactgctgggattccagacatgagccgccgtaactggccacaactctttttattttgagacagagtttcgcccttgttgcccaggctgaattgcagtggcgtgatctcggctcaccgcaacctccgcctcccgggttcaagcaattctcctgcctcagcctccggagtagctgggattataagcatgcaccaccatgcccagctaaatttttgtatttttagtagagacggggtttctccatgttggtcaggctggtctcgaactcccgacctcaggtgatccacccgccttggcctcccaaagtgctgagattacaggtgtgagccactgtgcccagccacaactcttaatagtgtgaaaatggcagttaagtttcaacattggttttggaggagacaaacattcaaaccatagcaatcactacctagtacagtacctagcacatagtagatgctccgaataatgcaaaatgaaagaaggacagaatgaaaaatgaacacgagacgaggaaagtaaaacgaaagaaccatcagaactactaatgtgcattcatgtcctgcttacaggagggagcactggtttaaacgcacacacaccctacacagcagtctgacaattttattccatttcaagatgtgtcaggaatgaatcctcggacagactggtacatttctctgagctaaatgttaaatgtctaaagtggacctcataattttttttttcaagacggagtcttgctctgtcacccaggctggagtgcagtggtgcaatctctactcactgcaacctccacctcccagattcaagtgattctcctccctcagcctgccaagtagctgggacaacaggcatgagccaccgtgcccggttaatttttgtatttttgtagagatggggtttcaccatgttggccgggctggtcttcaactcctgacctcaggtgatctgcccacctcagcctcccaaagtgctggcattacagacgtgagccaccgcacccagcctggacctcataactctaacctcagggcataattagaagatctgaaggatacagtagacataaagacttcagtcaaataggccgggcacggtggctcagccctgtaatcccagcactttgggaagccaaggagggtggatcacctgaggccaggagttcaagatcagactgggcaacatggcgaaaccctgtctctactaaaaatacaaaaaatattagccaggcgtggtggcacacacctgtaatcctagctactcaggcagctgaagcacaaaaaccgcttgaacctaggaggtcgaggtggcagtgaggcaagatttcgccgctgcactccagcctgggtaatagagtgagaccccatctcagaaaaaaaaaaaaggctttagccaaatgcctggcttatatgcaatgttaactaatattcactcactcaacaacttctcattgggtgtcacgtgccacgcactgttcagggcccaaggaatacaacattgctcaagacagacagaaaataccagaaggggatgtgagattgagtcctgtgggcacctgggggtagaagccagcagacagggaacagctgtgaaagaccctgaaatgtgcccagcatgatgaggaactgcctgaggcccatgtggcttcccttcctgtatacctagatccctaggagatgggacaaccaccttcttatcactcacttggactcttgactctggaacaccgatttctttagcaagttcttctctggaatcaatcccaggatatgggtttttcataaatgccttgatgagagtgtgtaactgagaggcgctgtaggtggtacgacaccgtctggcttctctacctagggaaggcatggaaagatggaggggggcggtcaaggaatattgcaagggtccattcacatattcaaacacagaacccaaacttgtcactctccctccaatttcgatcccactgactcctcctgagaggatcttgtcccaggttccttccaggtggaaggttctagaggagacccaggatgatatgtctgggcttctggactccagtagaaagaaagtaggcaagaggccgggcgcggtggctcacgcctgtaatgccggcactttaagagactgagagggggcagatcacaaggtcaggagttcaagaccagcctgaccaatatggcgaaacctcgtctctactaaaagtacaaaaattagctgggcatagtggcgcgcacctgtaaatcccagctacttgggaggctgaggcggaagaattgcttgaacctgggaggcagaggttgtagtgagccaagatcaagccactgcactccagcctgggtgacagagtgagactccatctcaataaataaataagaaagcctgggaagagggcaggggagaacttctagggtacgatgaaccctttgccaccataagaccctgaacaggaggtcatcagggaggagacattcttttttcaaagtcgcagttggctccgccgtagagaagctctgctggggaacagaactaagagggttatttactttgaaactccacaccaggttgatcttgcccctggctctggcttgattctaaagtctcagcttctggtcttttctggaatccgtgcctagctcttcgattctgaaaccaaatctaagtgaggaaaagaaaaggagagaattacgtgttaatgtcatttaagctacatcactgcctgttcccaaagtgagcaattcttattgggcctaggcccaggattattacttacttctgtcacattctaccaagtccttttttttcttttttgagatagagtctcactttgtggcccaggctggagtgcagtggcgtgatctcggctcactgcaacctccacctcctgagttcaagtattctcctggctcagactcccaaggagctgggattataggtgtgtgccatcatgcctggctaatttttgtattttcagtagagatggggtttctccatgttggtcaggctggtctagaactcctgacctcaggtgatccacccacctcggcttcccaaagtgctgggattataagcatgacctaccacgcccagcccatctaccaactctttggtcaagacttggcattcacacccagggcaacattgtgtgacaccataatctctactaaaaacaaaaaagttaaaaaaaaaaaaaattagccggccaggtgcagtggctcatgcctgtaatcccagcactttgggaagccgaagcaggcagatcacgaggtcaggagttcaagaccagcctggccaacatagtgaacctcagtctttactaaaaatacaaaacaaaattagctgatcatggcggcaggcgcctgtagtcccagctacttgggaggctgaggcagaagaatcacttgaacttgggaggcgggggtttcagcaagccaagatcacaccactgcactccagcttggacgacacagcgagactctgtctcaaaattaaaaaaaattagctgtggtggcacatgcctatagtcccagctatctgggaagctgagggagggttgcttgagaccgggatttcaaggcttcggtgagccttgattgtgcccctgcactccagcctgggtgagacagtgagaccctgactcaaaaagatgaaaacaaaaataaaaataaaagattgggcattcagcatcttcacaatctgctgccaacatgatttgctctaattattaatatttaattggtaaatagctgctacaattattacatgtttaaaagccagctcaagtatctccttctctgaaggtacgcctacacgtgttctctcacctcctgtgagctcgctcatcctcagtatccacatctgtgaagtgaggctaagaccaacaccttcgtgggtttattgagggtcagttgagatactccctaccaagccctcagcacatgggtacatagtatgggctccgttaatggttctctctcctgcctttttacttccagtcctggagatattgaactttaacttacctggattctggactcttctgtattgatttctaaagcaagtttttgtttggtagcataacctgggtaaggcttttgattgaaggtattgatgaggattttcaactgttcttctgtgaattttgtgcgacagcgcctatgatttgtttttaccatctctgtaggaagattacaaaagaagaagcatgtaataggttaatttatatactcaaacttcaggttcaagctagtctctcacttcctcttcccaaatccactggaatccactccaggagaactaccctcatacaagtatggagctcttgaacacacaatggcgatttttcaacttctttagctcatctgaatgccatactaagaagtcagggatcctctgttttgaaaaaccattaaaaaccattgtgagccgggcatggtggttgacgcctgtaatcccagcactttaggaggtcaaggtggtcagatcatgaggtcaggagttcgagaccagcctggccaacatgatgaaactccatctgtactaaaaatacaaaaaattagccagtcgtggtggcgtgtgcctgtaatcccagctactcaggaggtggaggcagcaaaatcgcttgaacctgggaggcggaggttgcagtgagccgagatcgtgccattgcactccagcctgggtaacagagtgagactctatctcaaaaaaaaaaaaaaaaaaactgggcgcggtggctcacacctgtaatcccagcactttgggaggccgaggcgggcggatcacaaggtcaggagatcgagaccatcctggctaacatgatgaaaccccgtctctactaaaaatacaaaaaattagccgggcgcagtggcgggcacctgtagtcccagctactccggaggctgaggcaggagaatggcgtgaacccgggaggcggagcttgcagtgagccgagattgcgccactgcactccagcctgggtgacagagcgagactccgtctcaaaaaaaaaacaaaatgaagtaaaataaaaaataaataaaaataagaatatgtatgtcatgaaaatgccaataattttttttaaaaaacaatgtgttctgttcatatggattagaaacaatctaagtcaagaatgcatgcaatatgtcattgtagtgatgaaaccatagaaacgaagagtttgtgatacaaggaccatttcaacccctttcagtttttcaggtcaaaattccttggtattttatttttattggcatatattttatttttattatttttattttttcaggcaggatctcactctgttgcccaggatggagtgcagtggcgcaatcatggcacactgcagctttcacctccacaggctcaggtgatcctcctacctcagcctcctgagtagctgggactacaggtgcacacccccacacccagctaatttttctactttttgatagagtttcgccacgttgtccaggctggtctcaaactcctgggctcaaaagcgattccccagccttggcctcccaaagtgctgagattacagatatgagccaccacccctggccggagcatattttttttactttgacctccattgctcaatagcaataacaggcaaacagtaacagtttccaaggtatttttaaaaacaccacagggaggacaaaattagctggaaaaagaatttcatactttcagtggaattttccaataggaaaaaaaataccacatcacataatttgctggataggacatctccttgaaataaccaaatctggaaagcattttggaagataccatttcgtaacagaattagacttagtgaattgagataagaagaaaatttactagagatgctagaagttcagttaaaagaccaacagcttttttgtttgatctttgaatgcttgcccttgtcttcagtttcacacacctggtccattgttttgttttttgttttttgttttttgagatggagtttcactcttgttgcccaggctggagtgcaatggtgcagtctcggctcactgcaacctccacctcccagattcaagtgattctcctgcctcagcctccaaagtagctggggttacaggcacgtgccgccacgcctggctaattttttgtatttttagtagagacagggtttcaccacgttggccagactggtctcgaactcctgacctcctgatccacccaccttggcctaccacattgctgggattacgggtgtgagccactgcacctggcccctggtccactgtatttcactgaagggggaagtttcaacttttacaagctcaatgaattggctcatacaatccacctttgacattacccatcattcctcttgaaccttgacctcatcatacgcgacattccataccttgacctcatctccttgacctcatcatacgcgacattccacttggctttatatgttgcaatgtgtactcctgccatgatatctaacttccatctgacccccaacccggccaacttcttccttctccagagttttcacttgctcctccgtctacccacaaggctcttcacacgatgatggatgagatcaccttgctcaggtctcagcttgcacaccatcttctcagagtccctccctgaccctccggtctaaggcagtccacaccccatgctatgacctctcactttaccaccatgcttagctaagtttttgatgttttgtagagatggcctttccctaggttgcccaggctgtatgagactcctggcctccccatacaatcctcccacctcagccacccaaagtgctggaattacaggaaagagtcacatcctctctcttttttttttctttgagacagagtctcactctgttccccaggctagagttcagtggcacaatatcggctcactgcagcctcagtctcctgggttcaagtgattcccctgcctcagactcctgagtagctgggattacaggcacctgccaccatgcctggctaatttttgtatttttagtggagacgtggttttgccacgtaggccaggctggtctggatgatccacccacctcagcctcccaaagtgctgggattacaggtgtgagccaccatgcctggccaatttcttaaacttgtttaaagggtagttgtcacatggagtctgaaaacatatcaatgaacttttcttactgcgttatattaaaatacatttttgtcttacatttttttcaagtttccaacccattatcttacattttgaatggctcttttacctatcgatgattttgtagcctcttgcattgatcatttaaaataacagtttagactgggcgtaggtggctcacacctataatcccatcaccttgagaggccaggacaggtgggttccttgagtccaggagttcaagactatcctgggcaacatagtgagacaccatctaactcattctacaaggccagtattactctgatactcaaaagcaggcaaatagacacatcgaaaaaggacaatatccctaatgaacactgatgcaaaaatcctcaacaaaatactagcaaactgaattcaacagtaaaaagataattcctcatgaccacatgggatttatcccacggatgcaaggatgcctctgtaccccatacatatatacacttactatgcacccacaaaaattcaaaatcattggccgggcacagtggctcacgcctataatcccagcactttgggaggccgaagcaggcagatcacctgaggtcaggagttcgagaccagcctgaccaacttggagaaaccccgtctctactaaaaatacaaaattagccaggcatggtggtgcatacctgtaatcccagcaacttgggaggctgaggcgagagaatcgcttgaacccgggaggcagaggttgcagtgagccgagattgcaccattgcactccagcctgggcaacaggagtgaaactccgtctcaaaaaaataaaattaaaaataatttttttaaaaaaggctagatgactgtaggattttggtggaaacaaaaattttttttaagataaaaaatatttcaaaataataaaaatgtgaaaggctagttttatgctagcaattcaaataattacatacatccttcttttccagacaagcatcctattccagtatgaagcacagggtttgatgcatatgtccctttgtgttacacaggatattaaaaaggtgtaatcaagggttaaagtttaataaaatcaataattgttactgcttaaggacattcctaagtgaaaccactttttgttcttgcactgaaagtatgagggtaaccacagtaactaccagtacaatttggttatactggtttgatgtcctctgaggtaccagcagatttacccatcattgtttttgtatcatcagtgcaaaagaaaaatgtcttagtataattaggaaaattgtgtcaaccttacagttcctggaaagggctctggagctccacaggccatactttgaaaacaagtgccctaaaataaatcttctattcttccgtatatttgtaagtaacaccacccctttcaaaagaccacttcataagatttacatagacctgccctgataccttgagaaattgatcctctctgcttttgtaattaacctcagaaagccactcctaaatccattttgcttttcctcaacttctacatttctggagtaggaaaaaaaaaaaaaaaatatatatatatatatatatgtatatatatatattcattcttttgactgaattctaatttctaacactttaccttctccacacaacaaacattcacttccagaaatggctaggtaagtcctagtagaattaaccagaatattttcatctaatttttcaagtgttaaaaaattattaacgcctattaaaagccagaccctggccgggcacggtggctcacgcctgtaatcccagcactttgggaggccgaggcgggcagatcacgatgtcaggagatcgagaccatcctggctaacacagtgaaaccccgtctctactaaaaatgcaaaaaattagccaggcgtggtggcgggcgtctgtagtcccagctactcgggaggctgaggcaggagaatggcatgaacccgggaggcagagcttgcagtgagccgagatcgcgccactgcactccagcctgggcgagagagtgagactcctctcaaaaaaaaaaaaaaaaaagccagaccctattctaggcaccataaacaaaacagttaagatatccttgatctttaaggagctgaaagatatcaagcaaacaagcaaaagatgtagtgtatcagatgatgagtatttccacggcaaagaagactcaagtggcaagagtagagagtgcaggggtgaggtcacagttctaagtgcaatagttagggatgggctcactgagaaagtataacatgaacaaaggcttgaggcacattagagagtgagtaatgctgacgtttgagagacattgcaggaggtggggagaggccctgggctgggacgctgcctgtcctatttgacataaggcaaggaggccagaacatctgaaaaaaaagaataaaagggaagcagacgaggtcacagaccataccaagcgccacgttatctagggcacgatagggccaagtgcctttttgttgaaggttttgagcagataagtgacataatttaatttatgtatgtatgtatgtatgtatttttgagatggagtctcgctctctggcccaggctgaggtacatggcatgatcacggctcactgcaacattcacctcttgggttcaagcaattctcctgcctcagcctcccgagtagctgggactacaggcgcccaccaccacgcctggttaatttttgtatttttagtagagacagggtttcaccatgttagccaggctggtcttgaactcctgacctcgtgatctgcccaccgcggcctcccaaagtgctgggattacaggcgtgagccacggcgcccggccgccataatttaattaacagtttaacaacatcacatgaggtacagcgttgagaataggttggtggaagcagggagatcagttaggagaagactgcaataatctcatgcaatgggccaataatctaatgagatggaccaagaaatggtcagattccttaaatatttgaatgttaaagccatcagaatgtccagcctgactgtgttatgggggaaaaaatggagtcaggggtgttttctagatatgaggcatgacctggcacctcctgagctggagaaaacagtgcgaggaatagtttagatatgaacatagggaattcagtttttggaacacattgagtctgagatgcctgttagagacaagcaggcaattagatgaagtccaaagttcaggagaaaagttcaaacattctgtagagagaaatcaggaaagtgctttccagatctggaatccttgattccaaggatattttgagctctgaactttgtgatgtgtcccatagttgctctgttttagcatctgtctccctctcctttttttcttttccactccttcctcctctcttccttcctgaagctcaaatatgtcttatttagttcttgaatatctgtacctttctgaaattcccaatgctcaaatgcactgaaaacagcctattttcataatatcacatcagagaaaccggttttcccctatccagatacagttaaagtttaaaaatggaactctcacaacttctgacaagaccactgggtttttagccctactttttccccaaaccaacaaaagctcagtcaagcacaagggaacttactgtgtgaataggtgtcttcggccatgctggaagagagtcctgaaggctgagccactgtctgggagacaagtcactctgcgcagagactgggttttatatgcgtagccaggtggtcccgcccacttttttaaaccatttacataaatctctagttccacccttagtaattgtatcactccttagaaacatgtatcctccatctaaaaaggactagataggacccctttccgtcaattgatatttaataatttacaccagtgtataaattattaccaacccctacacctaagccatcacaagaagaacatttcggcccatgccaactcacatacacagagtcatgctccttggctcccccaacccccttgtgggaaaaaaattcgtcccaaatcactggaacctgaacagggagacaagcttgcaatagttgccaattttttaaaaaagaatatttttgagtactattctgcttacacatatttttcaatgcttattatatacatatagtcttttgtaaatggggtttttatgctctccacctatcttttgacatagtggcctctccttataaattaaaagtgttatttctaattagtatcacataagagtgaggctagtgagacaggaacaaaatttaaggtggtgctaaaaattctgtgatcaagataaatagtatttgaaagcaatgtatattttaagtaatgtaaaaagtccatcttaacaaaacataaagattgtaaataaaaagaagatcccaccctgcacgtgcacgaccctgcaagttatgcaagtgagggtacctgcgcattgaaaaaagatgtctcaccattgaccagtcattgatcagtcattgatcagtcttgagggaagctggctggtggctgtcactttttatagctgtaatctacaatagtgcaggataaaagggaaaattttattacatgtctatatttgtgtaattttttaactgttattaagagcacataaagaagtgatatgaatttcatttattgatatatttgactatccataaataaaatttggccagatatcaagccattttggagaaacaatttcgaaccaggaaaatgacatgaaataacatttaacaggaaaattttacactttatttaattaaaacaatgataaattgtttttcttttctgtatatgacatttcatcacaatattttttcaccaaatttgtctggaaatctagagcagaattttctgctgtttgtttatattgatgtttatattttgatgtaaattatatgtacatctacttgaacattagtattacaattataaatgtgctttaaattaattgacacaatattggatattcattataattatattatcattaaatatattatattaatatataatattaataatataatcttgatataccatataacagatatattacatattatatttactccagttaaatattatatttactttttagctttattgaggtacagttgacaaaaatgatatatatttaaatatacaatttgaattttgatatacacatataattgaatcccagattcaattaccataatcaaatcaagctgattgatgtatttaccacctcaaaccacaccctttgtgtgtgtgtacatatatattacattatattatatttactccaattattgtatttactttttagctttattgaggtacagttaacaaaaatgatataaatgatatatattttaaatatacagtttgaattttgaaatacacaaaagatataattaccataatcaaatcaagctgattgatgtatttaccacctcaaaccacaccctttgtgtgtgtgtacatatatattacattatattatatttactccaattaaatattgtatttactttttagctttattgaggtacagttgacaaaaatgatataaatgatatatattttaaatatacagtttgaattttgaaatacacaaaagatataattaccataatcaaatcaagctgattgatgtatttaccacctcaaaccacaccctttgtgtgtgtgtacatatatattacattatattatatttactccaattaaatattgtatttactttttagctttattgaggtacagttgacaaaaatgatataaatgatatatattttaaatatacagtttgaattttgaaatacacaaaagatataattaccataatcaaatcaagctgattgatgtatttaccacctcaaaccactccctttgtgtgtgtgtacatatatattacattatattatatttactccaattaaatattgtatttactttttagctttattgaggtacagttgacaaaaatgatataaatgatatatattttaaatatagtttgaattttgaaatacacaaaagatataattaccataatcaaatcaagctgattgatgtatttaccacctcaaaccacaccctttgtgtgtgtgcatatatgttacattatattatatttactccaattaaatattgtatttacttttttttttttttgagacagtgtttcactcttgttgcccaggctgaagtgcagtggggtgatctcaggtcactgcagcctctgcctcccagattcaagtgattctcctgcctcaggctcctgagtagctgggattacaggcatctgccaccacgtctggctaattttttgtatttttagtagagatggggtttcaccatattggccaggctggtctcgaactactgacctcaggtgatccacctgcctcggcctcccaaagtgctaggattacaggtgtgatccactgccctgggccttgtatttactttttagctttattgaggtacagttgacaaaaaagatacatattttaaatatacgatttgaattttgatatacacatataatatgatatggttaccataatcaaatcaagctgattgatgtattaaccacctcaaattataccctttgtgtgtgtgtgtgtgtgcggtcagaacactttttaaaaaaaatatccttttctcccccatgcagaagaacacttaaggtctatccttgtcgcaaaaaataaaaatctatcctcttagcaaatgtcaagtagtattgtttttttcatttctgatcatccaatttaaaatttttttttctaatttgttaactatgtcacataatgtcacaatgtacatgtcaaataacgtcactatgtaccttaaatccccaaaacttatcttgcaaaactgaaaatttgtacttcttgaccaacatttccccatttccccttcactcaagcccccggcaaccaccattttactctctgcttctatttttgatccaacctcactgtttgtgtccacgctccttaattttcttggtcatgagaccacgagcttagataacaccttagacaatgagaccagtgaccctgacctgtttcagtttagttatttaaaatatttttctttcttttttaaattgtatttatttatttatttgttttgagagggtcttgctctgtcgcccaggctggaatgcagtggtgcaaccatggctcactgcagcctccgactcctgggctcaagcgatcttaccccctagggctccaaaagtgctctgacagtaaatgcatgagctaccatgcccagccatcaaattttcaatcattataaatcttagagctggaaataatatctcattgttttatttttaatttgagcgctagcgtgcttgaacacttttaatcaaatgtatttgccatattttatttttcttttattagctttcagattctttgcttctttcttaggtagaacatttctttgagacttaaatattatgctgcatttgtcctatgtcctgcaagtgttttcttaattcagtattttaaaataatattttgtttttatgttttttgtatctttatagcattcttctaaattggatctatgtttattttaattgtctagtcaaagtactgacaaggaggagtgaacttcctgaaaacggagaacaagatgtgatgccttttagtaaatgtttaccaaaagacacaggattccatttccaattccatatcgagaacctttaaaattgtacataaaaatgcaggtgaagtcgtggagaagggaggccaacagtgcacacaggtagtgcctctggggaagaatcagaagtcatcctgcatcctaaattcctgacctgacttttctgcagggcgagtatctgacctgtgctacaccatcagcaacacaaagaaaacttgatgagcttttatttccttttatttgtatgtttcactccagttttcaattccgtgccctcaaaagcccggatatcatcaccggtacctcttttaagcttcacctctctgtgcggctccgcaagtatgttggtctccctgagagagtggggcctgcaacctgctgggcgcaggcgccttgagctgccacgtctgcccttttaccggcttgggtgcaggcaagggaaatgcgtccccgggccggggggcgcgagcgggggtccggggccgcgagctggggtccggggagcgcgagcgggggtccggggggcgggggccgcgggccgcgaggggggcgggggccgcgagggggcggggcgtgcgagggggcgggggcgtgcgagggggcgggggcgcgcgagggggcggggcgcgcgagggggcggggcgcgcgagggggcggggcgcgcgagggggcggggcgcgcgagggggcggggcgcgcgagggggcggggcgcgcgagggggcggggcgcgcgagggggcggggcgcgcgagggggcggggcgcgccgggctcgtcctctccgcggcgctcagtggcagcagggagggccggtgagatgccagagcaaggtagggtcctgtatttggggaccgctgacgtttgggtccccctcccgcggctgttagcgctgcgtggcccgagacctgcggtcgggcggggattaaggctgctttccggagggccccggccgcgtggtcgccctgccagagcggttgatgtcaggcagtgctgggaggcgttgctctccgggttcgcttctctcctgttgtcctaactctgcatctctcccgggtgaatcacagagctgtaaactaaaaatcaaattctaagctcccagccaactgaatggacccctcctctcagctaagagcatggcaaacttaaccggaaacactagttcggccgcgataggaaggagatgggacatgcctcattttaccctcctctctttgaaattcaggcacaggtcgggcgcggtggctcatgcctgtaatcccagcactttcggaggccgaggtgggtggatcacatgaggtcaggagttcgagaccagcctggccaacatggagaaaccccgtctctactaaaaatacaaaaattagccaggcgtggtggcgggcgcctgtatcccaactactcaggaggctgaggcaggagaattgctttaacccgggaggtggaggttgcagtgagccgagatcgcgccactgccactccagcctcagcaccagagcaagactacgcctcaaaaaaaaaaaaaaaaaaaaaaggaattcaggcacagctgaccagtattaacattaaaacaatttttttttagtatcttcatgctaaaggggtaagtagaaattgcatgtagcctcccatcagtttattccaaatagcaaacatttaccaagccctgagttattaactacgtattttctttttgtaaaccttacaattgagcaggcaagtaataacattatctccatatttttaatgtgaggaaactgaggcccaggaagacgtgtaatttgcccaatatcaggtattcagtatattggagatttgaaggacaagttatttattttgaaaaatgtataccttttccaaagttccaacaataattcaatgaacacatttattttgccccagaattgccaatgatgttatgtcctataaggaggcacctaagtatacagtttgtccatttgggagatttggattttgactacttggttaagatggtatctactagatctctccactctttcttctttgtaattaataagtaatctgtgggtcaattctttgcaatgtctgaataatattaagtccccccacttcagcctctagttttagcctctgttgatgattcttccctgaatctgtgatcactgcttgtggggattctatttctattacttctttacattttatacttataagttgacactcctgtaaagaactttacccatcccattcttttttcttttctttttttttgtttttgagaaagagtctcactcttgtcatccgggctggagtgcagttgcgcgatctaggctcactgcagcctccgcctcccgatttcaagtgattctcctgtctcagcttcccaagtagctgagactacaggcgtgtgctaccacacccagctaattttgttttttttgggttttttttttgtttttgtttttgtttttttttagtagagatggggtttcaccatgttggccaggctggtctcaaactactgacctcaggtgatccacccccctcggcctcccaaagtgttgagattacaggcgtgagccaccgcgcccggcccacctcaggtgatccacccctctcagcctcccaaagtgttgagattacaggcgtgagccaccacgccgggcccacctcaggtgatccacccccctcggcctcccaaagtgttgagattacaggcgtgagccaccgcgcccggcccacctcaggtgatccacccctctcagcctcccaaagtgctgagattacaggcgtgagccaccgcgcccggcccatcccatcccatccattttaagttagttaattattttagaagccacatggagtggatgatttttatctgcggcattataatccatttatctcattgtattggtgctcacactacccagcattagcctctccaaactcaagtaggcttgactttcttatttctatcacagagctcctgaaacccttggaatttcctgtgtgttgaaatgtcttttgttatttttaatgactttttgatcacatctcagtttataccaatgagatggcttagggtggagaccctagacagcctcaagatgaagctggtcaccagaaagattagagagttggaactttcagtcctacccaccaacctctgtgaagtggaaagggtgggatggcttgacatgaagctctataaaaactcttggacaacaagattttagctttccagattgctgaacacattcagtgttcctggagagggcatggaagctccacacctcttctcacataccttgccctgtgtatcttttctgactgtttgtttgtatcctttgtgatatcttttattataaaacagtaaacataagcaaagtgtttccccgagttctatgagccattctagaaatgagttctagggggttgtgggaaccccaattctaatgtagttggtcaaaagcacaggccacaaccaggtgattgtgactggcatctgaagtgaagggcaattctgtgggacttagtcctcaacctatgggatgtgacacttccttcaagtagatagtgtcagatttgaattataggacacctactggtgtctcctggaaaactgggatggatgaaaaaacctccactcatttggtcacacaaatgttctgttttgagtgagttgaaagaaaagaacagttagtttttttgctttagatgtggtgtcagaaatgggatgttgaatgattgtgtaagagtgggagcacttggcagagaagtcaaagatggcggctgtagctgctgttcgctggctggggctctgcagcaggcttgaccagccactgacgggtcagccagcaggtctatgtgaacaagcacacagctgagattttattctggaagtgcaaccctctcaaatattgaaggaactgatataacagggattgaagaagtagtaattccaaaaaagaaaacttgggataaagtagccgttcttcaggctcttgcatccacagtaaacagggttcccacggctgtaccttgcgtgtttcaagataatccttacctcataccaacatcctcttcagaatctcgttcatttttactggcaaagaaatccggggagaatacggccaagttcattattaattcatactccaaatattttcagaaagacatagctgaacctcatacactgtgtttaatgcctgagtactttgaacctcagatcaaagacataagtgaagccactctcaaggaatgaatcaagctcagaaaagtcaaagtctctgtggacatgtttgatgagcttttgcaagcaggaaccactgtgtctcttgtaacaacatatagtctcttggatttattgtgttactatggtgaccaggagccctcaactgattatcagtttcaacaaattgaacagtcagaagaattggaagaggaaaataataagaggtctaggaggaaagctggtgatcaatttggagttacctggtgagcacaaaacaacgctgagagaatgttttctctaatgccagggaaaaatgcacattcctattgcacagtgatccgaggaatggtgaagcatcaagcttatgagcaggcattaaacctgtacactgagttactaaacaacagactctgtgctgatgtatacacatttaatgcagtgattgaagcaacagtattggtgataaatgagaaatttgaggaagaatggaataatatactggagctgctaagacaaatggttgcacagaaggtgaaaccaaatctacagacttttaataccattctgaaatgtctccgaagattttatgtacttgcaagattgccagccttacagattctatgtgaaatgaaagccatcagactagaaccctcgcttgcaacatatcaccatattattcagctgttttatcagcctggaaacccttcaaagggatcatctttcatcatctatgatataatgaatgaattaatgggaaagagattttcccccaaaggacctggatgatgataagctttttcagtcagccatgagagtatcttcatctctcagaaatctagaacttgcgtaccaaatacatggcttttttttttttttttttttttttttttgagagagagagtctcgctctgtcacacacgctggagtgcagtggtgcaatctcgcctcactgcaagctctgcctcccgggttcacgccattctcctgcttcagcctcccgagtagctgggactacaggtgcccaccaccacgcctggctaattttttttgtatgtttagtagagatggggtttcacagtgttagccaggatggtctcgatctcctgacctcatgatccgcccgtctcggcctcccaaagtactgggattacaggcgtgagccactgcacccggctacatggccttttaaataccagagacaactgaaaattcattggacctgataaacggcataattcctattattccatgttcttcaatttgatttgtctaatggaacgaattgatgtcaccttgaagtggtatgaggacctgataccttcagccttctttccccactcccaaatgttgatagatctccgagcattggatgtggccaactggctggaagtgattactcaaatttggaaagatagtaaagaatatagtcacactttctgcaacaacctgagagaagagatcctgacactcatggcaatggataagcacccaccagagcttcaggtagcatttgctgactgtgctgctgatatcaaatctacgtatgaaagccagcctgtcagacacactgctctgaattggccagctatctgtctcaactgtagagctgtctttttttttttttttttttttttttgggacggagtttcgctcttgtggcccaggctggcgtgcaatggcatggtctcggctcactgcaacctctgcctccgaggtttaagtgattctcctgcctcagcctcctgagtagctgggattacaggcgtccaccactatgctggctaatttttgtctttttagtagaaacagggtttcaccatgttggccaggctgtctcaagctcctgaccccaggtgatccacctgcctcagcctcccaaagtgctgggattacctacatgagccactgcgctcagccagctgtcctctttttaatggctgggagaatccaggaagcctggaaaatgttggggctttttaggaagcataataagatccctagaaatgagttgctgaatgagtttatggacagtgcaagagtgtctaacagcccctcccaggccactgaggtagtagaggtggctcagcttacctatttgtgagggcctcacccagagagtaatgactgactttgcaatcaaccaggaacaaaaggaagccctaggcaacttcactgcattgaccagtaacagtgatactgacagcagcagtgacagcgacagtgacaccagtgaaggcaaatgaaagtggagattcgggagcagcaatggcctcagcgcagctgctggaatcacacctgagagcgagatatgctaatatttaacactgttacaaagaagacaagatacagattgggtgaatttgttactgtgagatacagtcagtacacagctgatttatgtagatttaagctcctaatttgcaacttaataactgtctattaatacaccattaaaggtttagcatttaagtagcaacatggccgttttcaggccaggcgcagtggctcacgcctgtaatcccagcattttgggaggccgaggcaggcggaccatgagggcaggagatcaagaccgtcctggctaacacggtgaaaccccaactctactaaaaaatacaaaaaaaattagccgggcgtggtggcgggtgcttgtagtctcagctacttgggaggccgaggcaggagaatggcgtgaacctgggaggcggagcttgcagtgagccgagtttgtgccacggcactccagcctggacaacagagcgagactccgtctcaaaaacaaacaaacaaacaaaaaacaaaaattgccgtttacagacacatggtgaggtccatcgctcttgtcatcaggataagcctgcaacctacaatgttggtgcgctgacctcgtgctgccgtcctcgtgtgactgccctctccctgctgccgtcctcgtgtgactgccctctccctgctgctgggtcctcatgcgattgccctctccctgctgctgggcttctgcctttgttggcctgatgtgctgctgtgatgctggtccttcatcttagaaaggtgttcatgcagttttatcacaggtggtgttgggtcaatagtttcccaatttcaggatatttccatgtcagaaatagtgcatcttaggaatgactaaacaggatattgttggtttaggctgcacaactgataaaatgactgtaaataaatgttgtaataaatgtagaaaaaagagtgggaacacttataaatatttggaaattaaaatagtgcctttttaatttgcatttttagattttaaaaataattatagagttgcagaaattataaaaaatagtgcagagttctgtgtattcttcatccagcttattcaaatgatgacatatttatatagtacaatgttaaaaccaggaaattgacattgctacaatctgtaggccttatttagagttaaccggttctctacatctctcgtttgtgtgtatatgcgtacttctatgcaattttaattttttctttttctttttttttcttttttctttttcttttttttctgagacagagtctcgctctgtcccccaggctggagtgcagtggtgtgatctcggttcactgcaagctccgacttccgggttcaggccattctcctgcctcagcctcccgagtagctgggactacaggcgcccgccaccatgcacggctaattttttgtatttttagtagagacggggtttcactgtgttagccagggtggtctcgatctcctgacctcgtgatccgcccgcctcggcctcccaaagtgctgggattacaggcgtgagccaccgtgcccggctgcaattttaatttttttaatgaagctgtaaagggagacttatacaatagcataatatccattattagtagcaaagtaacagtgtaagaaacagtacatcagacttagtcaaagggcaaacaaaagccaagtttggtgatcagggaaaactctgcatccccaaatgcttattgagtaaaatgaaggcctaccagtcaaaacaccacattaaaccagatgctggaaaaaggatggtgatatggtttggctctgtgtccccaccgaaatctcaccttgaattgtaataatccccatgtggcaagggcagggccaggaggagataattgaatcatggggatggtttcccccgtactgttctgacgatggtgagttctcatgagatctgatggtttcataaggggcttcccccttcacttggctctcacttttcttacctgctaccatgtaagatgtgcctgttttaccttccgccatgattgtaagtttccccaggcttcccttgccatgcagaactgtgagtcaaacctcttttctttataaattacccagtctcgagtaggtcttcatagcagcatgaaaacagactaatatagatgccatgctcctctaataccaatgttgctctgtgcatgtgtctttgtctatgtaagaaagaactgaaactagaaaagtagaaccattacatttagatatgtcctggctgtagtttggatgggtttggagggctgacacgataaaagtaatctgacagatgagagtaatgggtttagaaaaataaatgtgttggctgggcgcggtggctcatgcctgtaatcccagcactttgggaggctgaggcacgtggatcacgaggtcaggagatcgagaccatcctggctaacacagtgaaacctggtctctactaaaaatattaaaaaaaaaaaaaaaattagctgggcatggtggcgggcgcctgtagtcccagctactcgggaggctgaggcaggacaatggcgtgaacccaggaggcggagcttgcagtgagccgagatcgcgccactgcactccagcctgggggacagagtgagactccatctcaaaaaaaaaaaaaaaagaaaaagaaatttgtttctaatgtgcaggtttaattagagtggaagatgtcaataaataaggttttagccagacacggtggctcatgcctataatcccagaaatctaggagaccaagacaggtggattgcctgagtttaggagtttgaaaccagcctaggcaacatggcagaaccctgtctctacaaaaaataccccccaacaaaaaaattggccaggtgtggtggtaggcgcctgtagttccagctaccctgcaggctgaggtgggaggatcgcttgagcctgggaggcagaggctgcagtgagctatgattgtgccacttcactccagtttgggtgactaaataaataaataaataaataaaatacaataaaataaagaaaagaaaagaaaaagaaggaagattttaaagataccattgagtagcctagagcgctaaactctgatctgcttctccttacctaacccttttgggttttttgtttgtttgttttttgtttttttgtttttgtttttgttttgagatggagtcttgctctgtcaccaggctggagtgcagtggcatgatctgggctcactgcaacctctgcctcccaggttcaagtgattcttctacctcagcctcccgagtagctaggactacaggcaggtgccaccacacctggctcatttttgtatttttagtagagacggggtttcaccatgttagccaggctggtctcgaactcccaacctcaggtggtccgcccacctcggcctcccaaagtgctgggattacaggtgtgagccaccgcacccggccaatcctttcttgttactttcctttaatgcagagtttctcaatcttggcattgagaatgggatggataatttttggttgcagtgggacatcctgtgaagtttaataactttaacagcatcactggcctctttttagtacataccagtgaggcaggataggtagtcaaggagtgaccatatcctggggacgcagcaaccagggtgtccatacaatcaacacaataagcctcagcattcgagtggtagttcagctcattcaagcaaagctttcttcagcagggaatttcacctgtaggaacatgtgcgctttgattttacctttcctcagacaccctttgctcattataatagtaaaaaacaggccgggcatggtggcttacgtctgtaatcccagcactttgggaggccgaggtgggcggatcacctgaggtcgggagttcgagatcagcctgaccaacatggagaaaccccgtctctactaaaaatacaaaattagccggcgtggtggcacatgcctgtagtcccagctattcaggaggctgaggcaggagaattgcttgaacccgggaggtggaggttgcagtgagctgagatcacgccactgcactccagcctgggcgacaagagcaaaactccatctcaaaaaaaaaagtaaaaaacacacccatgggtggcgatttaagatgttaatgagacatgtgacgtatgaacaagtgtgtacagctactgcacatgtgcacccagaggagcacccagaacatggttactagtaacacctctttcccacctcctcatgaataatcatggaagtctgccataaagggaatcccccagcaccagtctttgctgtctaatccttaggagcaccccagcctgaattctctctctcagggtgtattgtctatttttcacctaattttcaagatattctttttgctttacaataaattactctgtgctccatctcttgctgtgtgattcttatttaagttcttttaaactaagaagacaagaactgaggtatcacaacaccatcaacaccagtagcacctcccatcccgaatatatgttagtgaaaaatgtctctggattttgctaaatgatccctggaccatgacactgacccattgcttgcctggctccatcatgctccaggaggagtgcaattgagtctttgaggttgttagggcttgtaaagtttggaggctttaagttgtacctgcaccagttttggaggtggacacacacatttggggatgctaggactctgttcctcccccaacccccagacttttaaggcaccaaggaatataaatatcatttattattttccaggcaggtgccaagccctttttatttaatattccatacaaaatttgaaaaattaaaaacaacctaaagtggagatttctacctctactttttcagatgagaaaattgagaaatcaaaagttctgagactcattttttaaattgagctcatatgttttgagtgtttcttatgttgccagatgtcaatggagtttctgggatctgaggggatgtgggaaaaacatcgtttctttttttttttttttttttttttgaaacggagtctcgctctgtcgcccaggctagagtgcagtggtgcgatcttggctcactgcaagctccgcctgctgggttcacaccattctcctacctcagcctcccaagtagctgggactacaggcgcccgccaccacacctggctactttttagtatttttagtagagacggggtttcaccatgttaaccaggatggtctcagtctcctgacctcatgatccacctgcctcagcctcccaaagtgctgggattacaggcgtgagccaccatgcccagccgaaaaacatcgtttcttagttgagttataattaatattgagagcattaaatttatgtagaaaaatcatttttccttaaatcctcaaagataacaaacaagcataaaaatcatttatagatttagtatttttctgttaaaatcatttactcttctttgtttttgggtcagtgttcaattggtttatacctttgatagttgaaatttacttactgaatactgatatcatttgtgggtcctggtaaatatttcaaagttgtcgtacaaacaggacaatagattctctcaactcttcaaacgtctaacatgacagacttataagtcttttttcttcttttttttttttttttttttttttttgtagagatggggtctcgctatgttgccaaggatgatcttgagctgctgggctcaagggatcctctcaccttgaccttggcctcccaaagtgctgggattataggcatgagccaccacgcctagcctcttgcaaagtcttataatgtcgtttttaaactcttaagctgccaagtgtgggtggctcatgcctgtaatcccaacattttgggaggctgaggtgggaggatcacctgagcccaggagttcaagaccagactgggcaacatggcaagaacctgtctttacaaaaaattaaaaaataaattagctgggcatggtggtacacacccacagtcacatctacttgggagggtgaggtaggaggattgcttcggcctaaaatgttggctgggcatggtggctcacgcctgtaatcccagcactttgggaggccaaggtgggtgagtcatgagatcaggagttcgagaccagcctggccaacatggtgaaaccccgtgtctactaaaaatacaaaaaaattagccaggcatggtggcaggtgcctgtaatcctagctactcgggagggtggggcaggagaattgcttgaaccgggaggcagaggttgcagtgagccaagatcacgccactgcactccagcctgggcgacagagagagactccatctcaaaaaaaaaaaaaaaaaaaaaaaaaaaagtcaaggctgcagaaaactatggtcactccactgcaactacatcctgggcagcagagtgacctttaataaaataaaaacacccttgagctactctcgtaaacccagtaagacttacacatttaataaatcagattgtcttaagccttttgacatcctaaatataagcttatgcaaagcagcaacacacatgtaaaatataaaagtaacaaagataacttcaatacaattttttttattttaaaaattttttaagagttgggggcttgctctgttgcctgggctggagtgcagtggcaggttcattgctcactgcagcctgaaattcctgggttcaagtgatcttcccatctcagcttcccaagttttgaggattacaggtgtgagccaccatgctcagctcttaacaacttttttttttttttttttgagacaacgtctccctctgtcacccaggctggaatacagtggcaccatcacagctcacagcagcctcaacctcctaagctcaagcgatcctccagcctcagcctcctgagttactgggacgacagttgtgcaccaccatacccagctactttttaatttttttgtagagatggtgtctcactatgttacccaggctgatctcaaactcctggcctcaagcaatctttctgccttggcttcccagagagagtttttcagtccatcatttttcaggattgtgagccagggttccattagatcttattgagatatctcttgtgtgtctgctgtgtgccagacatggtttaaaagactagagatacaggccagggatggtggatcacacgtgcaatcccagcacttagagaggccgagatgggcagattgcttgagcccagaaatttgagaccagcctgggcaatatggcaaaagcccatctacaaaaataaaaataaaaattagccgagcatggtggcatagctgcatgtagtcccagctacttgggaggctaaggtggtaggatcgattgagcctgggagatcaagtctgcagtgaactgaggtcgcaccactgcactccagcctgggtgacagagcaagaccctgtctcaattaaaaaaacaaacaaacaaaaaaaaaacttaggatccagcagtgaacaaaatcatcactgacgcttaccctcatggagctaacattctggatgaaaagtcagaaataaacaataattataatacagaaatagacatgataagttaaccagtgctataacaaaaagaaggaaaaggagagtaaggtggatcagggtgtcagagtttggggagttgtttgcaattttcattagaatgatcaggaaacagcttatttagaatgtgacatagatcaaagtctatagggagatgaggggctgagccatgtggagattggggtaggaagtggatttcctgccacaggctttcaagcaagcatataatatccagggctgggtgctgtggctcacgcctgtaatcccagcactttgggaagccaacgtgagaagattgcttgaggccaggaattcaagaccagcttgggcaacatattaagacccccatctctattttttttaatcttttttttttttcttttgaaacggagtctcgctctgtcgccaggctggagtgcagtggcccgatcccagcttacttcaatctctgcctcctgggttcaagcgattctcctgcctcagcctcctgactagctgggattacaggtgtgtgccaccacgcctggctaattttgtatttttagtagagacttccccatgtttgccaggatggtctcgaacttctcacctcgagtgatccacccacctcagcctcccaaagtactgggattacaggtgtgagccaccacacctggccaaaataagccttttttactgtatttatttgaagattaaagatggtttaaggtgacaaggggtagagtatgattgccaactatatgtgtaaacttgtttaggctgtactacccagaaattgtattaaacactgaccagggtattgttatgaaggtatttcatagaaacggttaacatctataatcagttattttgataatgtaggtggttcttatctaatcagttgaaaggccttaagagaaaaacagggttccctggggaagaaattctgcctcaagactgcaccttcagctcctatccacgtttcaattctgctggcctgaactctagcctacagatttgggactggcctgtccctgcaatcacatagcccatttcttcttctatctttttttaaaatttttattgtaggcaaggtgggtggctcacacctgtaatcccagcactttgggaggccaaggtgggcggattatgaggtcaggagttcaagaccagcctggccaacacagtgaaaccccatctctactaaaagatataaaaaattagccaggcacagtggcgggcacctgtaatcctacctactcaggaggctgaggcaggagaattgcttgaacccaggagatggaggttgcagtgagccaagattgcaacactacacaccagcccgggtgacagtgccgagactctgtctcaaaaaaaaaaattattgtggaggaatggtctcactatgctgcacaggctagtctcttaactcccggcctcaagagccgggtctgtcctgtagaccctggctgagcgatggatgaaaggagtactcagacacaggtatgtagtgtaagagcagctaggggactgctgaagagtgagcagtcttgataagctgggactgcttgcttttattcagtacagacataatgccaaaagcctggagccaacacagtctgtgggtaattaacattattgttcccccttttgggggcagcctcactcgtgaatgatcaaatgttggttcctagttaacataagtaaacaagcctgtttatgttaaattcccctacacttccttgtacctactccttgccctctgccttagggtaagagaacagctgctttcagcttattctcccgtgaagctatgcagagacttctgacctttcagaaggtttgcgtccttttcttatagcttctcccaccactctgaccgatctcctacactcaagcaatcctccttcctcagcctcccaaagtgctgggattacaggcatgagccaccgcacaccacccccatttcttgcagtaaaatatgtgtgtgtgtgtgcgcgtgtgcgcgcgtgtgtattccatttctccctaataccatttctcagctgcatgaatccttaactcatgaaagatactttttatcctcttgactctacagttaatggaaaataaaaatcatcaatagtgacttctaagattgcttaatatacctttctgggaggacagttagaactcctaatgtgagcttgtcagtttcttgtgaaaaccaacccagttgtcccatagaactgatgtttgtggtttcttttgactgaacctagaaattgaccctcccactcttaaaacttgagaaaagtacatttgtcataatcgtttgtcacagaaataaccaaatttccttgtccattgttttttaactatggttgtcctaagacttttgtcatccacaattattgtttgactttgagtcttctccaaaggtggcttacagtcagctacagttcagggcttctttgagagagttcataaaaagaacacttgaattcaagtttctggtaactttggagattgtcctatcagcctagagagaaaacttccaggactctaattagaaggctgatatattcataaaatacataattatgtatacatatgtttatgcaatatgaagcagagcaggagtttcatggactgtactaatttatttcatgataaataaaaatattttattatatagtatattaagccatcttagaagtcactgttgatgatttttttttctccattaactgtggagccaagagggtaaaaagtatctttcatgagttaaggattcatgcagttgagaaatggaattagggagaaatggaacacacacacacaaacacagagatttatttcaagtactgaatttattttattattttttgtgtgtgtttgaaacattgctgattctttttgttttgtttttgagtcaggagaactttttttgtaaatctactttctgtctctatgaaacttttttctttccagctatttatagcctttaacaattgaatatacatttgtaaacaaaatttgagggctatttctctctctgcctgatttctccagaattcagaaactatttgtgaatattcttaattcacggcaatgtggttgtttgcatatgttcaataagaatctgttttctagctaggtgtagcatatgttcaataagaatctgttttctagctacttgggaggctgaggcaggaggatcgcttgagcccaggagtttgaggctgtagtgagctatgatcgtgccactacactccagtctgggtaaacaagcaagaccctatctctattttttaaaatccatattattttataacacaattgtaggcactgggtcttttcccaaggctttgacaggaatggcatatttttaactatgcgagactgctttgaggaattaagactgactttatgggccaggcgtggtggatcatgactgtaatcccagcactttgggaggccaaggcgggtggatcacgaggtcaggagatcgagaccatcctggctaacatggtgaaaccccatctctactaaaaatataaaaaattagccgggtgtggtggcaggcgcctgtagtcccagctactcaggaggctgaggcaggagaatggcgcgaacccagaaggcagagcttgcagtgagctgacatcacgccactgcactccagcctgggcggcagagcaagactgtgtctcaaaaaaaaaaaaaaaaaaaaaaaaaaagactgactttatggagctgatgggagcccttggaaggactggcctcatatcttgtgcacacagttcctttgtggggttcctggcctgtagtaaatacagtgtcattttctgataggcctaggaacctcaagatgttctggggcctcaagaaaaacgggtttcacccaattcatgcaggtatgtacaggtgcagacagatctttggctgggcttaagaggtctttgggtgttgagtctgagagattccttatgaggggttccagcaaagccaatttaggaggaattgtataaacagtgattcttgctgtagtttggataagtatggtgggactgaagcttgttttgcaggtaagttgttcctgctgtgatttgcttttgatggaagtcagggactagagagagaaaaactgtttccaaagaaaactatagtgctgccaggtgcagtggctcaactttgggaggctgaggtgggcggatcatgaggtcaggagtttgagaccagcctggccaacatggtgaaaccccgtctctactaaaaatacaaaaattagccaggcatggtggtgggcacctgtaatcccagctactcgggaagctgaggcaggaggatcgcttgaacctaggaggcagaggttgcagtgagcggagatcgtgccactgcactccagcctaggtgaaagaacaaaactctgtctcaaaaaaaaaaaagaaagaaagaaagaaaactatagcgttagattaacctttgagttaatctgagtggccacgtggtcatctatggtatgcagccacccacaatacccctcctcagcataaagcagccagaaagatcacgtccagattccccatgattgaggaattgataaatagaaacagggaactgaaaccagctccagtgtcccatagaactgatatttatggtttcttttgaatcaacacattatagacattgagcctccccttcctaaaactcgagacacttttatttgtcttatctgatttcctttctcaggaaaccaagcatcaggcctcccagatagtataaagaaactgaaacttactggattaccacatctggaaaaacgagatgctataccccttacccatgatgattgcctaactgaccatctgctgcctgttgacccattcctcttccttaccccttcctaattcctgttttctcaaacatagttacacttcttccctgatgtataaacccctagttttagtcagttgaggaaagagatttgagattgatctcccattttcctcagctgcagcaccgaataaagccttcatccctgacaatactcattgtcttgctgactggccttctgtgcagcaagcagcaggatctagatgcaaggacctggcctttctggtaatattgtcatcaaccatttaatgatgtagacttggtccccggctcatgctctgtgtattttcttctccatctacatgcattgccttgatggtctcactcaatatcatgacttgaaataacagtgtaaggtaactcctaaattcatatattcatgctcaaaccttcttccaacattcagtcgtaagtcgaattgcctgtgacagagatactttgtggttctgtagacatttcaaactaaccatcctgagcctccgaacctcctccacttgcagcctccccacctcagaagtgggcaaatccactttttgtgtggtctgggccaaatacatgactccctgcatcacgtagaggctgtgctggtccaaagaaggctcaaaagagggcagtttgcgcacacaacgtgtcggggcagggcttccagatgatcattcggcttttttgtgtcttccaagatgatgatccggggaggagggatgtgaaagggggtcagtcgccaggcgagctgaggacccagttctgcgcctttgcctgtgccctgacctgaaggaaagtccctgtctcccgagctccgattttcccgagagaagaatgcaatgtaacccttgcccctcggttccctccctccatccttcccctcgagttgtgcccaccgtaaagaggtgggtctggagcgtctcctcgggtcctggagtgcctttccctgggaggaaaacttgcgccgtgaagcgttcctcccgttgttgaacacatgaggaaaactacactacttagaaggctgtgcattatgcgtacggcgggagctgggccaacgacggcctaggacggggacgtttccgacggctcacgccggtgggggcgggacttccgggttgctcgctgcggacgccattttcttctgcacttctgtctggagaggtctgtagccactgagggccccggtcggggccgctttgcaggtccctagtcaggaccgagcaggggagtaggataggaatccccgccgcacctttgtacgagcctgaccccttccgtgggtttgttcctgggtcgccgtcaagctgcggtctctcctcccccgcccttcagccccgcggtctccaggggcggcgccctgggtctggaacgcggttgccaccgaggaggcggcggccctgcgtctggaacgccgttgccaccgaggaggcggcggccccgagcgcgcctggaagccccgggcaaccggccagggtcgggcacaggtggggtccgtcaggccgcccggggctcctctgtcccagctctgcggcccagggggtgacgtgatggcggcagcggtgctgacggaccgggcccaggtgagtggacggtggcttcgcggttgccgcttccttgccagcgctgaggcggtttccgaagtgggtgggagcccaggtatcccctggatttgtcttcgcagtcgtcgttcgctttggtgtgtggagctggtttgccacttaatttatacctggccgtaaggagtgttgggcctactggaaggagctccgtaggttgttgagtgaatgatgcttcctctggggactcccatcatccttggcctgcaagcattctctggtggaccaggtctcattccagcatgaattgggggcctgaggggggaaggggagggcagggcagtagcaagccgacaaatgcgcgagcagagacaaggtatgttgtatgtttaaggaggctcaggagggtgtgtaaggttgccatggttttcctgcggccgctgagacgtggagggcaacagtgtgtggtcttttcctggatgttctagccatccgcaactactgcagacattgtggccagtcagatgcccttactctcatcgctacagcctgcattatccttggccgctcgtgttccgtggccccaaagtatcctggcgtcagagacaagttctgtcggaacccagtaaggaaagaggccgatggttggttcattgtggaatttccttgggggatctgggagacccagggagatcccagagggcatgggaagctggtctggagcctgtcgttccccaagtagatgcagcccttccagtgccgctctgtggggtcagtgaggaatgctgagctttttgtgcccgtgttcacatacttttttttgttttgagacagggtctcactctgtcgcccaggctggagtacagtggtgcactctcagctcactgcagtctctgcctcccaggttcaagcaattctcctgccccagcctgccgagtagttgggattacaggcatgcactaccacacctgactgatttttgtattttagtagagactgggtttcaccatatttgccaggctggtcttcaactcctggcctcaagcgatccgcccacctcgacctcccaaagtgctgggattacatgcatgagccaccatgcccggcccacagatacgtttttcagggctaattgaaatagacttaatgttagaaatgagtggaaatgcttataacttcatcgcattagatttgctttgatgttgggggagtgttggagttacactgttagaccgtgaatcatagtaaccccatgtttagatcctatctatggtggtgagatgtgtgactgggtgaattgatagcgcttccttagcatgaagtcattgactgtgaaggtgatgatggtgttgactgcagggactgtgaaaggattaataaaaatcccagagcacactgagcattgaatactttaaatttaacaactgttactggtgggaagtgttattgtattgatccagaaatcaaggctcagagaaatgaaatgctgtctttgaggtaagagctgtcaagtgtcagtttcaagtgtttggagctaggaacttctagtcactgtgtttacacaggatgtgaagccttcaacatggggcaggcacctagctggaccagtgagactcaggtactgccgttgtaaccattattgctattattaccatttccccatttccctgtcgttttagagcccttagcttctgtatttcacagtccacaagttgtttccgttgtcctgtgtcattctctaacggccgttaaataggaggcttctctcctttactctggtattatgttaaaagcatctatcttccctcttgagcccagcacagagctaggccctcaggaggtgctctgtgattcaggccgccatcactgtacaccttttccagtggagcacagtctgtgatctcattcagcagctgaaaggccaatactactaattctgtttgactttccaggtgtctgtgacctttgatgatgtggctgtgactttcaccaaggaggagtgggggcagctggacctagctcagcggaccctgtaccaggaggtgatgctggaaaactgtgggctcctggtgtctctgggtaaggccttccttccccctccaccatgcaggtgacctgccacttccttcattccatcttctgactccaggcctggctgcacaagaaggcctctagaatctaccttgcctctttcccacagctttagtcattttccacagtaacctcttcctatctggtctcctatatctctgggctaaagacagggtactctttggctcccagccaaaggagaaggtggtaaaaggaaatggggtgttttgcaaactcaaaggtaattttcagctgtgcctcatgaggggctggtgtaggaactgagaaccaccacgatggtgtcctggcttctctgtctgggtctgctcatgtcacgtctattctctatggctttttctgccttagtgagttcaagacaagagtggccacctggattagggttctctaaagggacagaactaatagaatagatatatataaaaaggacagtttattaagtagtaataactcatgattacaaggtcccacagtaggctgtctgcaagctgaggagcaaggaagccagtccaagtcccaaagctgaagaacttggtgtccaatgttcgagggcaggaagcatccagcatgggagaaagatgtaggctggtagtctaggccagtctagtcttttcatgtatttctgcctactttatatgctggcctcgctggcagctgattagatggtgcccacccagattaaggggggggtctgcctttcccagcccactgactcaaatgttgatctcttttggcagcacctttacagacacacccaggatcaatacgttgcatccttcaatccaatcaagttgacacattaataaaaatcccagagcacactgagcattgaatactttctctttaaatttaacgactgttactggtgggaagtattattgtattgatccagaaataaaggctcagagaaatgaaatgatgtttttgaggtaacagctgtcaagtgtccgtttcaagtgtttggagctagggacttctggtgactgtgttaacacaggatgggaagccttcaacatgggccaggcacctagctggacctagctgttaaccatcacaactccatcccttgtcaacttgaacccatacacatctcctgagatcatacataatcttcaaataaagacaataaggtcataattatgcttaacataatacaagtatcgttcatgcaaccgaaacacactaatccccaacccaagtgctattacataaaggtagcaatacttaaatgctgatatgaagtcagtaaatcttacgtcacatgataaaggaaataaaatgcagatgttttcttagtacaagtgtatacatcacaaacatgtttttaataaaagaaggaggaaatacaacaattacagtcctcatttctgcaactggtcacttggtcgtagttggtattaatgactaccttcttctcctgcacattctgtattcactttgccttcagcaagcacctcagcaggtcatggttttttttcctggtggagtgacccaaaccttcattcctgaagggtctgggccatttgtagtcctgcctggattgggctgttgtagcttcccattgaccttaatcacagggcatggtaatactaagagatgccctaatggatcttctgtattccatgcatactcttccttacctccattgtggagtagtagactgatttcatcttgatagtctgggtcattcatcccagccaacactgtaactcccttcttaggctattgacttaaaggtaggaggagcccaaagtgtccaggtggcaatcttaacttccagtttaatggaatcgttgtgtctcctggtggcagcattcctccctctgaaactaagacttctaggccaacggaatgtaatgtcgcgggaataggaagcaaaattttgctagttgatcactagggatgatgttgagtggtgccatttgcacttccaccccttgattcctggacccatgaatcctggctatgggagaaacagtaccatatattggatgctaattcagagcatacatggcctactggagaactttgccccagccctgcaaagtattgtcactagttggagtaattatgactacaaaaggtcattccaccattctgtcaatccagttgcttcaggactatggggaacatggtaagatcagtgaattctgtgagcatgagcccactgctacacttctttagccataaagtgagtgccttggtcagaggcaatgctgtgtggaataccattacgatggataaagcattccatgagtccgtgaatggtagtcttggcagaagcactgcgtgcaggataagcaaacccatatccagagtaagtgtctattctagtgaggacagacctctgccctttccatgatggaagaggtccaatataatcaacctgccgccaggtagctggctgatcaccccgagggatggttccatattgagggctcagtgttggtctctgctgctggcagattgggcactcagcagtggctgtagccaggtcagccttggtaagtggaagtccatgttgctgagcccatgcgcaacctccatccctgccactatgaccattttgttcatgggcccattgcacgatgacaggggtggctggggaaagaggctgagtggtgtccacagaacaggtcatcctatacacttgattattaaaacctttctctgctgaggtcttccattggtgagcactcacatgggatacagatatcttcacagtttttgaccactcaggtccatccacatccctcttccccagatttctttgtcaccaactttccagtcatccttcttcgaagtccctgaccatccagccaaaccattggctacagcccatgaatcagtatataattacacatcttctcatttctccttccatggaaagtgcacagcgaggtgcactgctccaagttctgcccactgggaaatttcccttcgccactctccttcagggatgtcctagaaaggggctgtagtgctgcagctatccactttcaggtggttcctgcatatcatacagaaccatctgtgaaccaggccctagtcttctcttcctccgtcaaccgatcatagggaacttcccatgaggccatcggtgcaggctgggggagagaaggtggggtggcaggagtggagtctgtgggcatttgagccacttcctcatgtaacttgtgccttcaggatccgcttgagcccaatcacatatataccactttcatctgatgatggaatgctgctgtgcgtgacccacttgatggctagctgggtcagaaagcacccagttcatggtaggcagttcaggttgcatggtgatttgatgacccatagtgtaacaggccaagagctgtctctcaaaaggagagtagttatctgcagaagatggcagggccttgctccaaaatcctagaggccttcgctgtgattcacctatgggggcctgccaaaggctccaaacagcatccctatctgccactgacacctcaagcaccattggatctgctgggtcttaggggccaagtggcagagcagcttgcacagcagcctagacctgcctgttgcagagccttctcctgttctggatcccactcaaaactggcagccatttgggtcactcgataaatgggctggagtggcatacccaaatgaggaatgtgttgcctccaaaaaccaaataggcccactaggcattgtgcctctttcttgattgtaggagggaccaaatgcagcaacttactcttcaccttagaaggcatatcttgacaggccacacaccactggacccctagaaattttactgaggtagaaggtccctaaattttagtcagatttatttcccatcctctggcacacagatgtcttaccagtaagtccagtgtgtttgctacttcttgctactggatccagtcggcataatgtcataaatgtaatggaccaatgtgatatcttgtggaagcaaaaagcgatcaaggtctctctgaataagattacgacacaaagtcggagagttgataggcccctagggtaggaccgtgaaggtatattgctggccttgccagctgaaggcaaattgcttctggtgggccttatggacaggaatggagaaaaaggcatttgccaagtcagcggctgcataccaggtaccaggagatgtgttaatttgctcaagcaatgaaaccacatctggtatagcagctgcaattggagcaaccacctggttaagctttctataattcacagtcattctctaagatccgtctgtcttctgctcaggccagatgggagagttgaatggggatgtggtgggaatcaccacccctgcatcattcaagtccttgatggtggcactaatctccacagtccctccagggatgtgatactgtttttgatttactatttttctaggtagaggtggctctaatggcttccatttggcctttcccaccttaatagccttcaccctaacagggagccagtgtgggggttctgccagctgctaagtatgtctgtgcctattacgcattctggcactgggaaaatgaccacaggttgagtctggggacccactggacccactgtaagtcaggcctgagctaaaactcctgacctccataagcccctactttaactggaggaccacaatgatgttttgggtcccctggaatcagcgtcagctcggagccagtgtcctgtagtccccgaaatgtctgatcatttccctttccccagtgcacagttaccctggtaaaaagccagaggtctccttagggaaggatgagagaaagattaacagcataaattgtcagtagtgtagtggggtccttcctcaagggacctggcctccccttcattcaaggggttctgggtctgtaaactagcccaagtctggaaattgaagggccatgattctgtttttgtaattcaaattagtcttttgtccattcgacctggaagttttctgcttatataaattaaataggattgcagtaggcttcctatcagtttcatttctgggaacactgtgattaattagccaacgccagagatctacatgagtcagactattctgattgctgctttgtctctgttgtccattatgatagctatgcctaccttgcctttgatggttgagtgccaccacttggcccctgccacctcgggatccaattattcccaatgtattaaatttttgtaggtgagtgactgaaattccaactgctggatctggcaattacagggctcttcaaagatgcaggtgctgccctcgcaaatctattttgcaagccattggttaaggttatgtcttatggaccctcccagctgggatgagtaggtctaaagtgactaatctactccatcatcccaatctccctaagcctttggatcccttcctctacattagaccaagggagatcaagcattcccagctcacccatgatgggccatcttttaatccatatttcagctagccaagcaaataagctattggaaccttttttaactcctcaggctgcaacattaaatgcaggatccctaattagtgagcccaaatcaataaattcagcctgatgcatctgtatgttccttccagcattatcccacacccttaatatccattcccgtgcctgttctccaaatttctgcttatataaattagaaaactcaattcaagtgtagctcacctccccatgggtcacactctgaacctcacttctgtgggcccatcgggactttagttataggtctagaagcaaacaaaggtgttgagggtgctagaggagaatcgatattatcttgcctggcaactgcctcaggggaggccatcactgttgcctcaggcagcacagggtttatctcctcagacaaaggtggaaaggctgatggcagcatgggtcggggagaggatgttgccactattggggatgccattttcctttctctttcttctgcctattaaacctccactcctaaaaaaaaaaaaagaaaaaatgatgaactcagggattctaactcctggcttcagaagcagatactaagcctcaaatctgctaagattgccctgagtgagtcttatctcctgtagagaaaaagctgaaattgtagaaaaacagacataagctagtcatgtgagtggctgacctgcaacaaaaggtgcatgcacagcctcaccaggtgtctactgttaaagtgagggcactgattggaaaagaatgggaccctgaaacttggaatagggatgtgtgggagaaccctgatgaagctggggacactgagcttgtaaactctgatgaaccttttttgccatcccccaaatgccatcccagcgctttgggaggccaagatgggaggatcacttgagcctagaagtttgagacaaagcctgggcaacatagtgagaccctgtctctaaaataaattgaaaaaaaaaaaagccactcagtaccctgttttactcccccaccccaccccgacctttgggtcttgtctttttctttgtctttgtctcttgtctcttgtgtcttgtgtcttgtcttgtcttgtcttgtcttgtcttgtcttgtcttttctcttttccttttctttcgttttcttttcttttctttttctgtcttgctgtcttgcccaggttggaatacagtggcacaatctcggctcactgcctttgcctcctaggttcaagcaattctcatgcctcagccacttaagtagctgggactacaggtgtgtgccaccacacccagttcgtttttgtatttttattaaagacgggattttgccatgttggccaggctcgcctcgaactcctgagctgaagtgatccatccgcctcagcctcccaaagtgctgggattacaggcgtgagccaccacacccaccctttactttttataataaaattttttttatacatttgttatatatgtgctatatataattaccatatatgatttgttataaacattagtatataaatgctggatttctaattggatcaaattatggacattgttttaatttacttattgtatgtgtatatatatacaacttatttatgtgaagatatttatatatatagtttttaagactaaataagggtggtattgtgtttgctaggcctggcatttgtatggtacataaggtttaaaagttcactttcttttttctgccccttgggtttgtagctgcctttttctttttttcgttatttctctctttgtgttttaggcttttggcatccagaagtagtggatcttagtttctgtccctgggtagtaaaaagaagctggggagaggaagaggtttgatgcctccaggcagctgcctctccctggtacagcctctgtcccaagtgtaatcagtcccccgctaaatgactagtctcttacaggatgggaagagagaataaataactcagttaagcagcccaccagtgactttggtgttggcttggttgattggacttgtatcccaacacaatccatcagaggaagtctctactcactaccttttgtgaggagcctcagccttgtatattaccccgtaaaccaacccagaaactaggtgtgtttatgttggaaaagtagactaaggagatcagtctgtcccagaacggtgccagctggggaattactgcccttgcgtatctagactgtggcatctttaaacactggaaggatctgaggagcactcctttaggattcctacagcactttaggccagaaacccatggcagcaaatgccagacgcagctgaagcacaaggctgccagcatctcgcagccttccccgggcagaactttctgtgtggtacaatcccttagtgagctgatcttcagccttcccatgagcgcagagtcagcctgctgggtgcaccagttgtattaatttgtatctatgggccaagtgtggtagctcatgcctgtagtcccagcagtatgggaggcaagagggttgcttgagcccaggagtttgagaccagcctgagcaataaagtgagacccagcctctacaaaaaaaatcaaaaaaattatctgggcgtggtggcacatgcctgtagtcccagctactcctaaggctgagatagggaagattgcctgagcctgggaggtagaggctgcagtgagccatgatcacaccactgcactccagcctgggcgacagagtgagaccctgtctcaaaaaaaagcaaatttgtacccatgggattttaatttatagcagtgacttagtgatgacacagagaggttaataacattgaaagaagaattcattatttacaattcgtgaaagaagagggcatatgctgggcctcatggggatacagctggaagcacaggggaggagaaagcctttaactgggtgtggtattctgatacatactggtttttgtccaccgttcctgattcataacccctatagcccttttgttaaaatgctgggtatgttaggcctcagggtcaggcctctgacctcctgccctcctttcgctctaacgttcctccacctttctgactgtgggtctcatgagtgggtccaaccctataccctgggaaaggaatgttgatgttttgaagcttccataaagactccaagaggtcacagttgagtgagcttccaggtggtccccccaggaagggcatggaagctctgtgccccttccgccacaccttgccctaggagtctcttcatctgtatcctttgcaatattctttataatacactggtaaacatgagtgtttccttgagttccgtgagctgctccagcaaattagttgaacccaaagagggggtcgcgggaaccccaactcaaagcccattagtcagacattttggaggcctggacttgtgactggagtgcagggtggggcagtcttgtggactcagccctcaacctgtgggatccgaagctatccctgcgtggatagtatgggaacagaattagaggacaccccccactggtgtctgctgcttggagtttggggaaaaccccccacacatttggtcatagaagtcttgttctgtattgtcatggtgtgagagtagagaaaaaacatgattagagagagttttccctgcgtattgggtttcttctggaaaagcaagacagggcatggtaaacagtttagagctggctagtttgagtaatttcagtgaggtttggggcatagggactatctctagttgtctggcacttggccctgggttgatttagggcaggggaaatactggcttggtatgtgagagtttgttaaagaagtggttgggggtatggtttggggttaggtggattgcacatgaaaggcatgtgcttgttcccaggggagtttattatcctagaaattacctgtccctgagaggagcagtctctcccaaagtctgaaaaggcttcaagatgttctgagcaacgtcaagaaaatatgactactgtattttcatctgacatgaacctaaacttactcggtttagaagataaaccttcatctatgaagctgtcctttgagggttttttgttgttcttgttgttgttttttgttttttaaagtagaagtcctctttttatgaaatgttggtgagagtagatactatttgatgtttctgtaaatgtccttatttaactctatcacagtagaacgttcagttttttaaatttttaatggttcatgaaatgcagaggtctggaatcactgaacctgcccctccccctggctgctggtccctgaggatgacctccagctcacatctctgcatcgtcatcactacccaccacccactctgtggtgctagtaatttcctccttagtgtggtgtttggaaggggagcccgaaccctggtgtccagccccagctctgctctttaaaaactgtgtggccatggccaggcgcggttgcttacgcctgtaatcccagcactttgggaggccgaggtgagcagatcatgaggtcaggagatcgagaccatcctggctaacacagtgaaaccctgtctctactgaaaatccaaaaaaattagccaggtgtggtggcaggcgcctgtagtcccagctcctcgggaggctgaggcaggagaatggtgtgaacccgggctgaggcaggagaatggcgtgaacccgggaggcggagcttgcagtgagccgagttcacacgccactgcactccagcctgggcgacagagcgagactccgtctcaaaaaaaaaaaaaaaaaactgtgtggccttggtcaaatgactgaccttgtctgttcctcagtgttctcattggtgagatgaggatttaccacatctgcatcccagggttgttactggggtaaagggttattgatagggtttggctctgtgtccccacccatatctcaccttgaattgtaataatccccatgtgtcgtgggaggtaattgaatcatggggacgggtttttcccatggtgttgtcgtgatagcacataagtctcatgagatccgatggttttataaaggggggttcccctacgcatgccctcttgcctgctgccatgtaagatgtgcctttctccgccttgtgtcatgattgtgaggcctccctagccatgtgaaactgagtcccttaaacctctttctctttataaattacccagtctcggatatgtctttattagcagcgtgagaacagactaataaagttattacgtgaaaagggctcaaaacagcacctgggagaccacgctgtgtgcagggagccattgcaatcctgttgccatcagtactgttattgtcatcctcatcaagatcactgtcgttggcatacctggacccgggactttctgggtagcgttgtggagctttgtggttaaacagcaccgacagcagagatggcaggacctgggccttactgactcagccattcaccagttctgtgctcttcagcaaatcactttacttcctgatcctgggtttctttgtcaataaaatggtgttgatcacgatgtggacttcctggggatgctgtgagaaaatcctcagctggaatcctcattttttctttagtctagaggaagagcattataaaacattgcttaggatgtaaaaaaaataagacttagatcaatgaaatcacataccttgtttggaatgaaaagagtcaatatttaatatttaaatacatcagtttttctctaagatactctatcagtattcacttttggaattacataatgcatttatgtaattatggaaaccttggtttccaggtcacatgccagcttttcattcccatgcacaggagcagcttcactccaaggtctggtctccatcctgaagtcccaaactagattgaaggtctttatttcttttcacccacatccatgtgtccacttgctttctccataaacagggtgtcctgttcccaaagctgagctgatctgccacctagagcatgggcaggagccatggaccaggaaggaagacctctcccaagacacctgtccaggtaggagccaagatctgggcaggttggagtcccttctggcttaagactggatggagaccactggccctggaatctcttgggaagcttctcattgtggcctctctctatataactcttatataactctatcacactagaatgttccatttgagagccatggagccctttgacctgtgttttctctgtcctcctagccccatcacagtgtcaccatgcctgggaagaagtgagatttaagaactaagatgtgttcaggggttccaactgtgtgggcctgaaatgtggcttgccagtcacctgctgtgtggccctgatgaagttgcaggatctcctgtctttgtatataacttcagctaagttaacagtagctgctgtatcagacagattctaaaatctcagtggttcacatatgaaaactctttcccactcataccagggactgtgtgggtcagcgaggagctctgtacgacacagttattcaggacccaggttccttctgtcatcagcctgttgcattaagattatcctaacgtcctcgagctggcagagaattgagggaataagggaagttaaacccacttccagaaataccaactcccctcacattccacccacaggaactaggcatttggcttgggtccatgggactgggaaatgtggctgagctgcttgtccaaggagaagagcagaaggtttggtgagcacctactctcagtccactacattgagtctgttcctgaaaagtgttattagaaatctttttttttttgagacggagtctcgctctgtcacccaggctggagtgcagtggcacagtctcggctcactgcaagctccgcctcccgggttcacgccattctcctgcctcagcctcccgagtagctgggactacaggcgcccgccaccacgcccagctaatttttttttttttgtatttttagtagagacggggtttcaccgtggtctcgatctcctgacctcgtgatccacccgcctcggcctcccaaagtgctgggattacaagcgtgagtcaccgcgcctggcctagaaatcatttttatgtcattgggcagtttaaagatgttatgtgatacattaatgcataaaactggatagtttctgagccatagtaagtgactcatccgaatgtcattattaaccttaaagagtgatgctatgttacatttccttctgaactctagggaatagggcctttcttactctcccaatttctctttccacttatattctgcctatcagcctctcccaccttctccttccacccattccctgagtgtcaatcagacactaagaagcagtagtttgcccatgtcttcctatatctcctgttttccaaaaacctcagggtgacatttgaccttctgtgtcccacactcaggctgctgagggcactgaggccatctgtcatgtgtgtggattggtgccactgcagagccttggcctctgcccgcgtgggttccttgagctgctcatccaaccctgagtgtctgtgcagtccctgttcagcccttcagagtctgttccagattgtcccctcctcagtgccacatctgcacttgaaaatctcaaaagcacaaaactcaacatgcctaacaaggaacccatgatcttgctcactcctgccacctcccaagtttctgtgaatggttctgccatccaggcagattaggggactggccccaacctcagacaagtcaacccctccacctccatgagtccctgcatccagccaagtagacagtttttgtctccaggcacagatgtctcagcatgtgagtgctgatgtgttagcaggctttcaggttgaaaagaaagtctcctgtcttgtattgcttgatcagcagcccttacatgttcatctcaacttctcttttccttactggaagaggtcttgccccagtcatggccaattcctataccagggtctagaacacacttcctttcatggacatcctttcttcatttatattctgcttgttttgtgattctctactcaacctaaaaatatgcttgtttcttcttttttcttttctttttttttttttttttttttagagtctctctgtgtagcccaggctggagtgcagtggtgctatcttggctcactgcagtctctgtgcctcagcctcccaagtagctgggattacaggtgcatgccattacacccggctaatttttgtgggtttttttgtttgctcgcttgtttgttttttgttttgttttgttttttgagatggagttttgctgttgttgcccaggcgggagtacaatggcgcaatctcggcttactgcaacctccgcctcccaggttcaagcgattctcctgcctcagcctcccgaatagctgggattataggtgcatgccaccacgcccggctttttttgtatttttaataaaaatggggtttcaccatgttggccaggctggtctcgaactcctgacctcaggtgatccacccgccttggccttccaaagtgctgggattacaggtgtgagccactgcgcctggccatatttttagtagagacagggtttcactgttgttgcccaggctggtctgaaacccctggcctcaagcagtccatctgcttcggcctcccaaagtgcagggattacaggcgtaagccactatgcccagcctcgagtttcttacaattgaagaaaataaaacaaatgcttgtggctcatgatatatttatatattcattgatacattcatttactatgtgggcatttaattgtctagatttggctggcacagtggctcacaccataatcccagcactttgggatgctgaggtgggaggattacttgagctcaggagtttgagaccggcctgggaaacatggtgagaccccgtctctgcaaaattaaaaaaattagctgggcatggtggctcatgcctgtggtcccagctattcaggaggctgaggtgggaggatctcttgagcccaggaggtcgaggctgaagtgatcttattcatgccactgcactccagcctgggtgacagtgagctcctgtgtcaaaaaaataaataaataaaaataattcatgagagaccatgaaccagaggcaaaaaaaaattaataataattttctatgtttcattcacagaaacagtgatactgtggatattcatatatgtatttcattttccacttgtggaggtgcattttttgatcattcttggagtgaaattattggtttgtaggctatgcaaatgctcaagtttgcaagatcattccctttgttttctaaagagcttatgccaatttgcacttaaccaggaaagagaggttccgttgacccatatcctttccattataaggcttatcaatgtttgctcatcaaatggacacagaatagtctcgtgttcttgatttccctttctttcactgctgtaatgttttagcaacttactatgatttttggttgatttatattttcttctgtgaaaatagaaatcattttttattttatgatgaatgcctatttccattaacctgttttcctttcactgcttggtaggggttcttagtacattcttatccttaccttttatcacttatatatgctgaaaaatattttctagtttttaattttgttctcttactctctttaaagtatctttctccaaaaggtcttaatttactgtagtctaacttatgacttttcttatataattaatgatttttttgtcttgtataaaaaatgttggtttacctcaatattaaaaatatattttattctaaaagttttaaaacttggcatttgacattttttcagtgaggttgatttggaatatatagtgtgatagcaatgcagttattttcgttctccatgtggctacccaatttttctagcttcgtttccttaatttaacagaccatcaagttccatagttaagtatagttggtattttacagggaattatattgaatttatataatttgggtcgaattgtcagttcgtattattaaattcttcattgatctagatcatctttattgtcttcaaataagattttataattttcttcatcttgatcatgtgtatttggggttttttgtttgttttaagagaaaaggtcttgctctgttgcccaagctgggtgcagtggcacagtcatactttgctgcagtcttgaattttgcggctgaagcaatcctcccatgtcagcctcccgagtagttgggactacacaggcttgcaccaccatgcctggctaatgtgtttttagttttgtttttaaaaaattttttttagagatgggagcttgccgtgtttctcagagtggtctaaaacttctgggctcgagtaatctgctcacctcggcctcccaaagcactaggattacaggctttggggggctgaggtgaaaagatgagcaccatacacagcagcctggccattggtcatgtgtatggtgctaatcttttcaccaggctgttcctcaggcatacaagactcattgtgtcaagccaggtcctcttacctctttccttatgagccttcaattgatataacatcagtcatatcaccttcactgtcacccagctcggaatcatgggaatcagcctcccctctgtccctggattgtcatcaacaccatcctgcagtttctttgtactttctgtctctttagactacagtgtccagtgtccttcctgctttctctttatggcaactcttcttcacaagcataggactcacttcattgagcacctcttactggaaaactgatttcttcctacccaggattagccaagctcaaggttaaggacacagtcctctaagactaccaggtctaactcttccgacacggactacaggtttgggtcccaaagccgttgtcaggttcactaattagctttagactcacaaaattctctaaaacctgttttagttacagtcatgtttattacagacaaagggaacaaattagaagtgacacagaatgttgggttggaaaggttcccaacacaaagcctcagtgttttcaggaactcgctgtgccccagtctggcatatggcaatatgagcttagaatgttgccaacccaggaaactcaccagctcttcattgtccagaattgtactgaagcttcattacataaccacagttgattgtctcatcacctgtgtggctcggtctccagcgtgccatcctttccagagattcagcatttaaattatgacataagccctaaccttctaatcacgtggtttagctttctggagtggccagaccttaacctgagtcatctcttcaggataaactgtggaggactccatagtgagttccccgtttgcataaactgtcagatagggccattgggtcccaccataagtaaaaacattttggaactactcagtgtttacaggttactttccatgacttcacaggaaaagcgtacttctctttggggattaatttttgttactcacttcctgtcttccatgtgggctcattaggtgctccttcctcgtgttcttgtagcaacacagcatgtccttgcttagttgcttacaggaagcttaccatgcacggtgtcgtcgttactctgtctacccaggtccaatctgtaattgtgaaggtggctccacgaacagacgcattgtctcctgacccagcctctgcccctaggtctcccatgcagaatatcccgagtccaaggaccaggatagaaagaaattgcaaacccaagaatttgagatacagaaaatagcaacacagaggcaatatttttatctatggtttttcacagaaatggtaatattcttttttccatgttgtcctttactaacaggcccttttgtgtgctggatttctttcaggcgacaaaggaaaacctaagaccacagaacctaccacttgtgagccagccttgtcagagggaatctcacttcagggacaagtgacacaaggaaactcagtggactcacagttggggcaagccgaggatcaggatgggctatcagaaatgcaggaaggacacttcagaccaggaatagatccccaggagaagtctcctgggaagatgagccctgaatgtgatggtttagggacagctgatggtgtgtgttcaaggattggacaggagcaagtctctccaggagatagagtccgtagccataactcatgtgagtcaggtaaagatcccatgattcaggaagaggaaaataactttaaatgcagtgaatgtggaaaagtatttaacaagaaacacctccttgctggacatgagaaaattcactctggagttaagccctatgaatgcacagaatgtgggaaaacctttattaagagcacacatctcctgcaacatcacatgatccacactggggagaggccctatgagtgcatggagtgtggaaaggccttcaaccgcaagtcataccttacccagcaccagcggattcacagtggagagaagccttacaagtgcaatgaatgcggaaaggccttcacccaccgctccaattttgtcttgcataacaggagacacactggagaaaaatcctttgtgtgcacagaatgtggccaagtctttcgacataggccaggctttctccggcactatgttgtccacagtggtgagaatccctatgagtgcttggagtgtggcaaggtcttcaaacacaggtcatatctcatgtggcaccagcagactcataccggggagaagccctatgagtgcagtgaatgtgggaaggtcttcttggagagtgcagccctgattcaccactatgtcatccacactggagagaagccctttgagtgcctcgagtgtgggaaggctttcaaccaccgatcctacctcaagaggcaccagcggattcacactggggagaagcccttcgtgtgcagtgaatgtggaaaggccttcacccactgctctacttttatcttgcataaaagggcccacactggagaaaagcctttcgagtgcaaagagtgtgggaaagcctttagcaatcggaaggacctcattcgccacttcagcatccacactggagagaagccctatgagtgcgtggagtgtggaaaggccttcacccgcatgtcgggcctcacgaggcacaagcggattcatagtggagagaagccctatgaatgtgttgagtgtgggaaatcgttttgctggagcacaaacctcattcgacatgccattatccacactggagagaagccctataaatgtagtgaatgtggaaaggccttcagtcgcagctcgtccctcactcagcatcaaaggatgcatactgggaaaaatcccatcagtgtaacagatgtgggaagaccttttacaagtggacaaacctcagttacccttcgagaacttcttttagggaaggactttttgaatgtaaccactgaggcaaatattttgccagaggaaacatcttcctctgcatctgatcaaccataccaaagagaaaccccacaagtgtcttcactgtgagaaaaccttctgttgctgaatattacttgtcatctgaagagtcatattagaaattcgttcagtctagagccttattctccatctgataatttatcctggagagagacccagtggttattgtgcacataggagaaccttcagctgcatctttctccttagtttacagtgcaattttatctcaggaattatttttaaaaggaggaggggacatagaaaaaatgaaatgcaagcacacatcttttcaggcttctctgccaagcctatggcgctttgtcatggatttcttagtgtatttgggggaagggaaatgtttcaaggtaaagaaccttgaccctttatgtgcttgtatgtacatttattgctatccagtgtcagaacagttagtttaggaaaagtatgcaaactttaatcgcacatcttctgtattccacaatagtacttactcttgagaagcataactttatgacaacttagggggcttgagccatgaaatactcacgtttaagtcagtaaggatacacatgttaacattcaggcttttgtcttgatgcccgtcttttggtttacgtcatcattgtagccatatggtaaatttttatttgttaaatttttaaaaattacttagctcaaaatgtcagtggtaaatttttaaattgagtaaagtgattcttctttgctcttatttaaaatcgacagcatttctagttcctttgacattccatataatttttaggattagtttgtacttatttacaaaacagtcttgttcagatttttacagaaattgagttaagtctgtggattaatctgttaagaattggtatctttactatgttgggtcttgtagttcatgagtgcaggagtaggcctcttaatttataatagttaagcattccttaaagtatttcattaatgttaaaaattttcagcgtatagatccctatgcatttttgttagaatttgcatcctagggtgcttttttgtttgtgtgtgtgtgtaatttgagtgattgtaaatggcattgatgtttgaactttgaattgcacacaatttttggtagtatacagaaatataatatttttggacattgttttgctaccctgcaaccttattgagttcacttattatttttagctatttctttcgacagaatccttggaattttctatatagaaatgtcatctgcaaatacagaccattttttatctttcatcttacctgtaatataccttttatttcctttttgtttgtcttattgcattgcacaagctgggacttccattatagcgttgaataggaatagtgagaaaggccatccttacctggttcctgatagtaggggggacaatgttcagttttttgtttttttgttttttgtttgagacagggtctcgctctgtcacccaggctggagtgcagtggcacgatcttgtctcaccatagccttaagttcctgggctcaagtgatccccccacctcagccctcaccaccccccagtagctggtactacaagcatgcaccaccagtcccagctaatttttgtattttttggtagagacagggtttcaccatggtgcccaggctggtcttgaactcctgggctcaagcaacctgcttgcctgggtctcccaaagtgctgggattacaggcgtgagccacagtgcacagcatgttcagtttttcatcatgaagtataatgtaagttttataaaacatatgtcctctataagggtaaaaaatttcctctgttcccagttttctgagactctgtgttgctatgaataagtgtggaattttgttcagtactttttctccaccagttgatgtcattatgctattttccttctacatcctattgatggaatgtattgctttgatcaagttttgaatattgagccagccttgcatccttagaataaaccatacttgtttgtagagtataattgtttttatatatcatttgacatcattccctttgtttgtattttgttgaggaaatattcctctaatttattggctaataatgtgtagttcttttttcttttgtttcttatgttctaaatgtcttatgtgtggttttgatgtctaggtgatcttgacctttcaacatgaattggaaggagttctcttctaatttttggaagactgtgtagaattggtgttatttgttcttgtcatgtttgatgacctctagtcaaccattgggccagagatttttcttctggaggcttttaaattacatatttattttattggataggtagaactattcgaagtatctatttcttgtgtaataaattttgatagtctgtcctgttgaaggaatatttcatctgtatttgtagcactcccttattcttttgatagcaggatctgcacttctttttatttttaatatttaaaatgtgcatactcattttatgattgagtcttcttagacatttatcagttttattgcgcatcatgctgaaagatgtaatttttgcttcatctctcacttcagagaactagcactttatattaatgatttgtctctattcttgatttctttgatttctgctctgatcggtattatattccacttgctttggttgtatttggctctttctaacttttcaaggtggggttttagattattgatttgagatttttttgcttttttaatgtaagcattacattgtataaatttacctcatatcactattggtttgatcccacaagttttaatgttttcattacattttaattctaatagtttttattttttgagacattctctcttagccatgaattatttaatagtatgcttaattttctggtgtttggcatatttgttactgatttctaatttgttccatgtttgatctgactgtttaaatgtgttaacatttttttatgacccaggatagggtctatcttgtttcgtatagctgcttgaaaagaatgggtgttctgctgttactgggtggagtttctataaatgtctctatgatcctgctcattgttattcaagtcagctatgtccttgctgattttctgtccagcatttctgtcagttgctgagaggggtgttgaagtcctgaacataggccgggtgcagtggctcacgcctgtaatcctagcactttgagaccactaaggcaggtggatcacctgaggccaggagttcgagaccagcctggccaacatggcaaaaccctgtctactaaaaatacaaaaattagccaggcatggtggcgtgtgcctgtaatcccagctgctggggggctgaggcaggaggatcagttgaacgtgggaggcagaggttgcagtgagctgagatctcaccactgcactccagcctgggcaacagagcgagactctgtctcaacaacaacaacaaaaagtcctgaacatgattgtggaagtgtgttgctctttcaagttctatcactttttgtttgcaaagttcaaagctgtattgtttggtacatatacatgtaggtttgccaagtctttgtggtgaattgactcttctgtcattatgtgatgtcatttttttgccttttaatagtcttgtcaatactttacctgatgttctcatagtgactcctgcatattttgattaatgtttgcatggttaatatttcttcattttattttaaagcttacctgtatcattacttatgaagtcagtttctttgaacagcatatactcaggccatgctttttttattcattctgcatatgtctctcttaattggtatgttgaaatgatttacattaaaataattattgatattttagggcttaagtgtgcccttaaatgatttttgtgttcttttttattgttcctctgttatttggggttgtttactagtcttcctataggttacttcaccttttttttttttaataatttgatttgatacatatgtagtgttttttagtatagatcctccttgacttatgatggggttatgtcacaataaacccattgcaagttgaaaatactatgtcaaatatgcatttaatacacctaccctgctgaacatcatagccgatcttgccttcagaatgctcagaaaatttacattagcctgcagttgggcaaaatcatctaacacaaggcctactttataataaagttactgcaaagaattttaaataaaaattcaagtgtggtttctactgaatgcatgtcgcattcgcaccattgtaaagtcaagtagtaagtcgaaccatcctaagtcagggactgtctgtatatatctgcattttttagtgattgttctactattacagtgtaaatatataacttatgacagtttaataagttatcagcaatttagcactttacttccattaggttcctttagcttacctactaatgtaactatcttaagtaatagtaattcctcttcaaaaattgagcgctatgttgcaagatgtaatttttcttttccttttttttgagaccaagtctcactctgtcacccacgctggagtgctgtgatgcgatctcggctctctgcaacctctgcctcccgggttcaagcaattaactgcctcagcttccctagtaatggattacaggcgcccgccaccacgcctggctaatttttgtatttttagtagagacggggtttcaccatcttggccaggttggtcttgaactcttgacctcatgatccacccgcctcggccccccaaagtgctggggttacaggtgtgagccactgcacccggccacaagatgtaatttttactttatctctcacacgtattttacaaaacgtcatgagaaacattgtctcttgaccttttttttttttttttttttttaaagagacagagtctcactctgtcacccaggctggagtgcagtggcacgatcttggctcactgcaacctccgcctcctgggttcaagcgattctcctgcctcagcctcctgagtagctgggattacaggtgtgcgccgccacacccagctaattttgtatttttagtagagacggggtttcaccatgttgctcaggctggtctcaaactcctgaccttgtgatccgccaaccttggcctgtcgacctctttacccattccattgttcattcttctttcttgaaatcccaaaccttctattaacatttcttttcagttatacactgaactttactgtagcctttcttctagagtaacaaatgttctttgttttccttcctctaaagatgtctttatgtttccttcattcccaaagaatatttttgtggaatataagattcagagttggcagttgttttcttttagacttcagagatgtatctctctgttctgtacattattgtttaatataagaaacctactagcattcaaataatcattccctattttacaatgcatcagttctgtcaagcttcattcaaagtgtttttcattgtctctagtgttcagaagtttggctgtgatgtgcgtggcatggaagtttttgggtgtattctatttggcgctccctggtgcttgcccagctttttgatctgtaggattatgccttttgcaaaatttggggaactttcaactattatttcttcaaatattttttcaccccccagtcttgtcttttttagggacttcaataacatgagtggcagatcttgttttacactcccatgggtccttcaggctctcatcttttttctttttccagtctattttctgtcttgttaatattgattaatttttattgaccttccatggtcctcactgattgttttctttgtcatacctaatctgttgagtttgtgcagtgagttttcattttggttttgtattttccagttgtttaatttccattgggtgggttcttttgtacaccttctgtttctttgcttattttttaacgccaaagaaagactctcagagaatagacaactatattccaaagtcatggttctctggtggtttgtcttgacatttgaatagaaatgttaaactatctgggggaatagaaagcccacagtcttctgagttgtgctacaccaatatttctatgaacagatcttacaactgagagtgatctgcagatttttcagagtcatgttctccatggaatgtttgtaaaattccctagctctctgcactgagctgagatcgtgccactgcactccagcctgggcaacagagcgagactccatctcaaaaaaaaaaaaaattctctagctctctatgccttgttgtatcctcaggaaggagtcacctctcttccaggatcactcttgccttttgttattggacacattttcctacctcctgcccagtcttttttaggctctctgtcatacttcctcgcctagtctttaacttgtctctgataaccagatttttcccccataatctgtatctgtattcaagtctctatcctcatccccaaatggatttcaccccgcttgtccatcagtctctgcccatttcttctgtctcccacagacatggtctgtgtagttgttctgcacactacccgtcctcgccccttctcatttccctcactccacggacagctacaggagggcttccatcatttgtcctcttacttccttgttagaactttgtgctgctgaccaccactctgaaccaaaacttctttcttggttcttgaaagttgctgtctttctcctccagagggtctgtgtcttccttccaactcttaaacatttttgtttcccagaatccatcattggccattgctttttcacttgccatgagctctgtgaatgagatggttcctgctgaagacatttactttcaatgatctacagaatttcccaaatctatgtctccagactggatgtttctcacgtctgtggcccactgggcatcttctgcactttctctgcatttgtaaacactgagcctgtatgcgtgtctatgtggccatggccctggccgtggggatgcacccataattataatgagagcaggtgaatgtcatgtggctatgtatgagacattgttgtgaatgttttacatgcatcagctctttcaacatttacagcatctgtgtgtggtaggtaatgttgtttccttcattttgcagagcagaatatagataggctcaggttaagaatttgcccaaggttacacagttatgaagtttggatttaggaatgggaggccacgtagactggcttcagaattcatgtctttaaccactttattgcttctcatgttggggggtttgttttctggtcactatttttactaaagttgattcaacaatgctataatctgttactctcattcgacaatacatcttgactgtttcttcaacttgaggaaggtaaaccaaagccactctttaatgggtgcaaatatctgttgtaactatgtagaagatacagtgtctgggtttgaggacaggggagtgggaaaactgagtagggaagcggtaagacatgcatctggctttaggagtgtttgaagtgcctaaagatcagggtgaatttcccaaatttgaatcttgttgcccaagccacattgcaaccacctctttttctcttacctcgtccccacatccaggcactgccccattctgttcattccacctttttttttagtagaccctccatatatgtgtgtgttttggtgaatggccacacacagcaaagttatttttattgcaattttgttgttgttgtttgagacacagagtctcatactctgccacccagactgaagtgcagtggtgcgatctcagttcactgcaacctccatccccccatgttcaagcaattctcctgcctcagcctcccaagtagctgggattacaggcatgggccaccatgcccggctaatttttgtattttttgtagacacggggtttcaccatgttggccaggctggtctcacactcctgacctcaggtgatccacccgcctcggcctcccgaagtgctggcattacaggcatgagccaccacacccagcctttattgcaatttttggttccctcacagaatgtttaccatgaagctgtgcgtataggtggtaccatgtatgacataccttgacctcaaagataatctacctgggctttttttgtttgtttgttttgagatggagtctcactctgtcacccatgctggtgtgcagtggcgtgatcttggctcacagcagcctctgcctcccgggttcaagcgattctcctgcctcagcctcctgagtagctgggactacaggtgcctgcgaccacacccagctaatttttgtatttttagtagtagtgggatttcaccatgttggccaggatggcctccacctcctgacttcatgatccacccgcctcggcctcccaaagtgctgggattacaggcgtgagccaccgcacctggcctacctgggcttttttggacagatgtacatgattttagaaattgttatgaatgactgtcttgggatcctcaagaacacccccaggtttgacgatttgctgagaagactcaggtctcagcattctgtcatactcaacagctatgatttactgcagcaaaaaaatacaaagcaaatagtaaagggaaaaagccaaaattcagagaaaaccaggcacaatcttctgagtcttgtttcagtgaagtcacaggatgtgccttatttaagttccatctggtacttatgacaacacatgctatatgtccactgggaagcttattagagactcagtgccagggtttttattgggcatgttttctagcacatcccacaattctggacttccagaaggttagcaggggttcagcttttcagctgaaaacgttatccccctttcagctggggggaaaaaaaggcaccgaaaaacagggcagtgagctactcctgttttgggtgggtggagcagtagtaagcctcccaaaatctaaggtcccacactccagcaagggtgaaccttgcaaactcaaaaggatagcagtctccaacctgctgttttatacagtgacttaagtggtactaaaatgctatataagtcaaatttacgtaacattaagcaaataattttttttcagcaaaaaaataatggtcatgactttgtggtgaaggcttatgtaatgattgtaataaattcaggtggctcacgcctgtgataccagcacttttgggaggctgaggcgggtggatcacttgaggtcaggagtttgagaccagcctagccaacatggtgaaatcccatctctacaaaaatgaaaaattagccgggcgtagtggtacatgcatttagtcctagctacttgggaggctgaggcaggaaaatcgcttgaacctgggaggcagaggttgcagtgagccgagatcatgccactgcactccagcctgggtgacagagtgagactgtgtctcaaaaaaaaaaaaaaaaaaaaaatgcctcagttttgttaagaggaaaaagcaaatcctaagttacagtggaacttatgaacaccctagcctagagatttaatttagtgatgaaaaggtacagagagagtctttcaagaaaggacctagtctgctcgcgttctctctctctctctctctatatatatatatgtatatgtgtgtgtacatatggaccacttcaagctacacacacacacacacatatacacgtgtatgaatatatatatatggctataagtggtgcgacttgcaggtactccctttgttcacctttgtaaagatgttattgccagttcagtgtgtatttctatagtatatatgtaaacaatttgtcatccttttgttgctgcttttgaaactagttcatggcttcagtgggggagagatttaaataatatgggtttataatttctgcattattaaatgcagataacttgtgattaaagagtatgttattggaatcatgtttgcctgagttttactttggaggagttgaacagctgactccagccgagaggtcccctacagagacgggatgttggagacccacgggaatctggcttgtgggaattgcacagcaccctttttatcataccgcagcatggcctttcctgtctcgattgtgggaagctggagtgcctctgcaatgttcagtagtgtgcttgggttttgagggtcaaagatttttaatctttgccacaggcatgttacacatcttaaaattgtgtggtctcaactgaactgctccaaggagaagaaacactgccttgggcgcccagtgttggattacaggtgtgagccaccacacccaggctgtattgccactttcgagcgaagaaatgggcaaggcagaataaacaagttatgaattggctagtctgaataatttcagggagctccagagtatatagactgcttttagctagtaactagtactggggtactagttcccagctaaaagtaactgagtaagaagggggatagtagctccacatgtgagaacttgccaaagacagttgaggggtagggctgtggaatggctggtttgcatgtgacaggcaagatagcggaggagaaataccctcttgagtaagggttacgagccatgggccttgtgttgactggccaggtgactttaatgaaattttgtcacccaggctggagtgcagtggcacattcatagctcactgcagcctcaatctctcgggctcaggtgatcctcccgcctcaacttcctgagtagctgggattacaggtgcttgccaccatgcccagctgattctttttttttttttttaaatctagagatgagatatctgtgttcgaaacccagtctggtgtcgaactcctgagatcaagtggtcctcctgcctcagcctcccaaagtgctgggattacaggcatgagctactttgcctggctcagcatgtgtttttattctgatattttgacaaatgagaccttgctgatcctggagacactgctcctcttagaggtagcaaaagtctcctccgcttttgctaagttatgaattgctaagccaattcataacttgtttattctgccttacccatttcttcactcgaaaatggcaatacagcccgggtgtggtagctcacacctgtaatccaacactgggcgcccaaggcaggaggctcacttgaggccaggagtttgagaccagcttgagcaacatagccagaccccatctctacaaaaaaaaaaaaaaaaaaaaaattcacggggcacaatagtgcacacctctagttgcagctacttggaggctaagataggagtgttacttgagcctgggagtttgaggctgcagtaagctgtgactgagccactgcacctcagcctggacaacagagcaagaccctggctctttaaaaataaaatgaagaaatgataacacaggctttacccacactttccccttcctcctgtctcctaaccaaccgtgagtcttccctgtttagccctgtgtggcttcatataccccctcttcatgggaactatgagttacacactcatcagtggcagtcttctgatctgttggcatcgtcaacgctaaataataaaatctacattttaaaaaacctacctgaaagcactcatgaatttcaagaatttagcaaagcaaatcagccatttccatgtcatttccaaagaactgtgtcagtgcaccaagccaaatgtgatacttaggttggaactcagtggacagccatggaaggaggagggggtcaatgccaaagaggggctctccagatgcattggtaggacccaggcgtttgagggaccattgtgttagcaaaatctcaaccatctgaggggttggggtttttaggaaggtagctcctgatgcccttctcatagcccgacactcaagaaagctcaagcacaactaattgagggccccaaatacacaacaccttccgatatcattctccccgggccacttcttaatgtttgcaagtttgaaggaagaatgccatctcccggcccgaccacatggtgttttcttgattatcctccctttcatgggcatcctccctcctttcttaagcctttagccatttgtagctgtgtggtctttcaacatctctgtactcttgttcttcctagttccatgtcctggctctcaggtataagaactcacatatgttcaaagtgtgtctcttgatctttgaaattaggcttcagcagtgacagtaatcttttttcatctcagtttcttgacttttggcatacatgtcatttcagccacctacaagcctattttccatctgcatgttcttttgctgtgtgtgtgtgtgtgtgtgtgtgtgtgtttgacataggatcttaggctgggcgcggtggctcacacctgtaatcccagcactttgggaggtcgaggcaggtggatcacttgagattaggagtttgagaccagccttgccaacatggagaaaccccgtctctactaaaaatacaaaaaattagctgagtgtggtggtgcatgcctgtaatcccagctactcgggaggctgaggcaggagaaatgcttgaacccgggaggtagaggctgcggtgaaccaagattgcgccattgcactccagcctgggcaacaagagtgaaactccatctcaaaaaacaaaaaacaaaaaaaaaatagggtcttctgatcatggctcactgcaggctcagcctcccaagtatctgagactacaggtgcacatcactatgcccagctaatttttaaattttttgtagagatgggggtctccctgtgttgcccaggctggtttcaaactcctgggctcaagcagtcctcctcccctggcccccaaagtgctggggttacaggcatgagccaccgtgcctggtcttcatctgcatgttcttttgtcattttcaaaccctttctgaattatcctcacacttcttgagtatcagacatcaccagtctgatcttccatatgtccctatgtctgtatgggcttctccagctttgagttctttgtcttttcctcactctcttcctctaatggaggagcctcttggggctcatgtcacgctcccattacctcttccttgtgttatttctctccacgtcccgcaactcccctctccttgtaaactccccggctacagcaccacgctttttaccactctggtgaaggtcagcagtggctccctgtttatgaatcctaagtccttgtcttttctgggctatggacaggacttgaaactgttgttgtccagtcctttctccagatgtactcttggattctgtaaggttatgcttctggttttctcccctgcaccctctcactccttttcccctttcatgttggtgcatccacgtgtatccagccatttggtgttgaattttttttcttttttttttctctttgagacagagtcttgctctgtctccgggctgaagtgcaatggcatgatctcggctcactgcatcctccgcctcccaggttcaagtgattctcccgcctctgccccctgagtagctggcattacaggcatctgccattatgcccggctaatttttgtatttttgtagagacggggtttcaccatgttggccaggctggtctttaactcctgacctcaggtgatccgcctgccttggcctcctaaagggctgggcttacaggcatgagccaccgtgcctgaccggtgttgaaatttctaaggctttgtcccaggcctcttttttctcttactggtctctccccaggcctcatctgcactcttgggttcagctacctactttagtgaacataccctaaaacgtatttccccaaccctcatctcatacaagtcttactgctctcctttcactccatgcttccctttccttttcccactcgagatggagcttccaccacctgctttgcccagttagcaaatgtgtatccttcattttgtcccagagagcacaccttcacagaagcccactagagcacccagctagctcatacccattctttcatgattatctattgatttgtttggttattgaataatgaccgtatcctgaactcaatttccagcttcgaaaaagcacagaccttgatctagattttctcctaatgttccatgtgcatagtttgtagtcaatagtatgtattcagatatttgttaggtgaatgagccttaatcatttttgacattttaggttatgtgacattctctccccagtaccacctcaggctcgatgatttgcctgaaagtcaaaattcagaaaagaaagtcacacacaactcagaaaagctgttgtactcatggttacagtttattaccacaaaaggatagagaccaagatcaccaaaggtaaaaggcacataggaggaaatctgtgagaaaccaggcacaattttttttcttttttctttttctttttttttttttttttttttgagatggagtctcgctgtgtcacccaggctggagtgcaatggcacaatctcggctcactgcaacctctgcctcccaggttcaggtgatcctctgcctcagcctcccaagtagctgggattacaggcatgtgccaccacactggctgatttttgtgtttttagcagagatggggttacaccatgttggccaggccagtctggaactcctgacttcaagtgatccacccgccttggcctcccaaagtgctgggattacgggtggaagccactgtgtccagcacaggcacaaacttagcaggtgttccctcccagtgcagttgcacaagggcacactgaattctcccagcaaagttgtgtgcaacacattcacagtattgccagccagggaagctcccccaagccttgacgtctagagttttcgttaagggtcattgaggtaggaatgcagaacccacatgaataaccataaatatccagtctacaacccttgcagaaaacaaacatatagcatggcccagggcctcatgcatgcaaaagccagcatccaccatgaatcatattgttagcataaattatctggtcaaacgtgcagcaggacctacttatggttttcgacataaaaatcttaccaggcaagataccccaagaggttgttttcctgaagttggccctaattcattctagggtcagatatcagatagctgcggacagtgcctgtgtcctaaaacctgccaacattattcacagtagcaaatcctattctgtttatgctgcccctgccctgccttgccttgcctttctggtggaaaacacagcgcaggctctgggccttgctttctcctctgctgctgctttctaacctgctctggtgcttccacccgcatggtgtgctctgcctcctgtttctagggatctcttactataaacttcctccataataatcacttctgtatctgattgtcacaccctgcctgactaaatacaatcccaggtatattctagaatacacagggagcctattacaacatccttgggccaggcgcagtggctcgcgcctgtaatcccagcactttgggaggctgaggcaggactgcttgagcccaggagttcaagaccagcctgggaaatatagtgagaccccatctttaaaaagaataaatttttaaaaattggctggatgtggtggcatgcacctgtggtcccagctacttggcaggcttaggtggaagaattgcttaagcctgggagttcgaggctgtagtgggccatgatggtgtcactgcactccagcctgggtggaagagtgagactttgtctcaaaactaaaaataaaaatatgacctccttactgtggcctccaggacactacagaattcacgtccatctatctctgtgattcagtttatcttcagctgcagccatactaaccttgttgcacttccccaaacacgacaggatcctcctgctttcattcccttgtcttaggtgctctctctatgagaccctgttacctcagatgctccattcctccaagtccatgctcagatataactgtcttttagacatttcccaactactctacctccctctaaccttctatattgtttacttttgtggttgtggttgttctttttgagttactgattgttggaattaaaaggtccccgagggccagggacagtggctcacgcctgtaatcccagcaatttgggagactgaggtgggtagatcatctgtggtcaggagttcgacaccagcctggccaaaatggtgaaaccctgtctctactaaaaataccaaaattagccgggcgtggtggtgtgcacctgtagtcccagctacttgggagtctgaggcaggagaattggttgaacctgggaggcagaggttgcagtgagccgagatcgcaccactgcactccagcctgggcgacagagtgaaactgcatctcaaaaaaaaaaaaaaattcctcaagtacaggaatgcataattattttgctatgtacatatctgattttttagagcagtgcctgttgcaagataggcactcaatcgatactcattaaattaacaatatacacatatataaaacagcactttcacatggttatgagtgacctaaggaaaaacagaacaggatgacgttgtagtgggggctgttttaaattgacagtttggagctgggcgcagtggctcacacctgtgatcccagtattttgggaagccgaggcgagtggatcacctgaggtcaggagttcgagaccagcctggccaacatggtgaaaccctgtctctactaaaaatacaaaaattagccgggcatggtggcaggtgcctgtaatcccagctactcaggaggctgaggcaggagaaatgtttgaacctaggaggcggaggttgcatgagctgagttcgagccactgcactccagcctgggtgacagagcaagactccgtctcaataaacaaacaaacagacaggtttgggaaagcctctgagaaaggaatggttggcctgagctaagcgccattaccctgatccacctattgtaaccacctaatgggttcattattttccctgctccccagatagagtcgacttatcaagacaggataattgcaataaagggtttaattcacatcaatcgagctaaatgagagaccagagttttattactcaaataggtctccccaaatattttgagacgagcttttttgtttttgggtttttttgtttttgtttttgttttttttgagacagagtctcgttctccttctgtcgcccaggctggagtgcagtggcatgatcttggctcactgcaacctccgcctccagggttcaagcgattctcttgcctcagccttttgagtaggtgggattacaggcatgcgccaccacacccggctaatttttgtagtagaaacggggtttcgccctgttggccaggctggtctcgaactgcctacctcaggtgatccgcccgcctcggcctcccaaagtgctgggattacaggcatgagccatcacgccaggccttcaattatatttctgcaagatatgttccctgtctaaaagaattcaatttttaatgtttttgaaacttatgtgtttgctaaacaaatacgtgggggctgattttacgatctgaggccaaatccacaaactgattacagggtccaacaaatatttggcgagtgggaggagaggggtaagtgagctggactggtggcgtcctggctgtgagcaggcacagccgcaggcttcagggagccccatcgcggtgaccctggagagtggcctgaatcggacgtgaccttgaagcaaggtggttttggggtcgccggctgcacaaggcgcgaagtggtttagggtcacgggctgcacgaggctccagcacgtcaggagtgggcgtctgttcattcccacgtgcatcgcggctctctcctagttgacgcatgcacaccccgtgggtgtatgcgttgttcattcccacaacggccatcaccacctctccgcaccctctgtctccttccttctcgggcctcacccctggccctcgctttcagtgcccagcccggaccgcagcactccagttccgccccaacccgggaaccctggactgaggctcccgtttctgtcctttctattgggcgcacttccgatggcgtcaggaatttcagccaataggagccagccaggaagtacctctctgagcggttggtgccgggtataaaagaaggccgcgcagccacggctgctcacgacgccgcggatcccgaagcctgtgtagcagtgagacatcagtgaggctgcaggacgagcaggattggaagcgccccggccagaaagtgaccccccacccctttcaggaccctgtgaacgggaacagccatccagagggttcaggaaggcgtccgcgccctcacctcttctccccatgagctcccccagagctgtggtgcagctgggcaaagctcaacctgcaggcgaagagtgtgagagccagcgccagagaaaggacgcagggaaggctggggactgggccaggggtcgggtgcacagaagacacatgtgttgacatctcccctccctctcctcctccccaacgctcttcttttctccccactccctcccttccctccaattctttctttcacctctccctcccctactctctcctccccttcctttctctctgcctcttcttcacctcctcctcccctccctaccttaccttactctttcttcttccccttacctctccctccccctctccctgccttccccttccctctctttctctcctccccttcttcccctcacctctcgctccctattcccttctctactgttctcctctcctctctttctctccccttctccttccctcccctctcccttcctatctccctcctcctcctctctttcagtggctacagcaaaccaaacagcccagcagcccagcagcccagccatgtgagtcccttgggattggtatctggaaaaggaaggaaggtgggacgtggggatgaagaacagactgggtgtgtggggtgctggctcctgggaacgagaactactgatagggctgggtctgtgtgagaagggaaagcggcagaggaaggatacaatgaaagaggaaggggagcattggcatccctgactttccctccgcctaccctacctcccaagctgaggcttttttcttcctctcctgtcaggcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacagtaaggacagtctctgcttcctctttcatctttgacgtctgagcccagcattttccccaaatactaaccccaagtaaaccctgcacttgtaccttgaagacttctctgcagttcattccatttacactacctcctaccctgggtcagacactcgaatcctggttcctgttctccgttctcccctcacttgctcccagatagggctgttgttattctggtcccagcataatttgccacttgtgtgaccaggcagtgacggtggcatcatatgataggcctcagggagaaatctgactcttccaacattaatccttcagacaccccaatatcctgcgcctgtataactatttccatgatgcacgccgggtgtacctgattctggaatatgctccaaggggtgagctctacaaggagctgcagaaaagcgagaaattagatgaacagcgcacagccacggtgaggtgcgggtctggaggctctggggtctctgagtttactgtgggctggtgggagctctgtttgtggctgtcaggagggtccgcattgccttctgagaagtttacttctgaatgttattgtgtaaatttaatataatggcacgtatgttctacagctttatccttggataccctaattaacctcattgtatctccagaatattaataagtactgcgtataggtttggattctttggttataagcaacagaatctaactccactgccttatgtaaagaaacatattgaaaggctctgaaggagttcactgaataaatagctagaactggcttagagataggtacaaagagatttctagagggttccggaaagggaaccatggcaatgattttcccaggagcaatggtccaatcagcttgctgtgtcaggatgagtggtcttccatctttcctcctgtttctgtttcacttcctcgggcctcaagtcctgtgagagatcatctgagtggctcaatgtaggttctatgtctggctacttgctgtgctaggacaacagggaggatctgtgtccatgttaccatccatcctataagaccacataaaaaggagaggaaaaccacaccccacacaccagtaactggtgcaatttaaaaggaggaaatggagttactggaccaaaaagattccactgtaatcatacaattcatggtaagtgttccacctcagacggaaattgtggcaggcttcacttccagggtgacttttctttgcacccacagataatagaggagttggcagatgccctgacctactgccatgacaagaaagtgattcacagagatattaagccagagaacctgctgctggggttcaggggtgaggtgaagattgcagattttggctggtctgtgcacaccccctccctgaggtaggtcaggtggtggtggtagggtgagttctgagtaccagttaggaatgacccagtttaatgtatttcatgtgtccatgtgtaaaacctagatacgaacttggggtttctattggaatactgcctttttcttttcttttcttttctttttttttttgagacagagtctaactctttcacccaggctggagtgcaggggcacaatctcggcctcccaggttaaagcggttctactgcctcagtctcccaagtagctgggataacaggcatgtgccaccacactcggctaatttttgtatttttagtagagacagggttttgctatgttggccaggctagtctcgaactcctgacctcaggtgatccgcccaccttggcttcccaaagtgctgggattacaggcgtcagccaccatgcctggctgaactactgcctttttcttttctttttttttttttttttttttgagacagagttttgctcttgttgcccaggctagattgcaatagtgtgatctcggctcactgcaacctccccctcccaggttcaagcgattctcctgcctcagcctcccaagtagctgggattacaggcatgggccatcacacccggctgattttgtatttttagtaaagacgggtttcaccatgttggtcaggctggtctccaactcctgacctcaggtaatctgcctgcctcggcctcccaaagtgctgggatcataggcatgagccacgatgcctggccaatgctgccattttcaaacacctatacttgatatgtattcgtagatttaaataatgtggtccaatcaaaccttttattttctgatctttgttaatatataactataccagtaagtttgcatgtaaataaagtcattgctccacaattccaaaggagtgcatttttctgtatgaatgattttcatacagaaattttcttaccataatttatttacttggctctcattgatacaccatcagtttgttctagatctttcttaatgctgagaatattcttgtgaaaacattctggagcatgagctaaatcactgtgtgaataattccaaaatatggatttattaatagtaggccccagtacttttctgaaccttgatccatattaaaaatttgtctctccaaactcctgtgcttgggagggactttccagggtgtcctagggtctccacatctcaatgaaagctggggaaggagaatttccctcatcctgggcctctgcttagtacttattcccttttctgccttcctctaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtgggacagtcacctttgggcattcatgggggagctggtcagtgatggctgctgggctgtgggcacacacacacacagggttgtcttctgtggtccagaacagcgccttaacaaggctcaaagaagagggaggacattgatcaaagaaattaaccagacttctctttcttctttcctggcctcatcaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctgagccctgtctgcctctgttccctttgtgtgtgttcagggagctctcctggctctgccacctcatttgtctttatttttttctcttttaagatgtaagatgctaattaataaaagctgaatcatttcataccagctcttcatagttgtgtgagttattatgtgactgggtagaatctttatttcttgtgggaactctttcccatgagagctgcccaaggttgttctccctgctacccccaccttccacctcgggagatggtgacttcattcttctgaaaactcttgcctactttcaggtcaggcacggtggctcacgcctgtaattccagcactttggaaggccaaggcaggcgcaacacttgagttcaggagttcaaggccagcctggccaacatggtaaaaccctgtctcttctaaaaatacaaaaattagctgggcgttgtggcgggcacctataatcccacctacttgtgaggctgagacatgagaattgcttgaacctgggaggcagaggctacagtgagctgagatcgtgccattggagtccagcatgggagacagagtgagacaccgtctcaaaagaaaagaaagaaaactcttgtctactttctgcagataaattccctgagggtacataaacctgccacctatcacagtggctccttgatccaacttactattctccatgttttcaggagtatgccatttgtaaaacaggactgtcatcaacccaaaggtccactctctttttatggacatcaatatgctgctgtctcagaaataaaatgtttcactgcacgtcagtgcaacccacttcttaagtgaatacactagcacctctgtgttgtgttgcactctgatgacattagaataagtcattcctcataataaatgtaatatcacctcttctgaaattactgcatgctgcaatttggggagtggccttccagccttctgtaaccttctgtgacagcttcatgtggcagctgctccctgcacccattataaactgactaccacagtaagcatctagactcctcagctgtaagctcaaatgttttttgatcaatgcagtcagttacaccagtatttctcctaactttagttgttaagcactttatatggagtttgccttgttaatgttactcctatcattatattctacaaagtctcctcattgtgaaatatccagcagttgcaggcatgatttctgctatgaccagacccactacgtaagcataaataactcagccacttcacttggatgaaaagctcccactattgcagatctataagttaaatactccaagacattggttcatggtttttaacctgcactttcagtatttacctcttttttgttttttctttcttttacctgcatggggagacacagtgcttacctctatatgctttgcttcatcctatcagttttcctgaattaacattttaaacacttggcaattcctaataaattaactggttcacacatataaactcttacacattttaggtgctggataaacacatcactgggcacatttttggcaggtaaggatagaaaaatcactagggcctcagcactgatcaccagatgatatatgtttaaataatgaaaactctgtcatgctttacatgagggatttgaaagtgtccccaggccgggcgtagtggctcacacctgtaatcccagcaatttgggaggctgaggcaggcagataaacatgtgaggtcaggagttcgagaccagcctgaccaacatggtaaaaacctgtcttgactgaaaaatacaaaaattagctggccatggtggctgtaatcccagctacttgcgaggctgaggcacgagaatcacttgaacctgggaggtggaggttgcagggagccgacattgcgccactgtactccagcctgggcaacaaagtgagactctgtctcaaaaaaaaaaaattgtcaccaatatctacatagctttcttcagcagcactgattccagacattccatgatggaatataaatatactaactttaatatctgttctgcatccaaagcgaaaactaatttaaccctacgggtcatacacatatggaaaggagaattattcctctcttctaaattgggcaaattagtattgtcaatgatgagtaacagtgtcaacagcttgcacgctaattaagcaacatttctcaataatctcattttacaaataataccttctagaaaattgattccatctacatttccacccagttaacatcctgtcatgatactttctccactttcaaatctctggagggcattttctgcacaccttgtttccattttcataaccatatgtattgtcaaatcattgaaagctggattttattctctaaccttcatagtcatgagaagaaaaaaaacagtcaccaacggagactacaaaggttttgtataatatgattttttttttttgagacggaatcttgctctctggcccgatctcggcccactgccgtctccgcctcccagattcaagcgagtctcctgcctcagcctcccaagtagctgggattacaggaacccgccaccatgcccagctaatttttgtatttttagtagagacggggtttcaccatgttggccaggctggtctcaaacacctggcctcagctgatccacccgcctttacctcccaaagtgttgggattacagccgtgagccactgcactcggcctgtataattcttaaaagattgttatgaccctaacatgactttgttgctttcttgtttgcaaccagttagttcagggttgtcaaaaggccaaaattacaacaaatttagttttagatctaattgacttttgtttgtgattcatgaattgaggcaatctctgttctacacaatagaaattagagttcccactgggcaatggcagaacagtgggttttgtaaggtgggaacaataaaatagaacaatagaaaaaaaagctgattggttaacagattactttttctaagggttaaagcagaggggacttcctaatttcactaattcaggtagactgaaatctgcttttaggaaaaactgggatctgtctgcttccttaaaacttcagtttgattagatgacatttagtatgagagacgccattttgatttggtcagtgaggcctgctgtaggagctccaaaacaatggcctcctgtaatttttgtttaacaatgttcacctctttccattcctttctccatctatgctcattttttttcatggtcttgtccagtatcataacttgaaataacagtgtttgccaaaaacttccagatttttatgtccaggcacaacttctctcccaatattcagtcagagattgaactgctgtgacacagacactctgtggtcatacagacatttcaaactgatcatgcttaaagttggagtcatgagctcacccagtccaagactccccacgttaaggaatgtcaaatctactctaccagggctctcagccaatacctaaagcaaaagttgctggaccatgtgaagaccaagcttggccaaagaaggcccaagagagacaatgcatttgcaacatgtcccagctggacagggtcttgctctattgcccagactggagtgcagtggtgcaattacaggtcattgcagcctcgacctcctgggctcaagagatcctcccatctcagcctcctgagtaactggaattacaggggtgtgccacaatgctcagctaattaaaaattttttttgagtaggctggatgctgtggctcatgcctgtaatcccagcactttgggaggccaaggtgagtggatcacttgagcacaggagttcaagaccagcctgggcagcatggtgaaactgactacaaaaactacaaaacaaaacaaaaaaaccctcaatttgctgggcgtggtggtgcgtgcctgcagtcccagctacttgggtggctgaggtgggaggatcacttgaaccctggagtttgaggctgcagtgagctgtgatcgcgccactgcactatggcctgagcaacagagcgagaccctgtctcaaaaaatatatatataaatatatatataaatatatatgtgcatatatatacgtatatatacatatgtatatatacgtatatatgtatatatgtatatataaatatatgtatatataagtagagagagagagagagagagagacggagtctcactctgtcgcccaggctggagtgcagtggcgcgatctcggctcactgcaagttccgcctcccgggttcacatcattctcctgcctcagcctcccgagtagctgggactacaggcgccagccaccacgcccggctaattttttgcatttttagtaaagacggggtttcatcgtgttagccaggatggtctcgatctcctgatctcgtgatctacccgcctcggcctcccaaagtgctgggattacaggcgtgagccaccgcgctctattttttttcttttctttttcttttttttttttttttggtaccaatgaggtctcgctctgtcgcccagactgttctcaaactcctgtcctcaagcgatcctcctgccacagacttctgggaccacaggtgtgcgccagcacactcagcttattttaaaaaaattttttttttttttggtagtctccctatgttgctcaagctggtcttgagctcctgggctcaagcgatccgccccccttggcctcccaatgcgctgggatcccaggcctgaggcatcgcgccgcccgacgtccccctttggttactctgactgcccgctgatctgtataagaggatccggaggggaaataatgcaaggtggaagtcagagtccggagcctggtccagggtctctgcactggccctgaccctggcaaatgtccctgactcctggggctcgatttcctccggccaagaatggacggtctcgcgcttggtccctggcctccgagttgtgcccccaggacagaggcaggtctgagccgggctgtaggcccgctgcgacttttacaccgaggcctgccggctcaggatctgtcccctttgcaggtggtttgtagagaaaaactacattaactacaaggcattgccaggtgcgacggcgggccctggggccaatgatggtccaggacaggggcgtttcctgtgggttgcgaagcttggggcgggacttccggcatttggatgggacgtaatttgggagcgacggttccgtccacgccggctctagggagggggcggtgttccgtggccgcctccctggcggcgctggggaaatgagcaggtaggaggccgacagcgacctccgcgtctcggagcgaaccgtgagcctccccgtaacgagagagtttgactgtcagccaaggtcaccgggcccggcgcagggaaggggtggggctcggctgagcccgcgagacccgccctgctcgccgcagcccccgccccgctagggccacagggtcccggtatggcgatggctttgacggacccggcgcaggtgagtggacaaggtttcggccttgctgcttttctgctagttcggggaagcctcctgggcaggccggaagccaagacagccacaggattcctctttgtagttttgtttgtttacgaaacgtggagcaggctcgtcacttagtttatctcctgtcgtggtagtacctgagagactgaatattgaagcggacagtaggcagactatacatcgattatagggctgtgacgtacaatttttttgtagcaacctgcccaggaaaccagcctcctgttctgcaataaactactctggaagccagtctgccttaagttagtcttgcaaggagctagattactctctggtgacatttcaggaggctaaacggtaactcctggaacagtaggccccaaataggacttgatttgtaactgactgttctaatttttgcctccgcctccaaaagaggaccaagcagagaaagccatacgtgctcagcctaaccaatcacatacgatgccccacttctagttagcccttctgcagctttccactgctaaagtgtcaggcctctgaaagctgcttaataattgcttgaaggatggatgaagttccactccagggactcccgtcacacacatcatccgaactcagccttggcctgcaagtccctacccggtccactatggctgaccacctctgtccttgtttccttcctttcctccctggctcagcgcttcagacacaggtccactatggctgaccacctctgtccttgtttccttcctttcctccctggctcagcccttcagacatatcaatctgatcacgcagagttctttcctacccctcagccttcacctttacagttcattcagcctcagacactatcctcagatctctgcaagaccctttcacatcttgttggctctgctcaaatgtcacttctttaaagcggcctttcatggcagttcagactaaagtagtccccttctcacctgcccttggtctagcgtttttgtatagagaatctggcaaagttttagacacctactgagttgaggtcttaaaggattttgtggggacaaagagcataaataataacacaagaactgtaacggttggccttcattgagtccttgatgtgaactgagaaatgggcattatttatcatctcatttaatcctgatctccttaaagtgacattctattataaacactgctgtacacaagaggaggtcaagactccgacctgtttagttacctgctgaaagtcacatagcacttaagtaacaaactcatatttagcgtgtggaccaccagagcctttgtttttacagacagttggctgagaagccctgaggtgaactttgcagtctttccagcaagtcacagtggccattggaagcgaaaggcagacattccactagagaggactgtgtagacaaaggcaaagtgtgttggttgtttaaggaggtccaagaggacttatgaggttaccatggttccccccatccccacctgctgagacatggcctggaagggcaaaatcctgtggtcttttgttggatgttcgtcctgccttcagcctatagggcattttggccagtcataagcctgggttctcatgaccacagcctgcattatcttcagccacttgagttttctggtcctgaagcacactggccttagggatacctgctggcaggactcagggaaggaaaaggctaatggttcattatgcaatctccctggggtccaggggagaggatgagctggtccaggcactgcccctcgtcaggcatttggtacttgtgaatttggtgatgagggttttgcccacatcttggggatattttcaggagctgctaaaatagattaaatagcaaaaatatgtagaaatgcttcacaactgtattatagtagattcacgtgggtggtggaggattattggggtcacagtattaaaccctgaagcagagggacctgggttaaaatcctgtctcttatatataaatcatgcttataacatgtaaaactctggctgaacttggtgctcacacctgtagccccagtgctgtgggaggctgaggtgagaggatcacttgaggctaggagttcgagaccagcctgggcaacatagcaagatcccagctctaccaaaaagaaatagttgggcgcagtggtgcgttcctgtagtcccagctacttgggcggctaaggcagaaggattgcttgagcccaggagttcaaggttacagtgaactctgagcatgccattacactccagtctgggtaatagagtgagaccctgtctctgaaacaaacaaacagaaaacacaaaagactaggagaatctgtggagctcccttagcctcaggtcagtgactgtgacatggaggtgattggcggtggtgtttagtaatacttcaggggctgtgggaggattaataaaatcccaaagtccagtaagctctgaataactcatgtctgttattgggaaaatgggaattctgtattcatctgaaaattgaggcagagataaatgaggtccctgaggtcacaaaactggcaagtgtcagtttcaggagtttggattcaaacttgagaagtctgacttcagagtttgggacttgtagttgctttaaaacagaacatgaagcttcagcatgagctggaccagtgaggctcaggcactgtggttgtcaacattattgctattattattgtcactatttcctcatttctttgaggtcctcgaactctaattgtctacatctcgccatccacgagttattgccattgtcttctgttattctttgatggctcctatataggaggcttttctcttttacattacagtaatctgtccaaagcaatgtctgccttcctccttcagcctggtacaaagttaggccctcaggaggccctcagtgacttgggccttgatcttgttgcaccttttccagcaaagcacatgcaatagtcccacagcaaactctactacctctatttgacatttcaggtgtctgtgacctttgatgatgtggctgtgactttcacccaggaggagtggggccagctggacctagctcagcggaccctgtaccaggaggtgatgctggaaaactgtgggctcctggtatctctgggtaaggccttccccctccaccatgcaggggatctgccacctccttcgttccaccctctgactccaggcctgatgggtcaagaagtcctctcttactggccttgcctccttcccacaaattcagtcattttctacaacactcacctcttccttttttttttttttttttttttgagagggagtcttactctgtcacccaggctggatgcattagcacgaactcgggtcactgcaacctccgcctcccaggttcaagcgattcttctgcctcagcctcccaagtagctgggaagctgggattacaggtgcccaccaccatgcctggctaatttttgtattttcagtagagatggggtttcaccatgctggccaggctggtctcaaactcctgacctcaggtgatccgcccgcctcggtctcccaaagtgctgggattacaggtgtgagccaccacgcctggcctacactcacctcttcctatacagtctccatgcatcgctttggacaagaaataagagtactctttggctctcagccaaaggagagaagctggtggaaggaaatggggtgttttgcagacctcaaaggtaggattgccagctgtatgttatgaggggttgaagtaggaactgagaaccgccacgatggggtcctggtttctctgtctgggtctgctcatgtcactgtctactctgtatggttttttctgcctcagcgagttcaggggaagagtaaccaccccaggttttactgtttgtgacccctccttcccctccagatttcttgtctgtttctctggcctctgtggggcgtgtttgaggcagcaaatgctgctccacctccagctcatacttgcctccatctctcacccactgcccagcatagactggcctctgtctgcagttttttttttgagttccagagcgggatctgcctgggtgggcctggttgctcatgtatctgctccacagcccagtctgtggtgtaagggttggtgggatgttcactaagaagggttgagtcaggcaggccccaaggagacattgaccttccgtcccaccaggtgttattctaaacaaccttcacgtccttcaatcaccttcacatcctctgattctaaagtcactctgctgcagccttgctgggcttcttgctatttccccaagtgcccacccacctcaggccattgcatttgctgttctctttgatgagtgttctcagggtaattcagcatttcacatggccgccccttctcagcaccacttgcctcctcacccagcccttccctgaccaccgaatcttggggaggcccctttctcaccatagcctcctccctttacctttttaatgtctttctaagctagtgtttctcaaacagggacgatgttgagcttcagtggacactgggcaatgtgtggagacattttggttgttaaaactaagatgatgggccaggtgcgatagctcatgcctgtaatcccagcactttgggaggccgagatgggcggatcacaaggtcaggagatagagaccatcctggctaacacggtgcaaccctgtctctactaaaaatacaaaaaattagccgggcgtggtggcgggtgcctgtagtcccagctactcgggaggctgaggcaggagaatggcgtgaacccaggaggcggagcttgcagtgagctgagattgcaccactgcactccagcctgggcgacagagcgagactccatctcaaaaaaaaaaaaaacctaagatgataacattgacagctagtgggtggagatgctgctaaacatccttataatgcacaggacagatcctttctcctcctcttcccccgatctcacaaacaaagaattacctggacctaaatgtcaattgtgctaaggcgagaagctctttttcagagagtgcttggacagacactacatcagctggtgctgagagacacttgaggaagttgttcttttatttcttctcgtcttgtctccttagcatttgaggaaaactctggtttagtgctgagacttaacgtcctgcaaactgttggtaatttccccttttctacagagggagcagccttaggctcacagccctgaacaagcagcatgagctcacagggaccaaagagcactgtttgtttgtcttgagacagagtctcgctgttgcctcggctggagtgcagtggtttgatcttggctcactgcaacctgtgcctcctggattcaagcatttctcatgcctcagcctcctgagtagctaggattacaggcaggtgccaccacgcccagctaatttttgtatacgttgttttgatttattgctacattttcatggttacctgccatcaagacaagtgactctggattttccatttaccagagtgataaggattccatttttgaagaaatctaagaaaaataaaaagtggatcacttttaagaaaagcagcccgggcatggtggctcatgcctgcaatctcagcactttgggagggcaaggcaggcagatcacgaggtcagttgatagcgaccatcctggccaacatggtgaaaccccgtctgtactaaatatacaaaaattagctgggtgtggtagcgcatgcctgtaatcccagctactcaggaggtggaggcaggagaatcacttgaaccagggagttggaggttgcagtgagctgagatcgcgctactgcactccagcctgatgacagagcgagacttcgtctcaaaaaaaaaaaaaaaaaaagaaaagcagttaacagtccagatccccagagcactgattgggtgtctcaggcctgttccaggcagtgttcatgctccatttattctcacaggatccctgtcctcagcaaagtaaggaaaatttagccactcctgtgagtccctcatccagtttaacttactcagcacagatgaaacaccttcattttatgaagctatcactgaatgtttttgtgtagaaaaaattcttctcttgtgaacttttttttttttttttgagatggagtttcactcttgtctcccagactggagtgcagtggtgcaagatcatagctcactgcgatcctcacaccttaccgtctccagtagctgggactacagatgcgagccactgcgctgctatatgaagtttctgtaaatatccttatgtcaccatatcacagtaggatgttcagtctttaaatattttaatggttcgtgaaatgctggggtctggagtcactgacctgcccctcatcctggccgctggtccctgaggatgaatcctccagctcacatctctgcctcgtcaccaccctctgccacccactctggtgctcgtggtttcctccttactgtatttcttgggagagtagggtttgaagccagaacgctggtgtccagccccagctctgctctttaaaaactccatggccttgggcaagttactgaacttgcctgtgcctcagtgttctcattgttcaaatgaggacttaaccatattcgcatcccagggctgttgccagggtcaagggttattttatgaaaaggctcagaacagcacctgggagaccaggctgcgtgcagggagccattacaatctctgtttccaccagtactattaccgtcgtcctcatcatgattattgtcgttggcatgccttgacctggcactttctgggcagcgttgtggagctttgtggttaaacagcacagacagagatggcaggacctgggtttccttattgactcagccattctccagttctgtgctcttcagcaaatcactttacctccccgagcctgggtttctttgtcaacaaaatggtgttgattatgatatggacttcctgggtataccgtgaggaaatcctcaactggaatcctcatttaatggctaggcatggtggctcacgcctgtaatcctagcactctgggaggcctaggcgggtggatcacctgaggtcaggaattcaggactagcctggccatcatagtgaaacctcatttttactaaaaatacaaaaaaattagccaggcatgatggcacgcgcctttagtcccagctactcaggaggctgagtgagcggagatcgcgccactgcactccagcctgggcaacagacgcatttagtctttggtttagaggaagagcattataaaacattgcttaggatgttaaaaaaaaaaaaaaaagacttagataagtgaagatacataccttgttctgaatgaaaataatcaatgtttaatatttaaagtgtatcactttttctctaagatattccataaatattgttcactttttaatgcatttaaatgcttggcatagtcccctggacatggttatagcctataaatactagtttttgacttactattaggagtagagattctgtggcagcatgacatgccctgcccttggtttctagatcacgtgctaactttttgttcccatggatgggtgtagcttcattccaaggtctggtccccatcctgaagtcccagactagattgaaggtctttatttcttttcacccacatccatgtgtccacttgctttctccataaacagggtgtcctgttcccagacctgagctgatctaccacctagagcatgggcaggagccatggaccaggaaggaagacctctcccaaggcacctgtccaggtaggagccaagatctgggcaggtcggagtccctgctggcttgagacttcgaggagaccactggccctgggatctcttgggaagcttctcactgtggcttctctaagggtttgggagccttggagccctttaacctgtggtttctccgtcctcccagccccatcgcacttgtcgccactcctggggaggagtgaggtgtgtgaactgagactggtcctggggctgcagccttgtgtgccggaaccctggttagccagtcatctactctgtgaccccagtgaagtttgtatatgagtttggctaagttaataccaactgctgtatccaacaaactccaaaatttaaatgattcacacatgaaaactctttttcactcataccaaggtctgtgtgggtcagcagggaactctgtaccacacagttattcaggacctagagtccttctgtcatcaacctgttgctttaaggttgtcctgacatcttcttgctggtagagaattaagggaataaggaaagtcatacccacttccagacctcccctcacatctcacccatgggaactgggcatttggctgtacttgggtccatgagtctaggaattgtggctgagctgcctgtccaaggagaagagcagatggtctggtgagcacctactcagtccactacactcagtctgttcctgaaaaatgatattagaaattatttttataaaaaacaaaaaagaaaaacattatttttatgccattgggcagtttgaagttgtaatcatgtgatacattaatgcataaaactgcatagtttctgagccatagtaagtgacttatcaaaataagctatgagtgttactcatgtcatataaacattgatgagtgatgatacgttacatttccttctgaactctggggaatagggcctttcttactctcccaatttctctttccacttatattctgcctatcagcctctcccaccttctccttccacccattccctgagtgtcaatcagacactaagaagcagtagtttgcccatgtcttcctatatctcctgttttccaaaaacctcagggtgacatttgaccttctgtgtcccacactcaggctgctgagggcactgaggccatctgtcatgtgtgtggattggtgccactgcagagccttggcctctgcccgcgtgggttccttgagctgctcatccaaccctgagtgtctgtgcagtccctgttcagcccttcagagtctgttccagattgtcccctcctcagtgccacatctgcacttgaaaatctcaaaagcacaaaactcaacatgcctaacaaggaacccatgatcttgctcactcctgccacctcccaagtttccgtgaatggttctgccatccaggcagattaggggactggccccaacctcagacaagtcaacccctccacctccatgagtccctgcatccagcctatctccacagcctttcgatttcacgtcatgcatgcctcctgaattcatccctctatcacctccatgagacctatccttctgcttttttcttttttgagatggagttttgctcttgttgcccaggctggagtgcaatggcgcgatctcggctcaccgcaacctccgcctcccaggttcaagcgtttctcctgcctcagccttccgaatagctgggattataggcatgcaccaccacatccggctaattttgtatttttagtagagatggagtttcaccatgttggtcaggctggtctcgaactcccgacctcaggtgatctgcccgcctcggcctcccaaagtgctgggattacaggcgtgagacaccgggcccggcccccttatggtcttactctaaactcttatcatcttttttctaggggatgttaatagactcccaaaacttaatctctgtatctgctttgtgcctctggtcagctctttgtcctgcgtggggtactccagcattcagaccttgttccagacagttaatatttccccagcaactcagcatatgactgctgatgtattagcaggttttcgtgttgacagtgtcatctacttctattgtttaatcggcagtccttacacattcctctcaacctctcatatcggtagcttctcttttcccctggtggaagaggtcttacccttggccacggccagttttttcaagagtttatattatacgttttcatggacgttttttcttcacttatattccgcttgttttgtaacttcatcctttctgtactcaacataaaaatatgctcaacttccttacccttgaagaaaattcaacaattcagtgttcatggttcacagtgtattcatatattcattcactgtctgagcacttaattgtttacatgtttttatatcagtgatgctgtggacatttatgtatgttgttcatctttcacatgtgtagggacacatttttgatgtttctggagtgaaataattggattatagattatgcaaatgttctagtttgcaagatcattctcattgttttctaaagggcctatatcaaaaaattcctctcaggaatttttggaaggttccattgatccatatcctatctaatacttgaaactataaggcccctcaatttttgccgattaaatggacacaaaatattatctgttgtgctcttgatttgcattttcctcattggtagggtggtttagtgtctttcatgattctgagccaatctatattttcttctgtgagatgttatttggtgataaatgcctttttttcaattaacttctttggctttctctttttgattttatttttgtacattatagatacctatcttttatcagttacatttgctgccggtatattcttctagtttttaattttgtccttccactctttttaaagtatcttttgttcaatgagttccttacatagcgtagtctgatttatgttttttttttacgtgattaatgattttgtaccttgtggaaaaaatgttgctttaccctaatgtcaaaaaggtattcttgtttattttattgtaagttgtaaaacttgccatttggcattcaagtctttatcaatctgaagttgattttgagtatagaatgtgatagaatacaatatttccattccccgtgttggtagccaatttttctagctctaattccttagtagtctctcatcactgaggtgctgtgcctctttgccatctaccaaagccccatctatgtgcaaggggatttctgagctctctgttcttctttattcccagtttgcattatgtctgtgccagagtggtacctctgccttatgagctctgtcctgagagtggcactgctcttcacagctgtcacctaggtcagaatcttgggaatcagtccccctgtgcctcatctttccctagattctcatcaccaccaccctctcatgcactgtagctcatttgcatattctttctcctaaggctatagtgtctttctcacattctctcgtgacaagtgggacttacttcactgggtaccttctattggaaaactgccttgatctttttctacccaggattagccaaactcaagataaggacacagtcctccaggactttgtcaagtctacccaaatcctcttaattccaactgcaaattcagggatttcctgaaaccaaccttaggtttcataacttgctaaaaagactcacaacactttctaaaacctattatactcacagttttgtttattacagacaaagcatacaaattagaagaggacacgggatgtggggctgaaggggttccaaacacaaagcttcctcagtaacttgttacccacccagcattgagtgtaaaatatgtgcacagagcattgcaaacccaggaaactcactggagctctggtttttagagtttgttgagcttcattacacaagcacggttaatcgagacattgcccacattgccatgtgaagtttccagccttcgtcccttttccagagttcagctgatatcttgtggctcagagacctaaccttctactcactggttggtctttctggtgccaccagacctcagccagagtcatctatttaggataaactatttaggtacctataatgagttacctttatataaatatttagtctggaattgaagcgatatctccactctaggccctgtcccctcacctggtctctctgcctggtctccctttcaaggagtcaggaatccaaggaaaataaaagaaacaaattatagatctggggttcaagatggcaaaatataacagacataaaggcaccatttataacttcattttttttactgaagtggtgagtttgtttcttctctttttacattactaacaagcccttctgtgtgttggatttctttcaggtgacaaaggaaaacccaagagcacagaacctaccacctgtgagctagccttgtctgaaggaatctctttttggggacaactaacacaaggagcttcaggggactcccagttggggcaacccaaggatcaggatgggttttcagaaatgcagggagaacgcttgagaccagggttagattcccaaaaggagaagcttcctggaaaaatgagccccaaacatgatggtttagggacagctgatagtgtgtgttcaaggattatacaggatcgagtctccttaggagatgatgtccatgactgtgactcacatggatcaggtaaaaatccagttattcaggaagaggaaaatatctttaaatgcaatgaatgtgaaaaagtgtttaacaagaaacgcctgcttgctcggcatgagaggattcactctggagtgaagccctatgaatgcacagagtgtggaaaaacctttagcaagagtacatacctcctgcagcaccacatggtccacactggggagaagccctataagtgcatggagtgtgggaaggcttttaatcggaagtcacaccttacccagcaccagcggattcacagtggagagaagccttataagtgcagtgaatgtggaaaggccttcacccaccgctccacttttgtcttgcataacaggagccacactggagaaaaaccctttgtgtgcaaagagtgtggcaaagcctttcgagataggccaggtttcattcgacactacatcatccacagtggtgagaatccctacgagtgcttcgaatgtggcaaggtcttcaaacacagatcatacctcatgtggcaccagcagactcataccggggagaagccctatgagtgcagtgaatgtgggaaggccttctgtgagagcgcagcgctgattcaccactatgtcatccacactggagagaagccctttgagtgcctcgagtgtgggaaggctttcaaccaccgatcctacctcaaaaggcaccagcggattcacactggggagaagccatatgtgtgtagtgaatgcggaaaggccttcacccactgctctactttcatcttgcataaaagggcccacactggagaaaaacctttcgagtgcaaagagtgtgggaaagcctttagcaatagggcagacctcattcgccacttcagcatccacactggagagaagccctatgagtgcatggagtgtggaaaggccttcaaccgcaggtcaggcctcacaaggcaccagcggattcatagtggagagaagccctatgaatgcatcgagtgtgggaaaacattttgctggagcacaaacctcattcgacactctatcatccacactggagagaagccgtatgagtgcagtgaatgtggaaaggccttcagtcgcagctcgtccctcactcagcatcaaaggatgcatactgggagaaatcctatcagtgtaacagatgtgggaagaccttttacaagtgggcagacctcagtcaacatccaagaacttttattggggaaaaactttttgaatgtcaccactgaggaaaatcttttgcaagaggaagcatcttacatggcatctgatcgtacataccaaagagaaaccccacaagtgtcttcactgtgagaaaaccttctgttgccaaatgtcatttgtcacctaaggagtcatattagaaaatcacgcagcttagagccttattctccatccgaattcatcctggaaaaacacccagtggttattacgcacttgggaaaacctttagctccatctttctcattagtttacagtgcaatgttatctcaggaatttttataaacagaaagaggtgacatagaaaagaaaatgaaatgcagacactgcttttatactgttgtcttgtatgtacatttctgtcctgtgtcaggaaagttagtaagggaaggtctggaaacttactcaatgtctttgttctacaacattgtctcttcttaagaagcattgtttttatgagaaataatgaagccttgagttatgaaatacttttatatttaaggattaaaagaaacatgaatgcgcacattttattgtaccacttaatactgtttaggtctttgattttttaaaaaaattcttttttaatgggttttaaacactaacactgagaatttttcttgattcccatctgttggtttacttgattgctatagctgtatggtaaatctcaaaattaggtaatgtgatttcttttttcttactatttttatttaaaattcatttagcattcctagtttgactttccatatacactttaggattggtttttctgtttttcaaatattcttgcttggattttgatagaaattgagttaaatctatagatcaatgtgttggaaattggcatcttagtcttccaattcatgaacatagcctatcttttcattatttaaattttctttgatatatttcattactgttttatagtttacacagtataactcctgcacatttaaaataagaattatagctgcatagttttttgagtgattgtaaatggcattgatatttaaagtttcaatattcacatgatgttggctagtatacagaaacattattttttcaatcttattttgctgtcttgcaaccttcctaaactcattatttcttgccatttcttttgggagaatccttaggattttaaatatagaaatgtcatttgcaatttgggacagttttatttcttgcttcccatctgtataccttttatttgcttttctcatgttattgtactaggtaggatttccagtgtgatgttgaatacgaatagtgacaagttatccatgccttgttcctgatattagggggaaatgttcagtttctcattattatgatgttgaaagttgcttccaaagagtttctctatcgagtttagaaagtttccctctattcctaatttgctgggatttttttggttattattaataagtgttgaattttgtcatatgctttttctccaccaattgatttaattatgtgatgttacttctatagtcagttgatatgatgtgttaccttgattgagtttcaagtattgaaccagcctcacatctttgtgataagccctacttgatcatggagtataattttgtttgtgtactatgctacagtatttcatttgctagtattttgttgaggaagctttcctctgatttcatgagtgataatctgtagttttctttcttcaactgttactgtttggttttgatgtctagatgataactaacctcctaacatgaattggaaggaattctcttctgtttttttggaagatcatgtgtagaattggtgttatttgttcctttaatgtttggtagctttctccagtgaagaagtgggacctggagattttccttttgaatgctttttaattatgtatttattttatttaataggtatagaactattcagagtatttcatattggatgaatttttatagattttcttaaggaagtgttcattttatgtaaatgttctaatttgtagcattctttgaaatatttccttttatcctcttgatggcagcaggatctgtacttatgttccttgttgtattcttgatattggaaatgtatcacttattattgtcagtctttgtagacatatgtcaatttcattgatcatttcaaagaaatagcactttatatcactgatttttctccagtctctgttcttaatttcactgatatctgctctgatgtgtattgtatcctttctcctacttgctctggttgtatttgactcagtggtttcctgacgtggatgtttaggttattgatttgaggctttttttcttttttaatataagctttaagttctatacatttttcttacactgctgttagtttcatcccacaagtcttaatatgcttttgattatcttactcagttctaagattgcctgattccttttgagacatcttctctaacccaggaattatttagaagtatattgtttaatagtgtttggagtattccctgctatttgttattgatttctaatttgttttgcatttgatgttactgttgaaatttgttgactttttttccttatgacccaggatataggctgtcttgttttacatagctgcttgaaaagaatgtgtgttctcggtcatttggtggagtttctgtaaaagtttgtatgatcctgttagttggtggtgttatttaggtctcctgtatccttgctgattttctgtctagtatttctatcaattgccaagagaaggatgttgaagtcctgagctataattgtggaattacctattcctcctttaagttctatcagtttttgctccacataatttaaagctctgttgtttggtatatacacatgtaggtttgcttagtattcttggtgtattgacccttttataattaagtaatgtccctttttgttcctgttaatactcttatcaatttttatctgatatttgtgtggtcagtcttacgttttggttaatgcttgcatgatttacacttcatcatttttttaaaccttatctatatcactatattgggagtaagtttcttgtgaatggcgtatatttgggctgtggttttatatccagtttgcgtatctttttttttttttttttttttttttgagacggagttttgttcttgttgcccaggctggagtggagtggtgcgatctccgctcactgcaacctccgcctcctgggttcaagtgattctcctgcctcaggctcttgagtagctgggattacaggcatccgccaccatgcctgactgattttttgtatttttagtagagatggagtttcaccatgttggccaggctggtctcgaactcctgacctcaggtgatccacctgcctcagcctcccaaagtgctaggattactggtatgagcaaccacgcacagcattttttttttttttttttttttgagacggagtcttgctctgtcgccctggctggagtgcagtggcgcagtctgcaacctctgcctcccgggttcaagccattctcttgcctcagcctcccaagtagctgggattacaggtgcctgccaccacacctagctaatttttatatttttagtagagacggggtttcatcatgttggtcaggctggtctcaaactcctgacctcaggtgatctgcccacctcagcctcccaaagtgctgggattacaggtatgtgtcactgtgtctggccccagtttgcatatttctgtcttttattggtgtatttagaccatttaaagtttacaataattatgttagtgctatgtctgctattttatgattagttttttgtgtttcctgttgcttctttcttggtttgtttgggtttttttttttttgtctttaacattttttagaattccatttgatatatttgtagtgttttttaaatatatttctttgtatttttgtattaattttttagtggttgctttaagtagtataatgtacatatgtaacataattacagttaatggtatgaaaaatttagcactttgatgtatagaaaccttacttggtcccttcaccttgcctgttaatataattgtctaaagtaattcctcttcaaaattgagcaccatgttggaaaatgtaatttttgcttccactgtcaaatatattttacaaaagtcacaggaagtattgcttgttgatctctttacccattccactattctttcttgaaattctaagccaccttctattaacattttctttctgtttggcgaacttgtgtaaccttttttctagggtcagtctgctggtgtctctaaaagtgtctttatgttcccttcattcctgagggatatttttgtgggataataggatttagggtctgcagttcttttagtacttgagaaacatgtttgttccttctgtccgctatggtttcagatgagaaatctgttgccatttgaaccattgttccctagttcataatgtgccatttttatcaacctgcgttcaaagtgttttgttttttttgtagtgttcagaagtttggttatgaggtgtgtgacatggaatttttttgagtgtatcatgtttggtttttgtttagctttttgatttgtcggtttatgccctttgccaaatttgggaatttttaaccattatttcttgaaatattttttcatccctactctttctcctctctgtgatatgaatggtagagcttttgttactgtctcagaggtctcttgtgctttcatgtttaccccctttttctggtctatttttccctttttttcatattggttaatttctgttgactttttttcagctcactgattctttttttctgccatatgcagtctactgttgagcttgtccaatgagttttcgttttggtttttgtatttttcagttgtttaatttccatttgttttgttttgttttgttttgtttttttgagacagactctttgctctgttgcccaggctggagtgcagtggcgcgatctctgctcactgcaagctctgcctcccgggttcatgccattctcctgcctcagcctcccgagtagctgggactacaggtgcccgccaccatgcccggctaattttttgtatttttagtagagacggggtttcactgtgttagccaggatggtctcgatttcctgatctggtgatccacctgcctcggcctcccgaagtgctgggattacaggtgtgagccactgtgcctggcctccatttggttcttttgtacatctttgatttctttgcttagtttataatactaaagggctcagaaaacagaaaaaactaaattccagagtcatggttttctggtggtttgtctcaatatttgaatagaaatcctaaattatctggaggagtagaagtcctgtaatcttttatattgggcttcttaaatatttctgtcaacagatcttatatcagggtgatctgcatatcattcagagttacgtactccacgggaaggttgtatgtaaaatcctccagctctgtaagccttgttatatcctcaatggagaaggggtcattccttttctaagatcactcttacacttttttattagacacacacacacccttccccaaccaaacttgtctaagtcctctgtctttcatactcttgtttagtctttaacttctccttattaaccagcttctttcccataatgtatagctttagtcggatctcaagcctcgtttccaacctatttcacccttccttgcctatcaagctctggttattctttcttccacacacatgccctgagtaactattctgtgcactgtcgccacccctttacatttccttttactccccagatactactaaatggcttccaccaccgttgcctgacttaagcacgtctcagaaaggtcccttttgaccccctcactctctttttggacctccatactgctaaatctctgacttgaaggtcctttcctggcttctgtgaattcctggcttttttcctttttagggtctgtgtctttcttccatctgtaaaacagctttacttcccagcatccatcatgatcattgctgttttctaacttgtccttcaccccatgactgagttaatttgcgctgaagacactttactctcaattatctacagtgtttccctaaatctgtgtctccaggttggatgtttctcatgtcgttaaccactggtcatccttccacaccttttctgtatttgcactcactgagcctatatgcatgtatcatgtggccatgaccttggccgtggggatgcacccataatcatcataagagaacacaaattattactgtgtatcagacattgtttcgaatgttttacatgcgtcagctcttttaacctttatgacaactccataatgttatttcccccctttaactgattagaaaactgaggtacagaaagattaaggaatttgtcaaagatttcacaattatgaaatttgggtttggggactggaagccactgcactggcttcagaatccatgtccttaaccactttattgcttctcataaggtgggtctttgtttcctggtcatcacttgtttttactaaaatgggtcaaactgtgctcatttatttataatctactattcttatttgacagtacatcttggccattccttcaagcaaatgagataaaccagactcactctttaatgcctgcataagctattgtgactgtagaaaagacggagaatgtctgggtttgaggatatgtgggaggggtggggagaaggagtagagaagggctaaggcatgcatgttgttttaggtgtgtttgagatgcctgaagaacatcagtgtatccccctaatttctgtcatgttactcaaaccagacacattgtggccatttctttttcctttatcattcccacgtccggccactgccccattcctttttgttccgtagtagaccctcaatatatatgtgtgtgttggtaaatggccatacacagcagggtattttttattattattttcagttccctcagcgcgtttaccacaaagctgtgcatataggtggcaccatatatggcgtaccttgacctcgaagagaatctacatggacttttatggacctacgtacacaattttagaaatcataataaatgaatgctggagtcctcaagaccccttccagatttgatttgctaggaagactcacaggactcagcattttgtcatactcaatggctatgatttaccacaccgaaagaatccagagcaaactcagcaaaaggctcaaacccaagtccagaggaaaccaggcacaatctttgagaatcttaatgaaatcacacaggatgtgcttcattgaagctccatctgggacttaaaacaacacacgtgagatgtgttccaggaagtcgtcttgagcacccattgctcagagtttatattggacttgctttctagcacataccacaattgtagacctccagaagaacaggaggtgttcagcgtaagacaatttaggcacacggagctacttctcattactgggaacaatgggaaacttcccaaaacctaaagtacagactccagccaaggatgaaccttgcaagatcaaagaatagcagtctctggcctgctctgttctctttttcacagtaacttaaatggaaaaatgctgagttagcttaagtttctgtaacaaacattaagcaaataaaattttctataacagaaataagccatagctttgagatgaaggcttatatacgtgtaaaccattgtaaccaagaaaaaaaaaaaaagtcagagtcacagtgaaaatacttaacaaactagccaggatttaattcagtgatgacagggaacagaggaagtcttgtgagaaaggatcttgcctctgcctagtatctttcacagataggcttcaagtggtttgatttgcagatacaccctttcttggcctttatttcggcaaagatgtgatgggtaggtaaatgccgtgttctttccctagcacgtatgtcagtttctcatccactctttgttcttgctattgaaagttgtagcttctggctacaacagagatagttgaagaatatggagttcgccataatttatcattaaatgtggataatttgagattaaagaatatgttgttgcaggcttagtcactttgatggatctgtctgtgagtttcacttggaggaagtgggagcagttggcttcagctgagagggcccttacagagacatgatgctagagaccttgagaaatctggtctcttgtatatgtaactcctctttgtactcagactccggcccacagatagcctttcctttccactgtggaaagttggggaggctccacaatgctcagtgatgtatttcaattttgagaattgaatatttttaatgattgctaagagatggattatttttgctcatagcaaaatctgtttgtgtttcatatctcacaattggaaggtctcagctaaattgtaaatggacagtttcttttgcctctttcggagtagtgtcaagagtgtggacctgggagacagactacctgcttatactttctgtccttgttcctacctgctggaaaggacattcatagccactctgcctcacttaaattggagatccatgtattcacatgtttttattatgctggctttgagagagaagatctcactgtcacccaggctggagggcagtggtgcgatcataactcactgcagcctcaaactcctgggctcaagtaatcttcccatctcagactcccaaagtgctgggattacaagcatgagccactgtactggctattctgctgtttggcaagtggagccttgctgatcctgagagactgcccatcccaggactagctaattttaagtggtagcaaaggactcccctgggtatgtgcctttgatatgcaaccaaacaattcagtgcccattcccttcccccaccccctttatcaaggcctcacacatggagccactatcttcctgccataaccactccagggtcagatattaagcaagtagggacagttcctaatgaaattcaggcctgtaatctcagcactttgggaagctgaagtgggaggatcacttgagtccaggagtttgagaccagcttgggcaacatagtgagaccccatctctacaaaaagatataataattagctaggcatggtggtgtatgcctgtactcccagctacttgggaggctgaggtgggagtattaaatgagcccaggaggttgaggctgcagtgagctatgatggtaccactgtactccagcctaggtgacaagagtgagagcctgtctcaaaataaaataaaattaaaaagccaagcctaaccctgcttagcttgcttaccttgtcttgaccattcttacctgcaaaagcacagtgaaggttcttgcccatgctttcccccagctcctgctgtttttccgatcctgctgcttccgcatgtggtcctacactgcctggtgtgtgcccctttcttgggaagtgtgtgtagctaagcatctcttcaatggcagtatctcctgatctgttggcctcaccatacctgaataataaaattggcctctcaaaatgccacctcaaaccattacatggaagttacatttccgtgtaatttctagagtactgggtacctacatcaggcaacatggtatagaaccatggattggaggatggattgatgccaaggagggactgtttaggtgaattactaggaaccagacatccaagggaccactgtgttggtgggatcccagtgatgtcagtagtcaagactttagaaaaatagttccagatgcctttctcattgttggacacttctgaaaaaggccaagcacaactaattgagggccccagatatacaaacattattctgtcatttctccaagctgtttgaagtttgaagtttgtctttctgtatattatttcccagtcctacctacatcatttgttcttttttttttttttttcttttttctttttttgagatggagttttgctcttgttgcccaggctggagtgcaatggcgcaatctcggctcaccgcaacctctgcctcccaggttcaagcaattctgtctcagcctcccgagtagctgagatcacaggcatgcaccaccatgcctggctaattttgtatttttaggagagatggggtttctccatatcgaggctggtctcaaactcctgacctcaagtgatctgcccacctcagcctcccaaagtgctgggattacaggcgtgagccaccgcgcccggcccatttgtttgcttgatattctcaggcatctgcattaactctcttttcttatgatctacggcattgcagttgtatagcctctcaacatacctgtttgcccttcccagtgccattccatgtccctgctcttgggtaaaatgacacgtgtttgaagtggtcccttctcactctgtctcttgttgatccctggaatcacacataagcagtggtcactttctttgcaatcttgagtttcctcctgacatttgccttcgatgtcatcatggccacctacaagcctgtttttcatctgcatgttcttttgtcacttacactttctaagttatctttgcataactgacttctgcttgagtgtcagtcaccaccagtctggtctttcctgtgtgtgtatgggtttctccaacttgattatttgtcctttcctccctctcctcctttaatagaggagcctcttagggatgttttccttttttgtgtaatattttcacttctccattacctctttcttgatttctctccacttcccaaacctctactctttgtggaactccttgctacaatgccaccttctccgacattgtgactaaggtcagaagtgacttggtgcttataaatcacaagtccttgtcattcttgggccatcagtagaattttattgtgtctaatactcaattcgtgaaatatgttctctttccttggctctgtaacatctttttcctcattcgttccctccctctctcccttctttgtgcagtcatccatatctagctgcccactcaatgttgaaatacctaaaggttttgtccaaggctcttttgccttgtatggcctctccccagcctcatctgtgcccttggcttcagttacctcccttactttaaaggcattgaaaatagaataccccagtcttgagcaatccttacagctctggacctgaattaccagttatcttcttgctatcttcacatagatgtttcaaagatacctcattcttcacctgatgtaaataagatcaataaaatgcttctccctgactctgatctacttcagtcttccctctttactacatggcactgtttagttacgttggctagaaatttccaactcagcatagttacctcaatctcttcctccttcatgtacaatcagaaagttgtgtttttttgtttgttttttttttaacacagaatctcgttctgtccccaggctggagcagtggtgcgaactcggctcactgcaacctccgcctcctgggttcaagcaattctcctgcctcagcctcctgagtagctgggattataggtgcatgccaccacacccagctaatttttgtatttttagtagagacggggtttcaccacgttggccagaatggtctcaatctcctgaccttgtgatctgcctgccttggcctcccaaagtgctgggattacaggtgtgagccactgccccggccccatcatttttaattcttaaatatctctcaagtatgtccacttctctctaccacctcttcctagtccatccactcaccatctatcatctcaattagtgtccttttacccacattttctcttcaatccattctctaagctgaaaccagagaaccatctcagatttaatagtgctctgcttcgccctccctctgcccccactacgtttcctgaaaactttttatggcttcaactcttgggataaaaaccaaatatggccaggtgtggtagttcacaactgtaatctcagcactttgggaggccaaggtaggaggattgcttgagcccaggtatttgagaccagcctgggcaacaaagtgagacctcatctctaaaaacaactcccaaatcattacacggtcaatcctttgggctttatctgagctttatctggtctgggaggtgcctcatttactacctttcatcttgcataacttatgccctttctgttttcactttgtgtttccttttcccacctgccatggggcttttccaccacacactttgtccagtagtgaatatttatccttcatcccagctacgtcataagcattctttcataaatatctgtgtgtgtgtgtgcatacacatgcatatatatttaggtttgattactgactcctgactgtctcaccaactagatttccagcttcaaaagagcacagatgttaatatggattttatcctaattgttccatgcacatagttcctagtcagtagtagatattcagatatctgctaaatggatacgtggatgaatggccttaatcatcttgatattttaggttacttacctcaggcttcatgatttgctagaagtacacacaagactcagaaaagctgttatggttatagtttattacaataaaaggatatagaccaggatcaccaaagggaaaaatcacatagaatgaagtccacatgaaagcaggcacaaaactctgggtgttatctcccattacggtcacatagggacacacttaattcccccagcaaagatgtgtgacaagatgttcacagtattataatacaagccagggaagttcactcaagcattcatttctggggtttttatggagggtcatttacataggaatgcagggtccacataactagtcatagccatacagcccttgcaaaaagcaaacatacagtgtggcccagggcctcgggcatgcaaaatccagcattcaccatgaggaatattgtcagaagcatttgaaccacagcaaatccgtcttgaataggggctgggcaaaatgaggctgagacctgtgctgcattcccaggaagttaggcattctaagtcacaggaggagacaggagtttggtgcaagacactgctcacaaaaaccctgctgataaaacagcttgtggtaaagaagctggccaaaaccaagacggccaaaacccaccaaaaccaagacggccaaaaccaagacggccaaaacccaccaaaaccaagacggccaaaaccaagacggccaaaacccaccaaaaccaagacggccaaaaccaagacggccaaaacccaccaaaaccaagacggccaaaaccaaggtcatcctcactgcccattatatcccaattatgcattagcatgcaaaaagtcactctcagcagcaccatgacagtttacaaatgccatggcaatgtcaggaagttaccctatatggtctaaaaaggagaggaaccctcagttctgagaactgctcacccctttcctgggaaactcgtgaataatccaaccctcctttagcatataatcaataaataactataagtagccttagtccagcagcccaaactactgctctgcctatggagtagccattttgtattccttttttttttttttttttttgagacggagtcttgctctgttgcccaggctggagtgtaatggcatgatcttggctcactgcaacctctgcttcccgggttcaagcgattctcctgcctcagcctctcgagtggctgggattacaggcatgtgccaccacgcccggctaatttttgtgtttttagtagagatggggttttgccatgatggcctggctggtctcaaactcctgacctcaggtgatccaccctcctcggcctcccaaagtgctaggattacaggcgtgagccaccgcgcctggcccctttactttcttaataaacttgctttcattatggactcaccccgaattcttttttgtggaagatccaagaaccctcttgaggtctggattgggaccccttttcagtaacaatgttcttagaataaattatctcatcaaatcgatacatgaaggcctatggactcaggcttaaaaattacttttaccaggcaaaatattccagaaactcagagattgtcttcctggagctgatcaagggccatttctttctttagaatgtatagcatctgagcaactgaagcctgatgagttcacactttcgtgtataaccaaagccctggccctagcctagaatctcttacagcaaaacaatcatatttactgagcatctacatttagtataacatttatataagatatatcagcagtatcatcatgaacatgctgagccactggagcagctcgtgtggggaatggatagatttagaaacaacaatccatcccataaagccattcatacttttccatatatttgtatcaattcaattactcattgttctccttgatctactgttaattgtactttgtggtaaaccacctcccctctcactacattggcttaagttatcctccaccttgcacatctggaaagagccagagctccctaacaggacttctccctcttgcccctcccatattccaatttccatagactacccagagtgatccttttaaaacataaatcagtccaggcacagtggctcacgcctgtaatcccagcactttgggaggctgaggcgggtggatcacgaggtcaggagatcgagaccatcctggctaacacggtgaaaccctgtctctactaaaaatacaaaaaattacccgggcatggtggcacatgcctctaatcccagctactccagaggctgaggtgggagaatcgcttgaactcaggaggagaaggttgcagtgagccgagatcacgccatcacactccagcctggcgacagggcaagactccgtctcaaaaaacaaacaaaaacataaatcagataacatcacagctctgctcaaaaccccatgatggctacccatttcacagtgtattagctatattttcttattttctgcattgttgatgctatggaatttgggaccttgccatttagagttaactgattcttagagattgcaaatgactcactctgaaccatgccttttatttgcatactaacaaatccagagtaccctaatgtgaatcatctcctctgtctggctcttacactacaggagacaattttttttttttttttttttttttgctctaatgactccagggccaggtactaggcagacagggacagctcctagaccccaaagtctaccaactttattcaaaccagcaaatcctcttctggttacccagccctgcctttcttttcctgtggaaaacaataaaggatctggcctctgctttctcctctgcttctgcttcttataccaccctggtgcttctcacatagccctgcaggatgtgttttgcctactgtttctaaaactccgtgagttgaaagttcttccttcctggcaatcatttgcatgtccgagtttcttatcagaccatactgcaaaaaaccccaggtacatttttgaacacacaggaacatattacaacctctctacgctggcataaaagactacacaatttgtttccatctatctctccaacttccatgcacattcagttccagccgcactaggcttcttggtgttccacaaacacccaggatgctctgtcagttccattgtcctgtgtgttttctctgagtgataacactgtttcctgagatctccacttgatgagtctttaattcctccaagtccatgctaaaacatcactttttttttttcttttgagacgaagtcttgctctgtcgcccaggctggagagcagtggcgtgatctcggctcactgcaacctctgcctcccgggttcaaatgattctcctgcctcagcctccctagtagctgggactacaggggcccaccaccacggccagctaattttttgtatttttagtagagacggggtttcaccatgttagccaggatggtctcgatctcccgacctcatgatctgcctgcctcagcctcccaaagtgctgggattacaggcatgagccaccacgcccggcctaactgtcctattagacctgtcccaaccactctgtattgcacaactggctttatcccactctcactgattcttaatctgctctagtttgtcttatctccgcaacactcctaaccttctatattgtttaggagttttggattattattattttgtgtgtgtgtgtgtgtgtgtgtgtgtgtggtatgtatgtgtctccattgtgactttttgtttttttgtttagaaacagggtttcgctagatagcccaggctggtctcaaactcctggtctcaagcgatcctcctgtttcagtgtcctgagtagctaggactacaggaacaaacccaccaggcccagctctgtatctccactgtttagagcagagcctatcacaagatagtcaagtacttgttgagttaattaattaaaagttagtaaatatataaaaatatattttcaaatggttatgaatgtcctaaagaaaaatagagcagagtaatattggggtgagggactactttaaaatttttattattgttattattttttaaacaaacaggttctctcactctgttgcccgggctggaatgcagtggcacaatcatggctcactgcagcctaaaccgccgtggctcaagtgatcctcctccctcagcctcccgagtagccaggactataggtacccaccaccacgcctggctaatttttaaatttttcacagagacggggtctcactatgttgcccaggctggtcttgaactcctgggctcaagtgttcctcctacctcggcttctccaagtgttgggattacaggaccccacacctggccggaggagctactttagattaagagatccgcacttgagcccaggagttttgagaggagctgggcaacacagtgagaccccatctctacaaaaaataaaaaaaaaattagttgggtgtgttggtgtgggcttgtgatcccagttactcaggaggctgaggtgagaggatcacatgagcctgggaggtggaggctgcagtgagctatgaccctgctacagtactgcagcctgggttacagaggaagaccccatctcaaaagaaaaaaaaaagagtaagagatctggagaggcctctatgagaagggaatggttgatacaagctgagactcattacctggaccacatgtctacaatccaggtggcactggctcaacactgtatcttttacatcatcttgcaaagtgccttccctcagcttctctaagaagtatttgtagagtgaatgttgagtggattttataataatgctgtgaaatccccatggtctcctggcaccactgtaggactgttactgtaggactgcggggtcacccctggctgttaaggccatttccctttctcttctctcagcaaccagcctatggcttcaggggaaacttccagttcaagactgaaagtcatggttttggccctgagatgtatttctgctcctgactccatgagaacaagacagattctacagggaatgaaaggagaagctacaaggaatgaaaggagaaggaatgaaaggaatgaagggagaaggaatgaaaggagaagctgactggagcaaacactagttatgaaaggattccctatgaagtgagacttgagatgaagaggaagcagcagattccagatgaattttagggttggaacccatatattaccttcataaccagagagcctggtattcttgattcttccactatagaccactgatgtggtttgagaagagagtacagaatgacaccactttcaacaatacccagaggcataaattgctccaaagctttttatcaggcttgaccgaacacggtggctcacacctgtagtcccagcactttgggaggccaaggcgggtggatcacatgaggtcaggagttcgagaccagcctggccaacatggtgaaaccctgtctctactaaaaactacaaaaatgtaatcccagctacttgggatgaggcaggagaatagcttgaacctaggaggcagaggttgcagtgagccgagatcacgccattgcactccagcctgggtgacagagcaaaactccgtctcaaaaaaaaaaaaaaaaaaaatcaggctgtttgggttcccaaactgtttgatatttgttctacctcaggttggcgtacctccacatgtttctttccaggctctctgcttgtcccctcaggcagtatctctggatctgggttctaaagctgggagtgggaacaatggcccacttctgacatcctgctttgagggttgagtgctcagtggtagcgggtggccagtggtctcatgtcttttcagctgccctgtcatggtacactactacagactttcagtggggcaagtgtgatgaatccccagtgctcagcatcatgatgcccaaggaagggccttcatctcaccaacactggatgggtggaggaagggagctcctgcctctggggctgcactcactagggatttagcctcagcaagtttctggtggcaagataagaaatgctgacatcctaccctgctgggaagacagccctctgtatggaagctgagagggagagccctgtgttcttgtctgcaacactgtagagtacagtttccatatcattgaactgggagggctgaaggaaagagatagtcttggttcaaataccacagactctcgcagttcttacagaaggacagattctcttgaataaatattttttcatttgatgtatatccttaggactatctccagagacacgactttttttgttttcatttttgtttttaataattttcaacagttttgttggggaataggcccacagagctccttatgctgtcacgccagaagtctctccttgctttttttgttttaaactttttattttctgacaattttagctgtaaagaagcaaagatattacagagttcctatataacttcatgcagctccacctcatgttaatacttcataagcctatgacatatttgtcaaagctaagaaattaacatggtatactactactactactaactgaactacacactgtatttggatttcaccagtttttttccactaatgtcctccagttgcaggatccagtccaggacaccacatttcagttaatcatctcatcgctttagttttctcccatctgtgacagctgctctgtcttttcttgtttttcatgatctacatacttctggagtactcataatgcaatgtcccttaatttgcatttgtctggtattttttcattattagtctagaattgtgggttaaggggaagaacatcagattggcaaagtgtcctccttgtatcatcatagtaggtgttacgtgatgtcaagatgactaaaatggaccaggcacggtggcttacgccctgtaatcccaggactttgggaggccgaggcgggtggatcacaaggtcaagagatccagaccatcctggccaacatggtgaaaccccgtctctactaaaaatacaaaaattagccgggcgtggtggcgtgcaactgtagtcccagctgctcaagaggctcaggcaggagaatggcttgaacctgggaggcggaggttgcagtgagctgagattgcgccactgcactccagcctgggagacagagcaagactccatctcaaaaaaaaaaaaaaaaaagatgacttaagtgatgctaaccttgatcacttggttaggtacttgtctgccaggtttcccctgtcaagttactgttttcattttccacaattagtcactaaatccagccaactcaaggggaagaccacaaagctccactgtctgaagggggctgttggtatctatgtatactatttgcaattcttctttaagattggtttcttctccttgtttatttatgggtgagccttattaattactggttttaatttctgaaaaatcaagtaagtgctcaccttagcaatacatatattaaaaatcaaatgtaagtgcttctatgtgtgttttgtgaatcccgtcttatacaaataaggtaagggagatactaagatttggaaatagttcgtctccaccaaaactcatgttgaaatttgatttccaagctgggcatggtggtgtgcacctgtagtcccagctacctgggaggctgaggccgaaggatcacttgagcctaggagttcacagacagcctgggaaacatagtgagaccccatatgatatggtttggctgtgtccccacccaaatctcatcttgaattgtaactctcacaactctcatttgtcatgggagggatcggtggggggtgactgaattatggggcagggtctttcctgcgctgttatgatagtgaaggagtctcaccagatctgatagttttaaaaacaggagtttctggctgggtgcggtggctcacacctataatcccagcactttgggaggctgaggtgggcggatcacaaggtcaggagatcaagaccatcctggttaacatgatgaaaccccgtttctactaaaaatacaaaacattagtggggcgtggtggctcacgcctgtagtcccagctactcaggaggctgaggcaggagaatcacttgaacccgggaggcagagtgagccgagatcgcgccactgcactccagcctgagcaacagagtgagactccatcaaaaaaaaaaaaaaaaaaaaaggaaacattcagtaagcttgttctgtattcctacacaaagagtataacagcaatatattccacaagagtaaagcaaaataagtaaagttattctaagtaaactaaattagaaggcttttcatgaactgagcaactgttggaactaagctggcatggggttgttagctgattataatgtgcccagaattggaatattgatccagatttttacattacccatccctcttattttttctgagcagcagtcagagatgttggttcacaggaataagcagggtagcttaaattgcagaaacaaacttaaaaagaactaatgagactagaatttaataacaagtataccatagttcttgaaatataatatttctctctccagtttcccatttttactaaagacaaattagggtaagactgatttgatttgctttattatacttggcctgattatttatataaagtgcagcaagaataattattttccacataggcatttttttttttttttttttgagatggagtctcgctctgttgcccaggctggagtgcagtggcgcgttctcagctcactgcaagctccgtctcccgggttcacgccattctcctgcctcagcctcccgagtagctggggctataggcacccgccaccacgcccagctaatttttttgtatttttagtagagacggggtttcaccatgttggccaggctggtctcgaattcctgacctcaggtgatctgccctccttggccttccagagtgttgggattacaggcgtgagccaccacacctggcctatccacttttaattaagctaacttttaaccatagtgctctttaaaaaagaaatcctttcaaatctcttattacccaactttagccatgccaagaagccaatatttctaacttctgaactttaccaaaggttatctcctacgtgcatagagaaaggaaaatttaagacagtctgcggaggagaagagactagacaaggtcacgcagatattaaaccagaaatgacttacttcctaggtggggtatcaaacccaaactgccactgtgaaagtgcagaaaccttagttactgagctacagtgtgggacggtgcctacttcctttcacagaagcctagagtagttaattttgagcttgcaaaggcttttaactattttatatgatttttagagctgactatgacatgaaccctaaaattccttttccctagtaggtggagaccaagagaaggtactgccacatggttaaaaggtcaggctcccaaggacataaaacaaggggagacttcatcctgtttgtttgtttcagggacctgcagctgtttgttactgaccagtttgctgggtcatgttgaaaagtgggctcacaggtgttctaagcccatgtttcatcctacagaaaaacaaattcacagcacaaaatacaccagtttgactagcttagaattctttttcatattaatcaaaactttacagaggagatacacactgatttattatttttattattgttattatttttaccattcattcaaccgtttgcacagagagggagaagtcagaaatctgactggtaacaaattcttacctttttgctggcatgccaggcttctgtgttccctttctctgagtggtcccagtgatctggcttgtggcaccatcgccctgggggccaagcctcattgtaaaggaaaactactttttttcattctgaccagagcaaaacacatgtgatgaaacatacacattagccactctgcttagcacccaatattaaactggcaaggcttaaatttgcccccagataggccctgtcatctttaatccaacctctgacttggagtttcaacatgtggtctctgggcaagatggtcgccctgagtaatagagtaatagaaaagataagaaaggggccgggcgcagtggctcacgcctgtaatcccagcacttcaggaggccgaggcgggcagatcacaaggtcaggagatcgagaccatcctggctaagatggtgaaaccccgtctctactaaaaatacaaaaaattagccgggcatggttgcaagcgcctgtagtcccagctactcgggaggctgaggcaggagaatggcctgaacccgggaggtggagcttgcagtgagcagagatagcgccactgcactccagcctgggcgacagagcgagactccgtctcaaaaaaaaaaaaaaaattatatatggaaatgctttcgcaggcaatactttcccaggaaatattttccacaagcaatactttcccagggaaggcaaaatgatcagggaggccagagaaagacccacccattgcagtgacactgaaaagttcaggcggctacggctgctgtcgtgaagggatttttttccagcagtcccgtcagctctcaagtttccccttttgggggaggaaaaagctccccatgtcccacgatcctgtacacgcctaaccctgtcgcccggagccatcagcaaagagtgcaaggcagattaatccaaagacaatagcagttaacatcccacggtgccaaacctcttcttagccaagagggactttactgagaggggtctctaaccccctaaatcttagaagggactctaatcctcctaagttgggcctctaacccaaggtcagtcaagcgtccttgccttttattaagaggggcctctaatccactctgccttaggagagactctaactcccctaacttgagcgtctatcccaatcccattctttacctgggtaccccaccacttacccaaagtcatccaatcagtgctgcagtctatttcctttgagtcaggggggtctcctcagcattgtcccttttgtggtttgcgagaaaagtgttacccgaccccaccacttacccaaagttagcctttgggtcacgggttcctgcagtatagtctcttctgtagtggccaggaatgtgttacaggaaaggggtcccaatccatatcccaagagagggttcttggatctcgcacaagaaataattcagggcgagtccacagtgcaagtgaaagcaagtttattaagaaagtaaaggaataaagaatggctactccatagacagagcagccccaagggttgctgggtgcccatgtttatggttatttcttagtgacttgctaaacaaggggtggattgttcatgcctccccttttcagaccacatagggtaactccctgacattgccatggcatttgtaaactgtcgtggcactgatgggagtgtagcagtgaggaagaccagaggtcactcttgtcaccattttggttttggtggttttggccagctcctttactgcaacctgttttatcagcaaggtctttatgatccgtattttgtgctgacctcctatctcatcctgtgactcagaatgccttaactgtctgggaatgcagcctagtaggttttagcttcattttacccagctcctatttaagatagagttgctctggttcatatgcctctgaaaaaaccatttaaatttaattataagagtctggccagagggggtggctcacgtctgtaatcctagcactttgggaggccgaggtgggtggatcacctgaggtcgggagtttgagaccagcctgaacaacatggaagaaccctgtctctactaaaaatataaaattagccaggcgtggtggcgcacacctgtaatcccagctactcaggaggctgaggcaggagaatcgcttgaacccgggaggcggaggttgcagtgagtggagactgtgccactgctctccagcctgggcaacaagagtgaaactccatctcaaaaaaaaaaaaaaaaaaaaaaaatttaagagtcacaaatatgtgaaaaagagaatgatgtctttatcaattttcaaaaattactattgccagtgatgaataacagtgttccttgcacactaatttagccaaaaatatttctccaaaagtaccgcatcgtgtaggaaattgactccatctccattccttgactattttcaatctcaaaattaaatctcttggagagtactttctgcacacctttctatttccttaaccatatatatcgtcaaaccattgaaagctggactttattctctcactttcatagtcatgaaaagaaaaaaaaaaagttactgatggggactcctaagacttcgcataatataatctttgcatagtctaggattgttaaaattcctaacaagactttataaactctcctgtctgcaaccagttaatgctgggttgggccagggttcccctctttcccgtcacttatccatctacgctcattcttttcatagcctcacccaatatcatgacttgaagtaacagtttacagtaataactcccaaatttatatatccacgctcgaaccctctgccaatgttgaatcataggttgagtatatggcactacgctttgtggtcttactgacgtttcaaactgatcatgcttgaaatgggagtactgggcttcccggcaagcctgctccactagcagcctccccacctcagggtacgggaagtccacacgtggcgaacgcgaagcctattacatcacccggaagtccctgcatcctacgaaggctgggcccggccaaaggaggcccaatagagggcggtctgtcctttcccagcaggctgggcacactgtcaggcgtcctcctttgggtggctattttaactgctcatttatccttttcttctatgaaaagatccagaaaagaggcaaagcaagcgagaagtcgcgggcccagcccacagcagggtaagcacctttgttcggggtctgaatcggggcgaatatccccgcctcctgacctcgattttcctgagctagaagggacctttcgaccctccgacttgtgcctatactaaggcggtggccctaagacgacgcgggggttctggtgcgcacttacgtgcagtcggatgcgctgggtgagttcccacacccggtagatgtaagggaaaaactgcattacccagaaggcactgccccttgcgtcggccgcggactctgggccattgacgacccaggacaggagagttttctgcgggccagggcggcggaggcgggacttccgcttcttcgtgtgacgtcatctccgtgggccggtttggccctgaaacagtgtggggcctagagcgctgggtgggcgcgttctgcggcctgagcagggacgggtagtgaagcggttacgccccttcttcgcgtcttggcgggagcctgacgccccgcttctcccctaacgaggtgtcccaccggcgcccgccgaggcctaggcctccgcagccgccctccgtctcctcagccccgacgctgcgccttgggccttgtgcgcatttttttcgggggaaaactgaggctcggagtgcgaaagtcagccgaggtcgccccgcccaggacagagaagggctgtggtcggctgatccgcggcattcccgggatggcggcggcgtggatggctccggcgcaggtgagtggacgaggtttcggccttgctgctgctgtgctatttctagaggcctcgtgggcaggctggaagccaagacagccacaggatttttctttgtcgccatcgtttatttaagagaaatggccgtggcttgtcatttcctttatccgcagtcctgcaacagtgttggcctctgataggtgttcagtccgtggttgaaggagtgatgcttccttctagggatctcatcacacttcccctaaatccaaccttctctgttgcctgccagcccgtaccccatccacctggccaaccacccctgaccttgtctgtttgcatttttccctggtcctttgctcttcagagccaccaacctgaccgtgcagtcctcttccattttccaggctttctccttgcacttccttttacttcgaacactgcccctgtaactttgcagggcctccctttcacatccttttggcatctgtccaggtgtcacctatttggaggtgccttttttggcaattccggctaaagtggcaccttacacccttgcccagagtctggtatttttgtgtagataatctgatggtattaaagaagcttgtggatttgagtttgtcaaggatgtaatgggaacaaagaaaaataattgcaaagaatgatattaactgtcattgagtccttgctgtgggctgatcggtgagtattatttaaccctcagttcgtttaaccctgaaatttttttttttttttttttttttttttgagacggagtcttgttctgtcgcccaggctggagtgcagtggcgtgacctcggctcactgcaacctccgccttttgggttcaagcgattctcctgcctcagcctcctgagtagctgggactacaggtgtgcgccaccacgcctggctaatttttgtatttttagtagagacggggttttaccgtgttggccacgctggtcttgaactcctgacctcaggtgatccacccatctgggtctcccaaagtgctgggattactctttagaattaggttctgttgtcatcattgttttacacaagagcaatttgagggtcacatacgtccaattacctgccttacatcactgtagctcttaagtttcttaagtcagaaactaacaactggtgtgtctaacatcatagcctgtgtttttaccctcttctttacccgcagtggttagggaggcctgggggtgagacctaaagtaacctttgcaagatgaggcctccttctagccagtgatcttgggcatgaggagtcatggcctttcatactggtggaactgtgtagacttaaaaaatggtatattggttgtttaaggagttctcaggggacctgtgtggcttccacggtggttttatatgtggttccccttactcccttacctgctgacatattctgagagggcacgtttgtatggttatgttgctgaatgtaccctcctactcagccaggatagatgtaatctccagatgggcccatattgtcttggctacaacctgctgtgccctctatgactcttgttgcttgctcatggaatcttctggcctcagggatgcctgctagtaggacttaggtagaaaaggaagcgatggctcattgtgaattctccctggaagcaggtccaggccctaacacctgatcaggtgtcaccacgtcaggtgattctttggtgaggtggatgatgatgactacacttctctgcccttgtccatgggagtggctgaaatgtatatgtggatttgaaatgcttcattctcattaactgcattaactttgctaatagagaaatgtcaggttacataatcagaccagagggccctgggcttaaatcctgcctctgttgataagacctgtgactttgggctgggcttggtggctcacacctgtaaaccctgcactttgggaggctgaggtaggtggactgcttgagcccaggagttcaagaccagcctgggcaacatgggaaaaccctgtctctacaaaaagtacaaaaaattagaccggcatggcatcatgtgcctgtagtcccagctgtgcaggaggctgaggtgggaggatcactagatcacaggaggtcagggttgcagtgagccgacattgtgccactgcattccagcctgggtgacagagtgagaccatctaaaaaaaaaaaaaagagagagacatgaacacatgagactttgggtagactggtagagcggagggtaggactgaggcccaggtctcaggtccctgagtgtgacatagagatgatgatggtaaattcagatgctgtggcctttgcctcagtgtttgtttgtttttttttttttttacaaacagtttttctttctttctttgttttgatggagtctagctctgttgccaggctggagttcagtggtgcgatctcggctcactgcaaccatcgcctccgacgttcaagcgattctcctgcttcagcctcccgagtagctaggactacaggcacacactaccacacccagctaatttttgtatttttagtagagatggggtttcaccttgctagccaggatggtctcaatttcctgacctcatgatctgctcacctcagcctccgaaactgctgggattacaggcatgagtcaccgtgcccagcctacaaacagtttttctttagttcttttgactattcttttttttttttttttttttttttgagacagaggctcgctctgttctggagtacagtgacacagtcttggcttactgcaacctctgcctcccaggttcaagcgattctcctgcctcagcctccctagtagctgggattgcaggcttgtgccaccacacctggctaatttttgtatttttagtagagatggggtctcaccatgttggccaggcttgtctcgaattcctgacctcaggtaattcatgtgcctcagcctcccagagtgctgggattacaggcatgaaccaccgtgcccagccttgactattcttgatgaagtgggaaacacggttatattgacctggaaatggaggctcggcgaaatgaaatgaggtccccaaggtcacatagcaggcacacgttgatttcaggaatttggttttaaacctcaggagtctggctcctgagctggggagtttcagtcactttaccatggcatgtaaacctgtcagcatgaggcaggcacacagggaggattggtaagactcagatactgttcctgttattgttgctggtggtgatgtttttattattattatttcccattcctctaatatgtcagagcacttactgtctgtgcctctcagtccacttgggattgtcctaaccttatttctgtgttaagttcaagtggcttcctgcctaggaggctttatttatttatttatttatttattttttatttatttatttatttttttttgagacagagtcttgctctgttgccaggctggagtgcagtggcacgatctcagctcactgcaatctccgcctcccaggttcaagcagttctcctgcctcagccgcttctgtctcctcttcactgctgtaatccatgcaaggcagtgtccacattccccttgatcctagcacagatcttggccctttggaggtgcttggtgatttggcctttgattctctgtgcatcttttgcagtgctggagtgacaggttctaatcctattccacagttgcaaaggaaacattactggttctttttgacttttcaggagtctgtgaccttcgaggatgtggctgtgacatttacccaggaggagtgggggcagttggacgtgacccagagggccttgtacgtggaggtgatgctggagacctgtgggcttctggtcgcactgggtaaggcctgtcctctcctctccaaaatcaggggcaccagaaagcagcttcattctagccttcatcctggctccaggcctggctagtggaataggtcttgggagccagccctcctgtttcccaaagctttactctatttttttttttttttttttggagacagagtttcgctcttgttgcccaggctggagtgaaatggcgtgaccttggctcaccacaacctccgtctccccgattcaagtgattctcctgcctcagcctccagagtagctgggattacaggcatgtgctcccatgcccagctaattttgtatttttagtagagaaggggtttctccatgttggtcaggctgttctcaaactcccgacctcaagtgatccacccacctcagcctctcaaagtgctgggattacaggcatgagctaccacgcccagcctcatttttttgactcaccttattcttcctgatctctttgtgtcttacttagaaagggttggctacgaaatatagtttgcttttggtcacagccaaaggagagggatgtgttaccaggaaatgggatgttttgtagaacccaaaggcaggatttgcagccaggcccccctgtggcactaatactggttgtctggtgctggcttccctttatgggtctgctcctgtcactgtctttttataatggctttttctggctcagctattgtgtggaacgaagtgaccgtctagtcttgttctctgaggctcacacattccttggcactactacttcctgcatatttttgttgtctctctgttgatactcttctcacttaattctcccagcatccccatcgtcagtgagtaaggataatagggccattgcaatgaacacctcagaaacttaattaattcagtttaagagataaaccttcattgtgagatgctgttcgttgcattttttttcttggtaaaggttctttcttttgtgatgtgttgattttgatgtttgtgcaaacgtctatatgtggccaaatcgctatttggagttccctcccagttttttatttttcagtggttcatgaaatgtcgaagcgtggagtcaccacgtctacccctcactctgctgccctgttcccttaggattgagttcttccactcatgtctcccattctttatggcctccttgttttgagactcctggcaccacacgggggtgttcttcatttcctctgagcacagcacttgggagaccaaggtctgatgcctcagagtccaattccagctctactttttgtcagctgtgtgttcctgggcaaagtactgaactcctctgtgccttaattttctttttagaattttttatttctttatacccatgccagtgcagaaaagtgcctcaattttctcatgggtaaaatgggacaatatgtgccaaaaaaggcatacgtttgtttcattgtactttgctttactgcaccttgcagttactgtatttttagaagttgaatgtttgtggcaaccctgaattgagcaagtctgtcccgcaccatttttccaacagcatgtgctcactttttgtctgtgtcacgttttggtaattcttgcagtatttcaaatatttttattaatattatatctactgtggtggtctgcgatcagtggtgtttgatgttactattgtaattgctatggggcaccatgaactgcaccatgtaagacagctttatcaataaatgttatgtgtgttctgactgctccacttactggccattccctctctgtctctctccttgggcttccatattctctgagatacaacaataatgcagtcaagtcaattaataacactaaaatggaagccagatgcctctaatcccagctactccggaggctgagatgggaggattgcttcaggccaggagttcgagactaggcttggcatcataataagactccatctttttttactttttgaataagctataactcatatgctgtgttgtgcaaaaatcctaagaagtccaggccaggagtggtggctcacacctgtaatcccagcactttgggaggctgaggcgggtggatctcctgaggtcaggagtttgagaccagcctggccaacatggcgaaaccccgtctctactaaaaatacaaaacaattagccaggcgtggcggtacacacctgtaatcccagctactcgggaggctgaggcaggcgaatcgcttgaactcaggaggcagaggttgcagtgagccgagatcgtgccactgcactccagtctgggcgaagaaggagactctgtctcaaaaaaaaaaaaaaaaaaaagtccactcactgaatttttgcttatgtataaacccaagtaactaccacctacatcaatacataggctatctccagctcctcatcagggttttatgccctcgatagcttctttgattctattagctcatatttagacttcatcagcacagattggttggctgttgttgaactgcacagtgtgctctctgacatatctgtcttcttttgatcatcatgtctgtgttattcttttgaggtgtttatatacagtcggagttggttcattctcaatatgttgtagtttctcattgtatgtgaaactgccatccatttgtccattaccctgctgatggatgttcctgttgttttcaggttttggatatgttgctgagagtattattgttcatattttctggtggatgtaaatactgatttctgaattgtgtgttaacagtaaattctgttagaatatactcgtgtgtacatatcaggtcatggagtaggttgtatattcagctttctttttttctttattattttttgtagaaatggagtctcactatgttgcccaggctcatcttgaactcctggcctgcactgatcttccctccttggcctcctaaagtgctgggattataggcatgagccacactgtgtgggtgtgttcagctttaaaagaaactgcccagcagttctgcagaatgtaccatttcactttctgaccatggacatgtgaaagtttccattgctccacatcttcataatcacttgataacatcattcccctttgggaggtctaggcgggcggatcacttgaggtcaggagttatcagcctggccatcatggtgaaaccccatttctactaaaaatttaaaaattagctaggtgtggtggcaggtgcctatcatctgagctactcaggaggctgaggtaggagaattgcttgaacctgggaggtggaggttgcagtgagccaagatcacaccactgtactccagactggacgacagagcgagaccccatctcaaaaaaacaaacaaacaaaaaaaaccatcatttcattttactgtttgagtccctgtggtaggtttctctatatcacagcacagaaaccattgtaaggtcactcctttcattcctaattttcaaatacaacagtgaccataatgataactgatgatggcccacaatttaccgatctcttatgtagtgtctagcactgtgccaagtgctttatagaaattttccccttttttaagagacagggtcttcctctgtcgcccaggctggagcgcagtggcaccatcatagctcactgtagcctcaaactcctgggctcaagcagttctcctacagagtagctggaactacaggctcatgctacaacgtccggctaatttattaatttttttgtagagatgggatattgctatattgcccaggctactcttgaactctgggcctcaagcaattcttctgccttagtctcccaaatgtaacgggattacaggcatgagccaccgtgcccagccaagaattttcctatttaaccctcatcacagcctatgaaacagaatctgagagtttctgtttttcagatgaggaagtggagactaggatcaactaaatcatttctctggcatcagctgacttggtacaggcaagatttgaactgagatgttctgactccagagctacactcttaacctcccttcaatatgaactcacgattcagcacagagttttcatattttgtgcttgagcattgggccgtcttagattctctttctctgttctcactgggctttggttctctttttactctgatcttcacttttatgttggcttcatcagttatctcatagcccatcctttttactcttacatactctccaaggctaatccacacattctttttatttattattattactttttttttttttttaagagatggatctggctatgttgcccaggctggtctcgaactcctgggctcagcttcccgagtagccaggattacaggcagtacctttcagattgtgtctttttctagtattttcaggttattgtttctcagggttgtattgaatttctggatcagtttttagagaattgataattttatattatcaatttcttcattcagttagatctttattgtcttgaaataaagttttattattttctttttcaagatccagttgtttgttagccttttcgcctacctttcaccttgacagtggattctatatgtctaccaggattctgttcaccctctgtcctaggagctctgtcctaagagtagctgtggccatcactagctgtccctcaggcagaatcttgagcatcagcttcgtctccgccccttcctgtctctgaatcctgatcaaccttaacttcttatggggctgcctcctctcactgcagtcctctggattcgctgaagactctgtgtctttgtatattctatgtcctaaggctaatatgtccttctaactttaagctcatgaagcatcctctctgggaagcctccttgacctcttcctgtccctgccccttctaggctacattaagtgccccttccctggcctcttgtagctccttgacatgttcttgagcaagcttatgatagagtgtcatcattatgatgtccacctagtctcatcttgactgtgagtggggatctctattccagaccatctgtactctgcttgagcttctccctctgggtttctctttaaaaatttcaagagttggccaggcacggtgggtcacgcctgtaatcccagcactttggaggcagaggtgggcggattacttgagcccaggagttcgagaccagcttgggcaacatggtgaaaccccatctctattttaaaaatacaaaaaatttagccaggcggggtggctcacacctgtaattctagcattttggaaggccgaggcaggcagatcacctgagttcaggggttctagaccagtctggccaacatggtgagacctcatctgtaaaaatacaaaaaaattagcccagcatggtggcgcacacctgtaatcccagccacttgggaggctgattcaggagaattgcttgaacccaggaggcagaagttgcagtgagctgagatcatgccactgcactccagcctaggcaacagagtgaaattccatctaaaaaaaaataaacaaaaaaaagccaagcgtggtagcatatgcctgtagtccagctaccttggaagctgaggtgggcagatcccgggtgatccgcctcagcctcccaaaccaaagtgctgggattacaggcatgagccaccatgcctggcctttttttgagatgggtttccctctgtcacctaggctggagtgcggtggctcagtcttgactcactgcagcctccacctcccaggttcaagcgattctcctgtctcagcctccccagtcgctgggattatagccgcccgccaccatgcctggctaatttttgtatttttagtagatatggggtttcaccatgttggccaggctggtctcaaactcctgacctcaagtgatccgcctgccttggcctcccaaagtgctgggattacagggatgagccactgtacccagcccatcaaatcatagctattttcaaatcatcactattttcatcttattgttctcaccaaaaaggtggtttcatttcttctgtactatcttaataagttcttttgtgtattgtgttcccttcaggtgacagcacaaaacctgagaccgtagagcctatcccttctcatctggccttgcctgaggaagtctcactccaggaacagctggcacagggagtcccaagatactcctatttggggcaggccatggatcaagatgggccatctgaaatgcaggaatactttttgagaccagggacagacccacagagtgagaaactccatgggaaaatgagccttgaacacgaaggtttggcgacagctgatggtatttgttcaatgatgatacagaaccaagtctcaccagaagatgctctctatggatttgactcatatggaccagttacagattccttgattcatgaaggggaaaattcctataaattcgaggaaatgtttaatgagaattgcttccttgttcagcatgagcagattctccctcgtgtgaagccctatgattgcccagaatgtgggaaagccttcggcaagagcaaacacctccttcagcatcacatcatccatactggggagaagccctataaatgcctggagtgtgggaaagacttcaaccgcaggtcacacctcacacggcaccagcggactcacaatggagataagccctttgtgtgcagtgaatgtggaaggaccttcaatcgcgggtcgcaccttacacggcaccagcgggttcacagtggagagaagccttttgtgtgcaatgaatgtggaaaggcctttacctaccgctccaattttgtcttgcataacaagagccacaatgagaagaaacccttcgcatgcagcgaatgtggaaaaggcttttatgagagtacagccctcattcaacacttcattatccatactggggagaggccctttaagtgccttgagtgtgggaaggccttcaactgcaggtcacacctcaagcagcatgagcggattcacactggtgagaagccctttgtgtgcagtcaatgtggaaaggccttcactcactattccacctatgtcctgcatgaaagagcccacactggagaaaagccttttgagtgcaaagaatgtgggaaagcctttagcattcgaaaagacctcattcgacacttcaacatccacactggagagaagccctatgagtgtttacagtgtggaaaggcttttacccgcatgtcagggctcacaaggcaccagtggattcatactggagagaagccgtatgtatgcatccaatgtgggaaagccttttgtcggaccacaaacctgattcgacactttagcatccacactggagagaagccctatgaatgcgtggagtgcgggaaggccttcaaccgcaggtcacccctcacaaggcaccagcggattcacactgcagagaagtcccacgaacccatccagagtgggaacgtttcttgtgagagcacagatctcattcaacactccatcatccacactgagagtagcccagtgagtgcagtgaatatggaaacgccttcaattgccgctcattcctcctcactcgacatcaacggattcatagtggaagaaaccctaccattgtaacagatgtggaaagactttttacgtacacttcagtcaacatccaagaattcctattagcgaaatagttttttaatataaccactgaagaaaatctgtggtgagaggaaacatcttaccatctggtcattcatactgaagagaaactccataagtatcatctctgtgggaaaacctgttttagatcatcatttgtcatctaaacaattatgttagaaattgacacagccaagagtcttattctacatctgataattcacccatgaaagagacccagtggttactgtgcacttaggaaaaccttcagccacatctttcttattagtttacagtgaaatgttatctcagggacattcaaacaaaggaggaggagtcatagggaagagaaagaaatggaagcacagcttctttcagacttccctgacaagcccatggcaatttgtcatcccctccttattttatttgggagagggaaatgtttcagaaacaaaagggcctcatcccctttattttccctgtgtatacattcactgctgtccagtgctgtagacaaacggtttgtttgaaaacattttgtgaaagcctgctttgttccacagcattgtctccactcttgaggagcagaagcatatatctttatgagaaagatggaggcttgagttatgaaatacttttacatttaaggagataaaggatgtacatatgaatgggcacattttactgcacacttcagacgctttgacttttttaaaaaaattgtttctccgtgtgtctttaaccacccagtaccatacttttttcttgatctggatctacttgtcaatttcttctttatttttctgtaggatggagatgatattgtagctgtttgtacataatgtaatccagggagtcctaattcttccctctgattgtggtttctcagcttttttactgctctttagagagagtaaatagttcaaaattcacctcaacaattttctagaggtcaatttggaaccaaaaatgaaataagacatgtagctaaagtaagttaaaagattatgataaactcagaaaataaacacagagaaggaatctcatttttcagtcttacagaagattgtgtgaaggctgactatacataaagtgactggaattttaacaggtgaacctgcatatgtatatgcaggtagttgtcaccatggattgagtccagtcgtagtaattaatatgtttaatcagaatattttggaatttctcttttggtattctttttgtttcttttattgtttttaattgacaatgtttatggggtttggtgtgatatttcaatacatgtgtgctaagagtaatgatcaaatcagggtaattagcatatccatctcaatcatttatcatttctttgtgtttagaaacattcacagtctgcttttctagctatttgaaaatataaaatgtattattgccaattgtactcattctgcagtgccacagaacactacaacttattcaaatggaatcttacttgctgtaattttgtatttgttaaccaatctctatctgcctctctgctgtccttcccagcctctggttaccaccattctcaaccttttatgcttgcatatgagtagaaacatggagtatttctctttctgtgtctagcttatttcacttaatgtctttcaagctcattcatgttgctgtgaatgacaggtttatttttcatggctgagtagtattccattgtgtatatatgccatgttttctttcttcattcatctgataatggacacttagactgatttcttagctattatgaatagtgcttcaataaacataggagtgtagatctctctttgacgtatagatatatttgtttttgcatatatgcccagtagtggtatagatcattaccagtggatcatatggtagttgtatttttaacttttgtttatttttcattttttaaaatggggtcttgctgtgttattcaggctggtctcagactcctgggctcaagcagtcctgcacctcagcctcctgagtagctgggactacaggcacacaccaccgtgcctggctatagttttagatttttgaggaacattcatactgttttccatatggctatactaattagcattcctaccagccatatataagagttcccccttttccatgttctcagcagcattttttattttttatctttggtaatagccatcctaactgaggtgaaattatatctcattgtggttttgatttgcatttccctgattagtgatgttgagcattttttcatatacttggccatttgtatgtctccttttgagggatgtctattcaccttatttacccattttaaaatcagattttttatttttattttttttgctattgagttccttttatattctggatattaatccctttcagatgaatagtttgcaaatattttatcccactctactagttgtctcttcattctgttgtttcctttgctgtgcagaagttttttagtttaatataatccctttgtttatttgtgcttttgttaccttgattttcaggtattcataaaatccttgcccagaccaatatccagaagcatttcccctatgttttcttctgtagtttcatagtttttgctcttacatttaagctttcaaaccattttgagttgattatcctgagagcatagattcaaattgccctaaaaatacattcccaatttttgtttttgctttttaattattttttagagacatagtctcaccacattgcccagcttggtcctgaactcctggactcaagtgagccacaactcagccttctgagtagctaagattacaggtatgagccagcatacttggtgttttgagttgatttttgtgtatggtgagagatgagtctactttcattcttctgcatatgaatatccagtgtcccagcaccatttattgaagagactgtccttttcccagtgaatgttctttgtgcctttgttagaaatcagttggctgtaaatgggatttattcctgggctctctgttttgttccattggtttgtgtggtttttaaaaaatacctgaaccatgctgttttggttaccatcactttgtagtatatttcaaggtcaggtagtgtgatgactcccattttgttctttttgcttaggattgctttggatattcagtatcttctgtgatatcatgaattttaggattactatttctatttctgtgaaaaatgtcattggtattttgttaagagtgcattgaatctgtagatcacttgaggtagtatgttcattttttttcataagctatctcttacaggaaagtatgttcatttttatagtaaccattctaatccatgaccatgggatgtttttccttttttatgtgtgtcctctttgatttacttcatcagtgttatatagttttccatgtattcttattttatttttgttgaagtattgtaaatgggatggctttcttgatttctttttcagctaattcattgttggtgtatagaaatgctgctgatttttgcatgttgattttatatcctgcaagttcagtgaatttatcagtcctaagatttttttggtgccacttttggagtttagggttttctatatatttgatcctgtcatgtgcatacagggataatttgacttcatgcttcctgatctgcatgccctttatttctttgtcttgcctgattactctgtctcagaccttttgtactttgttaaaaggtgtgaaagtgggcatacttgttttgtttcagattatagagagaaagctttcagcactttcccattatgcatgatgttagctgtgggtatgttacttattacctttattatgttgaggtacgttctttctattattattataattttttttaattttttttttgagatggagtctcgctctgtcgcccagctggagtgcagtggcatgatctcagctcactgcaagctccgccttctgggttcacaccattctcctgcctcagcctcccaagtagctggaactacaggtgcccaccaccatgcctggctaattttttgtatttttagtagagatgggttttcaccatgttagccaggatgatcttgatctcctgacctcgtgatccgcccgcctcggcctcccaaagtgctgggattacaggtgtaagccaccgcggccggcccattctttctattattatgtgtaatttgttaagagttttcatcatgaggggatattgaatgttaccagaggctttttctccacctatggagataatcacattttttgttcttcattctgttgatttatcatgtttattgttttgtgtatgttgaacccattcttgcatccctagaatgaattccacttggtcatggtaaacaatctttttgatgtacttttggatttggttggctagtattttgttgaggagttttgcatttatgttcatcaggaatattggcctgtagttttcttttgcatgtgtgtgtccttatctggtgcttgtgtcatggtaatgctggcttgtggagtgagtttagaataattccctcctcttcattattctgggaaagtttgagaagaattcatatttaattcccctaaaatgtttggtagaattcagcagtgaagccatgagatcatggactttcctttgatgggtgactttttattactgcttaaatcttgttactcagaattggtcaattgaaattttctgtttcttctaggttcaatcctgatgggttgtatgtgtctaggaatttattttctgtaggttttccaactttttggtttgtagttgttcataatagtctctaatgactctgtatttttgtggtatcagttgcagtgtcatttttgtatgtgtttgattttgagtcttttctcttggttagtctaatggtttcttttcaaaaaatgaacttttcattttgttgatcctttgaatttttttttaagtctcagttttatttattactcttctgatctttattaattctttccttgtaattttgggtctgatgtgttcttttctagttccttgagaagcattgttagatttttcttttttctttttttctttttttaagagacagggtcttactgtgttacgtaggctggagtgtaatggtacaatcaactcaaactcctgggctcaagtgatcctcacacctcagttttgaattcttgggctcaagcagttctcccacctctgcctccagaatagctaggactactggtatgcgctatcatgaccagctaatcttttttttttttttttttttttttttttttttttttttagagataaggtcttgctatatatatggcccaggctggtcttgacccagcatcaagtcgtcctcctgccttgcgctcccaaagcactgggattacaggtgtgagccaccatgcccagccagatctttcttgtttttgatgtaggtgtttattactaaatacttccctcttaaaactgctcttgctgcatcccatacatttttatatgttgtgtttctgttttcactcattttaagacatttaaattttgtttcttaatttcttcattacccattggtcattcagaatcatgttatttaatttccatttatttgtgctgctttaaaagttcctcttgttattgatttctaggtttatttcattgtggtcagaaaggtacttgatgtgattttaattcttttaatttttgtgatttgttttgtggtttaacatgtggcctctccttgaaaatattgcatgtgcttatgaaaaaaaatatgtattctgtagctgttggatgaaaagatctgttagtgtcttttaagtccatttggtctaaagtcagtttaaacttggtgtttctttgttgattttctatgtatatgatctgtccattgctgaaagtagggtgttgaagtccacaagtattattgtattattgtattgtcttcccctttagatctaataatatttgccttacatatctgggtgctctgatattgggtgcatatatatttacaatttttgtatcctcttcctgatttcatccctactgtgtttgatacaaagtctcttatcgtaagtatagctactccttatatagtcatgattgtggtaaaaaaaaaaaaaaaagaaaagaaaaaagaaaaaaaatgtatagctactcctgcttgcttttggtttccatttgcatggaatatattctattccttcgctttcagtctgtgtcttttttttttttttttttttccagacatagtctcgctctgtcacccaggctggagtgcagtggtgctatcttggctcactgcaacctctgactcctgggtttaagcatttctcctgcctcaccctcccgagtagctgggactacaggtgtgcgccaccacacccggctaatttttgtatttttagtagagatggggtttcactatgttggccaggctggtctcgaactgacctcaggtgatccacccgcctcagcctcccaaagtgctgggattacaggtgtgagtcactgcgcctggccatatttgtgtctttagaggtgaagtgagtttcttataggtagcatatagttgggtcattttaaaaacccatttagtatatatcttttaaggtaggaatttaatctgtttacctcaaggttattatttttaagtgaagactcctttcattttgtggttttcagaatgttttgtatatcctttgttcttttcttcatctcttattttttatcattgtattttggtggttttctgtagtgataagatttgattttttttttctcttttttctttgcctatctgctctaccagtgagtcttatacttttatgtggttacataatggtgattattgtcttcttatttcccgatatagcattcccttgatcatttcttgaaaggctggtgtagtggtgataaattcccttaatttttgcttgcctgagacacactttatttctacctaatttttctctttcttttttttttttaagtggagtttcactctcttgcccatgctggagtgcagtggcatgatcttggctcactgcagcctccacctcccaggttcaagcgattctcctgtctcagcctctggagcagctgggattacaggcgcatgccaccatgcctggttaatttttgtatttttgtagagatggggtttcaccatgttggccaggctggtcttgaactcctgacctcaagtaattcgcctgcctcagcatcctaaaatactgggattataggcatgagccactgtggctggctatttctacctaatttctgatggattggtttgctgtgcatagtatttttgaccgatattttttcttttctttcagaaatttggatatatcatcccattttttcctggcctgtgaggtttctgctgttattctaatgaagattcccttatatatgacttgatgcttttctactggtacttttggatttttctctttgtctttgacttttgtcagttcaaatataatgtgccttggaggtgacctttttggggatctttgagcttcctggatctgaatgtccatatctctcgcaagacttgggaggtttttagctattatttcattgtctttttcgttttcttttatttttaatcttgctgtgatctccttagcagctataatttcattaaatatgttttatttttttaatttttttttttttgagacagagtctcgcactgtcgcccgggctggagtgcaatgacgcagtcttggcttactgcaccctccgcctcctgggttcatgcgattctctggcctcagcctcccaaatagctgggattacaggtgcacaccaccacacccagctaatttttcgtacttttagtagagacggggtttcgccatgttggccagactggtcttgaactcctaacctcatgatccacctgccttggcctcccaaagtgctgggattacaggcgtgagccaccacgcctggcctgttttatttaaaaagttgtattaaatatatatttttttctttttttcttttttttttgagacggcattttcacccttcttgcccaggctggagtgcaacggtgcaatcttggttcactgcaacctctgcctctcaggttcaagtgattctcctgcctcagcctcccgagtagctgggattacaggcacccaccaccatgcctggctaattttttgtatttttggtagagacggggtttcgccatgttgcccaagctggtctcaaattcctgacctcaggtgatccacccacctcagcctcccaaagtgctaggattacaggtgtgagccaccgcacccgacctgttaaatatattttctatgccttttgtcatctctttgccttctggaactctaaaaatatgaaatttttttcccttgatgttatctaataagtctggtaggctttcttcactccttgtcattcttatttattcttctctcactggtaattccaaacaaactctttatctttctttgcttgagtaagtttgctattgatgctctctattgtaccttatattttatacattaaattcttcagctgcaggattcctgtttggtgattttaaaatatttctttcttaaatttctctttcatgttatgaattgtttttctgattttattgaattatctttctgtattatcttgtatcctattgagggttttttgtttgtttgtttgtttgtgagacagagtgtcactctgtcacctaggctggagtgcagtggcgtgatcttggctcacaacaatctttgccttccaagttcaagtgattctcctgcctcagcctcccaagtagctgggactacaggtgtgcaccaccacacccagttaatttttgtatttttagtagagacagggtttcaccatgttggccaggcgggtcttgaactcctgacctcaagtgactcgcccaccttggtgtcctaaagtgctggaattacaggtgtgagtcactgcacctggccttgttgagtttttaaaagatcattattttgaattacttttttggtaattggtagatttccttctagcttgttaacggaaagttattgtgttcctttcatggtgacacatttccttgccttttcatgtttctattgtccctgcattgatgtctgtgcatctggtgaaacaatggcgtcttcccatttttctacagtcactttcatagaggctttcacctgcacttggtccttagtgtgctagttgagaagggtgtagtaactctgtttccagataagtgaaatggtatagtctttgttcagctttatcaacagtatttaatgttggcagtaactttgttttcctcagtggcctaggttgtaaaagtttgtagcagtaatggcataggttgttaatggcaagggcttttttggagtcctcctattttcatttgccccacaatgaagttacttagccatgaagatacttcttgctgtcaagtatgatatggcctataggcaggtacagtggctctgggttccaggtgcaggtgctcagggcagctgtgggtctggggttctaggctcagcatctgatgaacctattgtggcacctgggttttgagctatagatttgctccatgtggtagaattggaggtaggtttaccacagagccaagatctgtaactctgatgtactccctagcagcttgggcccaaagggccaggttgtagctttttgtttctgggcggccaggcacagcacaggcccaactctagggaagaagtggtgctttggagtattgggccaaggaaacagaatacagctgcagtttggtaacctgaaccattcaggctcattggcaacttgggtttctggcatagcacagtttttgtttgggccttgggcaatagggagcagcccagtgatgactcagctccccagggagaaagctgtctcagcagcccatacttcagggtgttagtcctgccccctggcagctggttatccagctagctccctaaagtgagtactagagttgtttggcctgtagtgtggggtgtctcatctcatgccctgctttgtttccctggaatgtgaaggcccatgccagctcagcccagtattgcatagctactcagttcaggcaaggcactgcatccccagagggtaatgtgcctcgtcagctcaggtctagggtgtgtgaccttaggttggcccaggcaccattttcctgggatgcaggaagctgcttcagattaggtactggactgtgtgtctgcttgggatggccaagacactgttacctggaaggcagggtggtaggtagggtgctgcttaaacttaggcactggggaggcatgactgctctcgatggccaaagtactgttttcccaggagacaaggtactgcttcagctcaggtacagaggggtgtgactgctctggatggttaatgcactgttttcccaggatgcctggcattgcttcagctctggcctagaggggcaggatgtagcagcatctgggaggggtaggtggaggagcttcgccaaggcatcctttcctcaggaggcaatgtgcagcttcagctcaggtccctggaagcagggcagttttgggagaagtagactgagaggtagacagtgagaggtggatgttgcacatctgccagagcattgttttcccaggagggagtgcacagcttcagctctagtcgaaggtgacaggacacagcctagcatagggacttgaggggtaggtggtgcagctctcccactgcatggccctacatgggaaggtggaaaagctgcttgtagatgttgggccaccaggtgggggtggatggtgatggcttatcctcagggatgaagaggtgccatggaaccagacagaactccagccgttccaaaataacagcacagtagctgtatgggccactgggggcaggacagtgtcagctccttcctcaggagcacagctgtatggactccaggcgggtccgtcagctaagcttagtgcctgtgagggctgtaggggaccccagtggtgagtactgtaggtgtccaaggtggtgatgtacgctgctggtatgctattgctcactttttccacatacggagaaattccttctggttttcagctgatcttggctgggggatggggttgtggagaccaggtgttccattctctgcttggctatcctgagtttctgtgctcaccagagtttttgttattactttgacatattctggtgctttcctttagttatttgcattaaaatgtatttgcttatttattttggctctgtgggggtggggagaacagcatttacggactgctaatctgccttcttgctgaagtcactctcttgctacagatatttggttggaaacattttcgtttgtattctgtaaataactaggagtagaattgctgtgtcatatgatatgtgtatatttacctgtataggaaactgccaagttgttttccaaaatggctgtaccattttgatttctcaccagtattttgtgggagctccagtcctacatctttttgagcacttggttttgttacactttaagtttttcaatttaacagatgtgtagaggtgtctcattgtggatttaaatttcattgctgaaatgactactggtattgagcattttttcatatgttcattgttcatatatctttagttatctttccaaatcttttttttttttttcttgagacggagtttcgttcttgttgcccaggctggagtgcaatggtgagatctcagctcaccacaacctccgtctcccaggttcaagcagttctcctgcctcagcctcccaagtagctgggattacaggcccccaccacaacgcccagctaatttttttattttttgtagagatggggtttcaccatgttggccaggctggtcttgaactcctgacctcaggtgatccgcccacctcagcctcccaaagtgctgggattacaggcgtgagccactgcaccagaccctatctgtccaaatcttttgtcccactttaaattgttttttcttcttaacattgaattttaagaattcattgtatcttttaatattctgaatgctagttatttgtcagatacatgttttgcaaaccatttatctgtatttggtttctttttgttatcttagcagtgtatcctgaagaatagttttaaattttgatgtaatccaaaatatttcggttgtttgtgttctttgttatcctatttttgttgttgttgttttatagatatgggggtctcactacgttgcccaggctggtcttgatctcctgaactcaagtgatcctcccacctcagcctcccatccttgtctacctaattaggctttgtgtaactcagtgttgcaaagctttgacatctgtttgagttaatgtttatatatgttgttacttaagggtttcacattaaatttaaacatacttatattttataaccaaacaagtcatgttggggcatactcattaggattgagtgctttcttacaccaaaatacatgtatacaaagatttaaaacactttcggccgggcgcggtaatcccagcactttgggaggccgaggcgggtggatcacaaggctaggagatcaagaccatctggctaacacggtgaaaccctgtcgctactaaaaaaatacaaaaaattagccagacgtggtggcaggcgcctgtagtcccagctactcgggaggctgagacaggagaatggcatgaacccgggaggcagagcttgcagtgagccgagatcaccccactgcactccagcctgggcgacagagtgaaggctatgtctcaagaaaaaaaaaaaaaaacttttataataacaactgtaaatagttcaattgacagtcatttgtaagatgtttaagtaaactgtgaaacagtaagtaaatggatgaaaacacactgattaaaactgctgcttttatccaacaagatggatgaatttcccaggaaagaatacttgagttcaggcctgttcaagtcccaacctgtttgtggtttgaggttgctctctgcctcgtagagcaaagtggaaaatttatcttctgggaggacagagttttcttctctgaaaaagtttcctacatagttggctttggcatttgcaaggaatgaaaggtcagggattgaggcctcatgagtctggatttctagctgaggttgagagaaaaggtagtgattgtaaccagaaaatccagagtgggtgtatttacctccagaactcatcacttaaaaaaaaattttttttgaactgacatgcttgaggctttttcttttttttttttttgagatggggtcttgctctatcccccaggctggagtgcagttgtgcagtcatagctcactgtagccttatcctcctggcctaagcagtcctcctgcctcaacctccctagtagctgagaccacaggcgcatgccacctgtgagtttctagagatgaggtctccctatgttccccagcctggtcttgaactcctgggctcaagtgatcctcctgcctcagccttccaaagtgttggattacaggcgtgagccactgtgcctggccagagctcatcactgttaactcagcctgggtttttcacagcagtcatggaaatagattcattaataatagtaacaaatatatagtctccctctcaaagaaaccttgagtggcagtggcataccagatacacagtaggaaatactgtagaattatgttgttaagttcataaccaaacatcatacatgatgataaaagacaagataatggtcacatttatgcagtattaactgagagggcaaatttgtgcctgagaagctattgggaatgttctctctctttgcattactaggaattacatgggaaacacatgtagacagtcttcaggctattaagatttgtccacttaatctttacttatacatgaataaaaaatgggaaaacatgataaatataataaactaatacactcaaccctgccccttgattatataatagaacaaaatcagcatgcccggcatgagcctgccagattgccaattccatcctccaccttcagaggatgccgccatccagaattttgccttactcattttactttcttcatagttcgacaccttaaatgtatattactaatagtagctttgcatttttggctgatttaaaaattgatataaatgaaataatgctgtagagatgctttttggtattaagtggatatactgttattcttaaagatgtttgaaatgaatatacctttctaaatatctttttaaaataatacattaaatgatactgctttagaattcatgaactgcatctcatgagaatatgtagagatgacgtgggcaggtaaagtaaaacttcaggttgaatatcctatgataatttaaaaatgacaaaatagtgtggtgaataatagagcttgagcactttaaggcaccgtagggaccccttcaatgtaatgatgacagtgctgaggtgcagagaagttaggtaatcagcccaagccactactctaaggacagaccctatctacttttcctaatttgtcagaagactgcctatgatactactaataaaaagtcctatgaaattggtattgtcattattttacaaataaaataatcttcaatttttgtttcctctatgcatgggttacttagtattttgtaatttgaatttcaagcataattaaaaagaaatcaggtatctaggctgggcatgatggctcaagcctgtaatctcaacattttgggaggctgaggcaagaggatcacttgaggccaggagtttgaggtatcttttgttgatctctacactgattgtattctctcttttattctatgaaagttaaagattttttctgatactacatattgtcagttttttaaatactcagtttgtgctaaaagaaaacattcggcaactgatatctgctgttctgtatgtatctgtcagtccagatttgtccattatggtgtatgaatctaatagaacctcaccaatgttatacctgccttcttgaaatcattactgagatagctaatattaaaatatcctggtttgtctgtatatttaattctttactctcattatactaaatttttttaatgtaatttgaattgatggtaaaaattgtatacaggccgggtgcagtggctcactcctataatcccagcattttggaagtcctatgcaggaggattgccagaggccaggaatttgagatcagcctgggcaacatagtgaaactctcatctttataaaaagtaatattaaaatttttaaaagtgtataaactgtaaagtatattttactggtgttttcttccttattcctacttgtcagatgcaaatacacatttttgtgtgtttgtgtttagtaattataagtatacatatttcattcttctatttcatatatttctatgacattatatcttagatgtgtaatttatgaactactactggattattttaatccattagaaattactattcacgcattctgtattcaattcatgtgatagctaatatatttggttttaaatgcatcttattttgtggttttcttctaggctgttttttgtgctttcttttaaaaatatataggttttaataatcttaattttcttttagtttgaaatgtatatactcattttattcattagtctaagataagaattgtaacacttctctaacctattatagaattgttaatacctttacccttctcttgaacacatcaaaggatgtcattgagtgttggtattggagtatagcatatctattattctgctcaattagaagatattgttcatgttgtatagagataataagtaattgtattgatctgcagatgcatccatctcttggattctcattccttctaccactgcagaactttcacctgtaatcactttcctttggccttaaggataacttttagggttacttttctactaaatttccaatttttgaccagatataatcttatattgtgctcttcctgaaaaatactattgttgtggatagaaatctgggttggtagttatttcttcagcaatttgaccatgtcattccactgtgtccctggcctcctgtatactggatgtgaatggatacaattatatattgtgtttatagttttcctgtgctataggaacagtattcgaatctgatgcaaaggacaacacaccctagagattgtaacagtgagatgaaccaagtgattggatggggttttgagttgctggaataatggagttacagtgtacaatgcataagcaacataataaattatatatctggtgaacaaatggatggattgtgccatgaactggttagatgcttacccacatgtcacagaaggtcttcacttgcaaggagggtgggaaatacctcttggtcagctctcaacttgtgcagcatcaggcctctttcaatggggaagagccacacaggagcaatgagagtggggaggcttttcacactggacaaagggattccaagtacagcaattgtgggaaagccttttgctgcaaatacatactttttcagtatcagaaaatccatgctggagtaaacccttatgagtgcagtcagtgctggcatacctttaataacagctactattctatagttacccaagagaattcacagcaaagctgtgccttatgagtgcagtgattatgggaaattatttggctccagctctaatctccatatacaccaaatagttcacacaggatcaaggctttaagagtgtgttggccaggcatggtggttcacacctgtaatcccagcactttgggaggctgaggcaggcggaccgcaaggtcaggagttcgagaccagcctggccaacatagtgaaaccccgtctctagtaaaaaaatacaaaaattagctgggcgtggtggtgcgcgcctttagtcccacctactcgggaggctgaggcaggagaattgcttgaacctgggaggcagaggttgcagtgagccgagatcacgccactgctctccagcctgggcaacagagcgagactctgtctcaaagaaaaaaaaaaaaagtgctgaatgtgagaaagcctctatcactagacctcatcctgtttagcaccagagaattcatagtggagaagaccttatgagtgcagatcatgtggcaaattctttataaagacacatttgttgagtaccagaaagtccacaatggaaaaatatcttctcagtgtggtgaacgtgagacattctaaagccacaattcttaccgtggttaggctttgtgtccccacccaaatctcatcttgaattgtaatccccataatccccagtgaccagggtaggacctggtgggtggtgattagatcatgggggcagtttcccccatgctcttctcctatagtgagttctcacaagatctaaggggttttttgtttgtttgtttgaaacggaatcttgctctgttggccaggctggagtgcagtggcatgatcttggctcactgcaacctccgcctcctgagttcaagtgactctcctgcctcagcctcccaagtagctgggactacaggtgtgcgccaccaggctcagctaatttttgaatttttagtagagacggggtttcgccatgttggccaggctggtctcgaactcttgacctcaggtgatccacccatctcagcctcccaaagtgctagcattacaggcatgagccaccgagcccagccctcaatctgatggttttataaggggctctttcctgttcgctcgttcgctctctctcacctgcctccacgtaagacgtgtctttgcttctctcttgccttctgccatgattttaagtttcctgaggcctcccgagctatgcagaactgtaagtcaattaaacctctttcctttataaattacccagactcaggtatgtctttatagcagtgtgagaatggagtaatggactatcttgtaacatgttagagaattcacaatggaacaagatcttgtgtgttcaggaaatgtgggaaagcagaaattcccacattgcttggcaaatgaaagtcaaccagagaaaggccttttgtagcagatataagaaagcatacagtgaaggcctaacctcattaggcatcagaaaatttacactggagagaggccttaagagttcatggaatgtgctcattgtttaacatggcatgatcctaagagaaaatctctgagagtaacctttgagagggagctctaagccaggatttgaacctcagacatatgtgtattcacactgtggagattacctacaactgcatgagtgatcagaaacaaatggggtcctcatctatttccccttagtggtttcagcgtggatattatccagctgcagcctaaaagatctgagctggggcctgctgtggatttcaagaggtccccatccttaataaacagtgttgaccccacatggtagctgagatggatttctccaaccagcttcccaatccaccaaccttagatatgcccacctcatgatgttctcatttgtgcagagataaatgccatagtgtttaacccttcaatctgttctgttcattgtgtgggactgattgagaaaagaagggctttgctagcagggaccaccaactttatgtgcctcagagtggacagcaggatggtagagagtagctctaagtctagtttggcctgttttgcaatgctacgcaacgtctcttagggaaaactgtagggcattgtgagactgatcttgtgacctggatgtcaggatctctgtgagccctaagctcaccctcatgagggagtagttggtgtgacaacctccagtgcttctagaaacagcataagttgagtccctttttcccagaggatgtgtcatattccatcaattctgttgaggggtggctgtctcctaggacctctatgcagaggacattgcccctgaaatctaaaatctggtaggcatgtaagacctacaggggctaagcaggaaacagatacagaaacactacatacagaaacattggatagtagggagtagtggagactgggaaactagaagttatgtgtgtactctaaagggggatacacaaatttaatgtaactatgactctgcgatgagggtgtacaaaaattctcacgaccggctgagctccttttctcctatggctgaggccggtgtgagagcaaacaatctgaaagtttgtgaattcctgtacctccctgggctgttgacattttggtcatcactgaacaggcaggaaccccaggactgacaaaagagagcttggagtcgatcgtgcatcttttgtgacccagtcagcatgtgggaagtgatggccttcattgctttctagtttttgctgccactgaaggagggctgactcaagatatgggaagagggagagagttgaataaatacaggattgattgattcagatttttatgtggaaacttttttttcttaacacatcaatgatatataattggcatacaataaactagacatattgaaattgtataatttgataaatttcgacatgtatacacatgtcaaaagtttcctcatgccccttactaatctcctcttattctccaatactttatccccatgtgaccattgatttgtttaatgacactatacattagttagtattttctgaaattttatataaatgtaatcatatggtatgtgtttattttttatctgtctttcagtaaactgtttctttttagatttggggggtacaagtgcagttttgttatagggatatattatgtattggtgaagtctgggcttttagtgtgactgtcacccaaatagttcacattgtacccaatagacaatttctcatttttcaccttttttcccttgttttgtgggtttattttcaacttttattttaagctcagggggtccatgtgcaggcttgttacaggggtaaattgcatatcactggggtttgatgtacaaatgattttgtcacccaggtagtgagcatagcacccaacagaaagtttttttgttttttgtgtttcccttacccttctcccacactctcccatcaagtaggccctggtagctatttttcccatctttgtgtttatgtgttctcattgtttacctcccacttataagtgagaagatgcagcatttggttttctgttcctgcattaattcatttctgataatagcctccagctccatccatgctgctgcaaaggacatgatgttttttatggttgcatagtaatccatggtgtatacataccactttctttattcatttcactgttgatgggcatctaggttgattcatgtctttgctattgtggatagtgctgcaatgaacatacaggtgcatgtgtctttttggtagaacgatttctattcctttgggtacataaccagtaatgggattgctgggtcaaatggaaggtctgttttaagttctttgaaaaacatccaaactgccttcctgaatagctgcactaatttactttcccagcagcagtgtataagcattcccttctctccacaaccttgccaatatctgttactttttgactttaaaacaaccattctgactgatgtgagatggcatctcattgtggtttgatttacatttctctaatcattagtgatgttgaaccttttttttcatatgcttgttggccacatgtatgtcttcttttgagaaatgtctgtttatgtccttggctcaattttttaaatgagattggttgttgttttgtttgttactttgcttaagttccttatagattctggatattagaccttgtcagatgcacaggttgtgaatattttctcctattctgtatgctgtctgtttactctgttggtggtttctttctctgtacacttcagtttaattaggtcccatctgtctatttttcctttgtttcaattgcttttagagactttgtcatgaaacctttgccaaggcctgtgtccagaatgatattttgtaggtttcttctaaggttttttatagatttaggtcatacatttaagtctttaatccattttgaactgatttttgtatatgatgaaaggaaggggtccagtttcagtcttctgcctatggctaacctgttatcccagcatcatttattgaaggagagtcctttccctattgcttgttattgcttactttgtcaaagatcagatgtttggagatatgtggctttatttctgggttctttattctgttctagttgtctatatgtctgtttttgtatcaatatcatgctgttttggtcactgtagcctttaagtatagtttgaagttgggtactgtgatgcctccagctttgttctttttgcttaggattgctttggctatttggactgttttttggttccatgtgatttttagaatattttttctgattctgtgaaaaatgaaattggcagattgatgaaatagcactgaatccataaattgctttgggcagtatggctattttaacaatattgattctttttatccatgagcatgaaatgtttttccatttgttttggtcatctctgatttctttcagcagtgttttgtaattcttgttgtagagatctttccactccctggctagctttattactaggtattttattctttttcttgactattgtgtatgagattgcattcttgatttggctctcagactggacattcactgtatattattggtacatagaaatgctgatttttgtacattgattttatatactaaagctttactgaagttatcagttctaggagcttttgtgcagagactatggggttttctaagtatagaatcatatcctctgcaaagagagatagtttgacttcctctcttcctatttggatgccttttatttcattctcttgcctgattactctggctaggacttccagtactatcttgaataggagtggtaagagtgagtatcgttgtcttgttctgattcccaaggaaaatgcttccggcttttgcctgtctggtataattttagctgtgagtttgttatagatggcttttgttgttgctttgagacaaggttcttgctctgtcacccaggctggagtgcagtgatgcaatcacagctcactgcaacctctgccctcctgagctcaagtgcctcccacctcagcctctcgagcagctgagactacaggtgtatgccatcacacctggctaatttttgtgtattttgtaggaacggggttttgctatgttgcccaggcttgtctccacctcccaaagtgctgggattataggtgtgagacactgcacctggcccatagatggctcttattattttgaggtctgtttcttcaatgcctagtttgtggagggttggaagggttgttaaattttattgaaagccttctgtgcatctattgagataaccatgtggtttttgtttttttgttctgtttatgtgatgaatcacatttcttaatttgcatatgttgagccaactttgcatgccagatataaagcctgcttgagtgtggtgatcgtggtggattagctttctgatatgctgttggattcagttaactagtattttgttgagaattttgcatttatgtttatcagggatattggcctaacattttcttttttcattttgcctctgccaggttttggtatcaggatgactctggcctcacagaataagttagggagtagtcccgcctccttgattttttgggaataatttcagtaggattagtaccacgtctttttacatctggtagaatacaactgtgaatccacctggtccagggctttttctggttggtagctttttaattactgattcaatttcagaactcattactggtctgttcaggatttcaatttcttcctggttcaatcttaggaggttgtatgtttcaaggaatgtatccatttcttctaggttttttagtttgtgtgctaagtttttagttcttaatagtctctgagagaattttgtacttctgtggggtaggtggtaatgtcacctttaacatttctgattgcgtttttttgcatcttcttttttccttattaatctagctagtgggctaccagtgttgtttattcttttgaaaaaccaacttacggttttatgatctttgtgtagattttcacatctcagttttattcagttcaactctgatattggttatttttctctgctgcttttctttcttttggggttgttttttttttcttttagttcctctaggtgtgatgttattttgttaacttgagatttatctaacttcttggtgtaggcattttgcactataaactttcaacactgctttagctgtgtcccaaagattctggtatgttgtatctctgttttaattagtttcaaggaatttttttatttgtcttgatttcattctttacctaaaacacattcaggagaagattgtttaatttccatgtaattgtatggttttgagagttcttctaggtattgatttctgtttctactgtgctatggtctgagagtgtggttggtatgactttttttttaattgttgagtattgctttatggccaagtatgtgattgatcttagaatatgtgacatgtgcagatgaaaagaatgtatgttctgtggttgttgggtagagtattctgtagatttctgtaaggtctatttggtcaaatgtccagtttagcttccaaatacctttgttagctttctgccttggtgatgcatctaacactgtcagtggggtgttgaagtctcctgctattattgtctggttgtctaagtcttgttgtaggtctctaagaacttgtttcatgaatatgggtgctccagtgtttggtgcatatatatttgggatagttaagtcttgttgaattgaatcctttatcactatgtgatgcccttctttgccttttttgatcattgttggtctaaagtctgtttcgtgtgaaatagcaatccctgctcttttttttcccatttgcttgatctttctccatccttttactttgtgcctatgggtgtcattgcatgtgagatgtgtctaatgaagagaatacacagttgggtttcatttctttttccaacttgccaccttgtgccttctaagtggggcatttagcctatttacattcaaggtcaatattgataagtgaggatttgatcctgtcattatgttgttagctggttgttatgtggactttattgtatagttggtttgtagtatcaacaggatatgtgctcaagttgtttctgtggtggcagatactcatcttttgcttctaggtttagcactgttttaaggacttcttgtaaggcaggtctggtagtaatgaattcccttaacatttgtttgtctgaaaaagattttatttatccttcacttaatgaagtttagtttggttggatattaaattcttggttcaaatttctttcatttaaaaatgctgaatataggcccccagtctcttccagcttgtaaactttctgaaaggtccacggttagcctgatcgggttccttttgtgggtaacctgccacttctctctagctgcctttaatgtttttcttttgtattgaccttggagaatctgatgactatgtgtcttagggatggtcatcttgtataatatcatctcacaggggttctctgaatgtcctgaatttgcatgtcaacctctctagtgtggttggggaaatgttcatggacagtatcatcaaatatgttttccaagttccttgttgtctctccatctctttctggaatgccaatgtgttataggcttggtctttttacatatcccatatttcttgtaggttttattcattttttaaaattcttttttctttatttttttctgctgtattggttcaaaggagtcgtgtttgagctctgagattattttctttttttttgtgggatagcaaacacttatttgaagaacttttaggataaaatttagtttacctctgataaagctgaagaaaaatgattgcagtttttatgcattaaatgataaacattgcctttgtattcttttcccagttcttctacaattttttctatatcatcttctaggaagtccgtgctccctaaaacaacttctttaaatttaaatggttctcctagttcagaagcatttcctggggaaatttcaaatattccagaaaaggggtaaggatggccaccataagcaaattctctgccatagacttcaatttctgaatgaaaaactccaattccaatggatgaggtatattccttcatccaatacatgtcacacacgttgagcaccactaactggttagcccccatcctcctccccgcggccgccgcctagtcctcaagccgctcggtctccgcggggccggaggccgctcccacccccgcgggcgcttcaaggggcctgagccgggcactaagcgtacagccctgcccgtggcagccggggcagaagcatcgggcagccaagccactcccgggcgccaacgacaggagcctctgtgcggacagggccggacagctggcggcccgctccggatgaggcacctcccctaggcggcagacacatggggaaaaactgagctctgagactattttctaagcttggtctattctgttgttagcgcttccagttacattatgaaattgcaattgctgtagttaatttcttatttccagaagttcagtttgatgactctttttcttttctttcttttttttctttctttttttttttttttttttttttttgagacggagtcttgctctgttgcacaggctggagtgcaatggcatgatcttggctcactgcaacctccatctcctggatccaagggactcttgtgcctcagcctcccgagtagctgggattacaggtgcctgccagcacacccagctaatttctgtatttatagtagagatagggtttcaccatgttggtcaggctggtttcgaactcctgacctcaagtgatccacccgcatcagcctcccaaagtgctgggattacagacgtgagccaccgtgcccagcccattttggttctttgttaatatggtaatattatatttaaactcttggattgcattattggtttccttggatttttccttccttgccatccagactctgaattctaagtcatttcagccatttaagcatggttccaaaccatcactagggagctagtgcagtcgtttggagacctttagagttgccagaaatcttgcactggttctttctcatatgtgtgggctgatgttccttgaatctttgaagttgctctcctttggatggggctttctgcttttatattatttgatgcccttgggagttttactgtggtataagttgggtttagtttcatggtttcaattatgggtgctttcacaggccaaggctcagctgagcactcctgagctgcatgctgtaaacctgggtagaggggattaagcccttggctttgttctctggctgcttggggtgaagcacctgctgtgctagaggggctgaggtgttctcagtctgctggcaaaagtgctccagcagagcattgtggggactgcagagagtgcactgtggctgggggatggggaggccacaggcaagtgtgcaccacttgggcagtagaggggggctacctgcaagtgtgtgccaatggggtggcatggctgtggtgtaggtgagtgaagcaccatggtgtgaggggtccccggcaatgcctcccacctttttgaatctccagtgtctattattccactatttccatatgtatacatcatttagctaccacttataagtgataacatgcagtatttgactttgtttctgaattatttcacttaagagaatggccccccagttccagccatattgctgcaaaagccatgattttttttaatgactgagtagtattccatggagtgtatatatatatacacatatatacatatacatacatatatatacatatatatacatatacatacatatatacatatatacatatacatacatatatatacatatatatacatatacatacatatatatacatatatatacatatacatacatatatatacatatacatacatatatatacatatatatacatatacatacatatatacacatatatatacatatacatacatatatacatatatatacatatacatacatatatacatatatatacatatacatacatatatacatatacatacatatatatacatatatacatatacatacatatatatacatatatatatcgcattttctttatccaatcatctgtcgatggacacttaggttgattctatgactttgctactgtgaatagtgctacagtaagcatgtaagtacaggcatctttttgatatagtggtttattttcctttaagtaaatacccaatagtggaattgccagatcaaatggcagttctattttcagttctttgataaatctccatactgttttccatagaggttgtactaatttacattcccaccaatagcatataagcgttcccttttccttgcatccataccaacatctgttggttttttactttttaataatagccactctgaccagtataagatggcatctcagtgtgtttatgtgtgtgtgttttctctcatcatatctcattataacctcaaattcctgggctcaagcaatcctcttgcttcagcctcccagtgtctaggactacaggtgtacaccatcatgccttgctcttttttttttttttggtagatataacatcttactatattgcccagggtggtctcaaactcctgacctcagcaattattttgtgttggcatcccaaagcactgagattacatatatgagctacctccctaaaataagggaagtgagccagaagctctgggcccagcccatgatctcaatcggggcgaatatccccgcctcctgacctcaattttcctaagctagaaaggacctttcgaccctccgacttgtgcccatagtaaagcggcggccctaagacgacgcgggggtccttgtgcgcacttaaatggagtcggctgcgcttggtgagttcccacacccggtagatgtgagggaaaaactgccttactcagaaggcaccaccccttgcgtcggccgcggactctaggccaatgacgggccaggacacgggcgatttctgcgggccagggcggcggaggtgggacttccgcttcgtcgcgtgacgtcatctccgtgagcaggattggccctggaacagtgtggggcctggaccgctgggtaggcgcgtccagcggcctgagcaggggagggtaatgaggctgttacgcgccttctccgcatcttggcgggagcctgacgccccgcttcttccctaacggggtgttccaccggcgcctgccgaggcctaggcctccgcagccgccctccgtctcctcagccccgacgctgcgcccgctttgtgcgcatttttctctggggaaactgaggctccgagtgcgaaagtcagccgaggtcgccccgcccaggacagagaagggctgggggtcggctgagccgcggcattcccgggccccgctagggctgcagggtctcaggatggcagcctcggcgcaggtgagtggacgaggttttggccttgctgctgctctgctacttctggaggcctcgtgggcaggcagaagccaagacagccacaggatgtttctttgtcgccgtcgtttatttaagagaagtggccgtagcttgtcatttcctttatccgcagtcctgcaatagtgttggcctccgacaggtgctcagtccttggtagaaggatgaatgatgcttccttcatggatctcatcacacttcccttaaatccaacctcctctgttgcctgccagcccctaccccatccacctggccaaccacccctgaccttgtctctccatttttcccttgtcctttgctcttcagagccaccaacctgaccgtgcagtcttcttcctttttccaggctttctctttgcacttccctttgccttgaacactgcccctataacttcgcagggcctccctctcatatctttctggcctctgtccagatgtcacctatttggaggtggctttcttggcaattccggctaaagtggcgccttacgcacttgcccatttttggcaatgtgtggcatttttgtatagagaatctgacgatattaaagaagcttgccgtttgagttggtctaggatgttatgtgaacaaagagaaacgaaataattgcaaagagtgacagctgatcataaagagtccttgctgtgggctgattggcaggcattatttaaccctcagctcctttaatcctgaactccttagaattaggttctcttgtcctcactgttttacacaagagcagctggaggctcacataggttcaattacctgccttacatcactgtagctcttaagtatcagaaactaacaactggtgtgtctaccatcacagcctgtgtttttaccctcttctttgcccgcaatggttagggaggcctgggggtgacacctaaagtaaactttgcaagttgagcaggcttccttctagcaggtggtcttggacatgaggagtcatggcatttcatgctggtggaactgtgtggactaaaaaaaaatggtttattggttgtttaaggagtccgcaggggacccgtgtggcttccacagtggtttcctgagtggttttctcctataccagctgacacatgtcttgggacacaagattttgtggtcttttgctagatgtgccttcctccttagccaggacagacatagccagtcaggggcccatgttctcatggctacaacctgctgtgtcctctgtgactcttgttccttgctcctgaagtatcctgacctcagggatacttgttggtaggactcaaacaggaaaaggtagtgatagctcgttgtggattcttcctatgagaatgggcatctgtgaggcccagaagtgtccgaggcagcagatgcaggtccaggccctgccacttttgaggcaggtgccaccacctcaggtgactcttctgtgaggtaggtgattatgactatgctgctctgcccaggtccatgaaaatatttcaagtggctaaccccagcacagtggcatgtgtctgtatatccagcttgggaggctaaggcaggaggatcatgagttcaagcccaacctgggcaaaatattgagaccctgtctcaaaaaaaaaaaaaaaaatcctgaaaatattttcagggtggctcaaatggatgtatttcaatgtttcccatcctcattaactgtgcattaactttgctaatgaaggagtgtcgggttgcatgattagaacatagaccatagggccctgggttcaaattctgtctctcctgataagagatgtgactttgggtagactagtggaggtcctggacctcaagtctctgagtgtgacatggagatgatgatggtgaactcaggagctgtggccctttgccccagtgtttcctttacagcttttcttcagatcttttgactattcttggtgaagtggaaaaccctgttgtgttgacctggacatcagggctcagataaatgaaatgagatttccaaggtcacatagcaggcttgtgttgatttcaggaatttggttttaaacctcaggagtctgactcctgagctggggacttttagtcactttaccatggcatgtaaagccattagcatgaggcaggctcacagggaggatcggtaagactcaggtgctgttcttgttgttgttgctggtgttgtttttgttattattctttcccattcctctgatgtctcagagcacttactgtcttgcctctcagtccccttaggattgtcctaaccttatttctgtgtgaagtggctttctgcataggaggcttctctctcttcactgctgtaatttttttttttttttttgagacgagtctcgctctgtcacccaggctggagtacagtggcacgatctcggctcactgcaagctccgcctcccgggttcacgccattctcctgcctcagcctcccgagtagctgggaatacaggcgcccgccaccgcgcccggctaatttttttgtatttttagcagagacggggtttcaccatgttagccaggatggtctcgatctcctgacctcgtgatctgcccttcatggccccccaaagtgctgggattacaggcgtgagccaccgcgcctgaccgacactgctgtaatttatccaaggcaatgtccacattgccctcatgcctggcacagatcatggccctctagagatgcttggtgatttgattcttgggtcactgcgcatcttttgcagtgctgaagtgacaagttctagttgtattccacagttccaagggaaacactactatctctgtttaattttccaggtgtctgtgacctttgaggatgtggctgtgacattcacccaggaggagtggggacagttggatgcagcccagagaaccttgtatcaggaggtgatgctggagacctgcggacttctcatgtctctgggtaaggccccttctggtcctgtgctcccttaggattgagttctcctactcatgttcccctctctcctccacagcccacttgttctgaggctcctggcaccacgcaggggtgttcaccattggctctgagcgtagcacttgggagaccagggtctggtgtccaggagtccactcccatctccactgctcatgatccctgtgttcctgggcaagttaaggaatccctctgtgcctcagtttttctcatgaataaaaagggccaggccaggcacagtggctcatgtctgtaatcccagcactttgggaggccgacgcggacaaatcaggaggtcaggagtttgagacaagcctgggcaacatggtgaaatcccgtctctactaaaaatacaaaaaattagccgggtgtgatggcgggtgcctgtaatcccagctactcaggaggctgaggcaggagaatcacttgaacccgggaggcggaagttgcagtgagctgagatctcatcactacactccagcccaggcgacagtgtgagagagactccgtctgaaaaaaaaaaaaaaaaaaggccaatatagtatttgtttcatagggctagtgtgagggcaaatggttcagtagagtgtgttgtgataggtggctgggcgcaggttagcaattgtgacctctgttgctgtcactattgtcactgctgtctaaatcattgtcctcataatcagcagtatcacacttggactccgcagtttttggaacaactttgtatagttttttagttaaattggccagatgcttttgatgactagactcaggtgtacattttggcttggccattcgccatttcccagattttggcaagtcactttatctgcctgagcctcgatctcttcatctataatgtggtcctgattgcagtacattcttaatgtgcatcctgtgaagaaatcctaaaatagaatttttcatgcagggaccataggagtagcaatgtaatgctttgcttagaatgtaaaaaaaaagccttaggtcagtgaagaaacttacctttctcctgaatggagactcagtatctcaaatatgttatttcttttctaaactaatgactaaatttaattgagtgtttataaaatacaatgcatttaaattgcttggcatattccctaggttatagttacattgtataaatatcagttattgacatactattaggagtaaagttctatggccaggtggcatattgattaaggacttggatttgagagccacagcagcaaagtctctccaagaagtgacatttgagctgagacccaaagagtgagttgattagaaggagcaagatagaggagcaagtagtattccaagtaggcaggctggcatgtgcaaaggccctgaggtggtgaagagcatgatcctgacaaagctgaaggaaggtctgattcccctttttcactgcactgtcattgaacccagtgccaagcacatagcaaaaatgagtgaacatttgcttagagatgactgatgaatcccaccctgtgtttttgtgggtcctactgcctgtgccattaacttctccatagagtacttatgtcttttacccccttatattttgaaaagttttgggctatatgtgcagatcagctcatacagtcttaaccctgaaggaaatatattatctcacctaataagcttagtggtaaggctggctcctgggttggtgggtgtcaagccagttgtctttctttgctcccactttcttttttcttttttggagacagggtctcactctgtaacccacactggagtgcagtggtacgatctcagctcactgcagcctcaccttccagtctcaagtgatcctcccacctcagtctcctaagtagctgggaccacgggtgcatgacaccacacccggctactttttgtatttttagtagagatggggtttcaccatttgccctagctggtctcagactcccaaagcgttgggattacaagcgtgagccactgtgcccagcctctttgctccctcttcttggtaaggtttttaggcaggttccctcacagaattcccaggatgctgcatggcagcaggagtggcagcctccctcatttagcccttcctgaaagagaaggttttttctctctttggagtggctggtataggtcacctgcctacctcagagtacagttgatcagggttgccatttgcaagatgatggagaccaggacttttctactgccatggggactaattataaaatcccttcagaaaatttgtcttaacagggttgagatttttgtaggatggagattaaaagtaattggtactatcacacagccagcactactgcttacagtctttggggcccaatgaggatgttttttttctctttttttgagacggagcttcgctcttgtcgcccaggctggagtgcagtggcatgatctcggttcactacaacctccgcctcctgggttcagcctcccgagtagctgggactacaggtacccgccaccacacctggctaactttttgtatttttagtagagatggggtttcaccatgttgggcaggctggtctcgaactcctgacctcaggtgatccacctgccttggcctcccaaagtgctgggattacaggcatgacccactgtgccctgccagatggtgtttttgtggttgttttatggtcacggttcaacgttttctttgcttggctgagaatagcttcacttcatggtcttccccatcctgcagtcccagatcagattgacaggtttctttcttctaacctaactccctgtgtcctcttttgttctccatgcacaggctgtcctttgttcaaaccagagctgatctaccagttggatcacagacaggagctatggatggctacaaaagacctctcccaaagctcctatccaggtaggagccaacagctgggaaggtgggggtcatggcagcttacacatggaaaagtgaacactgcctctgaattttgtgggcaatcttcttattgtggtctctctgggtgcttgggatccatggagcctctccccgcccgcccccccccacccgccttcagacagggtttcactctgtcactcaggctggagtacagtgatgtgatcatagctcactgcagcctcaacctcctgggctcaagggattctcccacctcagcctcccgggtagctgagactacaggcatatgcaccatgcctggctgagtttttaaaattttttatagagatggtcttgttatgttgctgaggctggtctcaaactcctgggttcaagctctcctcctgcctcagtgttcgaaaatgctgagccaccaagcctggcctcttacatcttaaatttaagtacttccaagttaggtcccagatgtatatatttcactaacgcataataaaaaattatggctaacatgtatttatttcttactcagtgccttgctctctgccgacgatagtatatgtagtgtttcacttcatcttcactatagtcttacaaggcagactctatttttggccctttttgtttgtttgtttccgagatggagcctcccactgttgccctggcaggagtgcgatggtgcagtcttggctcactacaacctccgtctcctgggttcaagtgattctcctgcctcagcctcctgagtagctgggattacaggcgtgcaccaccatgcccagctaatttttgtatttttagcacagacggggtttcaccatgttggccaggctggtctcaaactcctgacctcaggtgatctgcctgccttggcctcccaaagtgctgggattacaggtatgaatcactgtccctggcctttgttttttctataatgccatctctaataagcctttttgtgtattgtgttcgttccaggtgacaacacaaaacccaagaccacagagcctaccttttctcacctggccttgcctgaggaagtcttactccaggaacaactgacacaaggagcctcaaagaactcccaattagggcaatccaaggatcaggatgggccatctgaaatgcaagaagtccacttgaaaatagggataggcccccagcgggggaagctgctggagaaaatgagttctgaacgtgatggtttggggtcagatgatggtgtatgtacaaagattacacagaaacaagtttcaacagaaggtgatctctatgaatgtgattcacatggaccagttacagatgccttgattcgcgaagagaaaaattcctataaatgtgaggaatgcgggaaagtgtttaaaaagaatgccctccttgttcagcatgaacggattcacactcaagtgaagccctatgaatgcacagagtgtgggaaaacctttagcaagagcactcatcttcttcagcacctcatcatccacactggggagaagccctataagtgcatggagtgtgggaaggcttttaaccgcaggtcacacctcacacggcaccagcggattcacagtggagagaagccttataagtgcagtgaatgtggaaaggccttcacccaccgctccacttttgtcttgcatcacaggagccacactggagaaaaaccctttgtgtgcaaagagtgtggcaaagcctttcgagataggccaggtttcattcgacactacatcatccacacgggagagaagccctatgagtgcattgagtgtgggaaggccttcaaccgccggtcatacctcacgtggcaccaacagattcacactggagtgaaaccctttgaatgcaacgagtgtggaaaagctttttgcgagagtgcagacctcattcaacactacattatccacactggggagaagccctataagtgcatggagtgtgggaaggcgttcaaccgtaggtcacacctcaagcagcatcaacggattcacactggggagaagccttatgaatgcagtgaatgtggaaaggccttcacccactgctccacttttgtcttgcataaaaggacccacacaggagaaaaaccctatgaatgcaaagaatgtggaaaagcctttagtgatagggcagacctcattcgccacttcagcatccacactggagagaaaccctatgagtgcgtggagtgtggaaaggccttcaaccgcagctcacacctcacgaggcaccaacagattcacactggagagaaaccctatgaatgcatccagtgtgggaaagccttttgccggagcgcaaaccttattcgacactccatcattcacactggagagaagccgtatgaatgcagtgagtgtggaaaggcttttaatcgcggctcatccctcacacatcatcaaaggattcatactgggagaaaccctaccattgtaacagatgtgggaagaccttttatgactgcacagacttcagtcaacatccaggaacttttattagggaaagagtttttgaatatcaccactgaagaaaatctgtggtgaaagggaacatcttaccatctggccattcacactgaagagaaacttcataagcatcctctctttgagaaaacgtgtaatagatgatcatttgtcgtctaaacaatcaagttagaaattgaaccagcctggagtcttattctccacctgagaattcacccatgagagagacccagtggttgctatgcacttaggaaaactttcagccacatctttcttcttagtttacagtgaaatattatctcagggatattttttttttttttttgagacggagtctcgctctgtcgcccaggctggagtgcagtggcgggatctcggctcactgcaagctccgcctcccgggttcacgccattctcctgcctcagcctcccaagtagctgggactacaggcacccgccactacgcctggctaattttttgtatttttagtagagacggggtttcaccgttttagccgggatggtctcgatctcctgacctcgtgatccgcccgcctcagcctcccaaagtgctgggattacaggcgtgagccaccgcgcccggccatctcagggatatttaaacaaaggaagaggaaatatagggaagagaaagaaaccacagcttcttttagacttgtctgacaagcctatggcaattttgtcgtccctttgttattttatgtgggagagggaaatgtttcagaaacgaaagatctcatcccctttatttttctgtgtatgcattcactgctgcccagtgtcagaacagttatacaaacgagggcttgaaaacattttgtgaaaacttgcttagtcctgcaacgttctccactctcgaggtgcagaagcatacatctttataaaaaatatggaggcttgagttatgaaacacttttataaggagataaggatgtacatatgtttggacacattgtccacttcagatgcttgtttaaaaaaatgtttcaccatgtgtctttacccaatacacatactttttcttgatgtggatttactttttttttttttttttaagttttcctgggatagggatgatagtgtaattgttcatgcccacagtaatcctgggaatcttagttttttcctatgattgtggtttctcagcttctttacctctcctttgagttaggtccacctcagttttctaaaggtcaaattaaggcccccccaaaaatacagtatgtagctgaattcctttgaaagatcatgataaactcagaagaacaaacatagaaggaatgtcatttttaatctttttaaagagtgtgtgaaaattcactttaactggaattttaacaggcaagccggcatgcatatatgtagggatgtgtgactttcacagttgtcaccatggacttaggcttgattaaaatgctacacatttagagcgttttgtaattccttttttatatttttaagactagattttgagccatgtgatagttttacctcatattaaatatattgtacagaagtaaaaataatcatgtattcactttgaactcctcaaagccttttttatttatttacttatttacttacttggtttaggagcagaggtttaataggcaaaagaaagagaaaagagactagctctcttctgagaagagaggggtgtccaagtgggacttccctcctcagagccttttttttttttttttttttggagacagagttttgctcttgttgctcaggctggagttcagtggcacagtcttggctcactgcaacctctgcctcccgagttcaagcgattcttcttcagcctcccaagtagctgggattacaggcatgcgccaccacgcccagctaattttgtatttttaatagagatggggtttctgcatgttggtcaggctgatctcgaactcctgacaggtgatccacctgcctcggcctcccaaagtgctgggattacaggtgtgagccactgcgcccagcgctcacagccttttagtgaacacttgtatagttttctattgtaggcaaagccattttgtactgcattaattcatgtcattattttgaagacatctcttggtccttttttttttttaattgagatggagtctcgctctgttgcccaggctggagtgcagtggtgagatctcggctcactgcagccgcctccaccttccgggttcaagtgattttcctgcctcagcctcccaagtagctgggactacaggtttgtgccaccacacccagctaatttttgtatttttagtagagatggggtttcaccatgttggccaggatggtcttcatctcttaaccttgtgatctgcctggctcaaccttccaaagtgttgggattacaggcgtggccactacgcctggccctccttgtcctttttatgtcatgtctaagaactcctcaccaggttttctatcgtatttcctcctacaaattttatcttctacattggatctgattcatgttaagttaatttttgtattacagtatgaactttagtttcttttgttgttgcccatgaatttttttaagctccatttcttgaaaagactattctgcctctattgaattgcttttacaccttagcaaaaaattatttaagtatattcatgttggtctatttcttggttctctatgttattccattggtcttcgagcctaaacctatgccaataccactctattttgattactattgctatctactaaattttaaaatagggtaaacttattcctcactctttattctttttaaaaattgatttggggccaggcatggtggctcacgcctgtaatcccaacactttcggaggccaaggtgggcagattacatgaggtcaggagttcaagacctgcctggccaatatgatgaaaactcgtctctatttaaaaaatacaaaacctagccaggcaaggttgcaggcgcctgtagtcccagctactcgggaggctgaggcagaagaattgtttgaacccgggaggtggaagttgcagtgagctgagatggtgccactacactccagcctgggtgacagagtgagaccctgtctcaaaaaataaataaaaaataaaaattgatttggctttcatatcaattgtttcctttggctttgtatatacattttattgcatgtttgtctctatgaaatatgttgctgggattttgatataaattgccttaaatctaaagatcgttttggtgggaattgacatcttgttgagtcttgcagttcatgaatatggtacgtccctctgtttattgaggtcctcgttgatttatttcataagggttttgtaattttcagcttatagattatggacatattttaaaaatctagacagtttcttagagggccattatatgttgtattgagttttaaatttcagtttgcacttgatacttgcaattatagagaaatatataaattagaatttttatatgtattctgtgactttgctgaagtcagtagttccagcaacattttttaatagctttcttaggattttcttcataaatattaatgttattagcaaacatcaaacatcttacttctactttttttttttttttttgacactcttgttctgtcacctaagctggagtacagtggtgcgatcttggctcactgcaacctctgcctctcgggttcaaggaatttttaccctcagcctctcgagtagctgggattactagcacactccactatgcccagctaatatttgtgtattttgtagagatgaggtttcaccatgttgccagacgggtctcaaactcctgagctcaagtgagcctcctgcctcagcctcccaaagtgctggaattataggcatgagccactgctcctggcccaaacatcttatttcacctacccaatctatattacttttatttccttttcttgtgtttattgcactagctagaacttccagtgtgatgttgaatagaaatggtgaaagaggacatacttgcctttttcttgatgtttgggagaaagcattcagtgtagatcgttaaatataatacctgtagacttttatgtacatgttctttagaaagtttcccttctgagttgctgagggcttttattgtgaatgggcatgtaatttgccaaatgcttttcccccttcaattgatatgatcatgtaatttttcttctttagcctgttatgatggatggctttaactgattttagaatgttttgttgtttttttgagaccaagtctcactctttcgccaaggctggagtgcagcagtggagcaatctcagctcactgcaacctccgcctcccaggttcaagcaattctcttgcctcagcctcccaagtagctgggactacaggcgtgcaccaccatgcccagctaatttttgtatttttagtagagatggggtttcaccatgttggccaggctagtctcgaactcccaacctcaagggatccgcccacctcggcctcccaaagtactggaattacaggcatgagctaccatgcctggccgctttttgaatgtaggccagccttgcactcctgggataaaccccaccaggtcatggaatatgattttttttttttttttgagacgaagtctctgtcacccaggctggagtacagtggcacgatctcggctcactgcaacctccacttcccaggttcaagcgattcttctgcttcagcctcccgaatagcttggactactgtcatgtgccaccatgcctggctaattggaatatgatttcttttaattacaacattccatttgctagtattttattgagaaattttgtatctgaaatcatgagtattccatctggccaaatatgtggctggaatttcatcaaaagtggcagaggggttcccagaagggactgtttcaaaaagtcctgagataggacctgttgggattccaaagaaaggagcataaaacaccagggtaatcagttcaaatcattgttcggaggaactttcatacagggttgtgggggctgcagtgtgtccttgtgttggacagcaaacaaaaaaaaaagctctacttgtgtacgtctgcaatgagaagtttgggttatggagagtatatgagggcttaaggaatttggctcagatccagggccagtttctacatgtttagcaacatgtttgatctctcagtgtttcgggcaacaatgtaactgtcagtgcctgggcattccaatccctagcttacgtttaagcctgcaggggaagacatgcacttggtccagggtcacagagctgtcaaggcaccttgcacttctaggccaggacacagaaaggggagttggggaccactacaatgagcaatgttggtcagtagttttatttgtttgttttcactttatctgattttggtgtttgactaatactggcctcccaaaatcaactgggaatttttcctccagtgccaccccctttttatttgcatgacattttgtagaattggtgttgtttctttaagtattcggtagaattttttggtgaaaccatttaagtctggaggtttctcttgtggaaggtttgaattacgtagtcattcaacttaataggtactcaaactatttcatattgggtgggttttgatagattattatttttgaggaattgttccatttcatctaagttttgtaacttaaatttgtggagttatttatttgaagtattcccttattattcccttcatgacagaaggttctatagttgtatcctttgttttattcctaatagtggttatgtgtgtcttctttatctttgttaatcttcttagatgtttataaattttattgactatttcaaagaaccagctttctgtgtcattgattttctatgtgttctgactttgatttctattctgatcattattattttctttttctacttgttttggttgtatattgctgtttgtagattcttgaggtgggagcttagattatcattagagactttattctaacataagcatttagttttataagctaaactcagcactgtttgagctccatcttacattttcctatattgtaattatattttcattcagcttaactatttctcgattccatttaagaaattatctgtgacacatgggttatttagaagtgtgctcttttggccgagcacggtggctcacgcctgtaaccccagcactttgggaggctgaggcgggcagatcatgaggtcaagagatggagaccatcctggccaacatggtgaaaccccatctctactaaaaatacaaaaattagctggcgtggtggcgggctcctgtaatcccaggtactcggaaggctgaggcagaagaatcgcttgaactcgggaggcggagggtgcagtgagctgagatcgcaccactgcactccagcctggcggcagggcaagactctgtctcaaaaaaaaaaagaaaaagaaaagtgtgctctttcatttccaagtatttaaaatactcctgttatcatgttgttatttttagtttcacatttggcctgagcacaagctcgtttaatttcaaaacatttatatttgttgaagtttgttttggggccataaacaaaaagcccataaacaacatgcttgtggagtattccgtaggtacttgtaaaaaggatgtatattctggtgttgtttggtaaaatattctgtgtttatggatcctgttgattaatgatgttattcagactttctatattttcctcattttttgtctaatattttgctaaaagaaggatgttaaagtccccaacagtaattgtggaattttttatttcttctttcagttctatcactttttgcttcatatatttgaatgttctcttgtttggtgtatatgcatttatgattattatatcttcttcatgtattgtccctcttatcattatgaaactttcctctttgtccatgttcattttctgagctctgaagtatactttgtcttacactaatacaaggtataattgctgcatttttaaaagttaatgtttgcatggcttatctttgtccatttcttttattttcaacctgcctacatcattatatttgaagtaaattttatgtagacaacatgtagttgggtcctgctctttttctttttcactttgaaaatctctcttagttggtatattaaaccatttatctttaaggtggctattgatatgttgcactaaatatatcatttttttcctttgcttttcctttttttttttcccccttgagacagagtcttgctctgttgcccaggctccagtacagtggcatgatctcggctcactgcaacctccacttcccgggttcaagcgattctcctacctcagcctcctgagtagctgggattacaggcatgtgccaccacgcctggctaatttttgtatttttttagtagagacggggtttcgccatgttggccgggcaggtctcgaactcctgacctcaggtgatctaccacctcggcctcccaaagtgctgggtttacaggcgtgagccaccatgcctggcctctttttccttttttttctttttttgtttctgtgttggtttggtttttggcatattttattttcttgcctttttttttggatacctgtacaattttaagaattcagttttggtttgtctgtagtgttttttaaatttttaaattttattttaacagcaagctctaacatagtgcttttttaagtgtatttcttggtataattattttagtggttactttatgtattaaaatgtatttatgtaacttaatcacaatctgctggttgtcaacattatagcaatttgagtgatttgtagaaatgttacttttattaggtccctttatactcattattctttttttttttttttttttttgagacggagtctcgctctgtcgccaggctggagtgcagtggtgcagtctcggctcactgcaacctccacctcccagattcaagcgattctcctgcctcagcctttcagtaactgggactacaggcgcttgccaccatgcctagctaatttttgtatttttagtagaaatggggtttcatcacgttggcctgatctcctgacctcgtgatccacccgcctcaacctcccaaagtgctgggattacaggcgtgagccactgcgcccggccccattattcttttaatacaattgtcttgagcatttactctccatgtgctgagcaccatattgaatgatgttataatttctgcttctgttgtcaaacctatttatttaaaatctctagtcctatgtcataatgtcagactttgttgaaaggacaagaatagtctctttgcctgtatttcttaccctttccattgttcttctatcttgaagcctccttctaccattttctttgcatgtggagaacttcctgtagccattttttttagaataagtctacctgtgacaaatattctttgttttcttttatctgagaatatctttatttcttaattcttgaaggaaatttttgtgtggtataggattcatggttgacaagtcttttcttttggaaaacttgaaaaacattgcagcacttccctgtggcctctggttttaaatgagaaatctgcttccatttgaactgttcttcttctttactaatgtgtcatttctctctaactgcttttaaaatgtgtgtctttagttttcagaaatgtgattatgatgtgtcctagtgtggaatttttttatgtttatcctgttgcgtgattgttcggtttttcaagtcttcaggtgtatggcttctgccaaatctgggaaatgtttggcctttatttcttcaaatattttcattcccactcccttccccctttttgcaactcagaaaaactgagtgaggtctttattttaattgttccaaatgtcaggcctctattttaattgtttcaaatgttaggtctctattttacctgttccaaatgtccttgaagcgctcttcttttaagttttgtgaccttgatctgtctttggagagggctgcagggagtggagtgctgacgactctcactgcttgccttgagatggcgctatcctggaagtgaaagtataatgccaactagcattgccttggactgcctccttctgccttgctactggctaggggtgggagtttggctctcctgctgtgcaaagggaaggagcatgtagactttttaaatcaggttgcttaaaagtgggccaaaggggaggtggggcttttaaactggcaacaatcaaatgtcacatatcaaaaatggagtcagaggccaggcacggtggctcacgcctgtaatcccagcactttgggaggccgagcagggaggattgcctcaggccaggagttcaagacaagcgtggccaacatagcgaaaccgtgtctctactaaaaatacaaaaaattagccggtcatggtggcgcatgcctgtaattccagctactcaggaggctgaagcacaagaatcgcttgaaccctggaggcggaggttgcagagagccaagaatgtgccactgcactccagccggggcaacagagtgagactctgtctaaaaaacaacaacaaaaaaaaaaacccataaaacaaaaatggaatcagactgtcatacttttggttggctgaaaaataggaaaaaaaacaaacccagccttatttatagatggattatcttgatgtttggagtaagctaaaaatagattgatacatcacatcctgccttgagtggctgtgatgtggccagggatgtagagaaatcctctccatggcctgaagctggaccagtacaagtgggcgttacctttgtgctgggagaagtgccctgaggtaaagatacatgtgtgcttttgtgggaaatggtttgtctcgttgttcagaagtgctgcagatcagtgacaagtatatatagaacaagggcatgaaattactggagtgggcaaagtgagtggatatttatgtcccacgtcagtgcctataaaaagaaacccactgcagaagaggggaggggaacctagtagttaaggttaaccaggctcagtcctcagccatcccagtccttgcactctagggatataaaatatagtcaccaaggtgttaggggacggagggttttttttgtttgttattgttttttgtttgtttgtttgttttgagacggagtctcactctgtcaccaggctggagtgcagtggcacgatctcagctcactacaacctccacctcccgagttcaagcaattctcctgcctcagcctcctgagtagctgggattataggcgcttgcaaccatgcccagctaatttttgtatttttagtagagacggggtttcaccatgttggccaggatggtctcgatctcttgacctcatgatccacccacctcagcctcccaaaatgctgggattacaggcgtgagccactgcagccagccaggaatggaggttttaaaagggcccaacaacatggcatcctgctgaccacaactaaaatagctccgctccttacctactatttacgaagaccaacactaagacagtatatggtgtaatccctacaagagaacagcctgccccttggtgacatgtttacgtcagacctttttcctcccagacagtgcattgattcttatttaatggcattgctgctttttctggatatgacattaacttccctgccaacagagcctttgctgaaaccattataagggagtgtattgacttcttcatataccaacactggctggtcattaccttaaagatccaatcacaatgtagacacaaatggattagggtttgtagctaacgctgttgatgtcttgttctgtacaacccatcttcctacaagtcttatcaaatgacctctgggaggatgtcagcctgctcactaataaagtttttgttttgttttgttttttgagacagagtctggctctgtcccccaggctgtagggtaggagtgcagtggtgtgatctcggctcactgcagccttcgcctcctgggttcaagtgattctcatgcctcagccttcttagtagctgagattacaggtgtccaccaccacacccggctaatttttgtatttttggtagagacagggtttcaccatgttggccaggctggtctcgaacccttgacctcaattgatccaccctcttcagcctcccaaagtgctgggattacaggtgtgagccactgtgcctggccactaataaagttttattgcgccccctcttccgtctcactgcctcattttcattcctgtgcatcctgagttcatatctcagataaactccctgtactccagtaatcatctcacagtttactgccatagaatatcaaaagtaagaagttctgttttcacattctttctattaatgaacacccaattttcacattctttcccctctcacttctgtagatcgttacttcatactcattttctgaaatgtcttcctctttttgccccattctgtgggactcaaccatgcaaagctctaaacctagattgaacattagtccaacgttttctgagctgacccaggctgtttggaagttctgggaaaaaccttaacccccatttccaccaccccacagacctcttcccatccctcagtgaactaaaatctctggaggatccagtttctcagatgcccagtatttttctggccttgccattgccatttttgggggaaatcacttatccacaccaattaaaggaatgtcagatgaagttttctgttagtcttcctaaattgtggcagccagtgtctccccatgagttgcgtgcaaacccccacatggctctgtacaactttctctttgcaaaattaatatttttagtatataaaatgatatgccagatgtatggttgtctttcctaaatctatacagccatccctatgttttcacttactctaaaggaagttcaaattttgcattgttttcttgcatgttttctttatatatcattccttttttttttttttttggacaggtctaggggaatatctaaggtgtagtcttgaattatctctaagtttaaatattcttctattaatttttttgcctttttttatttttgtggagaatgaggtcttgttatgttgcccaggcaggtcttgaactcctaggctcattctatcctcctgcctctgccctcctaagtgctaggattgcaagcatgagccatcatgttcagtcctattaatttttcttaaaaaagataatgaagtaaactttgcattcagtaatctcctgttaagaatatttttggtgaattttgatgaatacatgattttgtgatcacaaaccaccattaaagctgtgaaatatttccatcacaagaaaatattccttgatatagtcaaactgtctcccaaactccagctataaggcccattcatttaggtttttctctttttgccttttttagaatgtgaagtgaatggaatcatataatatgtggttttcagatattttcacttggcatatgattttgggatttattcattttatttcatattgtttcttatatagagtagtttattttgtggatatgctacaatttgttcatctgttcacctgttcgtgaacaattttccaagtttttggctgtcgtgaataggacgttcatgaatatttgctacagatatttggatggaaacattttaacttgtcttttgtaaataactaagagtagaattggtatatcatatggtatgtttatatttacctatataggaagctgtcaagttgttttccaaaatgactatcattttgcattctcatcaaaaatgtatgagagtccagtgctgcatctttgtcatcacttggtatttattgtcactttgaaacattttactaatttcagcaggtgtgttgcagtattttatttgggttttaagttgcattgctaaaatgactcatgatattgaatatcttttcatgtgttcattgttgatttgtatatctttagttatttgtccaaatcttttttttttttttttttttttgagacagaatcttgctctatctcccaggctagagtgcaatggtgcaatcttagctcactgaaacctctgtctcccaagttcaactgattctcatgcctcggcctcttgagtagctcggattacaggcacgcaccaccacgcccagctggtccaaatcttttttcaatttttaattgcttttttcttcttaacacgaaattacataactttgctttaattttctcctttttaaatgttctatattatagtcatttctcagttatatgttttgcaaattgttttttttttcagtctttgacttgccttttaattttcttagcagtgtttttggaagagtagatgtcttaaattctgatgtaataaaaatattttgtctttatgtttttttgtgtgtgtcctgtctaattagactttgcctactgcaatgttgcaaagctttgacttatgttttcttctaggcattttatatttttagatcttttatgtggtctgagacccttttttttttttttttttaacggaatctcgctctgccacacagactggagtgcaaaatgatacaatcttggctcactgcaacctctgcctcccaggttcaagcgattctcgtacctcagcctcctaagtagctgggactacaggcacatgccactatgcccagctaattttcgtatttttagtagagatggggttttgtcttattggtgaggctggtctccaactcctgacctcaaggtgatccacccacctcggcctcccaaagtgctgggattacaggcgtgagccactgagcccggcctgagttaacgtttatatatgatctgaggtaagggtttcacattaaattaaatgtgttttataacccaacaaatcactctggggacataaccattaggaatgagggctttcttacaccaaaatacatgtacacaaagatttataacaatttcacaataatcaacaactataaataattcaaatgacagtcatctgtaagatatttaagtaaattgtgaaacagtcataaagtggaagaaaacacacagattaaaactgttacttttgtccaacaagatgaatgaattttccaggaaggaatacttgagttggggcttgtggaagccccaacctgtttgtagtttggggttgccatctgcctcacagagcaaagtgaagggtttggatttggggaacacaaaattgtgttctcctatgaaaaacctttctgtaatatagttggccgtggtatttgccaggaatgaaaggtcagggttggagacctcatgagtctgggttttcatttgaggttaagagaaaaggtagtgattataatcagaaaatctagagtgggtgtaattacctccagaactcactactgttagcctgggttttatggtagttatggaagtggattaactactaatgataaaaaatatagtctcctccacctcagaaaatctcgagtggcagtgacacgccaaacacacagtagcaaatacagtagaattttattgatacttttttaaccagacaaacctcataaatggtgattttttaaaaaaacagaataatgttcacatttttgcagcattaactgagagaaggcaaatttgtgcctgagagggaggaaatgttctcttcatttgcagttctaggaattacatgggaaacacatgtaggtagtcttcaagctataaatttaagatttgtttacttaatctataggtttatacatgtatgagaaatgggaaaaaagaataaatgtaatacattaaaaccaatacagtgaatctccacaccctccaatgaaaatatggaacaaaatctcagcatgcccagcatgagtctgccagattgcaaattccatccaacgcttcagaggatgctattatcaagatttcttcatagtttgacactttaaatatgtgtcaataatgatagctattatattatggcctgattttgaaatttatattaatggaatcatgcttgtagagatgttttttcatattaccgggatatatttttctgttatttttaaagatgtttgaaatgaatgtatatctttctaattatcatcctttgttgataacatgtacattaaatgggattgctttaaaattcattgaatctcatgagaatatgtagaaatgacattagttttggtacattgtaaagcaaaacttcaggttgaatatcctatgataatttaaaaccacaaaattatactattaataatagagcttgagcactttaagggaccatagagactcctttaatgtaatggtgagaatacagaggtacagagaagtcaggtgactagccgaagcccacactctaagataaaggccgaccccatctatttttcctaacttgtcagaatactgtaaattatactgcttttaaaagacctatgaaattggtgttggagatgccatcttgcaaataaaatattctcaaattttgattatctttgttttctttatgcatgggttacttagcgttttgtgacttgatatgcaaccacagcttaaaaaatttccagttatcttctatttttgatctgtaccctgattgaattattttatttcattttacacaagtttaaagagatttttaattgtcctagctattctcagttttgtttgtactctgtgctaaaacatgctgcaattggtgtctgttatgttatatggatttatcaggccaaatgtgttcatcatggtatgtgaatccaacagaactgtaccaatgttatgcctgcctttttgatattattactgagataacgaatatcaaagcagactggtttgtttagagatttaaccctttattctcattatactaaaattgttttatgtaatttgaattcatgtttaaaattgtaaagtatgttttcctgttgatattttctcccttatttctatttgtccgatacaaatgtgcatttttttgtgtgtgtttgtgtttaataattacaggtatgtattttctagacctcgatttaatatatttctatgacattataccttagatgtgtaagctatgaactaattattactggatatttttaactcatcaaaaattactgcctacttattcaataatttattccatgttcttttcttgtgatagctaatatatttgggcttaaatgcatcttcttattttgtgcttatcttttcttcagttttgtttcttgtgctttcttttaaaaacatgtatagattattaatattcttaattttccttttagtttggaatgtatatactcattttgttagtctttaagctgaaaattataacacatgtatttaacacatcagggtatagagttattaatacctttaccctcctcttggataatataaggcatgttatcatgtagtggtattgaggcatcgttaattctattgttctactcaacaaggggatattgttcatgttttatacagataatgaataattgtattgatccgcagatgcattccttatatcacgcagatctctcacctggaatcactttttttttgccttaaatataaccttttgggttacctttttaactaaaattttcattttttacctcatatggtcttattttatactgcttcttgaaaaacactattgttgtgaatagaaatctaggtttgcacttatttcttcagtaacttcactgtatccttccactacatccatgagtcactatatactggatgtgagtggagacaatttatattgtgactatagtcttcctgtgctacagaaacaaaatttgatggcggtggtgttttgttttgttttgtttttgtttttgcttttgttttgcttttgagacagagttttgctcttgtcgcccaggctggaatgcaatggcagaatctcggctcactgcaacttccacctcccaggttcaagcgattctcctgcctcagcctcccaagtagctgggattacaggcacccaacaccatgccctgctaatttttgtatttttagtagagacggggtttcaccatgttggccaggctggtcttgaactcctgacctcaagtgatccacccacctcggcctctcaaagtgctgggattacaggcatgagccactgtactcagcggtgatggtggtttttttgtgttttgtttttgtttttggagatggagtttcgttcttattgcccaggctggagtgcaatggtgcgatctccgctcaacgaaacctccgcctcccgggtccaagcaattctcccgcctcagcttcccgactagcttgggttacaggcatatgccaccaggcctggctaattttgtatttctagacacggggtttctccatgttggtcaggctggtcttgaactcccaacctcaggtgatctgcccgcctcggcctcccaaagtgctgggattacaggcgtgagccgccacgcccagctggtgatgttttgatgaggacaggacctgacttatgtctcttagtttcaggcaggaccctctcataatcaagtttgtgattggatctacctgccttgagtgccagaagggagaacgagaggtagagaggcaggtttcggttactgtgaatgaaagatgaataaggaagtgtcctctaaagtcacaaacttgaaacgggatgaattctactctccacttaggtctgagagcaattagtcctgctatttccaaaattagaatcttctttttaaaattttagttttagagacagggtctcgctctgttgctcgggctagagtacagtggcgggatcatagcacatagcagctttgaactcctagactcaagccattctcctgtctcagcctcccgaataactgggactacagtccaaaaatttgaatcttgtggcctgtaataacgagtctcttgagcagcatgcctacctatggttttaggcacactttttctgaactgttgaagaaataacccaaatgtgtgctttcatgtaaaatctttaatcatacctatgaggctagctgctgagttagggtgttattgtattttatgttttgataaatgccaaagatcctgctgaggcttagcctcccacagagtatatttacttcttttcatattttccatgtatctcttttattgattcatatcttgatagcatcatgtgtcttatttcactctatgtgaattgaagatagttttcagtcatctatattgatagttctgtaaatattcagttgtactaaatataagcaccccatatttgtatttattagaccagaattatcaatcttggcatgagaattcactagaactttaacaattttatattgtttctactaattgctgagataatggacataaaaatgctcagcatattcatagatttatgtctttatccttttacaaattgttgctttatgtaatacaagtcagcattatacattacatagagttcaaaatataatttcttggtgatcatttctttctttttttgttttctttctttctttctttctttttttttttgtttttgagatggagtttagctcttgtcgcccaggctggagtgctatggcgtgatctctcggctcactgcaacctccgcctgccgggttcaagcgattctctcacctcagcctcctgagtagctgggactacaggtgcccgccaccacgcccagctaattttgtatttttagtagagacggggtttcaccatgttggccaggctggtcttgaactcctgattcacctgccttgacctgccaaagtgctgggattacaggcatgagccactgcacttggccagtgatcgtttctttaatactgatattttctgatataaattttcattttcatgtgttaattctttgttgtattaaatatatttttcccaaagctgtttcatatagttttctaatattatactctacaagtgtttcttgtacccatactactgttttttgtttttgttctttatgagagacggtcttactgtctctcccaggccggagtgctgtgacaccatcagaactctgtgcagccttggctcaagtcatcatcctggctcagcctcctgagtagctgggattacaggcttgtgccaccacaccctgctattactttttttttttttttttttttttttttggtagagatggggccttgttacgtggctcaggctgatctattaatagaattcctgacctcaagcagttctcttgcttcagcctcccacattgcaggaattataggcatgagcctctgtgcctggccttttggaaatttttaacacatcaaaacttactaagtgctaatttaagaatttattccatactcatttcatgagatagctgatatatttgggtttatatacatcctctggttgtgtgtgtgcttttctttgccttacttattgtgtgtactttattttttgtaatgttttctttacatttacattttctttaaatttgtaagatatatactctgattcagttaatgtttaagctttaaaacagttatttaatacattatagagttaatgtatttgctctcctcaagaaatataagaaacttatatgttagttaatttgcccatatgagtttatatactattgaggatatgcatggtaattccaccattctgtttccagaagtattaatattttattttattttttattttaatttttatttatttatttattttgagatgcagtctcactctgttgcctaggctggagtgcagtggcacagtcttggctcactgcaacctccgcttcccgggttcaagtgattctcctgcctcagccttctgagtagctgggattacaggcgcccaccaccacgcctggctaatttttgtatttttagtagaaacagggtttcaccatgttggacaggctggtctcgaactcctgagctcgtgatccgcctgccttggcctcccaaagtgctgagattacaggcgtgagccaccgcgcccaacagtattaatattttatacagataatgagtggtctcattaatccatagatgcactcctctctcagatcctcatttcttctatcatcacagaccatcacctgggatcactttccttcaaccttaagaaggatcttaaaagtgttattttatgccagttatttttatccattaaatttctcattttgggcttcaaatagtcttatttcagtttttcttagccagtgcatttgtcgtgcatagaaatctgctggcagttatatctgtaactgactccgtatgttattccatgtgttcctgacacctaaatttatattggctttgagtggagacagataatttatattatacatatatataattatgtatgtgtgtatataaactacatgtgtatatatatataaatgctgtgtgtatgtgtgtatatatattttttctcaaagatatgaattatttctatgtcatctcataaaataaaccaggttataaaattttaactacagtgactcttaagtggacagtggagttaaaaattatgaagagcaattagtcttgatagttctgtgttttgaatcatacagcctataagaatgtgtcttctggacgatagacctacctgtagtttatgaaaccctcttgcatgtgatttttttcaattaaatgagtctattgatatattggtgtgcttttgtgcaaaaattataaccattaggggctcccacctgtaatcccagcactttggaagactgaggcagttggatcacctgaggtcaggagttcgagaccagcctgaccaacacggagaaaccccatctctactaaaaatacaaaattagccgggcatggtggcggatgcttgtaatcccagctactcgggaggccgaggcaggagaatcgcttgaacctgggagggagaggttgcagtgagctgagatcgtgccattgcacttaagcctgggcaacaagagtgaaactctgtctcaaaaaaaaattataactattatctatgatgctatttgatgagtgagggaataattgtacttttttctttttttttcaaaatcacactgatcctgaaaaggtggatctttgatttatcttcctaaagcagtgtatgtgagaaccttgtgttgaggaagactgataacagcttgtatgtatttagcacgatgtgccaggcctggtgttaagtactttttacctcacttcccatattcctaatgaggttggttgtagtgtttttcatcttactgatttttttttgtttgtttttgttttgttttgtttttggctaatgactttaaaagacctccagttcttgaacttcagctagggtcccatccccagagtttatcagaaggtataggttgggtccaagaattcacaggttttttaagttcatagtgaagctgatgctgtaaaactacatatcaaattgggaagcaatgaattagaagaggctcatgttttcgtcatgttacatgtaagttcctccttcacttttcgccatgaataaaagttccctgtggcctcaccagaagcagatacgggcaccatgcttcctgtacagccagcagaaaggtagctaattacatctcttttctttatatgttagaaaaattagaaggacattcaatgttttacaaaaaggcccacaaacgaaatacagacaacgttcaatttattaatacgtttcaatccccaaatctgagagaggtgaagcaggtttcccagggcctcagaagcaggattgaagaatgggtcccttgctggcgacttcagtggcgtggcattgtcccaggtggccatggaaatcagggtgcataccctttaaaagcagctgtggcctccgagatatcgttttcccagtcttttctccccctccctgcacgacgcctcttggcagacatccgggagaacccgaaaggcgctcgttgcctggttggatgcagggtacaaactacgttacccagaaatctgtgcccagctcattgttagccggcgtgcagccaatgacagcccagaaactgggcgtttcctgctgctctgggctgcaggggcgagacttctggcgtcgccgtcgtgacgtatttttcctatgcccggtccgtgcattctggttgtgaaggctgagttctagagatcgggtcggctttctacgcggctctcgtggaacctagcaaagaaagacagtgaagactgcaggaccttccttcgcgcttttgttacaatccatgacccctgtcgtgggacgggcggcctctcgcggaggtgtctgccggggctgggctcttaccgaggcctccacacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcaggtgagtgggggcatccctcaagcgcaccccggcctggttggtgtgtcctgggatgttcgctctcatcgcgcacttcagggtgctcactccgtcgcattatgtggaggggttccgctcccctcatcagtggcataaggtgtggaacggactcgaaggcgcaggggcagttcgtacaaatgcatgcatggagaggagaatgagtttggggagttccgggaactctctgtgcctggtgagaacagggactagggggtcagaggtaggcctggaatggccgcccgaggagctggtcctctcttctgagggtgctgggagtcatgcaaggtttggtacagagaagggaggtcctctgacgcagttcttaaaaggctccctctggctgcagagtgggtagactagggattatagggtagacggggagatcaagatgaagtctactgaaatagtccaggtgagcgttgatggtctgggccagagtggtggcagcagaggttagagaatgtatgggttttgggttttgtatgtattttataaggaaggctgaccagattctctgatgagacatagtgatgatatcctgggattcttcacatgactgtcttcacttgagacagggggcagtgaatggaggtcatttctagtttagtgtcctgaatccaggccatgagttgtatggagttatgtggagaagtccccacctggcgaccaatgggatgagtactgcaaaagtatatcagacctaggaacaggtacgctcaaatgcttgtaggattgagtttggagcgctcagggaatctcaggtcttaattacctttgttggaaacaggtatcagaggaaggagttaggcaggaatggctggccgaggtgtcttgagtgtggtaaaagtcgtgggagatttggagcagaggagggagatgatctgactcagattttaacatgctctctctggctttcaggttgagaacagactgtgagcatgagggagcagctactgcagtagtgttgatggtgtctggtctagaggtgtggctgtggaggtgagagaagttggtaaattttctgttttttaaagtagggtgattggattttttgatgcgaaaggtgaaagagaggagagtcgtggatgaccctaaggttggtttgtttttgctgtagctggtaaaattatgaaaatgccatcaactgagatagagaagttggcagcaggtatgatttttagtggttatatcaggagttaggctttggtcatgtttaggttaagaggtctcagttgtcatcttagttgaggcctcaggaaaacacacaggtttttagttctggggaagggttctgttgaagaagttgaaaaaaatggtggccagtgtgtggagtgggatggggtatcttcaaatcatggtggtaatgctgttattcagtaagaaagttgaaactggacactgagagaaaactgggtctgttgcttaggcacctggacggcagtggtggatagtgtgaagacgcgagcgcttcctggacactgcttgcagagtggcatgggggatgagggatgtcatggaggtgcatatggcatgggccagtggcggtggggatctcagatgtgaggaaggtgtagtccaaagagtaatgagcacgttgggaggagtgtgaactgatgcccttaagactctagtattggcagctcatgggagaagatggagctgaagtttggttgtgtttagaggcatcgtctggacaacaccaggagaactggttggtaggcgagtatttgggacccttcatgccagacccagagttgagacagcatctgtctgcacacttgcctggttctgctctgggctggacacagtggtgagagggacatgaggagagagcagacactagtggtgccaaggtctgttatctcctcttagttgggaggctggggaggcgagggactagagagtgggtgtgtgagtgtgtagactggggaggagggggttctggggagagatgctgactgtggactcagctgtacttatcatggcagagttgtgtgaccttcgaggatgtgttcgtgtacttctctcgggaggagtgggaactccttgaggaggcacagagattcctgtaccgtgatgtgatgctggagaactttgcacttgtggctacactaggtaagtctgtgttttagttatctaatgctacatggcaaattatcccaaagcttagtaactgcaaacaataaaaatcaattatctctccagtttcagtgcattggtaatctggttagagcattttttgttgtttattattttgagggttttttttttgttttttgttttttgttttttcagagagtcttactctgtcacccaggctacagtgcagtgttgtgatcatggttcactgcagcctcaaattcttgggctcaagtgatcccccccacctcaccctcctgagtagctgggactataggtgcatgccaccacgcccggctattttactttttgtagagataaggtcttgctacgttgcccaggctggtctagagctcctgacctcaagcgatccttcctccttggcctcccaaagtgctgggattacaggcttgagccagtgtgcccagcctgatcacaccttcttatgcaggtgcttttggctctcatgaagttttaatcaagctctcagccagtgttgtggtcttacctgagaagaatccacttacaagctcactcacattgctttttgcaagatttagtttcttgtggcttgttggactgtgagcactgttccttgctggctgttggccaaagtcctccctcaggtggcctgtctgtattgtaccttatgacacagaagctaacttctctttgagcaagtgaccaaaagaatgttcaagatggaagcccaggattgtaacctaatcttgaaagtgtcatttcattatttttgccatattctattccttggaaataagtaagtccatccagcttacaatcaagtgaggaggcttacacaggggcaagagtaccaagaggtagggatcactgggaccatctcagaggctgtgttccacaggcctttacacccactccggtgtccttggtggggtttgagtcttcttctcttccccatgggccactctttctgtccatccagatccatgactcttctccttcccttctttgtttcccagagtaggtgctgtgggttctagggctggctgtgttcagtgtttctgccttcactgggtaatctgaacatctgttgccctagagctttgcaggaaaaggttaggattcgggagtttttcagtctgctaagcagattctacacagctcaggtgcccactgcctgagtccgtgtcatgatctttgcacctctttgtcctagattctgccctcatcctctggctgacatttcctggggcctgactgtgccaggaatttcaggggctgacacagtcacttcttgtggtgattacagggctgtcctggtacatccgccttggagagtattttttctaaacattctattttctctgtggagtgggtctacctgcgccactcacctgccctttgtttgcgttacagctttcattttcccagtcccatgcagttgcgcagttggagggggcagaaaaccttgggtgcctgacagggcagacatcactgcagccacagtaaaggagacctacagagggcatggccctgctgaatgggagctggaagagggtatctgttatggttgggttcaaatcgaaccttcaacttgttttgtgtttgtcagtgttttgttgccaaggcccatagtgattcttcacatctactttactttcctcattcttggcactttttccatttgtcatttctcacgtgtcttccatcctttgggtgttttcccacttttctggcctccgtgtttcaattgctctcttcaacactagcttactttaatgtgtcatgagttctgcacattaaatagtccgtgagaatgagctacttatttggagtcagattttcgtgggcatggacatacccatctgcacagagctcacctgacaccagcggccaaggccctgctgaaactctcttgcagaggaatcaggtagaggcttcacctatactccctatactctatgccattgtttttaggtctttacctcatagtcagggttcctccattctgtgaggccctatactgacaaccagcccttctttacactgatcctggccctcttgtcctgccaacaagccagtggactcgcactggtgttagacacacatttgtgatggggctgctgcctcccaccaaagtcagcatgcacttcaccagctcttttttgctttcaggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgttcagcatcagagagttcacactggagaaagatcttatgactgcagtgaatgtggaaaagcctacagcagaagctcccaccttgttcagcaccagagaattcacacaggagaaaggccttataagtgcaacaaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagatcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaatttttgtgcctaactttgtggcctggctgccaggatttcctgtgagcccagtgaggagggcatagttggtgcgaaaatctcctgtgcttgtggaagcaacataagttgggtcccttaactgtcacgtactccccagcactgttgagggattgctgtcttctgtacctgtacaggatcaagtccctgatatccagaaccccataggcaagtaacattgactgtaagacctctgtagggcaatgtgaaaatcatgattgctacagaagcactgagataatggagtggggatgactgtggcaaacaaaaggagattcgaacattctagaggggcatccacaagtctcggtgcagttatgatggtgtgggatgggagtgcatagaaattctcaggaccttcagacatctgtatctcctgtggccaaggccactgtcagaggaaataatctaaatgtttgtggattcctgtgtctccctgggcagttgacctgcacagacaggaacctcagcagtgacagaagagagatccagggatgggtcttctctgacccagccagcattccgagtgactgaggtggatgtggacatcattgcttaccaatttttaccaacattgaggcagggctcactctcctaaattgtagggagaggaatatggtaaagccaaaatagttgacagatctaactttcctagtggaacagtatatatagattttaatgaggaacatttatttaatagctttatggaggtatgattaacatgcaataaactgcaaatatgtaaagtgtaaaatgtgctgtttcagcatgtgtgtacacctatgaaaccaccacagtcaagatatccaacacaacaaaagattgtccctttataatcctcaatttttccttatcttgttttccacaattcacaagcaacagcaagcattttctataattttataaatgaaaccatatggtgtgtactttttagggggtggggctctggctttttcagtaaacataactattttaaggttaatccattatcttgttgcatgaatcaattgtttgctcatttgtattgctgcgtagtatttcagtatttcattgtataccacaatttttcttctttgtcaacttaattgttatggatgtttgggtaactttcagtttttggctattacaaataaacctctgaagatttgtgtgcaaattatggctgaatgatattccattctataaatacacctcagtttctttatccatttacttattgaaggacggttgctttcaagttttggcagttatgaataaacctactacatatttgtatagtttttctgtggagatgttttcaactcatttggatatgtgccaaggagtgcaattttctctgtcatatagcatgtttagtcttgtaagaaactgccaagctgtcttccaaagcggctgcaccatttattttatttatatatattttttgagacagagtctccactctgtcacccaggctggagtgcagtggtatgatcttggttcactgcaacctccacctattttagtagacatgggtttttaccatgttggccaggctggtctcaaactcctgacctcaagtgatcaccctcctcggcctcccaaagtgctgggataacgggggtgagccactgcaacgggctgtggctgtaccatttttgcatccaactaacaatgattgaacattcctcttgcatctcatcctaatcagcatttggcattttcagtattttggattttaaaatgccattcaaataggtgtgtagtggtatgccattgttgcttttatttgcaattccctaataacacacaataagtatcttttttaaaggcagggttgttttgttttgttttgaaatggagtcttgctctgttgcccaggctggagtacagtggcatgatttcggctcactgcaacctccacctcccgggttcaagcgattctcccaccttagccttccaagcagctgggactacaggcacccgccaccatgcccagctaatttttgtatttttagcagaaatggggtttcgccatgttggccaggctggtctcgaactcctgacctcaggtgatctgtctgcctcggcctcccaaggtgctgggattacaggtgtgagtcactgcgcccagcctggctggggtttttttatgtgagtttcacacacctctgagtaagtggcttgcagacagagaagttaacaactttggctgttagcttgaacctgtgatttatgaataccaaaaagacaaatacagaatctaaggaaacacataacagtcctgtatacacacagcagctggcagccctattcccggtgtgtcccatatacctaccattgacctgaaacccagtttgtacgtgctcattgaacattttgtagagcagtaaatacacatcatcacacagattgcctactcatttttatttttatttttcgagacggagtcttgcactgtcacccaggctggagtgcagtggcgcgatctctgctcactgcaacttccacctcctgggttcaagcgattctcctgcctcagcctcccaagtagcttggattacaggcacccgccaccatgcccagataatttttgtatttttagtagagacagggtttcactatgttggccaggctggtcttgagctcctgacctcgtgatccgcccacctcggcctcccaaattgctgggattgcaggcgtgagccaccgcacccggccttcatttttattttttgacaagtgtttccatttgttatctctatccctccaaacagttaataagcgatgttttcaagtatgaaataagaaatacatataggagacagaagcataatgtgtccaggttccagcacagccagtctcaacttcattctttgacttctcagactcttgctcaaactctactgtaaccttgctttttccccccttcacatgtcacagagagatttctgtaggactatttctgccactagttttgaaataacataatcactgttagtccaaactgcaccatcctgtaagccccctgccatctcacagaccttggtcagagtgaagcattccacggagtgagggccttgagaaacatcctgcccaactgcctgactttcttatcacatcgttctgggaaaagatccaaggaaggtcactatcacatcctgccggataaaaggccaaactgcctcaggaacatcttacgcacatcctttggccgggtgctgtggctcacgcctgtaatcccagcaatttgggaggccgaggcgggcggatcacctgaggtcaggaattccagactggcctgaccaacatggtgaaaccctgtccctactaaaaatacaaaaaaattagccgggcgtggtggcacgcgcctgtaaagccaactactcgggaggcggagttcaagaatcgcttgaactccgggaggcggaggttgcagtgggccgagatcacgccattgcactcaaggctgggcgacaagagcgagactcctccaaaaacaaaaaaaaacccaccatcctcctgggcagcaagtcataccctcccgccgcgccccctgccccccacccctgacccctctcatccaggcctataattgccccagcctgtaagcagtgaggggttctggcactaagctagttctccccatcacaggtctcgtgctggacataaaacctgcattgctgtagagctgccaactctgcctttctttaaccctcgccttcccttcaaaacctaacagttattattaatagatttctgtaattttcatttcacaagtattttcacagataatttcaactccctgtaaaatgataactcacttctcaggaaggagataagatcatgaaagttcacagtttttattggggataatacgttccctgtgtacatatactccaactatggaatggcacaaaatgtcctgtcaggaaatggcatgtatcagtcactctcattttcagacaggattgagacttttaaaataaatgtaaaatatttcagacatgaagtaataagtattattagaataaaagcattgcactcttggtaggaacacaatcactgactctacagacagtaatgatgttttcttctggatccagaggcacagcgtcaccctttcaatctacgtcggtatctcctgtcttcttttgtgcaaattcccagccatgtagtctttctttgttctcttggaccaaccatattgaagcttaataaatagaagtcaaagtttaactgtatgtgtatttgaaaagcaacatatggctgagaggcatgagtagagacagagtgcctttgtggtatagtgtgtccctttggcggtgtagccgttgagaacttgctgtgcttcacaatccgatatcataggtccctcacatttctgtgagtatcctagaccttacttcaagaaaatctggttatgtcgcctttaagagcaacccaagccccgtcctgtccgtggagtccggcactctgtttaccagctcccctgacggtgccactgagcctctatccgccatataaggactgaccaacgctctaaggcaagtccagaagcggtgtcgaaacttcataacccagaagacactgcggttctcggcagcgcgactgacccaatgaatgtgcaggaaggaacctttgcgtgcgtgcgtgcgtgcgtgcgtccgtcctcgtgctcgcgcatcgtaggagggcgggacttccggcgtcctcttgccgtggttgatttgattttctctggtgttttcactagttccggcctttggcgctctatgacgtcaccgaagtgacggagcggaaaagcgcgagaagcggcttggttccttgtacgcagaggcggtagtgacacaggcacaactgacagtggcagaagctcagctgacaaggactggggacggcggtgtccttgtcttgcctttgtcgcccccgcccctctcttccctggctggacttgcggagtccccgccgaagaacccgaggtgggtgccccgtcccaggcccccccccacctccgcccgacccctccttccagtgctgaagcccatagaaggggccctgcaggtcaggccccttgtctcgaagagaggggcgttcctgtgtggggtccccgtatcagctggtttgatgcagcctcagagctcccttcggggatctcaggttcagagcatggaggtgctgccaagtgggccgcgtcggggagcccggagtgtgggttgtttctgcgggaaagagagggttttgtgaattttctcttggaatggcagcctgagcagccggtataaccatggaaggttgtcaagggaagaccagtgggaggggcaggtccagagttagaacgagcaggatggggaattgacacagagagacccagaagaggccactgcagtggatcccagaggctgcaccagagccgtggtataagagggacaatgtgatgggattctggatagacctggaagatagagccaacaggttttcctgccgtatcagatatgtctgtgagcaaaaatagggagtgaagggtcatttttttttttttgcccgaacatctgaaagaatgaagttggggaagtcagcagcatgagaagtaggtttcatggagaagatcatgggttggagtttggccagtgtgattctcaggcgtctcaagttgaaaatgtcacatgggtagggggacagaaaggtgtggagtctacagaggagaactggtgtagattcttcaaaagaatagagggtggccgggcgtggtggctcacgccggtaatcccagcactttgggaggccaaggcgagcggatcacaaggtcaggcgttcaagaccagcctgaccaacatggtgaaaccccgtctttagtaaaaatacaaaaattagccgggggtggtgacgcgcgcctgtaatcccagctattcgggaggctgaggcaggagaattgcctgaacccaggaggtggagattgcagtgagccaagatcgcgccattgcactccagcctgggcgacagagcgagattccgtgtcaaaaaaaggtgcggagcgcgggtctcttccgcggaaactgacattgcgtttccgttgtcggcctcccgctgcaggagccatatattgaagaccatgtctggaagcttctactttgtaattgttggtcaccatgataatccagtttttgaaatggagtttttgccagctgggaaggcagaatccaaagacgaccatcgtcatctgaaccagttcatagctcatgctgctctcgacctcgtagatgagaacatgtggctgtcgaacaacatgtacttgaaaactgtggacaagttcaacgagtggtttgtgtcagcatttgtcaccgcggggcatatgaggtttattatgcttcatgacataagacaagaagatggaataaagaacttctttactgatgtttatgatttatatataaaattttcaatgaatccattttatgaacccaattctcctattcgatcaagtgcatttgacagaaaagttcagtttcttgggaagaaacaccttttaagctgaatggagaaaattccaaaataaattatatcaccacaatggtgtatactcaggaatgtgtacattgtaaattacttgattaaatagcctggaaatcttttgtgtattctcagcttatctaaacttaatgaaatttcttttatatttaaaaatagtacattctgtctcatgtcacatatcagtagatcaattagtatttccttgtgaacaatgttatttataaagaactcattatcaataataattaatttctttcttttttttttttttttgagacggagttttgctcttgttgcccaggctggagtgcagtggcacagtctcgtctcactgcaccctccgcctcccaggttcaagcaattctgcctcagcctcccgagtagctgggattacaggctcccaccaccatgcctgcctaattttttttgtatttttagtagagacggagtttcgccatgttggtcaggctggtcttgaactcctgacctcgtgatctgcctgcctcggcctcccaaagtgctgggattacaggcatgagccaccactcccggccatgaaatatttttacttaaaaattgggaataagctttctttttctttctttctttcttttttttttttcttttgagatggagtctggctcctgttgtgcaggggctggagtgcagtggcacgatcttggctcactgcaacctccacctcccgggttcaagcaattctccttcttcagcctcccaagtagctaggattacaggcatgcaccaccacgcctggctaatttttgtatttttagtaaagacgggatttcaccatattggtcaggctggtcttgaactcctgacctcgtgatccgctcgcctcggcctcccaaagtgctgggattacaggtgtgagccactgcgcctggccatgaaatattttttacttaaaaattgggaataagcttttttgtgtgtgtgtgtatgtttttgtttttttgtttttgagatggagtcttgctcctgtcatgcaggctggagtgcagtggcacgatcttggctcactgcagcctctgcctcccgggttcaagcagttctccttccgcctccagagtagctgggattacaggcatacgcctggctaatttttgtatttttagtagagacagggtttcgccattttggccaggctggtcttgaactcctgacctcaggttatctgcctgcctcggcctcccggagtgctgggattacaggtgtgagccactgcgcctggctgggaataagctttcgacttgcccaattcagataaattgttttttttttttttttttttgacgtggagttttgctctgtcgtccaggctggagtgcagtggcgcttggctcactgcaacctctgcctcctgacttcaagcgattctcctgcctcagcctcccaaagtgctgggattacaggtgtgagccaccatacccggcccagataggttgatcttataacaatccagaaacaaatgtcatagtcaagatttggtagatagatttaaaactaaaatattctgccattggaagtgaaatgtcatagcacatacgtggacgttatgcatttagagatgttataaaaatgtattggcagtatacatagcactactcaagaagccaaagaaacacttgtgcagtgctaagtgtcacatgtctgcttctgccagaggctaggaatagtgatcttgctataatgtgagaacctgaatcatgtttgtaaaataggaggctgggagcagttccaggccacagtgaagtgtgttgcttctgtcactttatattcttatatttcctttccctcagacaatcaactgttgatgcctgtacttgtgaaaagttgtaaggcaatttttagggttgttgtcaaagaaaagcttggattacattaacatttgtactcagccttttaggcaatacaccagagggggctgggaattgtctgtttgttcctatgataagtagatcttactgtaaaatagtaaatgtccattgaaaagcaagtaacacaacctgtgctaactgggagcacttgaacaattttgttccattctgaataacttttcagcaagtaattctaagctttgtcttatatccttgtgtaaaattgctaccttcatttttaccctatttgatttcttaaatggtttgttcaagaaaaaaaaaaaaaaaaaaaagaatagagggtgtagattggaccgggtcctgaggatccaatttggtagggaagtctaaaggtcattgcctgcaagctatgtggtgagggaggagagagctgatacttggggttcacaccataggtggagccataagccagatgcttactttagaaaggcgcagacctgccataggaaggattttgtcctctgcctagaaaaagggaggcgtgggtgggataaggaatgggcttgggatggagactaaggtttgagatggtttatattctgcacctacaggcttggctgaccctcagggccactctttgtgggaaaagaaaaaagttatccaggctagtggagcagctgggttctaaactagggcactgctttttccccttctccacatatcaaggcaagattggatgatctactgccccagtcaaggtctgccagcaagctcccctcagagccttatgtaacaggcaggcctggttgcagaggaccagtagctgacctacctgctcagcccttccctacaactcattaagaatatatgaaacacttattggtataagcactaaccagtgtccttctaaatgtgtacacataggcagttagaagtgaagctattcattgagttaaattcctgcaaacactacataattgatttgacccaaatttgcctataattatcaacataccatggaaaattttagtatcctctaaaattttaaaagctaaaaatatacacctcagtttttgaaattctactacatcatttatactgaaaacatatagtaaaccattaatccaagaacagtaatagctgatatatatgatgagcaacgagtgtttgacaccggtaagagtcctatgaggtgggagccattcttacaacctatttacagatgagagcactgaagctccagcaggttcagttcttttctagagtcacagtgctgctaagagccaacagtgaagtcggaggagctgagtttatacaatcaacttgagatcagtttgctttagggtaaggaagaagagatggtggtccaactctgcctgtaagatcttcccatcgttgcccatttctcacggtttccctcttccttcagggtcccctggcgatggcagaaatgaaccctgcacaggtgagtggagtgttttctacctttcacctaccagttatctcatagatggttttggcacctccatgtaaagaaaagtggtgtccagagactctctttctgtctttctccctctcttatgtctgaaaagtgagtgattccaccagttctagtatcttaaattaggtctgggatttttgtttgattgttttaagtttactgtgacaccttacctggatggccctggattatgtggagtggctcccatttttgacagttgacgtggtaacatctgtcagagtgtcatgggcacaagattaagaatgtttcagtgtttagaggagagactgaactggatttttagggaactgcaagtgtctgttatatcggataggaatagggagcagagtgggaggtggctagagacacacaaacatcaggcctggaatgacagcctaggtcctgggtctctaatctaagggaggtggtagatggggaagatttgaagcagaagagggcagtgataggaccctagcttaaggaactttctttggcgtctgagtggaggacagactgtggaggtgagggtaatggcagggagatctgagaggatgttcctgcagcagtctaggtggatgttggtggtgacttgtcaagagtagcggtggcttcaggatgtgttttgaactggagctgcccacattttatgatgtagagagtgaggcagctgggggggtgggatagaaggggaatcaggagtggccccatggtttttgtttggaagcatagatgctccatcagctaagatgggagaagtcagcagtattaggaattttcagagtgagtgtgaggagtcagtgtttgttcaagccacagatgtctcagagactcctggtggaggagttcaggttggagacgtccacactatggtggctgtcgtatggaccaggatgaagccatggattcagtttaggtgacagcatctctaggttatggtggcagtgctgttcgaagacagagaattggaatggggcatgagaactgggtctcttactgggtagctgtgcagtggtggaggagtcactagacaaatgagggaatggagtgtttgtggggatgagtgtatgtgagatggtggggtataggagtgagaaagacttctgaaggagagtggacatgatggggttgctgaggagggtaatagggtgaggtcggagagttgctaagcatcagttggaatgagatgaggatgggaattctattagtctgttttcatattgctacaaagaactacctgagactgggtactttatgaagaaaagaagtttaattgactcacagttcttttttttttttttttttttttttgagatgtggcccaggctggagtgcagtggcacaatctcggctcactgcaatctctccctgccaggttcaagcgattcttctgcctcagcctcctgaatagctgggacgacagactcaccccactacgcccagctaatttttgtatttttagtagagatgggctttcaccatgttggccaggatggtcttgatctcctgacctcgtgatccatcctcctcagcctcccaaagtgttgggattacaggcgtgagccaccgcacccagcccatagttcttcaggcttaacaggaagcataactcggaggcctcaggaaacttacaatcctgtgtccatgaggcaggacacagctgagagtatgtgaagtcctcacatggtttgggcacctgacagtgaagtgagaaacagggccatgtagggaaccttcaacccagggcttagggctgcccccggtgctagggaactttggtgttctggggcaggactgggagtgaattggatgctgagcgtatttgccgtgcaccacctggtttctgtgtgcagagtggcctgttaggaggtgaaggaaatgcctgtggtgtgggctgggaggtgtctgtggaattgactggagtggaggtgtgagagatgggattggagtgctgtccaaagagtgatgtgcaggcaggaggagtgtgaatggagggcctcaggccctggccctggtagctcaagggaggaggatgagtctgagtttggttgtcttgggaggcaagatctgggtgactccatggaaactggctggcaggagaggatggatccccccacgggaggcccacattccttttctaccttatcttccatctgtttcctctgtgtgctggacacggtggccaatgtcaatatggagagaaaagtcactcatgccacctggatgtggtttctcttccacattgggagggtgtagagattgaggaaggaaaggaggtgtaggggagagggatgagttcctggagagagaaaagtagcagtgattgtacccattggggttttttgtttttttttttttagatggagtcttgctgtgttgtcacccaggctggagtgcagtggcatgatcttggctcactgcaacctgcacctcctggattcaagcagttctgcctcaatctcccaagtagctaggactacaggcatgtgccgccatgcccacctaatttttgtatttttagtagagatgggatttcactgtgttggccaggctggtcttgaactcctgacctcaggtgatctgcccgcctcagcctcccaaagtgctgggattataggcatgagccactgtgcctggcccccatggagttttaatttatggatgtgagtgagtgatgccagggacaggccaatgacactgaaagaagatatttattccttacgtttccctaaggaggttacataccacataacacagggccacacggtgaaacaccagatttgatcaggaggaaaattggagtgagtttagtttagtccacagatgctgttggggtttccaagggaaacaaggcagggctggctgtcaggatagtttggctagttttagtaattccaggacacctgggctattgggactgtccctagttgtgcagtacctgtccctgggttgatttagagcatgggaaatactgacttggtttgagaaagttagagatggagatggttaagaatatgtgcccaggatggtaggggagatggaaacacatttagctgttagtttgtccctgtgtttaatgggtggtaaatataagtagaaaataaatagagaacttaagtaaatacagtttgaaaagctgctcatgtattcatctttcccaatttggcagggtcatgtggtttttgaagacgtggccatatatttctcccaggaggagtgggggcatctcgatgaggctcagagattgctgtaccgtgatgtgatgctggagaatttggcccttttgtcctcactaggtaaggccctcacacttgcccagtgtcctgggttgggctgtgttgtctccttttacctgaaggcagctctgcgtttcccacagtgagaccatgggtgctgcttcttttccttgtttcctgacatatgttccatgagagtcaggactgcaatatgtgctgtgtgcttcctttttcctggcagccccatcctctgctgttctgaggcttgcaagaaagggctcaggatccagaaatgttgaaggtgacatagagacccactggccctgtgttctattcaaatgcatgagacctctgtgctctgttgttcccttgctcttgccaatatttcttggtcccttcttgttcctggaatttctggcactgacctgatcactaatttggtgaaccactggcttgattgtgtaggatgtagaaatcttctgtgaagttctggtgattatcgaatgtgagatatcatcaggtgatctctctgggaatgtgctgtcttgtctctttctgtgtctttcccctaggactggtctctttcaggtctcacagactgtcaccttaagcaatggggagggccctggtacccaagagggtggatattactccctgaagggctgtagagactcagagggacatgatcctggttcctgggagttgggaaaaggtgtaatatcacagctggggtcatattactaggaatctgtctggtgacccctgttgtttagttgaagactggttgccacaactcactcttcttttccttcccccgttgtcatttttactctgacttctaatccctggcttccagccgttacctattttcttcaactgctccctctgcagtgccatccactgcatgacctgtacttaaggtgaggtctgcatgtatttgtcagtagtccctgaacaccatctcctctgtcacaatcagatctctctgggtttagacacagccttctacacactgctcactagtcaccagcagccatggcctgtggaaagccatttgcagagaagtgacttggagaccctcctcctctctgcactgtacccctctcttgtgttcttacccatcatcagggctctcccattatgggtatttgccaggtccaactctgcacagcaggccttcttctcattggccttagtgtttgtattacttcattctcactctgctattaggaaatacccaagactgggtaatttctaaaggaaagaggttaattgactcacaggtccccattgctggggaggcctcaggaaacttacagtcatggcggaaggcaaaggagaactaggcatcttcttcacagggcggcaagacaaatgagtccaagcagggaaaatgccagacacataaaaccagcaaatttcatgagaatttactcagtttcatgagaacggcatgggggaaactgttcccatgattcagttctgtccacctggtcccacccttgacacgtggggattatggggattacaattcaagatgagatttgggtggggacagagagcctaaccatattattccaccccggccccccccacccaattttatgtcccttccacatttcaacaccaatcatgccttcctaacagtcctccaaactcttaattcactctagcattaacccaaaagtccaagtccaaagtctcatctgagatgaggcaagtcccttctgcctatgagcctgtaaaatcaaaagcaagttagttacttctaagatataatggggatagaggcactggataaatgtacctattcctaatggaagaaatgggccaaaacaaagcctacaggccccatgcaagtccaaaacccagcgaggcagtcattaaatcttaatgctctgaaatgatatcctctgactccatctctcacatccagggcacagtgatgcaataggtgggctcccactgtcttgggcaactctgcccctgtggctttgcagggtacagaccccccctcagctgctttcatgggctggcattgagtgtctctggctttttcaggcacacgttgcaagctgttggtggatctaccattctggggactggaggacgtggccttcttctcatagctccactaggtagtaccccagtagggagtctgtgtgggggctccgaccccacatttcccttcctgcagtgccctagcagaggttctccgtgagttccacccctgcagcaaacctctgcctggacatcaggcatttccatacctcctctgaaatctaggtggaggttccctcccaaatatcagttcatgacttctttgcacccacaggcccaacaccatgtgcaagccaccaaggcttggggcttaaactctgaagcaatggctggagctgtaccttgccccttttagccatggctggagttgaagcagctgggatgcagggcgccatgtcccgaggctgcatagagcagggggacccagggccagcagctgggatgcagggctccatgtcctgaggctgcactgaacagcctgggccaggcccacaaaaccatttttccctcctaggcctctgggcctgtgatgggaggggctgccgggaaggtctctgacaggcactggagacattttccccatcaccttcgtggttaacattccactcctcgttacttatgcaaatttctgcagcagccttgaatttctccccagaaaacgggtttttcttttctattgcatagccaggctgcaaattttccaaacttttctgccttgcttcctcttgaacactttagcacttagacatttcttctgccagataccctaaatcatctctctcaagttcaaagttccacagatatgtagggcaggggcaagaagctgccattctctttgctaaagcatagcaagagtcacctttactccagtccccaacaagttcctcatctccatctaagaccaccacagcctgggcttcatggcccatattgctaaatcagcattttgatcaaaaccattcatcaagtctctaggaagttccaaactttcccacatttcctgtcttctgctgagccctccaaactgttccagcctctgcctgttacccagttccaaagtcacttccacattttcgggtatccttacagcagtatttcactacctcagtaccagtttactatatttgtccgttctcacactgctattaagaaataccctggctgggcacagtggctcactcctgtaatcccagcactttgggaggctggggcaggtggatcatctgaggtaggagtttgagaccagcctggccaatatggtgaaaccccatctctactaaaaatacaaaaattagccgggtatggtggcaggtgcctgtaatcctagctactcgggaggctgaagcaagagaatcacttgcacccagggggtggaagttgcaatgagctgagatcgtgccactgcactccagcctgggtgacagagcaaaactctgtctcaaagagatacgcgatacttggccaggcttggtggcccactccggtaatcccagcaccttgggggggctgaggtggacgggtcacttgagatcaggagtttgagaccagactggccaacatggcgaaaccccgtctctactaagaataacaacaacaacaaaaattagccgggcatggtggctcatacctgttatcccagctacttgggaggctgaggcaggagaattgcttgaacccaggaagcggaggttgcggtgagctgagatcaagccactgcactccaggctcggggaaagaatgagagtttgtctcaaaaaaaaaaaaaaaaaaaaaaaaaagacatacccgagactggataatttataaaggaaagaggttgaattgactcacagttccgcatggttgggaggtctcaggaaacttaccatcatggtagaaggcaaaggagaagcaggcatcttcttcacaggacagcaggatggagtgagtgcaagcaggggaaatgcaagatgcttataaaaccattagattggccgggtgcagtggctcacacctgtaatcccagcactttgggaggccgaggagggcggatcacctgaggtcaggagtttgagaccagcctggcaaacatggtgaaaccccatctctactaaaaatacaataattagccaggcgtggtggcacgtgcctgtaatcccagctactcaggaagctgaggcaggataatcacttgaacccaggatgcagatgttgcagttagcagagatcgtgccactgcactccagcctgggcggcagagcaagactcagtctcaaaataaataaataaaacccatgagatctcaggagaactcatgatcatgagaacagcatggggcaaccgtccccatgattcggttaccttcacctggtcccacccttgacacgtggggattatggagattacaattcaagatgagatctgggtggggacgcagagcctaaccatattgtttccagaccaaaccgagggtggggctgcttattcttgcagcccaataatgagatgcagatgaactggggaaaaagagagtttttatttctgtaaccggttacagggagaaggcctggaaattattgccaaaccaactcaaaattacaaagttttgcagagcttatataccttctaagctatttgtctacatgtgggtttgcattcatctaaagatataagtgattaacttctctgtaaccaagatctgagtcctgaagaccttcctctggagcctcagtaaatttacttaatctaaatgggtccaggtgctggggtgattacccttatcttgtctccttttaaatcatggaggtttggggagtttccttagaaccccaataaacttattcgtggaggcctggggagtttcttcagacccccaataaaatgtatttaatcctaaacgagtcctgttaagaattccttcattatcttttcatcctttaaggcccaggaaaggcctaggcaaaactcttggtgggcttttgttacattccagcctgtacatgagggcactggctctatcagcttttaatcaacttaaccactcagtcagtgctgaaaccgttgtcatggaagcctgcctgctcagctgttagtgagacctggcctgccacagtaccagggttcatgcctgtcaccaattccatgatcattttcatggggtgtctgactgacatttgtgatggggttgcctccgctcatcacagtcaacatgcacctcaccagcatttttattcttacaggttgttgccatggagctgaggatgaggaggcacctttagagccaggtgtttctgtaggagtgtcacaggtcatggctccaaagccctgtctatctacccagaatacccagccctgtgagacatgtagctcacttctgaaggacattctgcgtctggctgagcatgacggaacacaccccgagcagggactgtacacgtgtccagcacatcttcaccagcaccaaaaggagcagattagagagaaactttctagaggggatggaggaagaccgacatttgtgaagaaccacagagttcacatggcagggaagaccttcttgtgcagtgaatgtgggaaagcctttagccacaaacataaactttctgaccatcagaaaatccacactggagaaagaacttataagtgcagcaaatgtgggatattgtttatggaaaggtccacactcaatagacatcagagaactcacactggagaaaggccttatgagtgcaatgaatgtgggaaagcctttctttgtaagtctcaccttgttcgtcaccagacaatccactctggagaaaggccttatgagtgcagtgaatgtgggaaattgtttatgtggagttccacactcattacacatcagagggttcacactggaaagaggccttatggttgcagtgaatgtgggaagttctttaagtgcaactcaaacctctttaggcattacagaattcatacaggaaaaaggtcttatggttgcagtgaatgtgggaaattctttatggaaaggtctacactcagtagacatcagagagttcacactggagaaaggccttatgagtgcaatgaatgtgggaaattcttcagcttgaaatccgtcctcattcaacaccaaagagttcacactggagaacggccttatgaatgcagtgagtgtgggaaggccttccttacaaagtcccacctcatttgtcatcagacagttcacactgcagcaaagcagtgcagtgaatgtgggaaattctttaggtataactctacacttctcagacatcagaaagtccacactggataaggcccttatgaatgcagtggatatgggaaagccttcagtcaccaacatattgtggctggacagcaggcagtacacactggagaaagactgaatgccgtgaacgtgggtaattatgtaggtacagctctccagtcgctatgtatcagagaattcacactgcagaaatgtgtgttcagcaaactcgggacattattttggtttgactctcatctcattagacattggagagtttacactgaagaagagtcttttcaataaagtagaaagtggtaaagattcaacatgcaagattgtacttattgggcttcagaatatccacactagtgaaagtcttctgagtacagcaaatgtgtgacattattttgctactactccacactacttagacatcatgtagttcacactggaaaaaggccacgtatgtgccttgaatgtagccaaaatgacgaacaacacccagaaatctgtgatttagcactgagaactagtattatatggtttttaaaaaacaatggtgaagtacatgccacataaaatttgccatcttaactattgtaatgtcttgtttaatacttgaagtacattaacattgttgagcaaagaatatcctgaactctttatcttgtaaaatgaaactctataaccaccattaaaaaaacaactcattcccacattcttcagtccctggcgaccaccatatttttaagtcattatgactctgactattcttggtacttctcagaagaagaatcttagagtgtttttcattattttttttcacttaggataatatcctcaaagttcattcattttttagcatgtgtcagaaattttaaggctgagcaatatttcattgtttgcatttaccacatttcctttatttctgacatctattcatggacacttgggttacttctacctctggctattgtgaatattgctactacaagcataagggcacaaatatctctttgagaccctgctttcaattcttattgggtaccccaaaaagtggaactgctggatcacatggtacttctaactttaattctttgatgaactgagaaacttttccataaaacttgcaccgttttacattcctaacattccacaaaagttgtgatttgtcctcattctaatccatagaaggcaacatttctaacaggtttctaggtgattttgttgttgctgatgtagggactacattttgagaactgtcctatcccatttttataacaatgcagagcttctctgtaaataccccttgtttctatgttctatcctgtgagccttttcattttgttaatttttcccagtgtttacaaccaggaaatagcttgtcatctttgatacaaaacagaaatctttgcaaaataccaattgcattctgtagcccttggatcattttctcccccaatctatgtagatatttagtggtgtataatgttgtatgagaatacatcatggtaagaatacattttaaaggactttaagtcaggtcacaaaatacagcaatttacctgtggacctgccctctacccaggccatccagtcccaatgactgtgctcttactgctgctttccaggtgtgtacctatcatggggtgtgcatgccactgaccattcctctgtgctcttactgctgctttccaggtgtgtacctatcatggggtgtgcatgccattgagcattcctcttaatgggttctaggcaacagatagaatagcttaggtgccaaagccacagaacctatcaggggttgtgtcattttgaaaattatgccaaattctaaatgatcttgtatgacagcagtcccccaacctttttggcaccaggaactggtttcatgcgagacagtttttctgtggatggcagtgcagggggctggatggtttcggaatgaaactcttccacctcagatcatcaggcattagttagattcacataaggagtgcacctaggtccctcgcatgtaacagttcacagtagggtttgtgctcctatgatgtctaatgccgccgctgatcaggaggtggagatcaggcaggaatgctcgctcctgctgtgcggcactgtgtggcctagttcctgacaggccacggactggtacggtctgtggtttaggggttggggattgctgttaaatgggatttggggaattttatttgggttctctctttgactagtctattgtcaaagttattccatctaatttttctagagtaagccaggttctgtgtcatgtaatagagccacataaacagcaaaggtgctattgtgaactgtgcatacgagggatcaagttgtgttccttatgtgaatctgagctaaaataagaaaaaaaaaaatttagcctgtgaggtcagaagcaagacagtcatgttagatttctgtcattattcatagttctgcaaaggtggtttcaggttctgcatcaactgaaacgtgctcttccatccagcagcatttaaaaccaaagatgctgtcccttaattagttaactctcacaatccattttagtaatggttcctcaggaaactgactacttcaatctataaagtaaaacaagttcttcacattatactctctggtttgaatagttacttggttttgttcttccccacaatgactaccttcttggtagccgtaggtctcagaggcattttctgttgtccctaaatgattctgcccttggtgggaggtggcttttaggctggctggtggctttcgttcagatggactgaaatctaagcttgatctagcatcaagtttggacccagcactctctaatttttttttttttagctgttatagataacaaaggattgagtaatttgctttttgcttattagcttgcattttcttatgcatccagtgaaccagagattgaatattttgctttttgcatattagtttgcattttcttatgcatccagtgtaccaactccctgggagctggatccatctctaaatttccatggtaactcttacctttagtaactgagcacagacagccacagttccataccatgtatggccatttggccactaaggaatcaaaggtttttcatcctccacccatttttaaattgaggattattcaaaagttaaagaaaaaactttattatctcttattaatatatgtaaattgtgttcaaaatagaaaatgaacttctactttttttttttttttttttgagatggagtctcactctgttgcccaggccagagtgcaatggtgcgatcttggctcacttcaacctctgcctcccgggttcaagtggttctcctgccacagccccctgagttgctgggattacaggtgtgcaccaccttgcctggctaatttttgtatttttagtagagacggggtttcaccatgttggccagactggtctcaaactcctgacctcgtgatccgcccgcctctgcctccacctcccaaagtgcttggattagaggtggagccaccgcacccagcttttttttttttttttttttgagacagagtcttgctctgttgcccaggctggagtgcagtgatgtgatctcggctcactgcaacctcagcctcctgggttcaagcaattcccctgcctcagcctcctgagtagctgggactacaggtgcgcacaaccacgcccggctaattttttatattttagtagatatggggtttcaccatattagccatgattgtctcaatctcctgaccttgtgatctgcccgccttagcatcccaaagtgccaggattacaggcatgagccactgcgcccagccgaaattctatttttatatttgtgtattgtcaatactaaagctaatttgaataaagtcttataaacaaatccatccaattttaatcaggttttgaccacacaaggtaagatttttccgtaaaccttttataccttcttacaaatttttttctatttttctctttccccaatttttagatctatttacctttgtttgagacagaatctcactctgtcacccatactggagtgcagtggtttgatcttggctcactgcaacctccacctcccaggttcaagtgattctcgtgcctcagccccccacatagctgggattacaggcacacaccaccatgtccggctaatttttgtattagtagagatgaggtttctccatgttggccaggctggtttcaaactcctggcctcaagtgattcacccacctcagcctcccaaagttctgaaattataggcttgagccactacgcccagtcctagatctatttacttttatctacattattttcctttcattttgaaacgacctttacataacccctaaactagacagaattcctttttttttctttctttcttttttttttttttttttgagagaagtctcactcttgttcctcaggcttgagtgcaatggcccgatcttggctcactgtaacctctgcctcccgggttcaaacaattctcctgcctctgtctcccaggtaactgggattaaggcacctaccatcacgcctggctaatttttgtatttttttttagtagagacgggttttcaccaagttggccaggctggtctcgaactcctgacctcagatgatctgcctgccttggcctcccaaagtgctgggattacaggcgtgagccaccacgcccggcccagaattactttttctttagcaaaaaccacatcttcattttttaaatataagcttcttcacaaaaaacacatagtaaacatcatggcactgggctgcacaatactttgatagagcacgttgatgtaaagacatttttgtaagtgtttagagcatgccttttatatctaaacatgcaaagaaatgagtagcctcctgtcgtaataaccatttactgtaaacaactgccaccagctgcttctgacactgcagctcttgcttgtgacagccattacgcacaaaaacgtcaagttctttcacaggacaaagtaatctctggtaccccccaaaaccaatgatatcaggtaatgcactacaaaagaaggcagaattttagacctgagataaatctgtcctcttaaaactcttgagtgagagagagagagagagagagagagagagggagagagatttcctcatctggttagtgtagatagcaggttggcttcctgagctggtcagtgcagtagtgggttagagttctgttttatatttggcttggccattgttgatttctatagtcaatttcttacatgtaaacaaggaagatagctataatattgagatttcttgttttcttaactggtcttaggttgaaaattgatttttcattctcctccccgctcccccctccccccaccatcccattcttctgcctctgccggatcttcagctgggtagcattttggttttgtttgttttttaacctggaggatgtccccaaatatcaaaacctaaacttctgattcttagaagtcctcccttcgatgagttgctagttttatttctgaacatgaacttaccaaaacatcccccagaaatcccctggtctcagacataactctctatgcttcccattccatggcagcaactcagcctaactcatccaaagcaaaaaagcaatcccttcttgcttaagtgacacaaggatccccagatgaacaagtagctgtatcacccttcaattaaatgtaataatatttacttctggtggaacctctccttccttggaacaaagggcccccaaccagcagaatttacaattaagaagaagtggccagacacagtggctcaagcctgtaatcccagcactttgggaggccgaggcaggcagatcataaggtcaggagttcgagaccagcctggccaacatggtgaaaccctatctctactaaagatacaaaaaattagctgtgcgtggtggtgcgtgcctgtaatcacagctactcgggaggctgaggcaggagaattgctttaacccgggaagagggggttgcagtgggctgagatcatgccattgcactccagcctgggcgacagggcaaaaaaaaaaattagccgggcatggtggcgggcgcctataatctcagctattcaggaggctgaggcagaagaatcgcttgaagccgggaggcagaggttgcagtgagctgagatcgcgccaatgcactccagcctgggtgacagagcaagattctgtctcaaaaaaaaaaaaagaaaaaaagaaaaaagaagaagggtagcagaaattctgtgaatgagttactaggttcaaaaatgaggatgctcaatataatgcataggttcagaaaaaaattacgatgaaaagaattgtcaaattttgtaactgatacttgacctggttaaatttgaattatttctaattccctatgtatatgtgcagtgagataaaagataaatattgtatgtgacatactcatcataaaattatttgttgtttatctgaaatacattctaaatcaggggtccccaacccctggggccacagatgagtactatggcctgttaggaatggggccatatagcagagggtgagtggcagatgagtgagcattgctgcctgatctccgcctcctgtcagatcggcagcagcattagattctcataggggtgcaaaccctactgtgaactgcacaagagagggatctaggttgtatgctccttatgagaatctaatgcctctgaaaccatctgcccccaaacccctctcccttatccatggaaaaattgtcttccacaaaaccggtccctggtactaaaaagcttggggatcacagttctaatgacataactctttccctgataatttgcttctacttaacaattccttgttttatataatttgcttacagaattcctgcagttacagtcttgatgccatttatgttgtgacaaaccttcgtcatttgtcatattcaacttatttcattcctttatctattggacattcattaatgagaaacacactcaacagtagcattctgagcctaaagactcatgatgataaacagtgtagaaaacattacaaactctattataattattctaccatctccatctgattttaacaaaaaagttattttgtctctttctttggaactagttgagaaaatcatgcaccttccaaagttaatatatatttgactgtccaccattttcattagtcaatgggcaattacatagagtcgaagaccttcaaagggaattttaaatactcctcagttcatcataaattataaacttgcattttgacattttttgcattcaatatactcaaaatatagacaatagcaacttctacaagagttgaaaaacattgtgggtacagtggctcatgcctgtaatcgcagcactttgggaggcctaggcggacagatcacttgaggtcaggagttcgagaccagtatggccaacatggcgaaaccccatctctaatagaaatacaaaaaattagccaggcatggtgccacgcgcctgtaatcccagctacttgggaggctgaggcatgagaatcacttgaacctgggagccagaggttgcagtgagccgagattgcgccactgcactccagctgggtgacagagtgaaactgtatcttaaaaaaaaaaaagaaaagaaagaaaaaagaaaacactggagaaaacgttggattttacaatgtatgtctgggtcagttagtctaccatttcatatccaaactcataactaattacaaacagatggaaccattgaaagcttgcaaacttttaaattatattcatataattaaaatataagtaataatttatattcaattaagaataaatggggccaggcgtggtggctcatgcctgtaatcccagcactttgggaggccgaggcaggcggatcatgaggtcaagagatcgagaccatcctggccaacatggtgaaatcccgtctctactaaaaatacaaaaaaattaactgggcgtggtggcgtgcatatgtagttccagctacttgagagtctgaggcaggagaatcacttgaaccggagaggcggaggttgcagtgagccgagatcacaccactgcactccagcccagcgacagagtgagactccgtctcaaaaaaaaaaaaaagaataaatagattttgatatctcaagggaaaaaaagtgatattcctatttgtctgcagggcagagctgtagtggtcaggcagtctcctcaaacaaagccaaaactgctattatatgagcttttaggaaggctggccttcagggactgaggactttcagaagcagcagagttgaaagactgatggactttcaggtatgttagtgtaaatgcaaccatttaccaactggctttcataaacaggattactgacaggaggcacttgtggattagttgttgccagcagcctggggctgccactgattgaccatctttagtactgggccttacccccattggaaaaattttagaatcttggcctaacaatgatttgctaagtttctggttaattactggggtgaagcttttgctgactagctgacttttaaagcataggtacacatcccaagttatctctaattaatggtggtttcttgtttatgattatggatttggggcagagataaattttttccttacttgaacataagccagcaacttaattctcattccccatttttggtttcccaacagccagaatttgtaagaaatcatatgctatggtttggatgtttgtctcttccaaagctcatgttgaaatttaatttccaatgtttgaggtggggcctaataggaggtgttctggtcatgagggtagatcctacctgaatacccccacttgaagatgtgtaaattctcactctattagttcccaagaaagctggttgttgaaaagagcctgatacactccccacccactgtcctcctctcttgcaatatgattccttcgcattatagctctctttcgttttccaccatgaatagaacccgccgaagaccctcaccagatgcagatgcccaattttaaactttccacacatcaacattttgagccaaataaacatttttttctttataaattaccagcttcaggtattcatttatagcaacgctaactggactaagacatcataagtattatctagatatttgtttgtgaggatatgattttcaactcatgttgccaatgagtaatttaacggccagttacagtctgagaaaaatgtgtctcccactggtgattctttgtaatatattacaaccagctgatatgtaggatatgtaggccattctgataagtcaatacaggattcaggaaaaatcgttatatataggtcatattcttaaactgtgcccaggtcttaattaataattagcaatgacacagaggggacactgccatcaaaagaaaagattaatgttacagttccctggaaataagaggcactgaacaccacacaggccacaagaaaccttattacatacagagactggaaagcagaaagagaaaacagagtaactggaagtatgtctttataactaaagtggcagagaatgatgaggtagagataccgtcgatgggcaggaaggaaaaacacattttagtgtttgtggttggggggttttatatgagtttcatgcacttgagtaagtggcttgcaagaaaaaaagtaaacaactttggttctattagtttgaccctgtgattaatgaatatcaaacagacaaatacagaatctaagaaaacatagaacagtcctgtatacacatagcagctgggaaacctattcccagtgtgtcccatgcacctatcattgatctgaaacccaatacatatgtgctcattgaacatttactagagaagtaaatacacattatcacacagcttctctattcatttttatctgtggcaagtctttcagtttatcatctgtacttacccctctaagcagttaatgagcaatgttttcaagtgtgtaaaaaaattacattttggaaacaaaagcatagtgtgtccaagtgtccagcagagccacaggttcaacttcattctctgacttctcagaatttgctgtctctcactcaaacattgagatcttatctttttctcacattacagatcgatttctctagggcttctggttttttttcttttggaataacctacataattactaatagatttcggtaatttttttatttcacaagtgtttttcacatttcgactccctgtgcaaatacagttgtaaacacaggtgaaattttaaatcacttctgaggaagaagataacatcatggaattccacaccttttttgaggataagatgtgcatatgcttcaactatgaaaacggtagacaatgttgtccagaaatggcatgtatcagctgctcttgagaaataaaaataaaattctaagcaccccctaactgactgaatggatgccctcttgaccatgagaaccctagaataactttggaagctgaattcaccactatagaggaacgggaaatcagacacacctcattatatcccctaccacactacaatcattaggttttcttccctaagggctaaatagaaatcaaccttttcagaagactactagcttatcttccaaggtacagaacagagagaagatgagattattcattccttcatccttctctgagacatcttctttattcccttttcccctcacgtgtttactctatcttatgtaaaatgtagatttactgggcactaactaaagtttcacatgtctgtaatcatttgtctcactgccaacccctcttcctttttaaggaaaatgtataataaatactaaacctcctaagaacctctttggaaaaaccagccacagatgcttctgtgacttacatttttctggatgtgcccttaggctggtccagtaatcctccatgatttgtgacttatgcctcaatcactcattttggtcgtcactctcattttcagataggattgtgattcttaaaataaatggaaaatatctcagatatgaagtagtaagtattattagaataaaagcgttgcacccttcgtaggaacacaatcgctgactctacagtcaggtaagatgtattctctttgatccagaggcatagcttcaccctttcaacctacttcagcgtctcctgtcatccttcctacaaattccagtccatagccctaactgcgtagtctttctttcttcttctggaccaaacatattgaagcttactaaacagacgccaaagcgtaactgtatgtgtatttgaaaagcaataatatggctggcaggcatgagtagaggcagactgcctttatggtatggggtgtctctttggacctgtagttattgggaattagctgtgcttaatagagtcttaagtaataagttgctaacatttctgtaaatatcctatactacaatccaaaaaaataccgtatgttgcctttaagagcaagccaagccccctcctgtctttggagtcggggactccgtttcccagctcccctgacagtgccactgggcctttatctgccatataaggactgatcaacgctctaagacaagtccggaagcggtgtcgaaacttcataacccagaagacactgcagctctcggcggcacgacttacccaataaaggcttagaaggggacgtttgcgtgcgtgcgcaccgtcggagggcgggacttccgccgtcctcctggtggtggtcgttttggttctgtgtggtgtttcaccaacttcggcctatggctctgtctgacgtcaccgaagtgacggaacggaaaagcgcgagaagcggctcggttcccaccacggagaggcgggagtgagtcaactgacaagcgctggggacagtggcgtccttgtcttgcctttgtcgctcccgccccgctcttccctggctgggctggcggaggccttgctgatgaacctgactgaggtgggtgtcccgtcccaggctcccccgcccgaccggtcctcccagtgctgaagccccctgaaggggccctgcaggtcaggccccttgtcccgaagagaggggcgttcctgtgtggggtccccgtatcagccgatttgatgcagcctcagagctcccgttagggacctcaggttcagagcatggaggcgctgccgagtgggctgtgttggggcgtcaggggtgtgtgttgtttctgcgggaaagagagggttttgtgaattctcgcttggaatggcaacctgagcagccagtaaccatggaaggttgtcaagggagggacagttggagggggcaggtccagagttcgaagtttcaagttaggaaaaccaggttaggaatggacacagggagacgcgaaaaggccctgaggccactgcagtagacccaggagaattatggttggggctggaccagtgacagtagagggagatgtgatgagattcttcataggcctgaaagatagggcccgtaggttttcctggtgcttcagttatgtctgaacaaaggcagtgaagaaccgtttcaagtgtttgttttgttttttgttttctgtttgaacgtttggaagaatggagttggggaagtcagcataaagagcagatttccgggagaagatcacaggttggattttggacatggtgattctcaaatgtctcaagatggatatgtcacacagacaggtggacataaaggtgtggagtctgaggaaggggattgggttggcgataccagacggatggagggcttggactgggccagagaatggtctgaggatcagattgagtaggtcggtctcgggttttttttgtttgtttgtttgcataaatttaaggagtcaagtgcagttttgttatatggatatatttgcatagtggtcaagtctgggcttttaatgtatccatcgcctgaataatgtacattgtatccattaagtaatttttcatcactcatcttcgtctcatccttctacctgtttggagtctccaatgtttgtcattccacactctttgtccatgtgtacacattattcagcttccacttgtaagtgagaacatttggtatttgactttctgtttctgagttgtttcatttaataatggcctccagttccatccacattgctgtaaaagacatagtttcatgcttttttttttttttgtggcctagtggtattaccttgtgtatatatatgccacattttctttacccagtcatacattgatggataattggttaattccctatctttgctattgtgaatagtgctgtgataaaaatacatgttttttttaatgtaatgatttattttcctttgggtagatgcccagtagtggaattggtggatttaatggcagttctattttcagttatttgaaaaatcttcatactgttttccattgaggttgtacttatttacattctcaccaacagtgtgtaacctttttctcttctccatatcctgggcaacatcagttgttttttgacatttaaatgatagccattctgactggtgtaaggagatactgtggttttaatttgaatttgtctgatgattaatgatgttgagcatttttttatatgcctgcttgcgatttatgtgtcttctttttgaaaaatgtctgccctgtgcttactgttttttttttttttttttttttgaaatggagtctcgctccgtcgcccaggctggagtgcagtggcgcgatctcggctcactgcaacctccacctcccaggttagttcaagcaattctgctgcctcagcctcccaagtagctgggattacaggtgcccaccaccacgcccagctaattttttgtatttttagtagagacggggtttcaccatgttggccaggctggtcttgaactcctgacctcaggtgatccacctgcctcggcctcccaaagtgctgggattacaggtgtgagccaccgcgcccagccctgtgcttactgttaatgagattttttgttgttgtttttttgttatgttttgtttgtttgttgttgagttctttgtaaattctggatattagtaccctgtcagatgcatagtttgcaaatatttcatcccatttttcaggttgtacatttacttggttgattagtccttttgctatacagaagctgtttagtttaattaggtcctgtctacttttgtttatgttgtttatgcttttgaagtcttattcatgaatttttttgcctagaccaatgtccagaaggggtttccctgagttttcctttagtattcttcgttcaggtcttacatttaaatctttaattcatcttgagttgatttttgtatatggcaagagaaattggtccagattcattctttttcatatggcaatccagttttcccagcacattttattgaaaagtgtgtcctttccgtagtgtgcatatttgttgcctttctcaaagatcagttggctatagatatgtggctttatttctaggaactttgttctgttccattgatctatgtgtctatttctgcagtcaaatgctttaccactgagctgtacaccttatgtgtctatttctatccattaccatgctgttttggttactaacaacttgtagtataatttgaagtcagatggacttaatttgagggaaatcttgaggttgtcatttcaggtgggctctgtgttgagagaacagggggctgagacttgggggccagaccattggtggctccacagacatcatactctgtccagaacggtgcagacctggcataacagggattctggattgcatctgtaaaaagggaggcctggactgggtaagcatatggcctgggatggaggctgaagtgtgaggtggtttcgatcctgcacctgcaggcttggttgaccctcagggccactctctgttgaacaagagaaatgttattgaggctggtggagtagctgggttccagatcagagcactgctttttccccttctctacatgtcagggctacaggggatgatctactgctccagccaaggtctcctggcaagctcactttagaagattatgtagcaggtagacctggttgcagaaaggaccagtacctgacctgcctactcttcccttctctataactcattaacttaataatgtatgaaacacttattgatttaaaccccaattagacagtatctttctaagtgtgtgcaaacagataggcagttaatagtgaagtcattatgttaaatttctaaaagtgagccgggtgtggtggctcacacctgtaatcccagcactttgggaggccgaggtgggtggatcacctgtggtcgggagttcgagaccagcctgaccaacatggagaaaccctgtctctactaaaaatacaaaattagccgggtgtggtggcgcatgcctgtaatcccagcttctcaggaggctgaggcaggcgaattgcttgaaaacaggaggcggaggttgcagtgagccaagaccacgccattgcactccagcctgggcaagaagagcaaaactctgtctcacaatagaggagaggagaggggaggggaggggagggcagaggaggggaggggggagggcaggggaggggaggggagaaagtggttcataattggtttgatgttaatttatctcgtttgctttccttggaaaaagttaatatcgcatcctctaaaatcttaagctaaaaacatacatgaaaatttcaaaaccccactctttcatttgcattgaactcatgtacaaaaccattaatcttggaccatagccgctgatatatatagtacatgctactgatgtttgatactaatatgagccctgtgagggggcagctattcttgcaatctatttacagatggagacactgaagctcaggtgggtttggttcttttccatggtcacagagctgcagcactgaggcctgaggaactttattcaatgaattgagatcagtttgctcccaggcagggcagacgaggtggtggtccatctcagcctgaaggatccttccatggctgtcaatttctcacggcctttctcttccctcagggtcccctggcgatggcagaaatggaccctacacaggtgagtagagtgtttcctactattcacccaccctggttatctcccagatggttttggcaggtgacaaaacctcttttcctgtctttctcttatgtctgaagggtgagtggtttcaccagttagtttcagtattacaagttggctgctgggttacatagactggtccccgtttttgagaattgatctgataagatatgtttgggcctcttgggcacaggattcagaatgtttcaatgtttggaggagagactgagctaggtttttagggaactgcaaatgtctgttacatctggtaggaatacggagcagaatgggaggtggctagaggcacacaaacatcaggcctggaatgacagcctaggtcctgggtctgtaatctaagggaagtgggagacggggaagatttgaagcaaaataggtagtgataggaccccagtttaagagactttctttggcttctgagtggaggacagactgtggaggtgagggtaatggaagggagatctgagaggatgttcctgcagcagtctaggtggatgttggtggtggcttgtcaagagtggtcatagcttcagttttaactagagctgcccacattttatgatacagagagtgaggcagctggggaggtgggatagaaggggaatcaggagtggccccatggtttttgtttggaagcatagatgctccatcagctaagatgggagaagtcagcagtattaggaattttcagagtgagtgtgaggagtcagtgtttgttcaagccacagatgtctcagagactcctgatggaggagttcaggttggagatgtccacactatggtggctgtcgtatggaccaggatgaagccatggattcagtttaggtgacagcatctctaggttatggtggcagtgctgttcgaagacagagaattggaatggggcatgagaactgggtctcttactgggtagctgtgcagtggtggaggagtcactagacaaatgagggaatggagtgtttgtggggatgagtgtatgtgagatggtggggtataggagtgagaaagacttctgaaggagagtggacatgatggggttgctgaggggggataatagggtgaggtcggagagttgctaactatcagttgggaggaggtgaggatgggagttgtattaatccgtttccatactgctgtaaagaactacctgagactgggtaatttatgaagaaaagaggtttaaccaactcacagttcttcaggcttaacaggaagcataactgggaggcctcaggaaacacaatcctggcggaaggtgaaggggaagcgaggcacatcttcccatgatggagcaggagagagggagagaatgaagggggaagagccaaacacttttaaacaaccagatctcgtgagaacttactattatgagaaaggcaaggggaaaatatgccctcatgatccagtcacatcccaccaggtccctcccctgacacgtggggattacaatttgacatgagatttgggtggggacacagagccaaaccatatcaggagtggaaatatggaggtcagtgcagctgggcttggaatgaggttttggtggagagcaattttcctgactgtttatgggacagagtgtaccatgaggcaggacacagctgagagtatgggaagtcctcacatggtttgggcagctgacagtgaagtgagaaacagggccgtgtagggaaccttcaacccagggcttagggctgcccccggtgctaggggactttggtgttctggggcaggactgggaatgaattggatgctgagcgtatttgccgtgcaccacctggtttccgtgtgcagagtggcctgttaggaggtgaaggaaatgcctgtggtgtgggctgggagttgtctgtggaattgactggagtggaggtgtgagagatgggattggagtgctgtccaaagagtgatgtgcaggcaggaggagtgtgaatggagggcctcaggccctggccctggtagctcaagggaggaggatgagtctgagtttggttgtcttgggaggcaagatctgggtgactccatggcaactggctggcaggagaggatggatccccccacgggaggcccacattccttttctaccttatcttccatctgtttcctctgtgtgctggacacggtggccaatgtcaatatggagagaaaagtcactcatgccacctggatgtggtttctcttccacattgggagggtgtggaagagattgagcaaggaatggaggcgtaggggacagcgatgagatcctggagagagaaatgtagcagtcattttacctattgggttttaatttatggatgtgagtgattgatgctggggacaggccaatgactgaaagaagatatttattccttgcatttccccaaggggggtacataccacataacacagggccacatggtgaggcaccagatttggtcaggaggaaaattggagtgaggggaaagtttagtttagtccacggacgctattggggtttccaagggaaagcaatgcagggctgggcgtcaggatagtttggctagtttaaataattccaggacacctgggctattgggactgtccctagttttgcagtacctggccctgggttgatttagagtacgggaaatattggcttggtttgagaatatgggcccagggtggtaggggagatggaaacacatttggctgttagtttggccctgtgtttaatgggtggtaaatataagtagaaaatagagaacttaagtaaatacagcttgaaaagaagctgcttatgtattcatctttcccaatttggcagggccgtgtggtctttgaggacgtggccatatatttctcccaggaggagtgggggcaccttgatgaggctcagagattgctgtaccgtgatgtgatgctggagaatttggcccttttgtcctcactaggtaaggccctcacacttgcccagtgtcctgggttaggctgtgttacccctttttacccaaaggcagctctgcgtttcccacagtgagaccgtgggtgctgcttcttttccctgtttcttggcatatatgctgtgggaggcagggctgggccgtgtgttttataccccctttttcctagcatccccatccctgctgctctgaggcttacaagaaagggctcaagagccagaaatgttgaatttggcatagagaccccaccagccttgtctgtccctggtcaggttactctgtccaaacacatgagacctgtgttctgttgtcccctttctctcactgatatttcttggtgccttcctgtgcttggaatttcaggcactgccctggtcactgattttggggactgctgagttgactatgcaggacgcaggactcttctgtgaagttcttacgattatagaatgtgggatgccatgggcttgatctctctgggcatgtgctctttactctttttctctttctttcccctagagagggccccaggcacctgagagggtggatattacttcaacaatggcattagaggctcagggacatggccctggtgcctgggaattgggaaaagggttgatgtcacagctggggtcaaatcaccctgggaacctgtcctgtgttcaccattgtttgttgccagggccactggccacagatttctaccttttcttccccattatcatttctagtatgactcctggcccctgcacctccaatgccccacagtctgtacttctggggccaccacccttcaaccattcttttccactgctccctttgaatgcctgccaacacgtggcctgtatttaacatggtgtgaggtctgcatgtatccctgaacacaagctcctctgtcacagtctgatctctctgggtttggagagaaccttctacacactgcttgccagtctccagcaaccatggcctgttgatggctgttttcagaggagtgagttggagaccctgccttctctctctgtaccatacccctcccttgtatgcttaccatcatcagggctctcccattatggggccttgccaggcccagccctgcatagtggaccctcctctcactggccttaatgtccatgatgtccccaatcccatggccttatttgtgtgtgtgcctgacacacatttgtgatggagctgcttcctcccaccagagtcaacatgcacttctccagcatttctgttctgacaggttcttggcatggagctgaggatgaggaggcaccttcacagcaaggtttttctgtaggagtgtcagaggttacagcttcaaagccctgtctgtccagccagaaggtccaccctagtgagacatgtggcccacccttgaaagacattctgtgcctggttgagcacaatggaattcatcctgagcaacacatatatatttgtgaggcagagctttttcagcacccaaagcagcaaattggagaaaatctttccagaggggatgattggataccttcatttgggaagaaccacagagttcacatggcagaggagatcttcacatgcatggagggctggaaggacttaccagccacctcatgccttctccagcaccagggccctcaaagcgagtggaagccatacagggacacagaggacagagaagcctttcagactggacaaaatgattacaaatgtagtgaatgtgggaaaaccttcacctgcagctattcatttgttgagcaccagaaaatccacacaggagaaaggtcttatgaatgtaacaaatgtgggaaattctttaagtacagtgccaatttcatgaaacatcagacagttcacactagtgaaaggacttatgagtgcagagaatgtggaaaatcctttatgtacaactaccgactcatgagacataagcgagttcacactggagaaaggccttatgagtgcaacacatgtgggaaattctttcggtacagctccacatttgttagacatcagagagttcacaccggagaaaggccgtatgagtgcagggaatgtgggaaattctttatggacagctccacactcattaaacatcagagagttcacaccggagaaagaccttataagtgcaatgattgtgggaaattttttaggtatatctccacactcattagacatcagagaattcacactggagaaaggccttatgagtgcagtgtatgtggggaattgtttaggtacaactccagccttgttaaacattggagaaatcacactggagaaaggccttataaatgcagtgaatgtgggaaatcatttaggtaccactgcaggctcattagacaccagagagtccacacgggagaaaggccttatgagtgcagcgaatgcgggaaattctttcgttacaactccaacctcattaaacattggagaaatcacactggagaaaggccttacgagtgcagagagtgtgggaaagcctttagccacaagcatatacttgttgagcaccagaaaatccacagtggagaaagaccttatgagtgcagcgaatgccagaaggcctttattagaaagtctcacctggttcatcaccagaaaatccacagtgaagagaggcttgtgtgctccatgaatgtggggaattctttagctaaaactccaacctcattaaacatcagagatttcacaatggagaaagtttaccattgactattgtaattgggtagtaatgttatataaattccacatttttatgcaactaatctccagaacatttttcctcttaccaagaagtaaaatgctgtacccattaacaacaactcattccccttccctacttccccagaaatgtctcaactatatttctatactctatggtacttatatgaggtaccaatagatatctatgaatttgatatatatttgtacctcatataagtggattctacagtatttatcttttgagactggcttatttcacttaggataaggtcttcacggttcacccatgttgtataatgtgtcagaatatccttcctttttaggtgaaataatattctatggtatttatataccacatttatttatccattcatctgttagtggatacttgggctacttccaccttttgcctattgaaataatgctgctatgaagatgagtgtacaagtgtctattcaagattctactttcaattcttatagggtatatactcagaaatggtggtgctggatcatataggatttctattttttttttttgtttgtttttgagacagagtcttgctctgtcacccaggctggagtgcagtgctgtgatcttggctcactgcaagctccgcctcccaggttcatgccattctcctgcctcaccctcccgagtagctgggactacaggtgcctgccaccacgcctggctaatttttttgtatttttagtagagacggggtttcaccgtgttagccaggatggtcctgatctcctgaccttgtgatctgcctgccttggcctctcaaagtgctgggattacgggcgtgagccaccgcgcctggccaggatttctatttttaatatttttgggaaaatttttccatagtacctgtgccattttacattcccaccagcagtgcacaaggattgcaatctatatacatcctcaccaacattgttcattttctatttctgtttttggggttttttgtagtgccttttgttttggatagcagctatcttgttggatgtgaggtggaatctatagtgtctttcatttttattttgtgaatgattgatgatgttgaggatcttttcatgtgcttgttaggcatttgtgtatctggaaaaatattcaagtcttttttttccatttttaatgggactatttgctttttgttgttgagttgtagttctttatacattctggatattaactccttaccaaatatatgctttttacatattacctcccagtccataggttgctttttcgctctgttgattgtgtcctttgatgaaattttaagttttgatgtactgttgactctttctgtctgtgggttctgtattcatggatcgaagcaaccatggatcaaaagtatttggagcatccatggattgcagtgatcattaatcaaaaatatttggaaaacaaaaagggtagttgcatctgtactaaacatgaacagacattttttcttgtcattattccctaaactatatagtataataaatatttacatagcatttacattgtattagaagttataaataacctaatgataatctatataggaagatgtgtgtaggttatattcaaacactatgcctttttatgtgagggacctcttgagcatcagatgattttggtatccacaaggggtcctggaatcagtcccccacagacaccaagggatgactgtagtgcattttatctatttttacttctgttacctgggcttttgatgttatatattaaaaaaaattagtatcaaatccaatgccaagcattttccctatgctttattctaagaattttatatttgaaggtcttacatttaggtcttttttttttttttcttttggaggcagagtcttgctctgtcacccagcctggagtgcagtagtggaatctcagctcactacaacctccgcctcctgggttcgagccatcaccccacctcagcctcccaagtagcttggattacaagtgtacaccaccacacctggctaatttttgtatttttagtagagatggggttttgccatgttggccaggctggtcttaaacttctggccttaagtgatccccctgcctcggcctcccaaattgctgagattacaggcaggagttgtaatgcactgtgcctggctacatttagatctttaatctacttggggttcatttttgcatatggtttaaggcaaaagtccactttatgtggctatccagttttccaagcaccattttttgaaaagagcatctttcctctgttgagtagtcttggcacacttgtcaaaatcatttgtccatatatgccatggtttatatgtggattctctattttattggtcatatgtctgtctttatgtcagtaccacacattttaggtgtgtgtgtgtgagactcagtgttgaggacaaggctagtgggctttcacactccagactgctgtattccagcccaaattactcaaattagccaatccatggggaacatggaaaacgtagctaatgcaatccgcttgccttacctaagttgtcccctgcagcctcaggttgctgttactgtgtttcagatgcaaccctctgtgggaccctacccaagttctctcattcttagctataggtaataaattgttctgattttgtgtatccaagtgacattgggttgtttcttgctatcagaagaacccagaaaagtattatgaatctagtgaatgttggaaaatctttagccattagcataacctcatttcgtgccagcatgttcaccctagagaaaagtagaagtgaaggcaatgtcatctttccttgttaacatgataactcagtagagcaatgctttggagattagctttttagggagagagccagcagttgagcctcctgcatctgaacatccacactagggatattgtctgtactgccagatatatgggaagattttgtgaactgtgttgcagttttcaacttgactggggcctttcccagagttatgcccctgccagtgcctatttaaaaatgtcatctcttttctaccaactggcaaagagccatggtgtgtagcattttagtcacattaaaatgcagttatggcagcatgctgtgttctctatctgaagaattcactagtcacttgaacactttggagtcctcacccccctcctatgattgattagggcatagacatcagccttggacagaagacatggactggctttggcaggcagattgcagaaatttcctttctccaggggaaagtattggttatctcattgatagtggtaggaggcagatacattgctaggcagactaaggacgggtccctggtgaaacccaaacttcaagccaacgacagtttaaagcctgaaaattgagctgccagttccaagtagagtccatgactggagtgagaacttcctcaatgccttttagccaatcaaatggtgctttttccaggcccacccatggaccaatcagtatgcagtctccattctgagcccataaaaaccctgggcccagctacacattgggctacccactttcaggtcccctcttgttgagagcttttctgccactcaataaagttccctgccttgctcactctctggtgtccacataacatcattcttcttggtcatgggacaagaactcggaaactgccaaatggcgggtgtgaaaggagctgtaacactgtagccctcctgccttccaccagccccaggcagccaccccatgtgacaggaagcagcggcagcagggccaggccagcccatgagccatgggctggagcagggtggcaggaccaaacaagctgtgacacacccccattcactgaagtgtgtggatggtgggaacagacaagctgtaacacaaatgagctgtaatgcttccttggggctcagaccttgggattccctgagcaaaagctgtaacaccccttggggctctgtggttgctggcgtctctgagtttttgggcgctgccatgtcccccttgtccagataccagcttccaaggcagaagccggtcgcagcacgcctggaccagctgtaggccaagcacagagccatggtgggcacaggatccggctggtaacatgagccaagcacagcctgtcggactgagttagttgagtgagtccagcaggccaagtgatgtctgggcagaagtgcttcagccatggaggtttctgcctggtgaagtggcactgaaagtatcttgtgtcatcatgacacttgggatggaattttccaacctgccagtcacccacactgtgaactccttctcacccctaatgcacacacataccctggttggttttgtgataataaaggtcacattgtttaagctaccttaactcttggaaatctagtcaccgtatgcagtgggttttgaacagaattggtctctgctagaataaaagcatgaatggttttttgtgggacctttactttgtgagctccagagggactagtaggaagcaaaagatcagctcgtatgcagatttgggccaatttgcattgccatgagaagcctcctgggaaagtctgaaggacttctgcacaaaatttcaagccctgagtacaaagattatttgtattcagaaaagtacaatttgaggagaaaacagttgccttgatgtttaaggcattgggcaacagtatgcattgggtatccctacccatatttcccatatttcccctgcattgatgagggatagctgtttcttgtgacctgctggaagctatgggtcctgaagtaaaacactatctaggtatatgttcctggctgttgacctttagggctagatggaagccatattcttttttttttttttttttcttgagacgtagtctcgctctgttgcccaggctggagtgcagtgggatgatctcagctcactgcaacctcgcttcctgggttcaaacaattatcctgcctcagccttccgagtagctgggactataggtgcacgccaccacacccggctaatttttgtatttttattagagatggggtttcaccatattatattggccaggctagtctcaaactcctgacctcgtgatccgcccacctcagcctcccaaagtgccaggattacaggagtgagccactgcacctggccagaagccatattctataataaatagtggttggattaataggacatgggagagactgcagtagagtggatgagtcccctctaaaggagcactcacaaatgccctggtagctatggctgtgtggggtggggtattacaggaattccaaagacctaaggagctgtgtacctcctgtagccaaggtcaatgtcagaacaactaaatcaatgattttatgaattcctgtagcctccctggactataaatttcaaaccatagttgcatcatctacatagtgatgggccttgagccttccctaaagataaaaagcctacatagcccgtgctgccccatcacctgtgtgtcggaacatcttccttgtttcaagctacatgagtgcttttttattctgttgaagtgtgtcatgtcatgcctggtgaattaataaatctgtcctctgcaactgacagggttcttccactgtgaaacaagagggttgtatataggttgcgtttaactaacagagttaattaaacctttttactttaaaaattactcagtcttgggccaggcgcggtggctcacgcctgtaatcccagcactttgggaggccgaggcaggcggatcacgatgtcaggagatcgagaccatcctggctaacacagtgaaaccccgtctctactaaaaatacaaaaattagctgggcgtggtggcaggcacctgtaatcccagctactcaggaggctgaggcaggagaatcacttgagcccaggagttggagattgtggcgagccgagattgcgccattgcactacagcctgggcaacaagagtgaaactccatcttttttttttttttttttttttttgacacagagtcttgcactgtcacccaggctggagtgcagtggtgtgatctcagctcactgcaagctctgcctcccaggttcacaccattctcctgcctcagcctcccgagtagctgggactacaggtgtccgccacgacgcccagctaagtttttgtatttttagtagagacggggtttcaccgtgttaaccaggatggtctcgatctcctgacctcatgatctgcccgcctcggcctcccaaagtgctgggattacaggcatgaaccactgtgcctggccactccatcttaaacaaatttaaaaaatagtttatctctctattttttaatttactgttgtttgtgggggttttgaagatgtatcaatgattttggttgagtagggcactttagctttacttctgagtgcatgcagcagtaaagttttttttttatgatttccttggctttaaacagttcaagtggttttctcaagtgtgttagggtgcacactgttagttattagtggaggttttggtaaagttgtgctgggaacagaatgccagatgagcttgtcttcaggcttcagcagtactggtggtgagctatgtatgtttatccttgtactttgcggtgctgaatgttggtacctgtgttggcagttctaggcaggccgattcttgggcctctggttggctttcttagatgctggttgtgatagcagtgtaccaagcatgtgagtgcactcttgagcccctgggctgctggtgtggcatccgtgatggtggtggcagtggtgcgaaactcttctgggtcgcacttgctgtgctcattagcagtggttgcagcgggctctgtgggccagccactagaccagcagatggcgcttgtaggcaggagatggctgaagtgggtgcagtagggtatttaggcctaacctcagcgccctaggagtgctcaggtgtttcacttggtggactaggttgtgcaatctctgggggattttaaaagtttattttgcaattgagaatgggatgtttagaatttttgtctcctactgattaaaggtagagtatggggaaaaaaacaggcaaaactaggagtttaaagaaaaggagagagaagaaaaagaaatgaagatacaataatacagaaagaacagagggaaaaactttatttatatttaatacctatgatgtgacatgcccggagttaggagcattcataagcaccatctcatattatcctccaactaagctactcatgtcagaaaaaattaaaattaacaaaggtcaacagggagtaagaaatagaaaatggaaaggaaacaattttggagtgagacctacaaaatgatctcagaatttaccctctgataagtctttctttgatcccagagtgcacaaaatgttacatgaaaaaacaaattaatataattacatctaaatttcaagctttctatttcataaagattatgagtcaaaactgagtgagttcagggactcagagaagacatttaaaatatctaaatgtgcccagttttacggttttaggcatgcgagttttagatttttttgcttttttattgagacagggtctctttcacctaggatggagtgtagtggcgtgatcttcactcacagtagcctccacctctcaggttcaagcaatcctcccattcagcctccccagtagctgggactacaagtgcgcactaccatgcttggctaatttttaacttttttggtagagacggggatctcactatactgcccaggctggtctcgaactcctagactcaaatgatccttccacctccacctttcaaagtactgggattacaggcatgagccactgtgcccagccaaagtttcagattcttcttaaaggaataaagtcagagatcttagaaatgaactaaagcacgagcatacaataaacaagagagaaaaatcagatggttatcaagaatatgaatggatattcaaactcggtgtcagagaaatgcaaattagatattattgcatgttactttaagttctataaattactatactatggaaagaaatatggggtgatgtagctgcaatcatgtatatttcatggaagagtcaaagactgtagcagtttcataaagcaatctgcacaggtactgtaaaaaaaatgattttctagaatatcatgtgacacagaaagcctgtttctggtatatctctcagtcaagtccataaattcttatgtgagagaagttttctcacaatactgttcaaggcagcagggacatggagacaatatgttgtagcattaagtgtaagaggaggaccaaagacatctatgagtgaagtagaagactgaatgtccacactaaagtacaacagggcagttactagcatttaagtagactttgacacaggagtatatatacatattaaacacacattttgagtaccaacaaagggagaaagaagtctatagtacagtacaattaaactacacaaaaagtaacagtgctcctctttctaaaacacatgtaaatacaaaaacacacaacagacctttagaattgttgtctacaagtggtggggtgatgaagtgtgaggaacaggaatgagtggaaacacgtcggaacattgaacaagacgaggtccttgtggggacataaggagagaatgtccactcactgtccagagcctcctgggccattgtcaccatacagccgctcattacatgaaagtggaatttcaaaaggtagcgaaacacctaataaaatatgttgaaagggctgggcatggtggctcatgcctgtaatcccagcactttgggaggccaagccgggtggatcatgaggtcaggagttcaagaccagcctggccaacatggtgaaaccctgtctctactaaaaatacaaaaattagccaggtgtggtggtgcacacctgtagtcccagctactcgggagctgaggcaggagaattgcttgaacccaggaggcagaggttgcagtgagctgagatcgtgtgactgcactccagcctgggcaacagagcgagactctctctctctccctctctccatatatatatatatatatacatacacatacacaaagatatgtggcctgtcaccaagtgttagatggatgtttgggccaggcgaggtggctcatgcctgtaatcccagcactttgggaggctgaggcgggtggatcacctgaggccaggagttcaagaccagcctggccaacatggtgaaaccccgtctctactaaaagtacaaaaatcagccaggcgtggtggccatgcctgtaatcccagctactcaggaggctgaggcaggagaatcgcctgaacctgggaggcagaggttgccgtgagccgagatcgtgccattgcactccagcctgggcgacagagagagactctatctcaaaaaaagaaaaaaaaagtttgtttagtttctgttggtaaatatctagaaatagaattgtaggatggtagggatgtattgttggtaaatgattaacatgtttttaattttcagttttttcagagacggggatctcactatattgcccaaactggttttgaacttatgaactcaagtaatcctcccgtcttaacttccatgtagctggcactactgaacagctttaactcttccagaccttcagttgggtggttttttcttttcctttcgtttccttctttctctctccttccttccttctttttgtaatttgataaaccaaatttcaagactttggccaaaaaacagtcttctcctttactgaatatctcagtgctccattttatttttccctcaccaattctgcaggagagatcacaagactatgtccatatctttatttgtgggggtatgattttcagctaacatagctgctaagtgatttaatttacaattatagtggtagaaaaatagctctaacttctgaggttttgtaatttattgtaaaaagcggaatacaggacatttaaagtgacctgacaaggtcaatacaggactgaggactaattcattaaatacgtcttacgtgtcttagaggaccacagacagctagcaaccctactcctaatgtgtcccatgcacttagtattgtacctggcatcgaatgagtgttcatcaaatatgttagagtaataaatacgacagcacagtttccctattcagctttacttttctggtaactcttttaatatatagtctttacctctcccttcaagctgttaatgcacaatgttttcaagtttgaaaaagaatcagattttggacaccaaacttgagtgtgtccaaggttccaggacaaccttagcttttttcctcctatcacaaatatgtttctctataactatttttgccactttctttggatatctacataatcgtcattaatagtttcagtaatagccatttcacaagagttattcagagacaatttcaactccctgtgcagacactgttgatacaatttcaggcgaaatgataaatcactttccactaatgagatgagatcatgcattcccaaacctttatctcaggagtaagatgctttctttgcacaagggctttgactggtggaaggccacactattctggcagataatggtagataagtcgcttttccttttcagttaggtttcagtctcttaaaataagtggaaaatatctcagatataaagtaataagtatcatgtgaataaagtgttgctgggtaggctgaaagacaataactgattattcagaaaggaaagatattactcctcaaactccccatcatgccatgtctgggtcttttcaatgtgcccagcagagcacattgaagatcataaaacagtctccagagcttcgttctgtgtgtatttggcaagcacaaaagagctgaccgctatgcgtggaagaccagttctttatggttggccatgttccttcggatgttcgtcttttgggaacttgctgtgctttacagaatctgaaaggacaggtctctgaaacatttctctgacttgttctagactgccttccgggaaaatctggatgcttgccgtttaaaagccaatgaagcccctccacgtccttggagccccgcaactgcatttctcaaagcctcaggaggatcctcctggctttcatcctgaacgcgagttaacttaagttcagaagcggggcaggcagtggcctgggaactacattacccaaaagacacagcggcggacacaagcagcgagtgtagccaatgaaggcctagcagagcggcgtctacgggggttcgcaatgcgtgtgggcgggacttcctgcaacgcctcctggggttgtcaatatggctgcgttgggatctgttcaccttcaggctgagtcgagactgaggtgaaaaagcggaaaaacgcgagaaaaggtttccccgttgtacagaggctagagtgaggctcggttgaatcggttgcaggcgttggtgcctctgtcagcgtccaggtcactgccgctcccgccccgctcttccctggctgtgctggcggaggctgcgccgatgaacctgactgaggtgggtgccgcgtcccagggcgccccgcccgatccctcctccgagtgccgaagccccgaggaggggccctgcaggtcaggcccctgtgtcccaaagagaggagcgttcttgtgtggggtaccggtgtccgcggtgctgtgaggcgggggagctcctgtcagggacctgcacgtgcgaggcttagaggtgctgcagagcgggcggcactggggagcccgagcgtctttgtctccacggagctgagggtgaggcggagtctcgcctgggagggcagcggagctgctgaaagccgtagaaggctgtgcaggaagggttatgcccagaggtagacgtttaaagttgggaaaaacaggatgttaaaccaggacaaggggaccgctgaggagaccccttgagttatggtagggatgggccagaggggttgcagtagaggggaagtgtgatgagattctggatggatctcagagatagagtcgacaggatttcctgctgcatcaaatgtagcagtgagggtagtgaagggtctattccatggattttgttttggcctgaaaatctgaaagaatggagttggagaagtcagcttagggagcaggtttcagagaggattatgagttgcattttggagggctgagttttggagggcagatcatgggtgggtccataagcctgacgctacctttagaaaggcgcagacctgtcataggagggattctggctcatatctgcaaaaacggagttctgaatgggttaaggaactggcctaggctggagactgaggtgtgaggtggtttagatttctgcacctgcagacccagcagccccccaggcccactctgtggaacaataggaaggtcatccagactagtggggacattgggtccagacgggggtagggctttctcacatctagtcaagggcctccagcaagcttccagcaactgaatttgtagcaggcaggcctggttgctgatgggaccagtaactgacctgcttgcttatcccctccctgcaacttatttatttatgaatgtgtaaaacattttttttttttttgagacagagtctcgctccatcgcccaggttggagtgcagtggcgcgatctcggctcactgcaagctccgcctcccgagttcaagcaattctcctgcctcagcctcccgagtagctgggactacaagtgcccgccaccacgccaggctaattttttgcatttttagtagagacggggtttcaccgtgttagctagtatggtctctatctcctgacctcatgatctgcacgcctcagcctcccaaagtgctgggattacaggcatgagccaccgcgcccggccgaatgtataaaacatttatttaaccactaatgaaccagtatccttctaaatatgtacacataggtcggcagttagaaatgaatgtaaccaatagttaaatttattcacttaataattgttgaatgttgatttttcttttttctttttttttttgagacggagtctcgctctgtcgccaggctggagtgcagtggcgtggtctcggctcactgcaacctctgcctcccgggttcaagcgattctcctacctcagcctcccgagtagctgggattacagacatgcgccaccatgcccatctaatttttgtatttttgatagagacagggtttcaccatggttggccaggatggtcttgatctctgcacctcgtgatccgcccacctcggcctcccaaagtgctgggattagaggcttgagccaccatgcccggctgaatgttaatttttctatttgcttgcaatggaaagttttatgtatcacatttccttaacaccgtaagaagtgggaaaaatacacacccaaaatttcaaaacccttccatgtcatttgtaccgaaaacatgtaaaaaatatttaatccagtagaaagaaattgctgatacatagtgtgtactacttatatttgatgcccatataagccctattagttggcaatccttttaatctctattttacacataagggcaccgagacttaaggaagttcagtcctcatcaagacactgaaccctgaggacttactgtgtaccctcagataactttgctctagttgcagggccagaggtggttgtacagtcagcctgtaggatgctgcaatgctgtcttaatcctcatggcctgcctcttcccacagggttcatagcagtggcagcaatgcttatggatgctggacaggtgagtggagagtgtttccagctttcacccatcccagatggtttcagcatgctgatatagggaatggtgttatcctgagactgttcaccttttcttctctctcccttgggtccaaggagagcctgtagttccaccagacctgggttccaaactcagtgcctggttatatagagtggttctagttctcacaactgatggtttgagatttggcaaggcatctcaaacacaggatctagaatgttcaaatgcttggtggtgagacttagatgggatgcttagagaactgtagcttaatgttctagctggcaaggataaggagcacagcagcagggcaggaggtcggggcatgcagggatcaggcatggaatggcagcctgaggttgtctaggtttttgtttttgttttgttttgtttttgagacagaatcttgctctgtctccaggctggagtgcagtggcgcgatctcagctcactacaacctccgccttcctggttcaagcgattctcctgccccggcctcccgagtagctgggattataggcacccgccaccatgcccggctaatttttgtattttttagtagagatggggtttcaccatgttggccaggatgttctcaatctcttgacctcgtgatctgcctgcctcggccctcccaaggtgctgggattacaggcttgagccaccacacctggccttgtttttttttttttttccagacagaggctaactctgtcgcccaggcgggagtgcattgatgtgatctcggatcattgcgacctctgtctcccaggttcaagcaattctcctgcctcagccttccaagtagctgggattacaggcatgaaccaacacacccagctaatttttgtatttttagtagagacaggatttcaccatgttggccaggctggtctcgaactcctggcctcaagtgatctgcctgcctcagcctcccaaagtgctgggattacaggtatgagccaccgtgcccagtggttctaggtctttaatctgaggggggtagtagctagggaaggtttgagaaagaaaaaagaggtgatttgacctagattctttttttttttttttgagacggagtctccctctgtcgcccaggccagagtgcagtggcgtgaactcggctcactgcaagcttcgcttcctgggttcacgccattctcctgcctcagcctcccaagtagctgggattacaggcacctgccatcatgcccggctaacttttttttgtattttttagtagagccagggtttcaccgtgttaggatggtctcgatctcctgacctcatgatctgcccgcctcagcctcccaaagtgctggaattacaggcctgagccactgcacccagccagatttgacctagattctaagaggcttcctctgcctgcagaatggaggacagagtgagagttagggaagaaccaaggatacctgggtgataattcctgccacagtccagtggaggttggtggtggctggacacgagtggcggctgtggaggtgggaggggtgggtggcttctgtaggttttgatctagagctgctcacattttttgatgtacagagcgaggaagctcgggaggtaggatgcaagagggagtcaggaatggccccattgttttggccttgttgagaaggttggatgttccagcaactaagatgtggtaaattttgtagtagggggagtttaatagagcatatgaagaacgaggtttgggctaagtcaaaaatgttccagagactcgagtagaggtgccagactggcagttgaacacacaggaatggagttcaatggaggtgttcaggatggagacatctactatatgatagccagcgtgtacaccatggtaaatctgtgggtcagatttaggaatagacatctttagattctggaggcaatgctgttagggagaaggaaggggaaggaaggggctgaggactggatctttctgttgggcacctggatggggttgctgggcatcacaaagacagatgagggagtggatggactgaggatatgtgtgtgtgtatttgtgtgtttatgttggagatggcctttggaaaataaaggcttttgagggggagagtgcacataaaagttggatggtgaggcatctccacaaaagaggtgagatgatagtgaggtctgggaggggcttagtaccctattatggactcaacagggttttgtggcaaatattggttgtacctgggtagtttcacgcgaactctgagactattttggcagaagatgggatcatctagaagcattgctagtcctggggtggggatggtgttggggaggtcagtgtatctgggctttggattagagttgggggatagagaaagtcgtgactgcttatgggacaacatatacatgtagaagggggagacagccaagatctggaactcaaaggaggtgtgcaagaatatgtgggtttggaaagctgaggtcaaagaaagaaacaggattgggttgggagacgttcaaagcaatgtttcctaaacattgcattctggtcattctaggggcaaatacgattctggttgcatttgtcatgcactgcaggatttcatgtgcagagtggcatggtaacacgccatggaaatactcccagttgggctgtggtggttgttagtgttgccaagagtggaggtgttggatacatgagggaggtgccatccaaagcctgagtggaggagcatgaatagatggttccacctctggcactgggcacttaagggaggagggtgagtccaagtttggttatctgagaggcaagatctgggtgactctagggaaattgagtgacaaaagaaaggtaggcccccatgtgccaggtgttttttttgttttgttttgttttttgagatggagtctagctctgttgcccaggatggagtgcagtggcgcgatctcggctcactgcaacctctgcctcccaggttcaagcagtactctgcctcagcctcccgagtagctgggattacaggtgcctgccaccatgcccggctaatttttgtatttttagtagagatggggttttactatcttggccaggcaggtcttgaactcctaaccttgtgatctacctgcctcagcctcccaaagtgctgggattagaggcatgagccaccatgcccggccatgtgccaggttttgatggcgcttttcagtctctttcccccacccatctttgttctatactggagtcagtgatcagtggcaatgaggggagagcaggtacaggtgccatgaagacctagtgtctcttcctccttcagaagtgggtggaggctagcagggtgtggatgtgtgtgggtgtggtgaggagcactgaaggtcctggagagggaagtgtatcagtgattgtacccacaggatttcaatctgtgaacaagagtgagtgattacagaaaagccaatgacattgaaataattttttttttcaattggtgagaaatcatacctggatgaaatgatttttattcctttcatttcctgagtgcagggagcatgccacatcacataaagccacagaggaaatagcggatttggtcaggtggcagatgcacagttgaagggagagcatatatcagtggctttattggggttttggctggaaaggcatgcaggggagagtgaagagcttaagactgggtagtttgcatgattttggcagccttggggtatagggactatccctccttttgtggtacaagccttgtgttgatttagggcaggagaaagaatcatgtgtgattgttagataggaggcagttcagtctatgggatctggattataagagaaatgttaaaatgctggttgttattttggtcctctaattcttagatttcaagtagataaatacagatctaaggaaacagaataagaagttgctcatgggccgggcgtggtggctcatgcctgtaatcccagcaatttgggaggccaaggcaggcagttcacgaggtcaggagttctagaccagcctgaacaacatggtgaaaccccatctctactaaaaatacaaaaattagccagtcatggtggcacgcgcctgtaatcccagctactcaggaggctgaggcaggagaatcacttgaatccgggaggcggagcttgcagtgagccgagatcacaccactgcactccagcctggcaacagagcgagactccatctcaaaaaaaaaaaaaaaaagaaagaaaaaaaaagttgctcacagactaaactgttataattttggcaggattatatggtttttgaggacgtggccatacatttctcccaggaggagtggggaattcttaatgacgttcagagacacctgcacagcgatgtgatgctggagaactttgcacttttgtcctcagtaggtaaggccctgacacctacgtcagtgtcttgtgctgggcaatgttttttcacttttttccttggcatctccgtctcacaccaggtcatggatgctgcatcctctcctggtttcctggcatatgtgttgtggcagctacagctgggctgtgtgatctgtatcaattttccttaagaagcttagctcttgtcactctgaagccttataaggctcaaaagtcagaagtcctcaggtttctcaagaatatcctaatgaccttgcctgtccctggttagtttactctgtccaaatgcatgacactttctctgtgcaaggctttctccattcttcttgctgacatagggataccctgtgtcaggaatttcagggacctacctcgtcactgcttgtgaggactgtgggcttatttctgcaggactctccactagaagttctggtaactttagaatacagcatgtcctgggtttattgctctgtgtacatgctgttgacaccctccctttccctgtctttcccctagcttggctaacgccacacctagatagttgctcaccttgagcaaggtagaggtccctgggtgcctgacagagtggacattactccattgaaggcaagagatgctcaaaaggacttggccctggtggatgggagctcagaaggggtgtgatgacagggctgggttcacatcacactgggaatcaatccagtttgatgcccctgccagtggccacaccgcatgtctctcttttcttccctattgtgatctctcttttgactttcatctcctggctcccacctctgaccctacgtctctggcctccacctctcacctgttcccgttttttgttttttttttgtttttgtttttgtttttgagatggagtttcgctcttgcaatggtgcgcgcgatcttgactcactgcaacctctgcttcccgggttcaagcgattcttctgcctcagcatcccaaatagctgggattacaggcatgcgccaccacacctggctaattttgtatttttagtagagacggtgtttctccatgttggtcaggctggtctcgaactcctgacctcagctgatccgcctgccttggcctcccaaagttctgggattataggtgtgagccactgcacccagccacctgttccttttactgttccctttgtagtgccctcaacatatgacctgtacttaaggtgttgtgaggtctggatgtatatatttcagcagtccctgaacaccagctctactgtcacatcagatctctctgggtctggacacagtcttctacacattgttcaccagaagctatggcctgttgaaagccattcactgaggagtaacttggggactccacttctgtgctctgcactgtaccactccctatgttgttccccatcatcaggactctttcgttatgggtttctgtcagtcccggttctgcccagtaggctttcctctcactggctttaatgtcccatgcctgtcaccaatcccatggtcttatttgtgagttggtctgacagacatttgttatggggctgcctcttccctccaaagtcatcatgcacttcatgagcatttctgttttaggttgttggcatggagccaaggatgaggaggcaccttccaagcaatgtgtttctgtaggagtgtcacaggtcacaactttaaagccagctttgtccacccagaaggcccagccctgtgagacatgtagctcacttctgaaggacattctacacctggctgagcatgacggaacacaccccaagcgtacagccaagctttacctgcaccaaaaggagcatcttagagagaagctcaccagaagtgatgaagggaggccttcgtttgtgaatgacagtgttcacctggcaaagaggaacctcacatgcatgcagggtggcaaggattttactggtgattcagatcttcaacaacaggctcttcacagtgggtggaagccacacagggacactcatggtgtggaggcctttcaaagtggacagaataattacagctgcacccaatgtgggaaagacttttgccaccaacatacactgtttgagcaccagaaaatccacacagaggaaaggccttatgagtgcagtgaatgtggcaaattgtttaggtacaactccgaccttattaaacatcagcgaaatcatactggagaaaggccttataagtgtagtgaatgtggaaaagccttcagcctcaaatacaatgttgttcaacaccagaaaattcacactggagaaaggccttatgagtgcagtgaatgtgggaaagcttttcttagaaagtctcacctacttcagcaccagaggattcacaccaggccaaggccttatgtgtgtagtgaatgtgggaaggccttccttacacaggctcaccttgttggtcaccagaaaattcatactggagaacggccttatggatgcaatgaatgtgggaaatactttatgtacagttcagcactcattagacatcagaaagttcacactggagaaaggcctttttattgctgtgaatgtgggaaattctttatggacagctgcacactcattattcaccagagagttcatactggagaaaaaccttatgaatgcaacgaatgtgggaaattctttagataccgttccacactcattagacatcagaaagttcacactggagaaaagccttatgagtgtagtgaatgtgggaagttctttatggacacttccacactcattattcatcagagagttcatactggagaaaagccttatgaatgcaacaaatgtgggaaattctttaggtattgcttcacactgaatagacatcagagagttcactctggagagaggccttatgaatgcagtgaatgtggcaaattctttgtggacagctgtacactgaagagtcatcagagagttcacactggagaaagaccttttgaatgcagcatttgtgggaaatcctttagatgtcgctccacacttgatacacatcagagaattcacactggtgaaaggccttatgagtgtagtgaatgtgggaaattctttaggcacaactcaaatcatattagacatcggagaaatcactttggagaaaggtcttttgagtgcactgagtgtgggagagtttttagccaaaattcccacctcattcggcaccaaaaagttcacactagggaaagaacttacaaatgcagcaaatgtgggaaattttttatggacagctccacactcattagtcatgagagagttcatactggagaaaagccttatgagtgcagtgaatgtgggaaagtctttagatacaactccagcctcattaaacatcggagaattcacactggagagagaccttatcagtgcagtgaatgtggaagagtctttaaccaaaattctcatctcattcagcaccagaaagttcacaccagataaagaatgtatatataaagcagatggggaaagacttcacacagaaatctactctgatttagcactgggacctacgttttaaaaaaagtattcttgtagaatacagataacataaaatctaacatcttaaccatgttaaagtgtatagttcagtactgttaagtcattcacattgtgcaatgaatatctagaagtcttttcaacttatgaaactaagtctataccttttaaaaccttattcctcactccatccagcctcttgacaagcaccgctctgtatgaattttactagtccgggtacctcatataagaaaacttaagttttggtcttcttgtggtttattttgtggcttattttgcttaacgttatatttttaaggtttcatgttctaatccattagaatttccatcctttttaaaggctgaataaaattctgttagtcatgtgttgcttaacagtggggaagtgtcctgagaaaagtgttattaggtgattttctttctttttttggtggtgggggggttgcgtgaatgcctaggctgtatggtatatcctatagcaccttgctacaaacttgtatagcatattactgtactgaatactgtaggctgttggaacacatggtaagtaattgtttttaagtatatctaaacagaaaaggtacagtaaaaatacagtataaaagaaaaaatgatagactcacagagaacttaccatgaatgaagcttacagtactgcaagttgctctaggtgagtcagtgagtggtaagtgaatgtgaaggcctaggttgttactgtgctgtagactttatagacattgtgtacttagacgacaatacatttttatttttattattatttttgagacagaatcttgctctgttgcccagactagagtgcagtggtgcaatcttggcttcctgcaacctcctccacctcctggttcaagcagttctgcctcagcttcccaagtgtctgggattacaggcatgcaccaccatgccccgctaatttttgtatttttagtagagaacggggtcttaccatgttggccaggctggtctcaaactcccgacctcaagtgagccactcgctttggcctcccaaagtgctgggattacaggcatgagccaccgtgcccggctggacaaaattaaatttatagaaatttttctttaatatattaaccttagctgaccattttttactttataagcttgtatttttaaaaactttttgacttttgtaataatgttttgcttaaaacattgtacaactgtacaaaaatattttttatatcctaacttcttaaattttttttgttaaaaactaagatacacacatttgtctaggccggcacaggatcaggataatgtcattttattccaccttcacaacctgttccagaagatcttctgggacagtaacacacatggagctgtcatctaaaataacaatgcctttttctggaatacctcctgaaggacctgcccgaggctgtgttacagtttgtgtgtatgtacacctgtatatttatagacatacacacaactccatatatactctactgttggagaacacctaatgataaaaagtgtagtatgctaagaacataagctagtaactcgtaagttttatctactgtacattattgtatatgttatacttctatatgactggcctcacagtaggtttgtttataccagcatcaccatgaatatgtgattaatatattgccttactactgctatcatgtcattaggcaataagcatttttcagcttcattgtaattttatggaaccactgtcatgaatgtggcccattgttgactgaaaagtgaggtgcatgattatatatgtatgtgccacttttcctttcattagtggacatttgggttgtttccactcagctgttgttaatagcagatgagcatgaatgtacaaatgtttctttgaggctgtgctttaaattccttttgaggatttactcagaagtagaattggtgctttctatgttttttttttgtttgtttgtttgtttgtttgttttttgagacgggagtctcgctctgtcgccaggctggagtacagtggcctgatctcagctcactgcagcctctgcctccggggttcaagcagttctcctgcctcagcctcccaagtagctgggactacaggcatgcaccaccatgcccagataatttttgtatgtttagttgagacggggtttcaccgtgttggcaaggatggtctcaatctcgacctcatgatccactcacctgtccccctatgttcatttaaaaaatatttttaattttttaaatttctgactcacaatgttcccattctatgttaattctgttttaaaatttttgaggactcttctatagcagctgcatcattttttaatttaactttattattaatttttttttttagtagttttactgggttgagttttttttttttctttagggttatttggttttgagatgtaggagttttttagtatatgtggggacttcagaaagtttgtggaaacatgaaagtaaaggatacaaaaagaaaacaagttttatttctcaacataagctccatcaagttcaagacaattttataagtgatgataccaggcatttagtccatccctaaagaagtgaggttcctgggaatttaaccttgtctatgcaatcttttttaatattaactaaagaaaaatgggtgccctttaaagattttttaaaagtaggaaacaagaagtcagaaggagccaaatccggactgtaaggtggatgccttagggttatcagaattcttgtaaagttgcagttatttgatgagaggaatgagcaggagcattgaagtgaaggactcctggtgaagctttcccatgggttttctgctaaagctttagctaactttctcaaaacactctcattgcgggcgccgtggctcacgtctgtaatcccagcaatttgggaggccgagttgggcggatcatctgagctcaggagtttgagaccagcctgaccaacatggagaaacccccctctctactaaaaaatacaaaaattagcctggcgaggtggtgcatgcctgtaatcccagctactcaggaggctgaggcaggagaatcgcttgaacccgggaggcggaggtggcagtgagccgagatcacaccattgcactccagcctgggcaacaagagtgaaactccatctcaaatagtaattaataataaagccatgtttcatctgtacaattcttcaaagaaatgcttcagcatcttgatcctacttgtttaacatttacattgaaggttctgctcttgtctgcagctgatctggattcagtggctttggcacccattgagtggaaagttcgcacaactttaatttttcagtcagaattgtgtaagctgaaccaattcagatgtctgtggtgtcagttactgtttctgctgttaatcatcagtcttcttcaataaggtcatgagcaagatgaatttcttcctcgcaaattgttattaatggtttgccattgtgggctgcgtggtcaacatcatctcatctcttcttaaaacgttatcaggccgggcgcggtggctcacgcctgtaatcccagcactttgggaggccgaggctggtggatcatgaggtcaggagatcgagactatcctggctaacacagtgaaaccccgtctctactaaaaatacaaaaaattagccgggcgtggtggcgggcgcctgtactcccagctactccggaggctgaggcaggagaatggcgtgaacccgggaggcggaggttgcagtgagtggagatcgtgccactgcactccagcatgggcgacagagtgagactccgtctaaaaaaaaagaaaacaggttatcagtttgtaaactctgatttctctgggtcattgtgcccataaacttttctttttcttttttttgagacggagtctcactctgtcgtctgggctggagtgcagtggcgcgatctcagctcactgcaacctccgtttcctgggttcaagcgattcttctgcttcagcctcctgtgtagctgggattacaggcatgcgccaccacgcccggctaatttttgtatttttagtagtgatggggtttcaccatattggtcagaatggtcttgaactcctgaccttgtgatccgcccaaactcggcctcccaaagtgctgggattacaggcgcgagccaccgcacccggccggttttaccatttttagagccaagctttactatatatttgatatttgttctttcttcaaccttagctgaattcacattcctctgatagaaggtgttttcaaactgatgccgttcttagtgcctcaaactagatcctgttcatacttgttagaacaagttattacaaattcactttggtgtaaaaaattgaaatccatacataatttttttttttttttttgacagagtctcactaacgctaggttggagtgcagtggcatgatctcggctcattgcaacctccgcctcctgggttcaagcaattctcctgcctcagcctcttgagtagctgggattacaggtgcccacaatcacgcccagctaatttttgtatttttagtagagatgggttttcactctgttggccaggctgctctcgaactcctgacctcaggtgatccacctgcctgggcctcacaaagtgctgtgattacaggcttaagccaccacccctggccaattttttcataatatacatttttttctcatttttcatgaaacttttgaagacccctcatattctagatattccttctcagatatgtggttttcaaatactttctcccattgagtctttttccttttcactctgtccattatgtccttttttacacaggaattttgaatttaaatggagtctaatatatctgttttataagtctttgatgcatttgagttcattttagcaacttaattcttttgcgtgtggatatccagttttttttttttaacatcaaaagaataatgtttttgcctagcattaaggcccttggtagaggcttgtcagttacaattttggagcagcagattaagtccacactcccaaccattttccttatcaggctctcaaactctgggccacaatatgtaagacccaatcaccccaggatcaggaatcagatatctagggacagcttctgtgcccaggagcttgtaaaattattccattggtcaatgcacaggggtccctgaaaacctagctaaccccaatttacatggcacacacaagctgccccctaagctccagcttgctgttatcttgggttccctcataactcttgcagccctgcctatgtccttaggtttcaagctgtaagtagcaaagtggtctacattttatgattatcattgtgacatgtcctgacatcagaaaaacacctttgtatgttattactatacaaccagcagaatattatgagtgcagcaaatgttagaaagtattcagcctaacttcactgagcaagagtaagttcatcctggagaaagtccttaggaatgcaggcaatatactttttttcctttgtcaacaggtcaaaaacagcaaagctctatcgagcttgtcttactcaccctatttttttgttgctctgttttgttttaggcttttagcctgaagccatggttttgtttctgtctctagtggtaggtggacaagaggaatgagatgagaaaggagctttactggcccagctagaaacaaactaagaacccatgactgtattctttcccttggatgaccctgtgttagcttgttgagggagatctcagcctgaaattgaatctcacatccaaacatccacgcaagggagatttgttgtaattgtcagatatatggtaaatttttgtgaatgatgttgcactttctgaccctgcctggggcctttccagagttaagttgctgaaagtgtgcattacagaagactcctgctattagctgtcatggtgccacaatgtgcatcaccttagtcaccttaaattacttagagagtgataaggtctggacttctggttaaatgtttttaaaaaatggggggtgggggggtggtgcatagattgctgtgttctctacctttatctggaatattcagtcatttgttccctttgggggcctcattcccagtcccctgactggtttgggtgtggacatcacccagctttggacagagaacacacgccaacttcagctggcagcttgtagagatttccttttttcagaggtattattagttgtctgatactgataatgttgatgataaattttctaccttccaagcttcccaacccagtcaatttccacctaagcattgctgttttcttctgatgataaaggtcatattgtttaagctacatttactcttggggttctcttcactgtgtgctgcgggttgagaacaaaattaggctttgccagaatgaaaaagtgaatggtttttggggccttcaactttttgtgctcttgaagaaataagaagacaaaatagctttcaatccacatcaggcccaatttgcattgcttcgggagttcctgggaaagtgacggacttctatccaaaatcgcgccgtgaatttgattattggtagttctacagtcagcttgagggttgttggtttgacagttgtcagagcatgttgcagctgtatgaggtgggtatctgtacatatggatgtcccatattctccagcattgcataggaatagctggtgtctagatcctgcctcaggagctatgtgtcctgaatttaaaaatcaggtatgttatatccctggggcatgtcagacatacaacaacagtgcattagtccattttccattgcttacaacaaaataccttaaactgggtaatttgtaaagaaaataaatttcttactgttgttttgttgtgctttcttttttttttttttttttttgtttactttgtttttagagacaggatctcactctgtcccctaagctggagtacagtggcatgatcatagctcactgccacctggaacccctgggctcaagtgatcctcctgcctcagcctctcaagtagctgggactacaggtgagcaccaccacacttggctactgttattattattttgacaagatttaatgtagaaagtatagcacctgttatctaccaggaatagatgaggatgatcaggtacatttatgtttgaatctgagcgtttaagtgtatgggaagatattagacactacctttcctcataagacactcagtgatctgaattgaggaacttctagtttttgctctcccacttcttggaaacccctatctactttcctatgtatttgactacttgaggtagcttatacaagtagaatcatacaaatgtattgttttgtgactagcttacttcacttacaataagtcctcaagttcttccatgttgctgtgtgtgtcaaaatttccttccttgctaaggctgaataatattccattgtatatatattttctttatccagtcattcatcaatgaatacttttttttgtgtgtgtgtgtggtagagtttcgctcttgttgcccaggctggagtgcaatggcgatctcagctcactgcaacctccacctcctgggttcaagcgattctcctgccttagcctcctgagtagctgggattacaggtgcccaccaacacgcctggctaattttttgtatttttagtagagatggggttttgccatattggccgggctggtctcgaactcctgacctcaggtgatctgcctgcctcggcctcccaaagtactgggattacaggcgtgagccactgcacccagccacatcaatcaacactttgattgtctccacattctggctactgtgaacatgggtgtggaactatcttcatgaagccctactttaatttctttttgtatatacccagaagtaaaattgctggatcacatataattctattttaaaattttttcttagttttaaattatcttttggagacagggtattgctctgtacccaggctggagtaagtggcacagtcacagttcactgcatccttgacatcctgggctcaagagatcctcctgcctcagatttccaagtagctaggactaaaagtgtgccaccaccatgcctggtgaattttttttattttttattttttgaggcaggtcttcctctggcactcaggctggagtggtgcagtggtgtaatctcagcttaccacagtccaataccaggttcaagtgatcctcctacctcagcctcctgagtagctgagaccacaggtgcacagccaccatggtggctgcatcattttacattcttatcaaaaggcacatgtttctaatttttccacatccttgacaacacttgttgtgttcttctgtttcttttaattgtagctactctgttcgaatggattttgattgaaaacatttgaggtatggcttttaggagacttgatcttaatttcctagcctttttgacctatagttttattgtggtttattgtggaaaaaggtgccctgtagctgcctatccaggtcagtctaatcacctttcatcattcaggatttatcatctgaggttcacaccaacatgtatacaagtggcatgtcttagtctgttttgtgcttctataacagaataccacaggctgggtaatttacaaagaagagacatttattggctcgtagtttggaggctgggaagtccaataccaagatactagcatctggtgagggccttctcgctgcatcataacatgacagaagccatcaaatggtagaagagcaaagagacagcaagagggaataagaacccattcttgcgatgatagcattagtccacctatgagggtggagccctcatgatctgaagcctcttaaaggttccacctcttaatattgttacagtggcaattagatttcagcatgagtttggagaagacaaaggtttaaaccataacatggtgtaagtcacataactctgggtcatatgcatatgaaagaattcgaaatttctctatgaacacatgctagtcttatttgggtttagagaaatctttagttgcagctgttaattcatcctgggtccaaggtttacatctgacagttgcctacatacttggctcttgaaagcatagatctttagaggtaattggcattttggaattttaggatattttttgggaaaataaagggggcctgggcaaaggatagaagagggaggaggtgcagaaggagaaagattaggcagggtacggtggctcacgcctgtaatcccagcactttgggaggccaaggtgggcagatcacgaggtcaggagattgagaccatcctggccaacatggtgaaaccccgtctttactaaaatacaaaaaattagctgggcgtgatggtgcgtgcctgtagtccctgctactcaggaggctgaggcaggggaaccacttgaacccgggaggcagagattgcagtgagccgaaattgtgccactgcactccagcctgatgacagagcaggactctgtctcaaaaaaaaaaaaaaaaaaagagaaagattagaagggtaaaggggaagtagaagagttagatataaggcagcaactagaggaataggagggggaggatattgcttaagtttgccaaattgttcaatggctttattcaaggaaatttttactgaaacaattttttattcagaaccttggagattgtacaaatacgattcattccaataaaaaactactgcttactgggcctgagaaattttgttttctttcttttctaatgcatctcttaaattaacagtttttgttttcttttcaactgaaatgttcctcctagtagccactgaaggcaaaaattatccgggtgaagttatgccacttagaaacctaaacactagaattgtgattgtaatcagagtacatataacatgcaggagactttcctggaaaggagacgatttcaatttagacgatccaataagtgctggcactgtctgagaggagtgtaatgattatgtaccttaggcctggttctacagcatgataggtggctacttccccacaagaacacgacaatcttcacacctcagcatgcagaaaatctgagaatactctttctgaatgaatgcctaattctctggacaaaaaagaaaaaaaaaaaagaaaaagaagataagagaatcttatcccattttatcagtgacccaaagcaaagtctgtccaaatggtcaccagtctgttgagaatcagaaaacccttggtctgtgatattagctgaaacaagtcactagagcctatgcttgagttttttttgtttttgtttttttaacggagtttcactcttgttgcccaggctgaagtgcaatggcgtgatcttggctcactgcaacctctgcctcctggattcaagcaattctcctgcctcagcatcccgagtagctgggattataggcgcatgcctggccaattttgtattttttagtaaagatggagtttttagtaaagatggggtttctccatgctggtcaggctgatctcgaactccggacctcaggtgatctgcctgcctcggcctcccaaaaggctgggattacaggcatgagccaccgcgcccagcctatgcttgagttttaccctattattatcctcttcatgacaatgctttaagaaagtacatcactaaactgttacatataagatagcaaaaagagatgaaaagaaatggtgtgatactatcaaggatggcaatgtcacgggagccaattaaaaaaaaaaaggaggcggggcgcggtggctcacacctataatcctagcactttgggcgtctgaggcaggcagatcacctgaggtcaggagttcgaaaccagcctggccaatgtctctactaaaaatacaaaattagccaggtgtggtggcacgagcctgtagtcccagctactcgggaggctgaggcaggagaattgcttgaacctgggaggtggaggttgcagtgagctgagatcctgccattgcactgcagcctgggcaacagagtgagactctgtcttaaaaaaaaaaaaaaaaaaaaaaaggtgggggggactaaacagagtctaaatagccaagaaacccagtgcaaagacagtagtgttcaaacttgttgctaacttaacatgtcatcatggatttgacaaggtgtgaagagcaaagcataaaggacctctgtggttactatacctgtttgatgactatggcccatggtgatgaacaggttagacgttatttcactgggacctctgtaagtatgatacattgtaacataatttctacaatggtcacatctaattatatcaatcctttgttcactgcaccttcattagtaagaagtatgcttaatggtagcattcatggactgcaaacagacaacttggaaataaatgaagacccaaatgagaacaaacatagcctattaaatcagaccacaccgtagtaaaggagtcatccacaatctcttgcactcagcagagcttgaaaggcaagcagaggtgtaaaaagcttcatagtagataaaaggtaaagtattaggtatgccatgactggaggctatagtcttgaggagtgtgtgtgtgtgtgtgtgtgtgtgtgtgtgtgtgtgtgtgtgaaggggttatttagaaggttgacatcctatgtgattggctagtgatgcactgactttctccagttggtcctaagttgaacatatgggcaacaattagaaagctgtcagttcttagtcatgtcttagccattttaagcgagttgttatgtgggatgttgtctggcttcctggccttgttgctagacatagtattctgacttgggagtggttactgtagataccacattagatttctgaatgggttggtgtagattatgggtcagagtcaatttttatatttggtgtagccgttgtccatttgtatagcaaatttctcacacctaaataaggaactatccacgttagtgggatttcttatttttaactggttatgttgaaaattagtttaatattcattaatttcccacaaccctttcaaaggtttgtttttgccagaccttcagttgggcagagttaatttttccttttttttttttttttaaactggttggcaaactaaattgtaacgctttggccaaaaaatagccctttccttttctgaatataaagagaatgggttttaatttttggtcttttctttgttcttccttcactaatcctgcagaagagaccataaggcattatccaaatcttcatttgttgggggcatggttttcaggtagtattgccaccacctgatggcaatactattgctactcaatttttctctcactgctactcaattgcagtgagagaaaaatagctctaaatgccgactttttgtagtgcattgtaaaaagctgaataaagccagggacggtgtcctgtacctacagtcccagctgctctagaggctgaggtgggaagatagctttagctcaggagctgaggccttatcataaggccttataagactacctggaggcttcatctgcatgatataaccttggtcttcacaaccccttgtctttttttgtttttgagacggagtttcgctcttgttgcacgggctggagtacaatggcgagatctcggctcaccgtaacctccgcctcccgggttcaagcgattctcctgcctcagcctcccgagtagctggcattacaggcatgtgccaccatgcccgtctaattttgtatttttagtagagatggggtttctacatgttggtcaggctggtctcgaactcccaacctcaggtgatccgcccacctcggcctcccaaagtgctgggattacaggcgtgagataccacgcccggcccacaaccccttaacccagacaaccatttctactgattccaggtctttagatacaaactctttcaaccaattgccaatcggaaaatctttgaacccacctgacctggaagccccgcccctcccttccagttgcgcctttccagaggaatccaatgtacattttacatgtattgattgatgtcttacgtcttcctaaattgttaaaaccaagctgtagatgggccaccctgggcatatgttcttaggatatcttggagccgtgtcatgggccattagtcactcatatttgtctcagaataaatctcttcaactatttcacaaagttccacccttttcgtcgacagaaagatattcctccttcaactctccatcacatcctgtgtgggtcttttctttcttgtcccaacagaagcacactaacgatcaaaaaaaagtctccagagcctcagtatgtgtgtacttgacaagcacaaaagagctgaccgctatgaatggaggaccagttcattatggtcagccatgtcgcttctgatgttcttcctttcgggacttgctgtgcttcagagaatctgaaacgacaggtctctgaaatatttctcagacttgtcctagactgctctccgggaaaatctggttacttgcagtttaggagtcagcaaagcccctccacgtccttaagagccccggaactgcatttcttaacgctcctccaggagcctccagcttttttccgtaaggtccgcgcgcccagcattgtgaggcgaggcaggcagcagcgtgggaactacattacccagaagacactgcgggcgacacaggcagcaacgtgagaactacattacccagaagacactgcgggggcagggcagcgagtgtagccattggtctagcagagagacgactaatgaggtctcaattgtgtgggcgggacttctggcggcgccctcatggttgcgttagcatggctacctagggatctgttcactgatttagagggtcccagagctctgggtcgggactgaggtgaaagagcggaaaaacgcgagaagcggtgttccttctacacagaggctagagtgcggatcggctgagtcggctgcaggcgcccctgcctccgtcagcgtccaggtgaccgccgttcccgccccgctcttccctgggtggactggaggaggccgcgccgatgaacctgaccgaggtgcgtgcagcgtcccaggccgccccgcccaacccctcctcccagtgctgaagtcccaaggagccgccctgcaggttaggcccttgtgtctctaagagaggggcgttcttgtgtggggtgcccgggactgggactgcggtgcgatgaggcgggggagctcccgtcggagaccgacacgtctctggggcttggaggcactgcagaacgggcggcactggggagcccgagcgtctttgtctccaaggagcagaggttgaggcggagtctcccctggaagggcagtggagccgcagagagccatagagggctgtgcagggaggacgaatgggagggtcacgcccagagttagaagtttaaagttggggaaaacaggatgttgaacgggggcagggggaccgctgaggagaccccttgagttatggtagggctgggccagaggggttgcagtagaggggagatgtgatgagactctggatggatctcagagatagggtcaacaggatttcctgctgcatcaaacatagctgtgagggaaagtcggtagtgaatggtgtcttccataggttttgttttggcctgaaaaatctgaaagaatggaattagagatatcagcttaaggagcgggtttcagacagaagatcctgggttggattttgggcgacatcacatgggtaggtggacgtaatttccaaaggtgagggaaggtagctggcctggagctttaaatgagttagaagttgtgcacttgagaagttggcctgtggatcagattgagaaggaagaatcctacatcgttttttcatatgggctgaggtaggggagggctcagatttggaggaaagaccatggtagggagggcatctctgatactccctgcagaagggagcagatatgggctaagagtctggtctgtttctgttgaaaaagaggcctggatggataaggagttgccctggaatacagagactgaggcatgagataattgtagtcactccacccttctaactcagctggccctgagggccactctttagggaacaagataaggccatgcagcaactgggtccaaaactgggcagggctttctcacatcctccaccacagttaagggcctccagcaagctccctttactgcattatatggcaggctgacctgtttgctgaacggaccagtaactgattgactgctcagccccatcctacaactcattaacttagggatgtaaaaacaggtaattgacttaaacagtaaggaactatatcaatcttaaataaccaagcaagtcagaatctagtttaaagagagtttattcaagttcacatgttgatgatagccatctgggaccatagattcaagttgtcctgaatatacacttcaattaccacagtgacaagtgtttgctttttttttaaggaaaaaagaagcagtttctgagttgtttaccaataacttatgttaaaataagataagtttttattggctatacattcttatttatattatagattacagaaacatgaagataataggtgagacagctagtcaggaacagaatgtcttaaaacagttgtcctcaggcataggttcagggatgtgactgacatctcatatattcttgcctctctgagcctgatacattttgtgtaggtcagacaggtctgggctatttttttttttcctcagccaatatccttctaaatatgtacacataggcaattggaaatagatgtaatcaataatttaaatgtattaaaatatttattgttagaatgttaatttacctgtaactctgcttatagtacaaagctttatatatatatcacatttccttaaaacattaagaagtgtgggctgggcacagtggctcatgcctgtaatcccagcactttgggaagcgaaggtgggcggatcacgaggtcaggagtttgagaccagcctggccaacatggtgaaactctgtctctactaaaaatacaaaaattacctgggcgtggtggcgggcgcctgtaatcccagctacttaggaggctgaggcaggagaatcgtttgaacccgggaggtggaggttccagtgagctgagattgtgccattgcactgcagcctgggcaacagggcgagacactgtctcaaaaaaaaaaaaaaaaaagggaaaaatactcaaattttcaaaacccttctactttgtgctgaaaacatgtacaaaaccattaatcctatagaaagtaatgcttatacatagtgtgtactacttatgcttcttgtcaatatgagccctgtgaagtgggaacccttttaatctccattttacacataagggcactgaggcttagggaggttcagtccttgtccaaagacacagagctgctaagaggcagcactgaacttaggacttgctgtagcttcagattactttgctccagtacagggcagagatggttgtacagctcagcctgtaggatgccacagtactgtcctgatactcatggcttgcttcttcctgttacaggccgaaagaatgagggtcgtgatcaactcagtatgccactggaggctatatgagtaaacagcaaactgtttctcatgaaagcaggatgttggcaaactgacaaactgcgtctgccacccagaaggaatgctgaaggcagtcacgacccaggcacaagtgtttcttgtgattaggcataattgaagcctgttaacaataatgtgaacttgtgatcaattaagcagctgaccagtcgttacctcctcctccctttcatcctacccaataaatgtggagggctgtggaagctcaggggctgcctttgctcactagaagcagggagctctcttcttccccagttcgccttctttaaaacagtttctttcgtcttaagttttcatttctacgttcgtcccccttcattcagtctcgtaatgatggtctcaagtagtaacagtaactgtcgtagtgatggtctcaagtagtaactgtacaagtctgccacatcttcccacagggtccattgcagtggcagcaatgcataaggaccctgcacaggtaagtcaaggatttctcaggctctctaccccaggcccccaccacttatctctccgttattttaggcatcctgatatagggaaaggtggtgtcctgaaacttcatgtttttcccttccttgggtctgaagactgtggttccacgacaaccaggagtcagaactcagcctctggttatagagtggtcctagttccgacaactgatgggataagatgtggcagggcgttcaggcacgggatatagaaagttcaaatgcttactggtgcgacttagctgggatgtttagtgaactgaaaatccatgttgtatctggtcgtgatagagtatggcagcagggtaggaggttggggcatacagggcatgcgggatcggcatggaatggcagtctaaggttctgggcctttcatctgagggcgatggtaactagggaaggtttgaggaggggggaaaaagaggtgacctgacccaggttttagtggctccctctgcctgcagaatggaagaccacgtgcaggtgagggtggagccaccgatacctgggtgatgggtccagcaacagcccaggtggaggttgttggtgactgaacgagagtggcggtggtggaagtgggaggagtggggggcttctgtatgtgtttgatctagagctgcctgtattttataacgtagagagcaaggaagcttgggagctgagatggaagagggggtcaggaatggccccacagttttggccttatttggaaggatggatgtcccagcaactaagatgtagtaagttctgtagtagggggagtgtttatatagtagagcatatgaggaaccaagttttggccaagtcaaaaatgttccagtggccaggcatggtggatcacacctgtaatcccagcactttgggaggcagaggtgggaagattgcttgaggccagcctgggcaacatagggagactctgtccctacaaataataataaatagctgggtgtggtggcgtctctctgtggtctcagctaatcggcgtgctgaggcaggagggtcacctgagcctgggaagtaaaggctgcagtgagccatgattgtgcccctgcactccagcctgggcaacagagtaagacaaacaaaaacaaaaatccaagccaaaacaaaaacaaaaatacacaaaaaatgtttcagagactttgagtggaggtgccaggctggcagttgtacacacaggaatggagttcattggaggtgttcaggaaggagacatccactacatgatagctgaactgttgtgaaactgggtcagatttaggaagcaatggtgttagtaggaaggaaggagaaggaacagactgaggactgggtgtctccactgggcacctggatggtgttggtgggtgtcacaaagacagatgagagagtggatcgactgagggtatgtgtgtgtatgtttgtgtgttatgttgggggcagcctgtggagtataaggaagggcttttgaggggagagtggccatgagatggatggtgaggcatctccacaaactcaccagggtttcatggtgagtcttgcttggacctgggtagtttcatgcaaactgtgagactactttaggggaagatgggatcagcaaggagcattgctaggcctggggtggggatagcattggggaggtcagtgtatctgggctttggattaggattagggggatagagaatgttgtgactgcttatgggaaaacatgtacattgcaaaagggggagacagccaagatctggaactcagaggaggtatgcaagaactgtgaggttgtcacttgggttttgggggggctgaggttaaaccagaaaacaggactgggaagggagaccttcagaacagggctcggtgctgccccaggcgctagggaacattatattctgggcagcccaggagcaaatagggttctggtgcactgcaggactccatgtacagagtggcatcttgggaggccatggaaatgctcctggttgggccagggctgctgttagtattgcaagagtggaggcattagatacatgagagaggtactgtccaaagcgagatgcgaaggtgaggaggagcatgaatgcgtggtcccagccctggcaatgggcacgtaagggagaagagtgagcctgagtttgggtgtctgggaggcaagatctggagaccccaaggaaatggggtgacaaaagaaggtagggccggccgggcgcagtggctcatgtctgtaatcccagcactttgggagaccaaggcaggtggatcacgaggtcaggagttcgagacccgcctgcccaacatggggaaaccccgtctctactaaaaatacaaaaattagccgggagtggtggcaggtgcctgtaatcccagctactcaggaggctgaggcaggagaattgcttgaacctgggaggcagaagttgcagtgagccactgcactccagcctgggtgacagagcaagactcttgtctcaaaaaaaaaaaaaaaaaaaaaaagagggtagggcgccctgggctaggcattgatgatgcttttgctttctccccacccatctttgtgctgtgctggactcagcaatcagtagcagtgggggcgagagaagtgcgaatgctaccaggatgtggagtctcttcctccttgggaagtgggtggaggctaagcaggggatggatgtgtgtgggtactggggaagcactgaagattctggagagggaagtgtatcagtgattgacccgctggattttcatttttggaaaagagtgagtgatgacagagaggctaatggcattgaaataattttaattactttcatttccttagtgcagggggaatgccgtgctgcaccaggccacgggaaatactagatttggttaggaggcagaggcatgactgaagggaaagcatatatcagagactgtattggggttttggcaggaaaggcatgcagggtgggatgaggagcttaaaactcagtggtttgcataagtctggcagccttagggctaagagattatcccttattgtgtggtgacagggcttgtgttgattaggacaggagaaataatcatgtatgagcattagatagtggttcagcatatgggatctggatcgcaagggaaatgtaaaaacattggctgttagtttggccctccaattcttagattttaagtagataaatacagatctaaggaaacacagaataagaagttgttcatagactgaagtgtcataattttggcaggattgtatggtctttgaggatgtggccatatatttctcccaagaggaatgggggatccttaatgatgctcagagacacctgcacagcaatgtgatgttggagaactttgcgcttttgtcatcagtaggtaaggccttcatacctactctggtgtcttgtgctgggtgctgtttttttgctcttttccatgacaactctgtctttcccacaccagattgtgagtgctacgtcctgtcctctcctggtttcctggcaaatgtgataaggcagccagagctgggctgtgtatactgtaccacctccccttaagcagccccagcttctgttgctctgaaactttacaagataaggctcggaagtcagaaatcttcaggtttctttaagatatcctaatggcggtgcctgtccctggtttgattactctgtccaaatgtgtgaaacctctgtccaagggtttccctgttccccttgctgacatacttggagacagtgtctgtgctaggaatttcaggcacctccctggtcaccacttgtgaggattgtgaagttatttctgcaggacgctctactgggtgttctggtagctttagaatgcagcatgtcctgggtttattgctctgtgtacatgctgtcccctccctttccctgcctttcccgtagctggacttatgccgcagctagatagttgctcaccttgagcaagggggaggtctctgggtgcctggcagagtggatagtcctctattaatggcaagagacactcagaaggacttggccctggtgggtgaaagctgggaaaggatgtgatatcaaggctgggttcaaatcacattgagaacttaccttgtgaccactattgtttgatgcagggccactggccactcgtcactcttcctttccttccctgttgttatttttactctgacttctgacccctggcttccacctctgacccctcctctccagccttcatctctccaccattctcttccacctctccctttgcagtgctgtctaatgtatgacctgtactttaggtgttatgaggtctgcgtgtatccttcagtagtccatgaatactcgctctcacacaatcagatctctctggatctggacacaaccgtcatggcctgttgaaagccatttatagaggagtgagttggagaccccacctgccctccctgcatggtacttctcccttgtgtccttaccaccaggattcccccactacacacacttcacaggcccacctctgaacactgggccttcctctcactggccttatttccttgcctgtgaccagtcctgtgccctcatttgtgggtgtgtctcacagacatttgtgatggggctgtctcctccctccggagttcacgtgcacttcaccagcatttctgttcttacaggttgttggcatggagccaaggatgaggaggtaccttccaagcagtgtgtttctgtaagagtgttacaggtcacaattccaaagccagctttgtccaccctgaaggcccagccctgcaagatgtgtagctcaattctgaaggacattctgcacctggctgagcacgatggaacacaccctgagcaagggctgtacacatgtgcagcagagcatgacctgcaccaaaaggagcagattagagagaagctcaccagaagtgatgagtggaggccttcatttgtgaaccacagtgctcacgtgggagagaggaacttcacatgcacgcagggtggcaaggattttactgccagctcagaccttctccagcaacaggtcttaaacagtgggtggaagctgtacagggatacccaggatggggaagcctttcaaggtgaacagaatgatttcaactccagccaaggtgggaaagacttttgccaccaacatgggctgtttgagcaccaaaaaacccataatggggagaggccttatgagttcagtgaatgtggggaattgtttaggtacaactccaaccttattaaatatcagcaaaatcatgctggagaaaggccttatgagggcactgaatatggaaagacctttattagaaagtccaacctagttcagcaccagaaaattcacagtgaaggctttctttcaaaaaggtctgaccccattgaacatcaggagattctcagtagaccaacaccttatgaatgcacccagtgtgggaaggcctttcttacacaggctcatctggttggtcaccagaaaacccatactggagaacagccctatgaatgcaacaagtgtgggaagttttttatgtataactccaaactcatcagacatcagaaagttcacactggggagaggcgttacgagtgcagtgaatgtgggaaattgtttatggacagcttcacactcggtagacatcagagagttcatactggagaaaggccttttgaatgcagcatatgtggaaaattctttagtcaccgctccacactcaatatgcaccagagagttcatgctggcaaaaggctttataagtgtagcgaatgtgggaaagcctttagcctcaaacataatgttgttcagcatctgaaaattcatactggagaacggccttatgagtgcactgaatgtgagaaggcctttgttagaaagtcccacctagttcagcaccagaaaatccacactgatgcattttcaaaaaggtctgacctcattcaacacaagaggattgacattaggccaaggccttatacatgcagtgaatgtgggaaggccttccttacacaggctcatctggttggtcaccagaaaatccatactggagaacggccttatgaatgcactcaatgtgcgaaggcctttgttagaaagtcccacctagttcagcatgagaaaatccacactgatgcattttcaaaaaggtctgacctcattcaacacaagaggattgacctcaggccaaggccttatgtgtgtagtgaatgtgggaaggccttccttacacaggctcatctagatggtcaccagaaaatccagactggagaacggcgttatgaatgcaatgaatgtgggaaattctttttggacagctacaaacttgttattcatcagagaattcacactggagaaaagccttataaatgcagcaaatgtgggaaattctttagatatcgctgtacactgagtagacatcagaaagttcacactggagaaagaccttatgagtgtagtgaatgtgggaaattttttagagatagctacaaactcattattcatcagagagttcatactggagaaaagccttatgaatgcagcaactgtgggaagtttcttagataccgctctacattcattaaacatcataaagtttgcactggggagaagcctcatgagtgcagtaaatgtagggaattgtttaggactaaatcgagccttattatacatcagcagtctcacactggagaaagtccttttaagttaagggaatgtgggaaagacttcaacaaatgtaatactggtcagcgccaaaaaactcacactggagaaaggtcttatgagtgtggtgaatccagcaaagtgtttaaatacaactccagcctcattaaacatcagataattcatactggaaaaaggccttagtggagtgaatgcaggaaagtcaccaaaactgtcacctcattcagcaccaaaaggttcacatcggaccaagaacctattaatatatgtaaatctaatgttgaaagagttcagatggaaatctgcgaggatttcctgctgggaactacattaaaaacatttatgtccaggcgtggtggctcacgcctgtaatcccagcactttgggaggcagaggtgggtggatcacctgaggtcaggagtttgagaccagccgggccaacatggtgaagccccatctctactaaaaatacaaaaattagctgggcatggtggcaggtgcctgtaatcccagctattcaggggactgaggcagggagcatcacttgaacctgggaggcggaggttgcagtgaactgagattgttccattgcactccagcctgggtgacagggcgagactctgtctcaaaaagaaaaaaattataattgtggcaaattacaggtaacttaaaatctaccatcttaacccatatttaactgtactgttcagtagtgttaagtcattcgcattgttgtcaattaatatccagaagttttttcaacttaatgaaactaaaacattataccctttaaaccaggggtccacaacccccaggctgcaaactggtaccagtctgtggcctgttaggaaccgggccagcatcactacctgagcttcacctcctgtcagatgagcagcattagattctcatagcagcctgagccctattgtgaactgtgcctgtgagggatctaggttgtgtgctccttatgagaatctaactaatacctgatgatctgaggtgggacagttttattctgaaactgtctgccccctcctctgtccctgatgcgtggaaaaattggcttccatgaaaccagtccctggtgccaaagaggttggggaccgctgctttaaactactcctcttcctcattccctacgccaaccagcccctgacaatactactgtatgaattttactataaatatctcatatgaggaaacttaagttttagtcttttgtgacttattttgaggcttatttccctaaatgtcttcaaggtttatccatgttgtagcatagcttatgattttcatcttttttaaaggccgaataaaatcccattgtagtcatgtgtcgcctaacaagaggactgtgttctgagtaatcatcttaaggtgattttgtcattgtgtgaacaaagagtgtacttacacaaacctgaagggcacagcctattacgcacctaggctatatgatatggtccattgcgcctcagatataaaccttaacagcatgttacagtattgaatattgtaggtaattgaaacacaatgataagtaaatgtgtatctaaacatatctaagtttccaaaaggtactgtaaaaatgtatgaaaaatggtaaaaactttatagggcactaacatgaacgaagcttgcgggacccctctggttgagtcagggagtgagttgtgagtgaatgtgaagctctaggacattactgtaccctattgtagatgttataaacattgtacacttaggctactctaaattaattttttctttagtaataaattaaccttagtctactgtaacgtttttacttcatgaacttttaaaattttaaaaagctttttgactcttttgtaataatagcttaaaacacaaacacattatacagcctgtatagaagtactcctttatattctataaactttttctatttaattttttaacttcgtaaaaaataagttaaaaatgaagacacagacacacacattagtcaaggcctacagagggtgaggatcattaatatcactgtcttttgcctccacatcttgtcccactagaaggttttcaggctcaataacagggagttgttatctcctatgataacaatattctggaatattttctgaagccttgcctcacactttttttttttttttttttttgagacagagtctcgcactgttgccaggctggagtgcagtggcacaatctcggctcactgcaacctctgcctcctgggttcaagtgattctcctgcttcagcctcccgagtagctaggattacaggtgcctgccaccacgctcagctaattttttgtatttttagtagagatggcgtttcactatgttggccaggctggtctcgaactcctgacctcatgattcgcccgcctcagcctcccagagtgctgggatgacaggcatgagccaccgcgcctggctttattttttttttgagacagagtcttgcactgttgcctgggctggtgtgtagtggtgtgatcttggctcactgcaacctccgcctcccgggtacaagcgattctcctgcctcagcctcccgagtagctaggattacaggtgcccaccagcatgcccggctaattttttgtatttttagtagagatggggtttcactatgttggccaggctggtctccaactcctgacctcatgatccgcccatctcggcctcccaaagtgctgggattacaggcatgagccacagcgcccggcctgtgctctttatatgactggcagaccagtaggtttgtttacaccagtgtcaccacacacacttgagtaatgggattgagttacagtggctgtggtggcactaggtgataggagttgtttagctctgttataatacgggattactgttatacatgtggtccatggtagacagaaatgtgtggcatatgactgtggtatatgtatatgccacttttcctgtattctttcttcagtgtacatttgggttgcttccactcttctgttcttgttaatgccactatgagcatgaatatacaaatacctcctgaggccctgctttaaattcttcttggacatatacccagaagtggaaatggtgcttcccgttaataataataattataataataataattattattattattttgagacggagtcttgctctgtcacccaggctggagttcagtggcacaatctcggctcactgcaagctccgcctcccgggttcacgccattctcctgcctcagcctcccaagtagctgggactacaggtgcccgccaccacgcccggctaattttttgtatttttagtagagacggggtttcaccgtgttagccaggatggtcttgatcttcctgactttgtgatccatccgcctcagcctcccaaagtgctgggattacaggcgtgagccaccacgcctggccacttcccgttaattctattttaaattgtggggggaattattttccatagcagctgcaccattttacattctcaccagtgcaggggttctagtttttcacattattgccaacactttgttttttaatcatgatgggtgtaagatgttattttattatggttttttaatttgcatttcagtattggtgttgagcatcttttcatttgcttgttgactaattgtataggttctttggagaaatatctgttaaatgtctttgcccattgaagaaagtttttgtaaattttcagataacattgtatgcttttgttgtgtacaacatgatgtgaagtatatatactttgttgagtggttaacatgtacgtattatatatgtacatattctgtatacgtattttaaatattaaccccttgcagatatgtgtttttcaaatactgtctaccattcagtctgcttccttttcattctgttcatgtcttttttttttttttttgcacaggagttttcaaatttcaatggagtccaatatatgttatgtttgtttcctatgcttttggtattatacccaagaaattattgctaaatccagtgtcatgaaccttttttcatgttattttctaggagttttatagttttaagttgtacttttatgtctgatttatttcagtttgttttagtaaatggaggaaggtaagagttcaacttcattcttttgcatatagatatccagctttttgaaagtcatttgttgaaaagactccttaataagtttttgcgctcttgtcaaaaatctgagcataagtatgaggacttccgtctggcctctttattccactatatgtatgcatttgtgctagtaccaaggtgttttgatacataattcttttaaaagaataatgtttctgtccactgttgaggcccttgctagaggcttgacagtgctacatttggaacagctgattaagtacacttccaaccactttccttaacaggctgtcaaactctgggtcaatatatatcagccccagtcaccccaggagcaggtatcagacatctggggacaactcctatgccctgaaatgtgtaaaattactcaaattggccaagtatagaaagcccagaaaatctagctaacccgaatccacttgccacacacaagctgcctcctacaactccagtttgctgtattactatctatattccttcacaactccggtgcagccctgaatcatgtcctctggttctgagttgtaagttacaacatgctccacctttcatctatctgtcatgtcatgtcctgacatcaagaaaacttctaaatcttaaaactacatacccagaagggtatcatgagtgcagcgaatgttggaaagtcttcagccattaacctcattcagcaccagtaaaccatcttggagaaagaccttaggaatgcaggcaggcaaagtgcttttgccagcagataaaatagtaaagctgtggatattagcttttgtgagggagacctcaaccagaaatggaatcttacatccaaacatccacacaagggaggtttgttgtaattgtctgctatatgagaagcttttgtgaattaccttgcactttctgacctgcctgggatccttgccagtgttaagtcactgaaagtgtgtactacaaaagacttccatccactattagctgatatcacagtgtgtatcaccttaaaatgcttagggagggcagatagctgtgctctctacctttatctggagttattgagtctgatcccttcgggcgaggcctcattcccacttccatggctggtttgggtgcagacatcatccaactttggacagaggatacaggctggcttgagctggcagcttgtaaagattttcctttcttcatgggtattattgcttgtcttataatgttggtgatagatttttcaccttccaagctgcccaaacccagtcaatttccacgtgactatactggttttagtgatgataaagtcattgtttaagctacatttactcattgcagttttattctctgtgtgctgtgggttgagagcaaaattggagtctgccaaaatgaaaaagtgagtggttttgtgaggttttcaattttatgtacttccaaggaaatagcaaaaacaaaaaaaccaaaaaaaaaaaaaaaaaaacaactcaatccacaaacgcctgatgtatattgcttcagaaggttcctgggaaaaagaaggatttctatccaaaatcctttaccctgaatttgaagattatttatggttgcacagtcagcttgcagccaggacaattggtttgacaactgtcaggatttatggcagctgtgagagctgggtatttgtacccatgcatgtcccatattctccagtattgtttagggatagcttgctcctgtgatgtgccttatgagctatgtgtcttgaacccaaaaatgatgtaggttatgttcctggatgtaaaatgtaagagtgcattagtttgttgtccattgcttataaaataatacctgaaactgggttatttataaagaaaaatctatttcttacagttatggaggttgaaaggtccaaggttgagtggccgcatttggtaagagccttcttgctggtagactgtgcaaaaagtcccaaggtggtacagggcatcacatggtgaggctgctgagtgtgctcacatgttaacgtgctagcgcaaatcattctctctcttttttttttttttttttgagacggagtttcgctcttatcgcccaggctggagtgcaatggcgcgatcttggctcactgcacctccgcttcctgggttggctcaccgcaacctctgcctcccgggttcaagcaattcttctgtctcagcctcttgagtagctgggattacaggcatgtgccaccacaccccgctaagtttttatttttagtagagcagggtttctcccatgttgatcaggctggtctcgaactcctgacctcaggtgatctgcccgccttggccccccaaagtgctgggattacaggcaagagccacggcccctggccctttctcttcttataaaaccaccagttctcccaggataacccattagtctatcaacccataaattgattaattcattcctgaggatagagccctcatgattcaatcacctcttaaaggtcgcacctctcagtactaccacactgtagattaagcttcaatgtgacttttggaggagatggtcaaaccatagcaagcagtttgggaaccatagtctgtacagaaacagtgattgtattaatatgaagtatgagacaccagcaaactagagtggaatggatgagcgccttgtaaagagacatccatgaatgtttcagtaactatggctatgtgagatgagggtatacagaaactctgaggacctacagacgtgtgtatctcctgtaggcaaagtcattgtcagagcaagtaatccaaaggtgttatggattcttgtgtctctggcgttataaaacgtatgttgaattttaattgccattttaacagtgtggagaaatgggacctttaagaggtgattaggtcatgatggctctgcccttataaaggaatcaatgcctttatcataagagtgggtttgttaacccgagagtgacgtttttataaaatcagctgtctctgtctttcatgctcacttgcccttctgtcatattatgacagagtaacaaggccctcaccagatgccaagcagataccagtgccatacccttggacttcccagcctccagaactgtatgaaacaaactactttataaattacgcaatctgtggtgttttgctatagtagtggaagacagacacagacataaagcctgttaattcaaaccactactgcacaggtaggagcctcatgactgaatgaagggagattctatacttctgagataagtcttttttttttttaaacctaaacataattcctggtgactcaggtggacataaccttccttgtctccagttcttcttccccgagattctgaatttccaacaacattgcttccagtttttgatactataaaatcagagttgacccacgtaagacatgaggagaggctaatgatggaatcaacacagctttgccagaggttataaaagaggattgagaaatccagattttatttggaatttttcttttctaacagctttattgaggtattagtgacattcagttgcacattgttaaagtgtaaaatatataaaaacaatcaccaaagtcatgataataaacatatccattgcctcaatagtttgtttgtacccttttctattctctctcgctcacagtcctacccaaatttttatgctcaggtagccactggtttactttatgtcactatatacatctttccttccttccttcctccctccctcctgctcttttctttttccttttttcttttcttttttctttgtttctttccctccctccttctcttctcctctcctctcctcctctcctcctcctctcctctcctctcttctcttctttctctttctcagaatttcactcttgttgcccaggctggagtgcaatggcacgatctcagctcaccgcaacctccaccttctgggttcaagcgattctcctgcctcagcctcctgagtagctaggattacaggcatgcgccaccacgcctggctaattttgtatttttagtagagacgggggtttctccatgttggccaggctggtctcgaacgcctgacctcaagtgatccacctgccttggcctcccaaagtgttgggattacaggcgtgagccaccatgcccggcctataaattttctagtatcttatacaaatgaaatcctacattacattcatatggagcattttttgatatttatacatgttaagcgtattcattttttgttgatgaagagtattgcattgaatataccacaatttattaatctattaataaatattttgattgtttctagtgttggactaaaaaactaacaaagacccatgaacattcatatacaagtgtttatatgaatatatttagcagaattgcatttgttatacctccttgtccatgatggttatggtgtattttaaagattaaccattttcatagatgtgttgtggtcagtgtggtttttaaatttgcatttctctaataattaatgatgctgaataagtttttatatgcttatttgttatctgtatatttggccaaatttctaaatcttttccctttttttaaaaaaaaatcttatttttctattttaatagagttttaattttagaacattttaagatgtacagagaaattgcaaatatagtacagagatatctcatttacaagcacacctagttgttactaatatatagtcatatattagtatacagcattatttacaattagtgaaacagttttgatacattattaaactaaagtacatctttgattgagatttcctcagtttttaccaaaatacatgttctgttccagaattccacctaggataccacattgcatttattttattattttttattcttttatttattttttttcatgtgtctctaaatgtaaccacattacagttagtactcacatttctttaggcttgtcttgcttatgagaatactcatttattttgatattgatttttaatttttttttttttagatagtcttgctctattgtccaggctggagtgcagaagcactttctttctttcttttttttttttttttttgagacggcgtcttgccctgtctcccaggctggagtgcagtggtgggatctcgactcactgcaacctctgcctactgggttcaaggattctcctgcctcagtctcctgagtagctgggattacaggcacctgccaccatgtctggctaatttttgtatttttaatagagatggggtttcaccatgttggccaggctggtcttgaactcctgacttcaagtgatctgcccacctcagcctctcaaagtgctggggttaccggcgtgacccacggtgcccagccacttttagttatttttatttttattttgagtctccctccgtcacccaagctggtaagtaattctcgtgcttcaccctctggagtagctgggactacaggtgtgtgccacatggttggctaatttttgtatttgagacagggtttttgccatgttggccaggctggtctcgaactcctggcctcaagtcatcttgagtggatcacttgaggcatttgggagtgcctcagcctcccaaaacggtgggattacaggcgtgagccactgtgcccggcctgcacatgtctttcttacatgtggactctccaggggatttatgctgttcaagaagcacctgaatcaaactgtgctttaaaaatatttttaaaacattccatgattcttcatagtacaaaaatgagaaatctcccctaaatctctaaagaattccctttttaaactttttgatttcctgaacttgtctgaaggacttaacacagttatatagagtgttctttgtgtaacagtatccatgactttcatttttagctctggtattagatcttcctggacaagagcattactggccatgtgtatgttgctatcacaaataactagtagttaatatttcctaaatcttagcaagagttatgataaatagctgaattccatgaagagaaaagactcatggcatgacaaccagattaggaaagagtgttttccttgtcctgcaggcaaaacagaactgagagatatgagtatcactcatgatgaggacaaaagggctgcgtgctgggaaacatgaggcgaccaacacagagttggtcactatccactggcctgggtttgcaactacagttgtccaaattgtcagaaaactatggactgaatagaaaacaaaaaaggagctcaccaggaccatgatggtgtgtgtggctctggcttcctgggaaggtctgcaggagagtctgttgctgtgattgtgttggacttgctgcttgtgtctgtagaggaagaagaccatggagccactggcccagaccatgaagcccaaactcataaaatcaggggaaaaatataagactgcatgtaatgagctaaatctctttgatgctttgtaagaacagtatccataattgttttttgcactactgtttttgctattcagtgggccattcactaatagaagaacagatgcattcatcaagacatggggggcccagcagaggagacaacagaagtcaataaaccttggggatctaatcttgatctccatccacctgcatatactggggttgagcttaatggcttggaatccattgagaaggcagatggtgctgagggaaactcttgtgcccaccctgtgataataaaagacaaacttacatccagtgtcattcagcaaatatttcaatccaaaagctgccattgtctgaggtatccctttaaagaaaaggaccatggagttagccaaggccagttggctgagaatcaagtccgtgggtctcagcttgtgtccagtgaacaaaattaagttataaaaacaaaggagaaaggaatttcccaggatcccaactccagtctgaatgaggaagctaatccctgattttacttttccaaaagccatttcatcaaaatctaggggatgttgattttcattgaggtctgaagaatcagtagaataaaaaagcagaaagaagtatcttgtcatcagtggagacagaagttttaatgtgtctccaaccatattttctcatcttaaacagaaattaagattgtccctgttcgtgcaaaggcaattgcttgtgtgtccaactgcagagaagcaggtgaatgaatgagggctcaaccgcacaacagatccacaaatcaaacctataaaactcagggcttacacacatgcaacaagtaaatacaagcaaaactagggaaatatataaaaacagaacacagaagagtcaatatcattagagtgatattatactatagtttgcaaaatgtaatcatgacggaaccctgggtaatatggacagggctttttctgtattatttcttatgactgcttgtgagtctacacttatttcaataaaaccttcaattaagtagcctggagatatgaaaagcaaaaataatacaccataaaaccttttccacactaatattttagtaaacaccattgttattgatgcattgaaacaaattttaggccgggtgcagtggctcacacctgtaattccagcacttcgggaggccaagatggagaccatcctggccaacatggtgaaaccctgtctctactaataatacaaaatactaataatacaaaaattagccgggcatggcggcgcgtgctagtcccagctactcgggaggctgaggcaggagaatcgcttgaacctgggaggcagaggttgcagtgagctgaaatcaaaccattgccctccagcctgggcgacagagcgagactctgtctcaaaaaaaaaaaaaaaagaaattaaaaaaacgctacaatacaattggtaacaaggccttcagcacagtacaaatgctaacttgaagaatttttaaaaactataatttttggaacaatcaacattgcatcatggtatattttattttaagcacatatatttctgttattttccaccggacaggtctagagattgtgaattgactccgtagaaataaccatgaccaccttgagcccacacatttttatctcaatgccatttctcacaagtaaatgcaaaagatcctgaaaataaatactaatcccagaaacacctaagatatccttaaaacttgttaaataggaaattcaatatgttccagaaagcttgggtttatttttagggaaagataattcaattgggagggaatttcattgcacaatattcatatatatcaatcacaaaagaaatagtaactgcggccaggcacggtggctcacgcttgtaatctcagcactttgggaggctgaggcgggtggattacaaggtcaggagatggagaccatcctggccaacatggtgaaaccccgtctctactaaaaatacaaaaattagctgggtgttgtggtgcgtgcctgtagtcccagctactcgggaggctgaagcctcctgggttcacgccattctcctgcctcagcctcctgagtagctgggactacaggcgcccaccaccacgcccggctagtgtgtgtgtgtgtgtgtgtgtgtgtgtgtgtgtgtttagtagagacggggttgcaccgtgttagccaggatggtctcgatctcctgacctcgtgatccgcccgcctcggcctcccaaagtgctgggattacagggatgagccacctcgcccggccataatttagattcttttggtgtctctatggaattgctatcatcagggaaaattatgaggtattttctcccatgaataactacatctctttaggggtggagcaatcaataacacagcagtatcaagattctcaggcgagaggtggctcacgcctgtaatcccagcagtttgggaggccgaggctggtggatcagctgaggtcgggagttcgagaccagcctgaccaacagggagaaaccccgtctctactaaaaatacaaaaattagtcagaggtggtggcgcatgcctgtaatcccagctactcgggaggctgaggcaggagaatcgtttgaaccccagaggcggaggttgcagtgagccgagatcatgccattgcactccagcctgagcaacaagagtgaaactcggtctcaaaaaaaaaaaaaaaaaactcaggctctgaggtatgaaaaccttttagattcccacaaaccacttgttgacaaatgtttttcctatttatatgaactcatcatttattttcaagatagttcctgattctttgctttaatctcttattttgctccattgtcctagttgtataatttatttccaatatgcatttggtttcctattttttcagcttctccttataaagtaccatttttactatgactattttgaaagcttcttgtatgtataaagttagtgtgattattgactttaacataccacctccttctcctcctagcctcagaaagaagtgttggtaactggtgagaattttcagacagattttcctttttttttttaatttaatttaatttttttttctttctttgctttcttttttttttttttttgagacagagtctcactctgttgcccaggctagagtgcagtggcgctatctcggctcactgcaaactccacctcccacgttcaagcgattcacctgcctcagcctcctgagtatctgggattacaggcgcctgccactgcgcctggctaaattttttttgtatttttagtagagatggggtttcaccatgttggcccggctggtctcgaattcctgacctcgtgatccacccaccttggcctcccaaagtgctgggattacaggcgtgagccaccgcgccaatttaatttaattttttaaagttccaggatacaggtgccggatgtgtaggtttgttacataggtaaacgtgtgccatggtggtttgctgcacctatcaacccgtcacctaggtattaagctcagcatgcgttagctatttatcctgatgtgctccatcccccgacccctttgacatattccagtgtgtgttgttcccctccctgtctccatgtgttctcatcgctcaactctcacttataagtgagaacatttggtgtttggttttctgtttctgtgttagttttctgaggataatggcttccagctccatccatatccctgcaaaggacgtgatctcattctttttatggctgcatagtattccatggtgtatatgtaccacattttctttatcactgatgggcatttgggttgattccatttctttgctattgtgaatagtgctgcaatgaacatatacatgcatgtatccttataacagaatgataataatagaatgatttatattcctttggatatatacacagtaatgggattgctgggtcaaatggtatttctggttttaggtctttgaggaattgctacactgtcttccacaatggttgaactaatttaccttcccaccaacagtggaaaagcattcctatttctccaccaccttgccagcatctgttgtttcttgacgttttaataacagcccactgaacagcaaaaaccttagtgtgaaaaacaattatggagtctgctcctgggcaatgcaagaaatatttggcaccttatatacaattatatacttttctcctgactttttgagttttggcttcttggtgtgggtcagtggctccatagtctttgtcctatacagacacaagcagcaagtccaacacatttgtagcaagagactctcctcaaatcagtataagtaaaattaggaaaatattaagatgatagtgagggccgggtgtggtggctcatgcctgtaatctcagcactttgggaggccgatgcaggcggatcacgaggtcaggagatagagaccatcctggctaacacggtgaaaccccgtctctactaaaaatacaaaaaattagccggacattgtggcgggcacctgtagtcccagctactcgggaggctgaggcaggagaatggcatgaacccaggaggtggagcttgcagtgagccgagatcgcgccactgcactccagcctgggcgacagagtgagactccatctcaaaaaaaaaaaaaaaagatgatagtgaatatatcaaaatcaatatcatcattgtgatattatactgtaattgccaaatgtaaccatgggtggaaactgggccatgtgtagaggctctctgagttattttttaaactgcttgtgagtctaaaattaaattaaaattattgttaataaaatggtcagtaaaaatgctcaggaatatgtaaggcaaaaataaggcattataaaaccttgtccgtcattatgttttaatacacatctcctcacatacttatcatttctttctgatgagaacatttaaaatctactcttttggcaattttggaatagacattaacaatagtcaccacgccgtgcaacagatcactagaacacattccttgtgtctaactgaaacttcgtatgctttcacaaaaacctcccgtttttcagtttgccctctatctctttagcctctggtaaccaccattctactctctacttttataaactcaacttgcctaaattctgcatacaagtgagaccatgaccatgtggtgttggtctttttggactttctttgaatgtgtcctgccttcagagatgtgttgacctacaagaaaaatgtattgaagcataccactataatgtgtgcacatttctgaatgtcatgtataagatacctatttttgccactcctattcagtatagtactagaggtcctagccagagaaatcaggcaagaaaaatacctagctaactaaataaaagatattcgggtgagaaaatataaagtaaaattgtttttctttgttgtaatatgatcttataaactcttagaactggggaacaaatttaatatagttgtaagacacaaaatcaatatacaaaaatcagtagcattgcggtacaccaataatgaaatagccaaaacagaaatcaagaaggcaattccatttgcaatagctataaaaagcaaaataaaataaaatagaacactgagaaatatttaatcaagaggggaaagacatcaaggaaaactacaaagcattgataaaataaactgaagaggacacaaacaaatggaaagacatcccatgctcatgtattcaaagaatacatattgttaaaataacagacagtactacccaaaacaatctaaagatttaatgcaagcccaatcaacatacaaatgccattttttcacagatatagaaaaaaattctaaaatttgtatggatcttcaaaagagcccaaatagccaaagcaatcctgagccaaaagaacaaacctggagcatcacactacctgacttcaacaccttacacagccatagtatccaaaacagcatagtattggtattttgtttttgttttttgagacggagactcgctgtgtcgcccaggctggagtgcagtggcgccacctcggctcactgcaagctccgcctcccgggttcacgccattctcctgcctcagcctccccagtagctgggactacaggcgcccgccaccacgcctggctaattttttgtatttttagtagagacggggtttcaccatattagccaggttggtcttgatctcctgacctcgtgatctgcccgtctcggcctcccaaagtgctgggattacaggcgtgagccaccgcgcccggcctaggacttctttttaacatatgtgttgagattccaatctttgtggttgctatttctttgatgattaatttatagattacaatgattattactatgcagtcaaatcacaatgtattttctatagaaattaatacaaaatatatatttaaaataaaatgagttagtttagtcttccaaaaatttttgtagtttagagattatttaaattatttgagttagcatttgtacttgctttgttctatggtgaaagctttgctaccaattacattgtaggtttatttgtttcaattcatcaatacccaatggtgtttaccaagatatgattaagacaaggttttacaatatcttattttcatcttacatatcactgggctatttaattgaaaattttattgaaataattatagattcacaagcagttgtaggaaataaaacagaaagagcctggcccatatcgcccagtttttcctcatggttacatttgcaaattatagtataatatcacaataatgttattaactttgatagatcttatatcttttaaatatttcccttgttttatttctattcctttgtgagtgtagaacccctgagttttatggattttataatttcattttaattgaacattatttaggaattatataaagtatttatgtttgtaaaaacccaaagatatatcacagaata

SEQ ID NO: 289 - DNA, 26 bp, Homo sapiens
agtaatagttttacttattaacttac

SEQ ID NO: 290 - DNA, 1131 bp, Homo sapiens
ctggggtgtaaggcaagatgaaacatatcacatcccgttctaaactttattcttgtggccaggggtcagcaaactttttctgtaaagggccagatggcaaatatcttaggttttacaggccaagaagcaaatttggcatattatgtagctacttatatagtaaaataaaaatttccacaattatgtaattgatgaaactcaaaatgtaataataataatcgaaggcagtttttttgtagtataggtttaataatgagaagaatggaatcatttttggaggtgctaacattctgcttggttggaatttaaagttagtgttctgtatcagcaaatccattgccaatgttcatctaaaaatgttttcacttctgggccggatttcgttcaaaggctgcagtttgctgacctctgctcttggttacaccttttgaggcccttgctctccgagcataaaatggaatccatttatcagactaaatcgggaagattaaattttccagcctcacgaatgctcagccattgactcactcgttcatacaatgaacactcattgagcttatactacatgccaggtgctggaggaggcatggggcgcccaggagaaagatgctcgctttgcggccacagcccagtgggagggagacccatacctaccggtgctgtctcagaaacttgtggaacaaagatgaagcaatgttcatgttattcgcctacatctgtgaattacacaaggaagacgagtttgagaaatccgaagttcagtacaaatttatggtaacttttttaaaaaagaatacactgaagttttcttagtgaatggaataatgttccctttttctcccctgtacacacaaatacacaaaaactaacaaaaatacgtcgtgtgtgtctgatttgggttgtatttaaatcatttcataaatgactttttcccataacttcagtttcaaagttttaaagcacagtcaattaatgatttggcaacagctaagaaatcacaagttcccttcttttcatgtaaacttctgtaaaacacacgctacgttctgctgatggtaaatagagccatttcaggaagttagccagtttctcttctcggccacctcctgcatagagggtaccattctgcgc

SEQ ID NO: 291 - DNA, 1280 bp, Homo sapiens
acccttccgatgttaaaaattctcttctcttcaaattgtaagattctgattccaagatcttacaattctattttctgaagatttaagattctctgcctggaattctgagaactggaattctgaggccaggggtccccacagacccccatgccctcttggctcaaacccccaccccagcccctcagacccccagccccacgtcctggtctcctcaaccaaggggtcacccctctctctccaaagtctttgtgctgcccagacagaggctcccatgcccggggttggggagcggctgcttggtgcacacagccatggggatacacggtgggcttctgggggcctccacttaattccacagtgcgtgctcagtggcattttgtatcggatccggcacagaagggtcaaggaatagatgtggctgcaaatacctgggtcacttacacacagggtggctgctgtgggcacccccgggactgtgcggtctctctcccactctgggtgagcagtgggatgtccagacccttggatcatggtggtcctgatgggtgggggggatggggtcccagggttctgtgcccagactctgacattgtggtcccggtctgatggcagagacacaaactctgcccttggggaggctacagaggatggagtagatgtggaccttatccttaaggagccctaaatatgatggggagcccttcccttggggagccccaggtctgatgataggaagacaggacagcccaaataaataaccactgccccatctgtcatcctctgccctcagggccaccctcggcaccagtgaacctgatctccagtgtgaatgggacatcagtgactctggagtgggcccctcccctggacccaggtggccgcagtgacatcacctacaatgccgtgtgccgccgctgcccctgggcactgagccgctgcgaggcatgtgggagcggcacccgctttgtgccccagcagacaagcctggtgcaggccagcctgctggtggccaacctgctggcccacatgaactactccttctggatcgaggccgtcaatggcgtgtccgacctgagccccgagccccgccgggccgctgtggtcaacatcaccacgaaccaggcaggtaggcggagaaactccgtcccgcagcgtcctggtcccccagcttcccctgcctcagacccatccagggatcagagctctgccggggacgtgctgtgggcctttaggcaagtgcctctctggccctgcgctcctcaccaggacccagagctgga

SEQ ID NO: 292 - DNA, 1283 bp, Homo sapiens
ggggaaggaaaaaaaaagaaaacacccagaaactttcttccttgttgcgaataatcgccgcctccccccctccgcccccagcagaagcagtaacgtgacacccgagcgaaatcccgagacccgagcggagagggaggggagagggaggagagtgctgcggagcgccggagggagaaaggggaggagaaggaggaaaacccctgtcaaggaggtggagcgaggggatggtgtccgcctcctgttcctccctgccgttttttagagaagcctgaaccgggacaaaacacgccgagacctacagacacaaagccggggggtccacgctggcgctggaggcgagccccggcggccgcaagcgagcccgaggcgcggcggggcgcggggcgtggggacgctagcgggcgccggacgggcgcggcgccccgtcacgggcagcgccccgaaccggggccggacacctcggccgctcgggccgcggcggcggggaccatgccgaagaaagtctcctgagcccggcaacttcggcccctccccgcccccacccggctgccctccgcgcggccctccccatgtgcagccggccagccgggctctcctcctcgcggcggatgggtgaccttttcctggcacgggcaggctgtgggaggcagcggagcaggcgatgaagaagaagcagcagcatcccggcggcggcgcggatccctggccccatggggcccctatggggggcgcccctccgggcctgggcagctggaagcgtcgggtgcccctgctgcctttcctgcgcttctccctccgggactacggcttctgcatggccaccctgctggtcttctgcctgggctccctcctctatcagctcagcgggggaccccctcgcttcctgctcgacctgcggcagtacttgggtaaggaagctgggcaggcgctagggcggcgccgacagcgcaaagttgtgcggcggggagagggtcgcggcggggacttctcgcgctgccaccgcgcgccgccgccgccccgggtctctccaggtgctaagcccgtgagcatctgtgccgcggtcgggagcgccttcttcctcccgcgcgtccgactgtcctcaccgaggcgggggcgccgctgggttgcgctgccggcaggtaccccggggcgaggcaccgctcaccttccccccgccccacctccgccacccggatccggactggggcggagtggatgggtgtgtggggtgtgccggagtgtgtgtatcttcaggcctggcggcgcggggagtggcgaaggga

SEQ ID NO: 293 - DNA, 1321 bp, Homo sapiens
gaatagaaatagaaaatgacttctttatttttaaaatgaatgcaatatctaacagatgagtgccaaattcttcaatgcaatcaagttcacaaattcactcacctaagcagcctgattggaaactaaatagaaaacaaacaaacaagaagccataaatagaagaaattcaaaaggtagctaacatgttcatccatgttagataccctgctgtaattaattttaaaattaaccttccacatattcatcaggcatcaggcaggtttgattgtctgaattttcctctggaaattgactgcaatctgtgtcttcaggccactgtaggcccacaatcccaagaacagactcacagcgttctttagagtgttcacacaatgccctagatgaacaagaaagacaaaacattagaagcagaaatagctccatctgagacagatgtcataaatttatgtcaagttttaattctgtgtatgtggcatgtattgtgggtgtgtggatataaaagatgcacatatatatgataggtatttgggaaaccaaaatgagtaatatctctgcaaagagtatacattccagcaccacactttcaccaaaagaaactttattgcagaaataggtctaaagatgtttccaggacacagattcccttctctacactgcctttctcattctgtcttctgtctttgaaggagacatattctccaaccttttgttccaaacagggaagtctccaacatcactttggatagtttgccaccaaagtcattgaatctatacaacaccctcatcctcagagatctccccctctgcagaccagccttgtgagccatctcatgtgccaccttagcttgcctaaggcatgcctcccttacttcagcttccatcaatattggtgaaaagcttaggactccttccaaacccacttacgttgagctcgagttggttaaaatgtttggtttttgttttaaagaaatgatatattattgtatcaggtgctttcgtgcgtattatgtcttttgtctccagaatatttttaagttaaagtatcagcgtgcctcacagaagatttctttacttctttttttacttcttatggaaaaaaatatgatttttgtctcaatatattactaagaaattagttacacagttaaaaaaaaaactaaccaaagtaagttcctaggccaatatactcttaatggactcaaataaactcttacttatcaaaagtttcaaattttatacactaattcaactaagttctcatttttaagataaaatgggagacagatcttccagaaaggccagctccagtcttgcccaaaac

SEQ ID NO: 294 - DNA, 1817 bp, Homo sapiens
taggttatagccagcataaactttagcagtagatcacagaaagatgaactgtggattgtgtgcaattcccgggacatgggactaactagaacccttttttgcatactcaaggaagcatatttgaatgcaagggagagtgaccttatgacaggaacaacctagacctgattctttttacagaggaaatcattttcaaatagattacttacaactaagccataatggctgtaagagaaccagctaaagaaaagactcttcgggcaaaaaatggtcttctaaagtaactaactggccctttagttatcttgtgaataaagctggactttgatttacactattgggtcttcttaacaagcagagctcaggccccatgctctgatcgtgcctcccaaagcacacctttagattctgcttcatggtggatcacagcaaggggcttagtgaacgtcttcttattctgcatcatggcccagattatcgaggcgtccagcgaggtgcaggcttcgtcaggaggcacacactgcagacaggcagaacaaagcacagaatcaggggccactcaaaagtgccttcaccagctctacctgcacagctgtcctgtggccttttatcagacagcacacagctgttcactacagaaaagcaagaaggtgggtgtttttcagagaacaccaaataacctgggagatatgacagcaggcccagtggatttttggttgtacctgaagatgcaaatatcactggatagcttctcaatattgtcctccccctccccttcttctcacaaaactaaacattttagtgttagtttgaaaaacagaaaaactatatgcctagtgttggtcctcaccaagctgggcttcatatacacggttcatgtttgtgattggtgattgtgggaaatttcccataaagacgctcctcaacttatgatgaggttacatcttgacaaacccactgtaaactgaaaatatcactaagttgaaaatgtgtttaatacacctaaagtaccgaacaacacagcttagtccagcctactttaaacatgctcagaacacttacgttaacctacagctggaaaaatcatgtaacacaaagcttatttcataacaaagtgttgaatagctcacataatttattgaatacttagattgaaaaacagaatggttgtatggggactgtctatactgcattatgaaggtgacagattttacatttttctccaataagataatcatgttgctgagtttgtttcatttttaatcctggtataggctcatgtaaaactaaactttccagggtcatctgcttttaatgtttcaaaatgcagatcctgggggctgtgcccaggttgtggaggccatgagattagccgcttcaaacctattaatgagcatgctcaggcccactacatctgttttgaaaaaatatgatcacactccgcactttttctttaaaataactttgttttcttgtctatatttatcaataggtatagttcttttttatttttcttgagacagggtcttgctgtgttacccaggctggagtacagtggtacaatcatggctcactgcagccttggcctcatgggctcaagtcatactcctgcctcagcctccccagtagctgggactacaggtgtgcaccactacacccagctaatatatatatagtagtgacaggggtctcactatgctgaccaggctggtctcgaactcccagcaagctgccaagctcagcctcccaaagtgctaggatgacaggcatgagcccacgcccagcctaataggtataactctaaagtaaatgacagc

SEQ ID NO: 295 - DNA, 1846 bp, Homo sapiens
tggtgctcgttcaataatatatcatgcacacaaaatacattaaacacatattgcaacacagttgcaaggttttcatcacagaaataggtaaggacatttcattttttaaaagtgccttttgctatagggtttctaaaaaatcatttcatagtgaaaaattaactactggtttctttgatgtgttagtttgactgaaagaatatattactagagaatgcttattatttttataaccatatttctgaaaaaaaaaaaaaaaaaacgttcatttgtttttttgtaggtctgggcaagggatgataaaaacccttaaagtccaggcaatcatgctgagaacaaagggcaggtgtcattttttactgtgattggccagagctgaaatcaggactttctccctctagcagaagctattgtggaatttacagtaatccccctggctgactgcccatcacactgccaaacagcacaacaacaaaaacgtaatatctggggagaaggccaaaacatatattaaaaattctcattgtttttattcttcaacattgaaagatgatttaagagaaaagaaaaaactcacccagctgttaccgctattcatattccaacagcctccagattgctcgaggccacctggttgacttttgccttggagtcggtccagaaaagcattatttaccctttaaaacaatgaaaaatgtgtgtgagtagaaaacttgctgcagggctgagagatttctgagaatctaatgtgttgtatgaactgaccatggggatagcttcctggcttcagcttagaagaaatccacagaaacttctcttcacactaaccatatgacatgctgttaacccctctttactggagctggtgccaatcttggctcaagccaaaggggatacgaattcttaacctgagagtttcaggcactcatctcctgccagttcagcaagaccctagttcaagaaagaaactacagccctcagaatcatgccaggtatgaacctcagaggctggagagagaaagaagcctcagcatgaaccaaaacatgaagaagaaccaaagatagctctatggcattattgttgcaagatagatgtccttcctatattccctgcactccactgccagtcttgctaaagtaaaccccatacatgaaaagcagaaatggaaggtgagcttatattattctatttctggagcttgctacctggttgttcactttataattaatcactataaatatctgttttgtggacctttctgtgtttcatattacagtttttaaatttaaaataataaatcacaggtaacgtcgtgctctgagttgcccacgtatggctgagtagagtcagggacttggaagctgaagaaatggcactgcaataggtaccctatgacatcaacagattatttaggaagtgcagaaataagactataagcttctgggaagcagaaacacaatgcctggtgcatagcagcaaatatacatttatggaaggaagggaggcaggaaccagtcacatgagcctcttgttcagtcatgaagattagcagaatgtggtcatggtgagtggctacaggccagtgactgtgggagattagggaactttgaggcaaataaaggctgggtagcaaagtgaaaggctggagggggtttctggctgtctgcgcttgctcagtgctagctaagatgccaggcgtgtgtgggctcagttgctgtctctcaacaactttaggtcccatcgggctgcggttccacctcagctattataaagcttctttcctgtcttaccataaaatctacccaagtgccatattctagtcagcctgcttcactgccaagctcc

SEQ ID NO: 296 - DNA, 2122 bp, Homo sapiens
ttccacatttgaggcagtcttaaaatggaaaagtgatctggatagtaaagttcatcttccaaatggcagccctatccctgctgtcctcttggctaacaaatgtgaccagaacaaggacagtagccagagtccttcccaggtggaccaattctgcaaagaacatggctttgccggatggtttgaaacctctgcaaaggtgagatctgctttgcttatgcatcttttgctttctagctcataattctgagctgtaaatgtaaagtatttagatatatttatgtgagtggtgtttgaaagtctggaaaatgagaagtgtagcatggatgtgttatagcttctttcagtccacaacaggactgctttccaaattggctaatggctaatagaagggcagattttccatcaaaacaaaaagaattatttagggcaaaaagcaaatgacattttctgtgagtttgagtttttaactgaggtacttctcatgcaactagagtggttgggggtattgtcaagcacgagaatttttggtttttacaaaaggctaagtgaataggaagatgcctctggtgaagatgtgtgtcacatgcaggaccatgtgaaaagatcagagaggagatttattcagatgatgtttgaagagttttaggttaactgtgtacgaaagatttgaaacagccagaaagtatcaacatttgtggtatgcttcataaacagtagagtgagaattttttcttttgtctattatggaaagctgaataaaatattttctgaaggaaaaaataaaacactcagttgactttcaaaaatcttaacagtctagtgaccaggcacggtggctcatgcctgtaatcctagcagtctgggaggccgaggcagatggatcgggcagatcgcttgaactgggagttcgagaccagcctgggcaacgtggcgaaaccctgtctctgccaaaaatacacaaagtagctgagcatggtggtgcatgcctgtggtcctagcttctcgggaggctaaggcaggaggatcacttgagtctgggaggcagaggttgcagtgagccgagatcatgccactgcactccagcctgggtgacaaagtgagaccccatctcaaaaaaaaaaaaatcttaatagtctagatatagaaaaaaggtgaaaattatacatatataaaatgtttggggggggggttacgtgcattggaactttcacataagggggttagtgacaatcagatttatgtaagaatgatgaaatgtttgaaaaattctgtgatgacagataaacattataccataaatttgttgaaatcataacacagttctagcttttagtttatgttctgtggatttcttgtgtgtgtttacgggtgtttttatatatgtatgtatgtatgattgttcctccaaatcacccacctcattctggatatttactaatcagattaggtttagctctactagaaacttacccttagagtgaaaaactacttgatgccaatgatgatctgcgggataaaagcgaagcaatgagagactgcacaaaaggagaccgctccaaaaatattgcgcaatgatggagtcactgggaaaaaaaagactgtctactgcaggcagaaatgtacactcctaagctagaggctaattgtttgaataaatatagcatcttaaaatttcctttcataaataaaacatagtgatagaagaaagatgaagcccaggagtgctatgtgagcacttaatctgacacgaaggagaaaatcacagaaagaaagccttcttatagagaagtcacctcattctcccaagaagctaggaccacaggcatgtgccaccatgcccagctactttttgcatttttagtagagacagaattttgccgtgttgcccaggctggactcaaactcctgagctggagtgatctgcctgcctcagcctcccaaagcactaggattacaggcgtgttcttctggacactcatgccctctgtctgctctgtatgcctattgggtgatttgctctacttgccagctttgctgtaaaaagacgaaaaaaaaaaaaggggcagtaagtataactgcttatgcgagtgtgcattttggtggaggagttttataaatgata

SEQ ID NO: 297 - DNA, 2403 bp, Homo sapiens
aaaagacagaaacactaagggagtggctcagtaagaggcaacaattccagtgcccaccaggtgccccaaatgtttcagcatcatggacaactctagggggcttgggtttccaccccagagacttgcgcagggcagactctaccaaggtgtgggttggagttgggagtcggggtgaggttccccgctggctccaggctgctccaatggggcgggggccgcccgcagggccgggcggggctgtgctgccatctggagccgctgccgccggcggccactgtcagggcgcgagcggctggagcgcacgcagggctggagcgagtgcagccgccgccgccgccgacaccgcggcacatgggccggccccgccgctgccgtcgcccctagccccagcagccctggtctcgcagcctcctgcggctctggtcgcccgaccagccatgtctctcggcggagcctccgagcgcagcgtcccggccaccaagattgaaattaccgtgtcctgccggtgagcgggccgcgctggggagggcttaggcactggcactgccccagccccagccagccgcggggctcagcctgggcaggggctagacccccggggagaggcgaaattggctggaaaatcacagctgatgacagggcgagtagctggtgggatcgagaagcggggggtcttgggcagccccaccccgaaaaaagggctcagcctgcgggttcagggggtgggtcgcagatatccggtaggagctcggccccaggaggacaaagttctggggcgagccctctttcctgggcccttggagacagtgtgggtgcgttcgcgtccagtccgcagagccatggttcctggacagcgatttccggtgctgtccagagtgctgacagagcggaccccggctgggggtagccatgggggacagaggttcgatgcgggccccatgcctctcctcagtgcccggctcagagccgactcgaggcgggcggactccaggatgatccactctgtctgtctgttgcttttctctaggaacctgctagaccttgataccttctccaagtccgaccccagtaggcggctccaggaccgggagggggaacttggggtctgggcgcgactcaggggcgggtggagtcggggccaggggtgggagccgacctgacgtccttccctccccgcccccacctgcagtggtggtgctttacacgcagagccgggccagccaggagtggcgggaggtgagtcccagagccccctcccggcccagggcgtcgcccgggaattcccctgcccgtctgcacgtcccacgctgaccctccacccccctacccagttcggacggaccgaggtgattgataacacgctgaacccagacttcgtgcgcaaattcgtcctcgactatttctttgaggaaaagcaaaatctgcgcttcgatgtgtgaggccccgcctggaattctggcttggcccgcccccgacctggatccgcccggaattctggctggccccacccccgcctcgcctccggcctggttcttctcgcaggcctccctcccattctgaatggccccctctagcctgagccctgcccttttatgagatgcggtccagttccgtcccccgctctggccccgcccacaactctgctcctatcgcagctccacctcaggcccgaccccttccacacaaccctgcccccagcagcccctgacttggcctcggcccaggcttgaccgtctgactactcagcccaccctgactcctccccaaaaggagaccaaagctgaattcgggtccacggccgcccatccctccacccaaaattttcaccaagactcggtgcccgacccctttccaccctctcccccacccagccccaccccacaccggttccactcttttcccaggtacaacgtggactccaaaaccaacatctccaaaccggtgagcaaacgtttcctcgagggttggcggagcgcacaggaggcacttagatgtgttcaacgactctcagaactcctcccaaccctcgacccagaccccatcttcttcaggcccccaacccaccctcctggtccctctcctcctgcctgagtgtcctgcctgtgccccctactcactgttcctcttccttcttggctgccactgctgggacctgcagaaggtgaggctgaatggggctgggcagaggttgggggtgggggtggtattgtggagaacaggcttggactgatgacccactacaaggcagagattgctcgcagaccccttctttcacaccccctccattaaagcccatgtagggccgtggctcttgcaccactcattcgcctgggaactgccctggtcctgtgcaggagcatcactggggctaggctgggactcagcactcaagagcttctggtc

SEQ ID NO: 298 - DNA, 2506 bp, Homo sapiens
tgccaatgcctctatactactactattaatactactgtattcttttcctttgctcttagaaaatatttttaaaattttcagtggacttcttaaaactttgaaatatatttttaggattttatgtttgtttatattacattttatggtctattcatgtgtacaagacagtacagaattctgcatgtagaaaggtatctggagaatataaaaaattgtctaggctgggcacggtggctcatgcctataatccaagcagtttgggaagccaagatgggtggatcacctgaggtcaggggttcgagaccagccgggccaacgtggcgaaaccccgtctctactaaaaacacaaaattagccaggtgtggtggcgcatgtgtgtaatctcagctgcccagggggctgagccaggagaatcatttgaactcaggaggcggaggttgcagtgagccaagattgtgccattgcactccagcctgggcaacagaacaagactctgtctcaaaaaaaagaaatatgtatgtatgtgtgtgtatatatgtacatatacacacacgtatttctgatgtgaaacacctggaatgacagtaagaataatttcaacatatcagaacctaaacagttattatccttcaagttgattttattataatcttatattacatataattaatgttacatataatactattatatgcaacatttatttgaatatacagcttctgacatttatttaaattacttggttacaccctacatgtatgttacatggctactcttttcagtggcatttccataatatgaaagttaaggtttagatagataatgatttattgtatatcctttttaaagttattctttttagttaattgctctatgtgtattgagactaggaatcagaaagcttagattctagtcccaggtgtaagttgtgtaacccttggcaagtgtcaatctctaggcctcagctttctcatctataaaatgaggaagttgtcgtattctattttttttcttaagatgatacacttaaatgttcccttctgttgggttatataattgcatcaaaagtgtagtaatgttattaaaaaattgttagagatccaaactaaggtctctttcaactctcccattcttttttctgtgactttatggtaataatgaaactggtggttttcttttcttccccctcacagtatctcagagatgttaactgtcctttcaagattcaagatcgacaagaagctattgactggcttcttggtttagctgttagacttgaatatggagataatggtacgttttgtggggaatgtgtattttaaagagagaggaaagatgggaaagggagtgtgaaaatgtagggaactttgcagtttgttttgtctagtactattttacctttggtttattcttatcacaagttaaaagcacttttattgtctttcattggtgtttatatatttctgttagaatttggaaatggtgccctctggagaaggctaattgactgtcttctcacagagtaacactactttgataatatggtctgcaccttagcctttcaaattaaattgtttttagtgtcccagaattgatgggactttgaagtgttgttgcagtaggtaatttctcaaaagactgaaacatgtctaatgccaatatacattaatactctataggccagaatatattacttatgtttactgtcttagcacagatacttctatggttggaagcttctgaatgttagtacctatagtaaaaacaatttttctttaaacgggtgttttctcttattagaccatttcattttgaaaggcctgccaacatctaaatgcaagatttgattatcttatctgcatcccctgcattttgtgtttttcggttagttacagtcttcttaattatttactttggaagcctttttatatcttggcttatccctttcccttcatcccacctacactgactttttctcatgtttgttgtatcttcattcccattggcataatcctaattcaggctcttgtcactttctgccaggagtattataatatctcccattagtgtcaccttctgttcttaactgcatggccaaccaagctaactttctgaaacgttaatctattttaggatgcaacttactccttgtttccaaagaacagttccagttacatattcatattaataaacatacatatccataaacactaatttcccattttctataaaaagaattttaagctccttagcatggtagttaatgatgactgatatccaacctgtattcacatcttgacatcccagctaaattagaataatagtgcttcctgtttatatcccatttccccctctgtttctttgttcacacttttcccttggctaatataccatttcattctatctacacatctaaatcctacccatctttttaagatccatctcatatgctgtcttatgtcttagcagcagtataatttccctctgaacttccatagcttttaac

SEQ ID NO: 299 - DNA, 2543 bp, Homo sapiens
gaagtaatgcgcgacaagaatttaaactcttaaaacgattagcagcaaaggtctcatgtgcttttttttaattatcattttttaatcgaggtataatttatgcatttaaaaaatcagatcaattgccccccgggctctgggatggaaggcggtgtgcgcctgcgaaggtcagaggcccagcggcgccagggctcctcggcggagagccgcccgggtccggcgctttgctttcgccttctgccccaccgcgggcgaagccccagggccccggggagactccaggccggctgggccggggtgcgcccgccggctgtccgcgctcgggcagggtggggcgcagcgggcgtctgtcctgctagcggggatcgggcggctggacccaagagcagggcacgtgcgcagcgacgcggggcggccccgccaggagccccgacccgggcgcggcgcagggcccggcggagagcgcgcattcccgagcgccgcgagccggccgaagtcgggcgagcgcgccgtgcggcggctgggagtgggctgcatgtgccgcgcggggagcccgcccgacttcggggaggcagcggggcgccgtggccccgcggctcagctccctgccgggtcgggtgtcccagccctgcgacttccggggcccggcggctcctcggggagctcgtccacaggcagcctccggggcgagagagcgcgcggcgcgggcgccgggacggtccgcggcacgcgggtggagccgccggcgctcgggctcccgcaggggcggcgggcggggcggggtgaggcgggccggccgccctcccctctcctccctcccgcagcccgccctcccttcctccggtcccgcagccaattaggcggccccctcgggcgggaggcgtggggcgctgcataaagcggcggggagctgccaccccgggagcgggctgcgcagtgtccgggccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaaggtgaggcgggcgcccctcccacccgacggccgcgggcccctgcgctgggcagccagactcggggcggcgggggcgagggagcagcgggccgggggtccgccgggcgccgccgagacccgagcctccctgcccgggcgcggctctccagaaaccgcacctttcgcgggacgtctcgggcgggatcgcaggcggcggggctcggcgctgtgagcctcgaagccgggaaaccgaggccgtccagcgcccgcgcggggccgggccgcccgcatccctgcgaggccccgacgtgtccctgcgctgcccgctttgatcgcgagtggaggtgcgcgccgcgttgactcggagcgcgctggttttggggagctccctccccaaaaacccctgcgatgatttccagggtggacgagtctggctttgagagggtcggagggtccgagagcgccaagagagagtccgggaggcagatggcggagctgcagttggaagactggggaagcgggtcctccgagcaaagcgcagcgggcgccttccgtgcttagtttatacccggctcagcagcagaacgaggaggagtaggaaggtgctcgcttactgacgaaacctccccggagcccagaggtcccggtgtttacacacaaggcgcgcgctccggaaggtcgcagacctgggcctttgggaagcggtgggtcgcgaggccgcagaagcgcacggttctctgcctcctcgctctgtgggctgggaggctacagcgttggcagaacggcgagattacctgcccggggcagaaaggaataaaagaagatggtgaggcctccgaggcctctgagctggggctgaggagggccgagagacccgggtccgggagcgcgacccgatggaggacacccccaggctgtctggcgtgcgcgtctgtcgtgggccggtgctggggcactttagaggcacaggccaggccgagagccattgccttaactttccccacctttggcttctcttgatttttgcttttacccatagcccccaactccagctgacaccgcacttagagaatttcctcatccgttttactttaagaagtagcaattatctttctcaaagaattttaatcaagcggagaaagttgcagggcactatgtgtggccttcagatttgggtctcttggcacttaattcccaatgtcggctgagcctctgatcacaagacatttaaattaactgttttcagaaggctctgtaatcaacaaagacacgtcgctgtaaactaaacgctggaaattattcttaatgtagttttatttgtaatatcagcttcagagtgaaaattccaacacgaattctgggaagagtgaaaatggtacccgaattttgtaagaccctaaccccaggtgcttggctgctgctactgatggttaagtggggaggttgtttgttttcttttggttgta

SEQ ID NO: 300 - DNA, 2585 bp, Homo sapiens
cttcattctttacccttcaacctctctctcagcacagtaacctttcgttaattcaatcacccagcccctattgggctcccgaccctgggcacacagcggtaaactctgcctcgcaataccgtgtgggccttcgcgcacccctccgcgtgagcgttccgagcccggtgcagtcccggcttccgcgcgcccctgctctccgcacagcgctcccgctccgaaggtgctctgacaaccccgcaggcgctattcggagccggggcagggcagctggggctggaggcggcgggcgcgggacggagctccatgaaagttggaagaagtgattacaaatcgggacccgactctcgcagccttggcgctcgcccctccacgcaggcccgggatgccggcctcagcccccagatgtcgggaagacggcgccggccagtccaaggaagagcttccaggaggctggggagcaagggtgccgggctcctcatgccgggtcaggtctcccaggagtgccggctcccagggccactaggcccaggcctgcgcgaggagggagcgcgcgcctccctccacccacccggtcctcgcccctaacccgctctccggcccacactcacctgcctggctgcaagcgccgtcccgggccaggcagtcaggtttccatccccagtgcggcgcgctccgatgccgtcatcgggacccccgccccccaaaccagcccccccctcacccgcaactccgcccgccggggcgctcgggggcggaggcgcgagccggtcggcgtcgcggagtcggcccgcagacagggcgggcggggcccgtgctcaagggctgggcctggagagtgtgcagcatcctcatgatggcatcgccttattttctagaatttgtctccaaactggactccagaccatcctgtcctcagccccgagtcaccttcatccccggtctctgttttccactcccagtcccaaaccacgcctcctgcacgccactcacacagccggcagaaactttaatctccccacgtttaaaaaagttttctcagttataagactctctttttctcacattttagcattcctaaaattgagttccatcttacactcattgtcaagggaaacttggcaccaggaggggcaggagaggtgatctgggggtgtccacggcagcctcaaagagatggttggtgtcttcacctctgagacctctgatccattgtttgcactggaagcaccatgaatgggtgaattttaaaatctgaaaacatatttgtcacttaaaacgccattagaaaaagtaaactccagtgtagtttctagtgaaattttattatgtatatagaagattacctgtcatagacaggcaacataattaaaggccatagaaattgccaggctcgtcagatagatctatattaggaaaccctcagcctccagtaacagaaaccacaatttgaagtggcttgaaccataaggtcatgtgttatctcggggaacagtgaaacccagagggatgagggctcctgggcaggttgagtcagtggcaacattaccaaggaggtggcctttttaactctttttttttttttgccatcaacttcagacacaaaacgtccagaggaagaagacagcagtgtgtggtgaagcatgccctttggatcaagagcactccaagctgatttccttcccattccatgtaccacacagcttaggcctgtccacccccaaactaatcactgtcaaggggatggaactaccatgattggcttgcaataccagtgtgagacagcgtggatataggaaagtcatccacaatctccacaaccacatcctcgaagcttcatagaggagaggctggccaactgattcgtgtatcacaaaggaccatgattcaggtaccaagcatctatctgtcagatgccaggagctgtgccatttcctccaatagacaattcaattaaggagaaactaaaacctcgagcaattggaaagagcacatgaaaccccagtgttctttgacatgctgtagaatgacactgttgttcccaaatattctaaatcaattggggtcctgaacaagaacaacacagagcagcctgccgccgtgatgcccaaagagaatcattttagaccctgaaaatgtgaagaagctgaaaactgaacttggattttcatatgtgtaaaatgtaataaaaggtgatgatgattaatgaaacatcatgctttaagaggtacaattctgggccagccaaggtggctcatgcctgtaaacccatcactctaggaggctgaggcaggcagatcccttcagcccaggagtttgagaccaacctgggcaatagggcaaagctgtttccacaaaaaatgcaaaacataggcaggcgtagtggcatgggcctatagtcccagctacttgggaggttgaagtaggaagatacactggcttgagcctgggaggtggaggttgcagtgagccgagatggtgccactgcactccaacctgtgtgagagagtgagaccctgtctcaaaaaaaaaaaaaaaaaaagagagagagacagaggtacaattctaattacaattatagtaattaa

SEQ ID NO: 301 - DNA, 3216 bp, Homo sapiens
tttcaggaagagatgctgggaaatgtaggaaaaggaatacaaatcagtgagacggagaagcgctgagtgagagagacggatacgtggagagaagagggatgccggagcgggtgttaaaagagacaaatctggccgggtgctgtggctcctaatcccagcactttgggagactgaggcaggcagattgagctcaggagttccagaccagccaacatattgaaatcttgtctctaccaaaaatacaaaaattagccgggtgtggtggtgcacgcctgtagtcccggctactcaggaggctgaggtgaaaggatctcgcttgggcctgggagggtgaggctgcagtgacccgtgatggcaccactgcgctccagcctgggcgaaagagcgagactctgtctcaaaaaaaaaaaaaaaattgagagacagcaaatatttgctggaagagggagagggaactggttaggggagaatggattctagagtctgaaggccaaacagaacgagagagagagagagagagagagaaagaatgaggttgagggtaggcaggaggaagagcaagatggggagggagggggagagcaggagagaccaaactagtagagtcacagacagagaaaaagtcaaagacaggaaggtgatacagaggagagagaagaggaagaggagagactgacaggtgcacaaatcagagaagtcccagagatagcagaaacacacacagagacagagatagagagggagaggtaagccggagacagactcagagattcgcacaaaaagcaacgtggagactcagaagcaagcgcagcgtcaaggaatgctccatttctggtgtgttgttttcccagtattcaagaaatatttattgagtgccaacctgttctagacccaatctcggccaggggatgtggtggcaaatagacggacaagggcctgctctcctgaaacacactggagagataaacaataaataatatcatttcagtaaccaaaaagtgctttaaaaattaagctgaaggccgggcgcagtggctcatgcctgtaatcccagcactttgggaggccgaggctggtggatcacttgaggtcaggagttcgagaccagcctggtcaacatggtgaaacttcatctctaccaataaataaataaagtagctgggtgtgctggtgtgcctgtagtcccagctacttgggaggctgagaaagaaggatcacttgaacccaggaggcagaggttgcagtgagctgagatcgcgccactgcactccagcctgggcgacagtgagtggtaacagaatgacagagcaaggatgactttagatgaggtccttggagtagaccttgtggcagaggtcacagagatgtggattgtgagtaggaaagagaggtgagaaagtctgggggccaggcattccacccaccagaggcagccccaaagcccagaaaagtagcaggtcttcgaggaggcctgtgcggtgagcagatccaccataggacagaggcacagggtaggggctgatcagttagggccttggatccttgggaagaaatctgaattttattctagatctgatgggaagtgcttggagggttttgagcacaggcatgccatgatcatatttttattttcttatttatatttattttgaaaaagagtcttgctctgtctcaggctggagtccagtgggctgatctcggctcactgccaacctccgcctcccaagttcaagtgattctcctgcctcagcctcctgagtagctgggattacaggcatgtgccaccacgcctggctaatttttttgtatttttagtaaagacgggatttcaccgtgttggccaggccaatctgaaattcctggcttcaaatgatccacctgcctcggcctcccaaaatgctgggattacaggagtgagccactgcgcccggcctcatatttttatttaaacaagaacagcagaattacattgctgtgctgagcatacgtagacttcaggagtcaaaggggaaggaaggaggtagcgggctgttgccttcctctggttgctggaggcctggaccaaggtggagttagtgggatggaggaagtggaagaaggcatgggattttggaggctagagcctgcattggtggtgaactggatgtcatagaggagggaaggaaaaggaaccaggaagagaagaactctctgaattgggcacgcacatctctgatgggcaccgatgaggattgttaccaggaacgaggagactgggatcaggaaagtggctttgggagggaggaaccaaggcttctcttttggatgtgtcaagatagatctgccttcgagaaatccgagttgtggtatcaaatagccagttggatatgtgagactggagtttgggggaaagagaggccgtggctcaaaaacgtaagttttggaaacgtcaacataaagccacaggattgggtgacgtggcctagcaggggggtggggacagagaagcgaccctggccagagccttggggacatctacatctgggggagaaggggatgtagcaaaacgagcttaggagtgatctcgaggtaggctgaaaccaggagggttacagagggcaaatgcacctttgtgtttcaagaaggagaggagacagccagctgtgccaagggctgctgagacttggacaaggatgcagagagcagagtgaccattaggtctgatgacatggacagggttggtgatcttgataagataagatgtcagttcagtgcagtggtggggacagaagccctgctggagtggaggggagagagaatttggggggaagacagaaggaaagggaattcaggcaagtgtgtgtgtgtgtgtgtgtgtgtgtgtgtgtgtaactgacacaaaggccaggtgcgatggctcacgtgtgtaatcccagcactttgggaggccgaagtgggtggatcacttgaggtcaggagttcgagaccagcctggccaatatggtgaaaccccgtctctactaaaaatacagaaattagacaggtgcggtggtgcacacctgtaatcccagctacttgagaggctgaagcaggagaatctcttgggcccaggaggcagaggttgcagtgagccaagatcacaccactgcactctagcctgggtgacagagcaagactctgtctcaaaaaagaaaaaaggtaaaaaaaaaaaaaaatgaccctgaaaggaagtaggga

SEQ ID NO: 302 - DNA, 3240 bp, Homo sapiens
agtgacctgaatgggaagattttcaaaaatctttacactccatattcttgctttactgcatatggaaaatccaggggtattgtaagaagagattctttgaagcattcattttgaggaacagttcatgaaatggctgacaagagacgttgtgtatgtttggtgaagaatggtgtagtcacacagaaacagataattagtttgggacaaaagaaagaggctaggaagcatagataagaagaaagaaagtaagtaattctatcataagggaaagggatatttcaggcaggaaaaaacagttgtaaaggccatgagctaaggatgaaacaccatcaaaggaggcagaagagcccacagaaacatttccgaggatatgaatttaagaataagagacatttgccagtgatcaaggagaaagctctaattctcatgacatcgttgtgcatggatgggatgttggaaaccatataggtcaagctcttcttttacaaataggaaacaaagacctagtgggattgccagaagttacacagaggaaaaaggcttccctactctcctgactctatatccgttctcttctacaaactttttacatgctatgaatacttttacaaaagtacacgctttctgagtatgaatgtaatatatgttcactgaacaaaatttgaaaaatatagaaacagaaacataaaataatcctaaaataattaacatttttgcttactttcacttagtctgttacttattcaaacatgtgtgttttaaatcatggtcattctatatgactgttttttaattgtcgttttcacttactatgtcatgttgcttaggaccacaaagtttgcaaatccataataacatgagacaaaaaaagaagtctgattaggtaatttcagggaaccccttgtgactttctgtgtattttttcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtggtatgtaatttacaaagttataggaaacacttttaaattatggttactagtgatgtatgggaccaaatcctgccttatggatgaagtgtttgagtttgaccatatcaacactgaattcctactaatcattgtagagagggatacaatttaaggttagttttctggttgtgggtattgttcttttttaaaaaaatataaaaccaaaattgtcctttaaaaagtcattctttctgagtttcagtacattcgttggccacattgtgggtgcattacattgttagaaagataaaattaaccaaataggatcaaaatgtggtttccaggtttaggcacaatggaagtagtaagtagggaacaagtctgtgtaaaacagtcggacttatgaaaaagtagatctgagttgtggagtgatataggttgggcttcctgtaaatagactctgagattgagagttgtggacagaaggattttggggagatacatctatgaggatgtgaggaaggtgaggatgtgcagagggagaagttgatccacaggcaattgcaactgaggttgattgcaactgagttcaggagatgagctggtccttaggagttgttcccagtttagagctaagctattgatatccccattttagcagtccttggctttaggccaccctcagggttgggtataaccttgagtgagacagtttgctgtaggaaagggtgattcccaatgaggagcacagaacctgttgttcctagcagccgagggatgggtacatcagccccaagaagggatctgggcagacgacgagattatctattactggagaatagtataaagttggagctgaggttcaagaatggaataagaatgagccaaataagtacatgattaacaacaagagggatcagagagccttttgttcctagctggaagatgggttgtcttcttggcttgcctttggtttcatagattagtctgtgtatatggcccaaatgcttctctgaagagttcttttaaaggaactctcatggaactgtctcaaaaaaaggacaggtatatatcatggttcatcatttctaggtttctgtattatttcaaacgtgattggagcttctgtatattaagaatgttatagcaaattctattgcatttaatatttactttaggtaagctaccagaactgtaagttgtgtctgtcaggttctatatgttctgatttgtgtttctccagttatcatttcttatataaacatgattacaattatttctaatttaaatatataatggtaccttaaacatagactatagtttggaagaattaattatttcattcagggagctagtatatcttttttctgtaaagggccagatagtaaatattttaggctttgtgagccatttggtctctttcactactgctttgcctttgtagtagaattgtgctaggcaatataagcaatattagcagacaatataggcagcgatagacaatatgcaattgaatgagcttggttgtgttccagtaaaacttgatttgtgacaaatgggtttggccattgggcagtagttttctgacctctgattttattaataaagctcttgaatttatttttttaacttttattttaagttcaggggtacctatgcaagtttgttacataggtaaactggtgtcatggggttttgttctacagatcatttcatcatccaggtcttaagcctagtacccatcagttatttttcctgatcctctcccttcttccaccttccacccttgaataagccccagtgtgtgttgtttccctctatgcgtccatgtgttctcaacatttagctcccacttataagtgagaacatgtggtatttggttttctgttcctgtgttagtttgctaaggataatggcctccagctccatccatgtccctgcaaaagacatgatctcatttttcttttatggctgcatacctaaagaaagaaataccattcaatacagcaatcccattactgggtatatactgaaagttatataaatcattctatgataaatacacatgcatatgtatgttcattgcaacactcttcgcaatagcaaagacatggaatcaacctaaatgtccatcaatgatagactgaatagagcttttgaatttatattctccattgccttttccag

SEQ ID NO: 303 - DNA, 3508 bp, Homo sapiens
ataattgggaagtatggacagttttttcaaacagtggtgagattttacttgtaacagggagggcaagattactaattaggaaaagcagagattagaaaacacagacatcacggttgagggactacattttcagtgtccttcggtgttatcaatcacaagccctgtaacatttttccctgcagagtggctcagacttagcatacctgctccttattaacactgcctccaccctgtgttaaacccctcatagctaaaatcaaccatgtcgtgggctgcaccccaggcctgcctgcctgcttgcctgctctggcccctgtctgcctgggcagcctcatggctgtaattttgttttcacactccaacaataccatccttctttgcattcctagaatactgcctgctcttggctgccgcaggacctctgcacacactgctcctcctagaacacgctctctcctatgacttccctgttaactcctacataagccgtccattctcagctcacttttgattcctcaacaaaacaaacgtacctgattgctctcactcaggagttcctggcatagttctcatgcattccttttcctcacaccagtttgtaatttaaccttcatttccaattcatgcccacctcaccatcttggccagtgggtctcaaagtggtgtcaggtcacagcaacagcatacagaacaacctattagtgatgcagattctcaggccacatcccagaccaactgaatcagaaacttgaggtgggagacaagcagtctgtgttttttaaaaaaaaccctactgattctgatgcatgcttaagtctgagaatcaacgtgctacactatgtggtatagggtctgtaccatcacagcacagaccagttaagttttagcaccccatggtgtctcctagtgccaaattcagggacaacagtaaggacttggtaagatttcctggtcagatgaatgattggttaaaaaactttcctgctgggagcggtggcttacgcctgtaatcccagcactttgggaggccgaggcaggcggatcacgaggtcaggagatcgagaccatcctggctaacatggtgaaaccccgtctctactaaaaatacaaaaaattagccgggcgtggtggcgggtgcctgtagtcccagttacttgggaggctgaggcaggagaatggcgtgaacccgggaggtggagcgtgcagtgagccgagatcgcgcccctgcactccagcctgggctgaacagagcgagactccgtctcaaaaaaaaaaaaaaaacttcccatggctccataaatcccctactttattaattctaaacccttgcagcgactatagaatacccccaaaataaacattgaaactgctgttcgaagacctgggttctagctcctgctcccaggcctttctgggttcaaattttggccctccttctcttactatctgtgtgatcatccataaatttcctaatctctcttggccttaacttcctcacctctaaaataggaatcattatagtaccgatttcccagggttgctcaatgattgagacaatggcactaagaatcatgactcacacagttaagcactcaacaaatgtaggtagtattactgccataataatagttattcaactttaaatggtctttcctcttgggtctcagctttcttactcaagattgaccacacacacactttagactagttcttcctcccttgcaaaactacacacatctaacacccatccgacgcctgaaacctcccctagcaacccggagtcctgctggggttttccagctccacctcctgaacagctgggctgtagcacacaggctggatctactcatacttgccttcctagagctcaactgaagtcacttcagacaagtgaagtacccactcacctctggaatcagatcttggtaacgccaacaggttagcaggtgatttcatttcagtgtgtgtctgggtggctagcattcaaacgcagctcacactgggagctatttctagtccaattttgctacttggtaacgtattaatagcatcaattaaaacattcccaacgaatagatctttaaaaggacggtttctgacttccctaacaagcagagggccgaccacctgcctgcgaagtgcccctcctgccctgtctccaggcagcatgctgtgagcgatgacagaaactggacccgcgcacagagaagctgcaggcacgccctgcccggccacccagctgcctgcctgcttcgcccggccgccgagccccgggggaaaacctagaatggggatgccggtgcgccccgacacctgggcacggccgcgggccggggagccgcccacacttggctccccaagagttaaacgctgagtaattttcctgaggagcaaacagtcggagcgggggctctgccaatggccacagtatttttatccgacttaaccgacaccgcggcgcgacctcggctgtccccaagggtatccccacgcggcacgctccggagtccccgaccgggaccctcgccggctcccagcgcgacatggacgacagcgccgccgccgagtcccccgcgcccgggcaggaggcagagacctggggccgcccgaggactgctaggggcccctccgcccggggtccgcgcccgggcctaagcggtagggggtgtgcgcccaagttggcccgctttgctgcaagagtggaaaggggtgggagcagaaagcgccggccccgcccggggcggggagcaacgcggggctgcagggccgcctcggggccccgaaccaccgccgcccggcccaccgcggcgccggggaatgaatggggctccccagctggcagcgggcgcgcactcacaggcgacgtaggccagcaaggcgatgcccagcagcagcttcatcctcctgcggttgacggcagacacgaggcgcagcagcgccttgctcaccatccccgggagccgcgcgggtccagggccctaccgcgcgggggcccgcctgctgcacaatgcgcggcggcggcggcggcagcggccccgagagccccgcctcctgccgccgcgcgcccccgcccccgcgcgcctgcttcctgctggcgggatcaccgcgcaggcgcgcctccacccccttcctccggctccgcccccgcccctccggcttctctacccgcaggcgcagttgccgcctttcttgccttggttttcgaagaatgtgacctggagggctggtgggcggtgcggcgcgccgcggcgcatgcgcgttccggtctgttttccctgagttaaagcgcgcgggtgccagccgggaggtgcggctggattcgtttcgctgaggtgcgtccccaacccaagggcacgactgcagtggccagtttccgagccccgcccggaggggggcacgcggtgggcattccggtgttgcagtgaaacgaaacttatttgctaaacttggccgagccttagaagttgaatgcctgcctcagaaagttgcctcgttctctgggctgttt

SEQ ID NO: 304 - DNA, 3597 bp, Homo sapiens
gaatagaaatagaaaatgacttctttatttttaaaatgaatgcaatatctaacagatgagtgccaaattcttcaatgcaatcaagttcacaaattcactcacctaagcagcctgattggaaactaaatagaaaacaaacaaacaagaagccataaatagaagaaattcaaaaggtagctaacatgttcatccatgttagataccctgctgtaattaattttaaaattaaccttccacatattcatcaggcatcaggcaggtttgattgtctgaattttcctctggaaattgactgcaatctgtgtcttcaggccactgtaggcccacaatcccaagaacagactcacagcgttctttagagtgttcacacaatgccctagatgaacaagaaagacaaaacattagaagcagaaatagctccatctgagacagatgtcataaatttatgtcaagttttaattctgtgtatgtggcatgtattgtgggtgtgtggatataaaagatgcacatatatatgataggtatttgggaaaccaaaatgagtaatatctctgcaaagagtatacattccagcaccacactttcaccaaaagaaactttattgcagaaataggtctaaagatgtttccaggacacagattcccttctctacactgcctttctcattctgtcttctgtctttgaaggagacatattctccaaccttttgttccaaacagggaagtctccaacatcactttggatagtttgccaccaaagtcattgaatctatacaacaccctcatcctcagagatctccccctctgcagaccagccttgtgagccatctcatgtgccaccttagcttgcctaaggcatgcctcccttacttcagcttccatcaatattggtgaaaagcttaggactccttccaaacccacttacgttgagctcgagttggttaaaatgtttggtttttgttttaaagaaatgatatattattgtatcaggtgctttcgtgcgtattatgtcttttgtctccagaatatttttaagttaaagtatcagcgtgcctcacagaagatttctttacttctttttttacttcttatggaaaaaaatatgatttttgtctcaatatattactaagaaattagttacacagttaaaaaaaaaactaaccaaagtaagttcctaggccaatatactcttaatggactcaaataaactcttacttatcaaaagtttcaaattttatacactaattcaactaagttctcatttttaagataaaatgggagacagatcttccagaaaggccagctccagtcttgcccaaaactggtagagaaagtgtaacaatcaaatgaggaaatttcggagaaagttctgtctaggtttaagtctggacaaagctcagcataactcaacactggcttagcccaggaatttgtggtaaagataaagccatggtatttctatattaggtcaggaaagatggaaagttcaatagttgataactgtctgttgaactaactagttttgttgcagatttataaaaaatgtatataactcaattgcaactgctattttaaattagtcatatgatacttatttgtacaaaagactatatagtgcctgactctaccacttccaatttttttctgtaaaatggaaattacaacaatatgcagcaccacaagtccagggggcgctgttcttatcatagtccttgtagtgttcagccataggtagcacctctgatgatacacacttcaaaaggttattttgagtacgctacagcataacaatcctcaagtatttagcccattgtaaggactcgatgttagatttttcagtctcatagctaaaaaattcaatgttaaaattaataaacacacctagcaaaagcaactatgtattgctttatgaacttattagcatattattcaaaaatttcttataaacaaatatcaaaatataaaattcgtagtgatagacactgaaaatgaaagatgtatgggtaaacctgaaaaaaagaaataaatttatctaaaagaaatttaccaaaattttgattgaacaacacttcaggatcatccttggtcttatgcattttaatatggaacttaagccctgaaattataaattacatctggatataaattcacatttatatttatagcagaaaatgctgcttcagggaaatttttatctacatatgaaaagaaagtcaaatgccagaaattgttaagtactattaaaagaaattattcactatcactgaccttgctttgcaaaagtgaagtaagatttaaaacagctttttaacataaaattggtagatgttttattagagatacttttaaaagtacttagcagaaattttcagatatttttctacacaagctaacatttagttttattctctctattggtataatttgttcagttccccaagtcattttgaaattttattatttcctgtcctgtctctatagatgcccttactttgttatccatttggtattcagcatataatttattgttttctcttctgtccactatagtaatagtactgctttttaaaaaaaactctgcgtgacttctgatcccaacatatggtttctgcagttgctactcgcatttaggccagcacatttgtatacctaccccttgagggaaaacagcactgaagagagtagcaactcacttctgagagtcatcctgtatatgcaaaccctctgactacaatgcctaacacatggcgcagcaaagggacagactgccaagaagctattgtgttcctgtgctatcatcatagctattgtccattcagggttcattacaatgaatcagaagcactttacattcatttgatctcaaaacaatacaacccaacaaccattactatccttattctacatgtaaaggaaccgaggctgagagagactcaggattttgtctaagggctacctagaaactagagaagggtcaagattttaacccaaacatggactctggaacaatactcttgacactagaatatcactcatattcaaagtccaagctacgctcttgaaatagcgcatcttatttcattcaaacaggcagagaaatgtcagcaatgtccatcgctgtccaatctgtgagtctggcactatgtattcttatgtcatatctctaacaagtgctgtcagagtgcagcattgtaaacacatcagtgttgccagaaaaagaggcagatatatcccttttatactatcatacttttttaaaaaaatggctttttaatacaacagaatgaaatacctgtgaatttatttgattaaaacacataaactatcatcaaaggacgttcacagctcccttgtttggtacttcgttaatgaattctgactcaaatattcattttacaacttctacttctttgtctcacttgttaaatataaagtatttgataaatgcagagctccttagggaaatttacgttgtccaaactcaactaagtcttcaccccttggttctctctgaggcaaaataagggactggggtagatcccatcatattacctgcaaggagggatatgctcgcctgtattcacatcacattttggta

SEQ ID NO: 305 - DNA, 4568 bp, Homo sapiens
tccttctcgaaattggctttttttttttttttttttgcagttaaactaaggtgtcttttttgtttaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggtgtgataaatgaagaagctctttctgttactgaactagatcgagtctatggaggtcttacaactaaagtccaagaatctctaaagaaacaggagggacttcttaaaaatattcaggtgaaatttatatatttaataagatctgtgttttaaaaattacagaaaagatatgtctggactaaacctatattcagttaggaaaatgacattggagaatatctgtagttaagagtagaacttaatacatgtatattttgtaaaattaaacttggcacatcagttttatctatgaaacaaagtcacttcttttttttttttttttgagatggagtctctctctgtcgcccaggctggagtgcagtggcgcgatcttggctcactgcaagctccgcctcccgggttcacgccattctcccgcttcagcctcccgagtagctgggactataggcgcccgccaccacgcctggctaattttttgtatttttagtagagacggggtttcaccatgttagccaggatggtctcgatctcctgacctcgtgatcctcctgccttggcctcccaaagtgctgggattacagacgtgagccaccatgccctgcagaaacaaagtcatttctatggctaaaatgttgcatattacttaggagtgcttgatacttcagatatttttcatggttccaagtttttaatagctttggttttttttccatatgggaggaaaatcgaaattagttggaattactgatacctttaattgtatggctaacatacatacagacttcagtcattttttaaaaaaataatgcaaagtaaatatgttgagaagtttgaagttagttttcgtgtttacagataggtagtttggactaacaaatacttgaaagtttgcccttttaatagttaatatgcaaaattaaacatatatttctactcctaaacattgtatctatatatgatataaaataactccaaaaggtaaaataattttcatgttatattttttacaagtgttatatactaatagaaatctgtgatcattattggttgttttgactcctattggatttttgaaatttttacttaagaaagatttaaagcataatgaggcttcaaaagagtgtactaggtattctagtaattttgcatatgtatttaattacatatgattttcataattggaaaagatcaataaaaatgttatgagctatattaattttataaataaatgtaaatatgtaaatctttcttttaacaaggtctcacatcaggaattttcaaaaatgaaacaatctaataatgaagctaacttaagagaagaagttttgaagaatttagctactgcatatgacaactttgttgaacttgtagctaatttgaaggaaggcacaaaggtatgaagtacatgcaaaaggaaccatagctagcaagtacagatgtgaacgcatagtttggaagttaagtggtatttccagttgaaccaaattgctctttgcctagaattttagctttaatgccattgctgctgcgaagtttgttataggagggagaaagcttaatgaaggtggcaacatttcatgggaactttgaagaatgaattgcatatttcaactggcagaaaaggggtataaatattccaggtagcaggaattagcagagatgtcaatgacacctttttaagggataggaagttgactaatttgatgaattttgaggggcaggagtagtcaaagctgatttgtgatggaaaagcggaggggcatgacttttatgttctctgcggtggtttgctgaggacagacttgtggcctgcccaagtgtcagaaggcttactgaatatgtaagtactttcttgccttgtcctttaaaaagtttagggaattcgcttatatttctttttaccaatttgtttttgagggaacagtgatttttaagttttttcagatgcataattccttttggtacttaacttcataataatcactgaataaagttaccttgatataaatacagtaggtaaaatgtaaaaccctctgaagagagggtgaaaatactgcaaagccttccaaatagagaggatagtaaaatgccattttaatttggtttaaaatgctttgtttaaataggtaagctgagaaaaccctccagagagcctttagaaattcttttaagggtttctgaagtatgcttgcatttctgtagtgaatttgaaaacctaatccttccacttaaataggtttaatgttattaaacaattgacttttctctaggaattaggaaggttttcatgatcatgaatcttttaacttgttacattttttatgataatgttctgtaaaaatgcttttattatttttattttctttaggagtcttagatcatatttaatattaagttgttgggcctagtaaattgtataaatgtatctcatgcagatctcagttcttcggctctaactatcattgacaaattagctttagatcacattactctctggattaaaaaattgttcttgttccttacttgtatttgttctttgcttatagttttacaatgagttgactgaaatcctggtcaggttccagaacaaatgcagtgatatagtttttgcacggaagacagaaagagatgaactcttaaagtaagtctgttttgtgtaccaaattgtacttaaagaattttcttttaaaaaatcatgtagagacttttggtatgaacttggtagtatgagatagcaattttcctcttctcatggaagaaggaactagatagagtattttacaaagcaacaagtaaacagctgcataatctgggaatgaaaggatgaaaagaagcagaaactctagatgcaggaagtacagtgaggtcacagaaatgataaaaacagttcaggtggcagatctcaggaagtgccagtaaatacaagcaatttattttgaagtggcaaataggttccttacataaaactagagctatagaacatggaggagacagcatgaatagctcagagaataccagcaaaatcactttcagaaggaggctgctgagaaagcagggccagttaacatacgactcatttcctgctgagtaatcaatacagagtagcacagtgctgataaaaggtggaaaacattaacaaaatttaataaaacttcatagatgaagaacatttaccaaaataatattgtcacagaataggtgaaaattatgagcaaacatctgaccatgagctaaacaaaaacaacaacaacaacaaatgtaaggaggcaatcattctaaggccggggtccccaatcctggggccttggactggtactggttcgtggcctgttaggcactgggctgcacagtaggaggtgggtggcagacaggcgggcagctgggcgagtattactgcctgagccccacctcctgtcagatcagccacagcattagattctcataggagcgcaaactctattgtgaactgcccgtgtaagggatctaggttgtgcattccttatgagactctgactaatgcctgatgatctgaggtggaacagtttcatcctgaaatcatcttccgctcccctgtggaaaaattgtcttccatgagaccggtccctggtgccaaaaaggttggggactgctcctctaaggaacactttgagcagaaattccagaactgcaggaatatggtaagaaaacaggaagtgataagatgtgaggtgtcagaattcaggaaagaagtagaagggaagaataaaaccgtgacatgggaaagagcacaaagggcgaataaacactaaagaacacacaggaacacagagtagaaatgaggaaattaaaatgaaaccaaagtcaagaaagaattagagagaaaatgggcacagaagatctaatataggcaaaactgaatttctctcagaagaaaaaccagatagaacagttatttaacgttctgtaaacagaacacttatttaatgatactcaagaacattttcttaagtgaagattgttgaaagaggatatcatatggtaggggaaaatgacaagaactgtcagcatcaaggcatataaattattggccttaaaagataatggcagaatcctttaggcagtcaggcaaaacagtcaagccagtttataaaaaggtgaaaaaaattaggctggcagctctgtatgccagaagagagtggagtgattgctgtaatctcaaggatagtaaatatgagctaaagattttatatcatatagtaaatacatgctaaagattttatatccagactgtcttttgggtacataaaaagccatatattcattagtaataaatataaagagctgaaagagtcttataccgatgaccctttcagccaactagatctttatt

SEQ ID NO: 306 - DNA, 4573 bp, Homo sapiens
actcttgtgggaggaagcacgtaattacacagatgctgaagcatagtcatggtgtctggtgtgcaggagaaagccgtggggcttagagactcatgtgtctgtcactcgttcattcagccactcacccattgccatttttggccatctgctaaggtaccaggaagtgtgttaggatccagatccccaggggtgaaacagactctagccctgctctcaagcagtttattgtcatcaaacaccgccatccaggcagggcaatcggtgctggaacccggaccaccgtgggtaccgtggcacacggtggacagagtgaccaactgccaggagtgagcagcacttggggtaggcttcctggagaatatgatgcccattctgggtcttgaagaaatgagtgggcatcttctggttgatgaaaggcatgagaaaggcttgtggggccaaagaacaacttgggtgaaaacgggaggaagtgaacgagcatgatgtattggggtcagtgctaacagttctgggatgctgatgtacaaggtggggctgggagatgaggccgggaaagtagccacaagctagagtgtaaaggtaccagggtggccgggcgcggtggctcatgcctgtaatcccagcgctttgggaggctgaggctggagtatcacttgagcccaggagtttgagaccagcctggataacatggcgaaaccctgtctctacaaaacattaaaaaaaattagccgggcgtggtggagcacacctgtggacacagctactcaggaggctgagggaggaggaccatttgactccaagagttcgaggctgcagtgagctaggatcgcggcactacactccagcctgagcaacagactgagatcctgtctcagaaaaaaagagaaaaaggtgcctgagttccaggcagagggactgaggctcttctaaggatggtgagagaggatgacagctgcgcgggggcaagggctgtgcggtgattggaggggatgggtttgaagttcactgagaaggcagaggggacagcgcccagtaggcttcccttccatatttgctcagcaagtgtttcctgaggcctcccccgaagccttgtgctgggcggtgctgggagtggagaggtgattttgatcttgccctgctctcaaggggctcccagtctggcgggaaaacaggcacagacgcagcttgaggaggacgtggcagcggtggtgccatgctgccaggggctctgcgtgcccttctcttgacggaagggtacagatcagagctgggtgttcagaatttctctccgaggcctgtgtggaaggaccaggaagagagagactgaaggtccctaggaagaattctgccaaggcggtttcaggaagagatgctgggaaatgtaggaaaaggaatacaaatcagtgagacggagaagcgctgagtgagagagacggatacgtggagagaagagggatgccggagcgggtgttaaaagagacaaatctggccgggtgctgtggctcctaatcccagcactttgggagactgaggcaggcagattgagctcaggagttccagaccagccaacatattgaaatcttgtctctaccaaaaatacaaaaattagccgggtgtggtggtgcacgcctgtagtcccggctactcaggaggctgaggtgaaaggatctcgcttgggcctgggagggtgaggctgcagtgacccgtgatggcaccactgcgctccagcctgggcgaaagagcgagactctgtctcaaaaaaaaaaaaaaaattgagagacagcaaatatttgctggaagagggagagggaactggttaggggagaatggattctagagtctgaaggccaaacagaacgagagagagagagagagagagagaaagaatgaggttgagggtaggcaggaggaagagcaagatggggagggagggggagagcaggagagaccaaactagtagagtcacagacagagaaaaagtcaaagacaggaaggtgatacagaggagagagaagaggaagaggagagactgacaggtgcacaaatcagagaagtcccagagatagcagaaacacacacagagacagagatagagagggagaggtaagccggagacagactcagagattcgcacaaaaagcaacgtggagactcagaagcaagcgcagcgtcaaggaatgctccatttctggtgtgttgttttcccagtattcaagaaatatttattgagtgccaacctgttctagacccaatctcggccaggggatgtggtggcaaatagacggacaagggcctgctctcctgaaacacactggagagataaacaataaataatatcatttcagtaaccaaaaagtgctttaaaaattaagctgaaggccgggcgcagtggctcatgcctgtaatcccagcactttgggaggccgaggctggtggatcacttgaggtcaggagttcgagaccagcctggtcaacatggtgaaacttcatctctaccaataaataaataaagtagctgggtgtgctggtgtgcctgtagtcccagctacttgggaggctgagaaagaaggatcacttgaacccaggaggcagaggttgcagtgagctgagatcgcgccactgcactccagcctgggcgacagtgagtggtaacagaatgacagagcaaggatgactttagatgaggtccttggagtagaccttgtggcagaggtcacagagatgtggattgtgagtaggaaagagaggtgagaaagtctgggggccaggcattccacccaccagaggcagccccaaagcccagaaaagtagcaggtcttcgaggaggcctgtgcggtgagcagatccaccataggacagaggcacagggtaggggctgatcagttagggccttggatccttgggaagaaatctgaattttattctagatctgatgggaagtgcttggagggttttgagcacaggcatgccatgatcatatttttattttcttatttatatttattttgaaaaagagtcttgctctgtctcaggctggagtccagtgggctgatctcggctcactgccaacctccgcctcccaagttcaagtgattctcctgcctcagcctcctgagtagctgggattacaggcatgtgccaccacgcctggctaatttttttgtatttttagtaaagacgggatttcaccgtgttggccaggccaatctgaaattcctggcttcaaatgatccacctgcctcggcctcccaaaatgctgggattacaggagtgagccactgcgcccggcctcatatttttatttaaacaagaacagcagaattacattgctgtgctgagcatacgtagacttcaggagtcaaaggggaaggaaggaggtagcgggctgttgccttcctctggttgctggaggcctggaccaaggtggagttagtgggatggaggaagtggaagaaggcatgggattttggaggctagagcctgcattggtggtgaactggatgtcatagaggagggaaggaaaaggaaccaggaagagaagaactctctgaattgggcacgcacatctctgatgggcaccgatgaggattgttaccaggaacgaggagactgggatcaggaaagtggctttgggagggaggaaccaaggcttctcttttggatgtgtcaagatagatctgccttcgagaaatccgagttgtggtatcaaatagccagttggatatgtgagactggagtttgggggaaagagaggccgtggctcaaaaacgtaagttttggaaacgtcaacataaagccacaggattgggtgacgtggcctagcaggggggtggggacagagaagcgaccctggccagagccttggggacatctacatctgggggagaaggggatgtagcaaaacgagcttaggagtgatctcgaggtaggctgaaaccaggagggttacagagggcaaatgcacctttgtgtttcaagaaggagaggagacagccagctgtgccaagggctgctgagacttggacaaggatgcagagagcagagtgaccattaggtctgatgacatggacagggttggtgatcttgataagataagatgtcagttcagtgcagtggtggggacagaagccctgctggagtggaggggagagagaatttggggggaagacagaaggaaagggaattcaggcaagtgtgtgtgtgtgtgtgtgtgtgtgtgtgtgtgtaactgacacaaaggccaggtgcgatggctcacgtgtgtaatcccagcactttgggaggccgaagtgggtggatcacttgaggtcaggagttcgagaccagcctggccaatatggtgaaaccccgtctctactaaaaatacagaaattagacaggtgcggtggtgcacacctgtaatcccagctacttgagaggctgaagcaggagaatctcttgggcccaggaggcagaggttgcagtgagccaagatcacaccactgcactctagcctgggtgacagagcaagactctgtctcaaaaaagaaaaaaggtaaaaaaaaaaaaaaatgaccctgaaaggaagtaggga

SEQ ID NO: 307 - DNA, 4668 bp, Homo sapiens
ctgaaattgcagaaaaatttgttttcttcattggcagtaaaaatggggtaatgctttctttttttcaattattgtgatgatttaacaaccattggtaaaatatctgttaatactttgattaaaatgtagatacttcaacactttaaccagatgaccaatctggtttagcatgaattaaaaagtgcttattattaatctaggaaaaactataatagtaaacaaaattttagaaaaatatatttaaactattttttatttcatgatttgaaaatattcaggtcttctaccacaattgagtgtaaaagctaggattcatgtaaatatctaagtcagtctctaaatcagtaagtcagtatcttaacaattttatattttagattgttactttacttttagaaatctcattaaaggaataattgaactgtgtcaatgatatttgttacagggttattaattattttgaaatatctggggaaaatatggcagcatttccagtggaccactgattggtaggaagggacccctccccacttgttgtaagtctctgttttacttggccaagcatacagaaaggcgtggaagtggccacacagtgtaggaacatatgcatcatatcttcatgcaactttgcctggcccacaaagttcctgccaggaaggcaaaatgactggtgacacaaaaaggtcaaggcttgccagatgcaagatgctgaaattcatgtagtgccatagctcatttctgtgtggggttcaaattcctgttcactttctgtgctccatgcttccacttaagcgcattgacaaatacgaagctttcagaaactacactctgcatcagcagggctacgtgttcactgggcaacgtcagcgcccaggcagcctgagcacccgtcttgtctccagatgagtcccagaaggccctctctgcacaaccggacaccctccattgggggttttatatacaacattaagattacatatattgggagaaatacctgtacaaccatgaaaaaggttttagtgatgtaagaatataatctgaattaaaaaagcaggacacaagtgtcatacatgacatgatcccaattatacaaatacgtaaataaaaaattctgataaaaattagaaatatggatagtaaaattctaatcacttaatgtttttattttgtttttaatttttttattttccagagttttcatattggcccactttttaaaattcaaacttaattctttaaaataaaattatcgtagagatcatttatattttaaaattttaacccaactatataagtatatattttataagcatgttatttctttttttgagacagggtctcgctctggttgcccaggctagagtgcagtggtgcgatctcagcaccctgcagccttgacttccctggctcgggtgattttacctcaagtagctgggattacaggcatgcgccaccacacccggctaattttttgtatttttaatagagatggggtttcactgcgttgcccaggctgacctcaaactcctggactcaagcaatccacccatctcagcctcctagaatgctgggattacaggcatgagtcaccgcccctggctacgcattatttcacgagtttactattatgatgcacgtgattttcatattaggcatagtacttaacagtttcctacattgtatcttactgccatgtaggtacatacatggatttaaataaatgagtaaataactagtactagtcttatggtacaaatacatttctattacagaaaacattctgtacacagaatattagatagaatggcttatactaatggtactgattactgactccatcatacaaatgcttacatacaaaatacccctaccagtatcctcttagcgctctctgtaacagttattcttgactcccttgtagtcatgataccctgttttgtcttgttttgttttgtttttttgttacttgtgaaaccacccctttttcttgatggcaatatgtggcatatacaaactgttttttgtttttagtaataaaagtaattttgtttctgatgatttgggaactcccttgatatctaaaacttttgagggtattattctttaaaaagtctgtgattctgctgagtgcagtagctcatgcttgtaatcccaggactttgggaggctgaggcagatggattgcttgagcccaggagttcgagaccaacctaggcaacgtggcaaaacccagtctccccccaaaaaaataaaacaattagccgggtgtggtggcactcacctgtatgtagtcccagctacgtggaagactgaggtgagaggatcacttgagcccagaaggttaaggctgccgtgagccatcgtgattgtgccactacactctagcctgggcaacagagggagaccttgtttcaaaaaagaaagaaaaaagtatctgattctgcttcatggagaacattattttggaagataaagagaagcgattaatgcttctattgttcaattaatagtaatcaccctttaccaaagaagcccactgccctgctgccttctctttctccttccaaccatctgttcatccattcggttgacattgatcgaacatcttttatatgctaagcatcctgctagacactgtggaaacaggaatgaaaggcattctccctgggaagcaacttgtgtatcaggacttgtacaccaacaatgacaataccatgagacaaatgctgtggtggaaaacagagagggcacttaactcaccccagaaagttgggagactaggaaagcctcctgaagagagtgatggctaaagcttgaaggtgagaagtaaggaaagagaagtaattcaggtgaagagtgtggagtattctaagatgatcaagaaaaatgtatgaaacagatattccaacaaatgggagaaagatcatactagaggaatgtaataggattttcagtcattgttgactgccattttgatgatggatgttagtttgatactaatctgcccagagtacatggtttttctccaccatcactcacttgcatgggtgcaggcatggaggaggaaggtgattacctggggcagtctttgctggttgggtacagtgcaaagtgagggagctcagggcatgaatggtatttaacagagatgattgtaatgataaactatgggctctgagatggaaaaggagaaaagtgaaggtaggaagaggctgatggagtaggagcgactgttagtggggggaagaggggtgtcaatggacatttgagacctttcactaaggtcaaagagttattactgtggggatgcctgaagaagtggttagagaatgtgttgtttgtacatgtgattttggaagcagtgcagtttccagtgaaactggaaagcttcaagatgtaaccttggaagtgaccatggcagaagcagagtgagggaaaaggcctccattgggaggcaaatgcactgagagctccggatgtcaggtggattgccaagacccatgtgggtgtgaagaagattcatgacagtagctgaaaaggtaagggagattgtgagccagaagagatgacaacaaccctggtggtaaactgatacgagcctctgaggttttttcaagaggagggaggtagagtagttgtttataggtggcactggggagcaaggaggaccctaatgtatgtagggtagtgagaataaatagcttcgtttaacaaggctgcagaggaaggggttcagggtaagtcatattttagttaaggccaacatgtggagagaatattctgaaaaggctgagatattggggagtttgccagtcatggagctgaagtcatagagtggaaggattttagaggaagggaagacagaaggggattattgggccagattaagggatgtttacagagttaggaaattcagagttccagggataatgggtcagaggagagggctggacatctggggcgattgaggcaatgggagggaagatgggattcattttgatggtctctaaatgaacttgtactaggtcaatgtttcttgaattaggaaacccacaagactacagccacatgctcaggggaccagagtgtactaatgaatttttaaattttggattgtaattttaatgataatctaaaacttgatttcagttcccagattagtttatgttaatttggaattgttaccatatagtgctatacatttatatgaaataataataaaagtgatttaaggccaggcgtggtggctcaagactgtaatcccagcactttggaaggctgaggtgggaagatcacttgaggccaggagttcaagaccagcctgaccaacatagtgaaaccccatctcaactaaaaaatacaaaaagttacctgcacgtggtggtgcatactggtaatcccagctactccggaggctgaggcctaagaatcacttgaacccagaggcagaggtttcatgagccaagatggtgccactgcactccagcctatgcaacagagggagactctgtctcaaaaaaaaaaacaaaaaaggcgagggggagtgatttaaatcaatgaatactagtgtaccatgaaaatttgaggaaattggctagatattatttaaaattccttccaattcttattctactttcttgcagagtacattactttttgggtaatgta

SEQ ID NO: 308 - DNA, 4811 bp, Homo sapiens
tgctgtctataatggattcgaaatgaaaggattgataatgattccaccaaagagactagggaagactagtattgatataatgttgtgagtctcccagagatgtccacattcaaattcccagaacctatgaatatgttacctgacatggcaagagggattttgcagatgtaattaaggttaagggccttcagatgggaggattatcctggataatctgggtggctcccactaatcacatgagtcctaaaaagaagagaatctttccaaggtgtggtcagagaaagagatgtgaggttggaagcagggtcagagaaacatgacgttgctggcttagaagatggaggcagagggccatgagccaaggaatgagggtgacctctagaaactggaaaaggcaaaaataatggactcttccctagagactccagaaaataatgcattcctccaacaatttgatttttactccagtgaggcccaggtcagacttttgattacagagctgaaagacagaaatttgtgtggtttaagacactaagtgtgtggtaatttgttacagcagcaatagaaaactaaccaaacatatatacatatgtatccactcatataaatttaacaggacagtatatattagggcaaacatacataatcaatagtgttaagtggttgtctgttttgtccgttatagacccatctcatctcatttcttgctaatttcttcttaatgtgacaagacattgaacttattgaacgttgagattccattttaaaaaatgatcaagacttgctgatctgtttaaggaactgaatttatttagactcagaggagtcatatggttgtgtggactgagcctgagacaaacataagctgcattcatttctcattgcggaactgctctggctggacgcaacagatttgcaaaatttaagccaatctctgaagtccccttcacctaaaagactcacaggttttgatgaattaatcactttcagttttcatgcttatcatcaagcatttgctccatcagcacagctcaattacaaaagctactgactgatctgaaaaacaactgggtccaccaaaggagacacagtattccttaaaatagaaagatgaggacttaagtattagagccatcccaagtctttgagcaaacggtgagcaaggtttgagttcagctagttccagaaaaatgcattccctttcattaaaactgatgcaacagctataaagaagcattatttgtgatagaaacctggagtgacagtaaacctggggatgagatacaataatacactccacagttttccaggttggttcctgctacttaattacacttaattacaatattcattagttcagtccaatttgctcagtttaagaaaaccataaaatcaccattattttgatgtgatatgtgtttattatacacaggggcagcttcagggacctgctactgcacataggatcccaattttagacaggggtcccaggcttgggttttcatgctctgctaccacagtcttgaattttttaacaattttacctgtgaatctgtgtagtccaatgcagcaatgaagcacatgtcttggctcatatgcagtcctgcctccgagtgacttcctgggataggtcctcagccacctgttctcccacccagtgattactgccaccctttattccttgtgggggccttggcacaccctggggtgggtcagggtcatttggtggggccacagatgcctgtgagggtctgcagtcactttataagtacctctatactctagaaatctaacattaaatagcaaataaaaataacctttcataggtcatagtctctcgtgacctatatgtcacgagacatatagtcactttataagtacctctttatatagtcactttataagtacctctttatatagtcactttataagtacctctatactctagaaatctaacattaaatagcaaacaaaaataacctttcataggtcacgagagactgtgtaagaaagctacagttcctttctcctgctttttgaacaagaagcctcacattttcattttgtattaggccccacaaattacgtggccaaccttacctatgtatgtgggtaagtgtgcacatgtatatatatctgaatttgtacctataaagaataaaataactttctattttagataaattgaacttacaattttataatttctaggaaaaataaatgtatatataactttactatattttatctgtaaagaggaaaataataattgtaacagtttgcatatcatgaaagaaggcatttcaataaaatattatcttctaagttttttatgactgatgaattaccttgaaaaatctttaagaatatattatatgctaaaaatggggatattctagcttcaggcattctaggacatgtcatgtctaggacatgacaatactaaaattttcttattaaagaaatctaccttacaactttgatttatcgacaggtgagagatttctggtcaggaaccaaagtcatcaaatattaagagtatgaagatacatcaaatgtgttgaagggtcttcaaaatgcaccaaataattttagtgcatttcaattattcacataattgaacaatctcaaatatcttaaattcatacctgaaaagtcataccctttgtaactaatcattctcaaaacacacctacatgaatcttgaattcttctatttataataatgcagatgaacaaaatattgctattataactttcattttgtttagctctattatttaaggaatcttcataatcaatatataattgaaaatatattcaagatttttctcttcactttataaatattaccaagatttgaggggaacaatagttacagacattccatagatgaagagatatgtatttcatatatatgtataaatacagtgaaacaaaatggactttgaaacaaatatttttgccctaaatttagacatttacaatatttctgatagctaaaacttcaaaaaaaaaaaaaaaaaaaactagacactgtcacatttgaaaaagattaagagctgccaaaactacgtgggtgcctgtaatcccagcactttgggaggccaaggtgggagggtcacttgagcccagtagtttgacaccagtctgggcattatggcaaaaccccatctctacaaaaactacaaaaattagctgggcatggtaacacacctgtagtccaagctacttgggaggctgaggtagaaggatcatatgagcccaggagttcgaggctgccattagctgtgattgcccaactgcacttgagcctgggcaacagatcaagaccctgtctatctccataaaacaacaacaacaaaaaaacataacaacctgcatgggctctttacacgccttcaaacatagctcatgatccctgtaatatcactgttattggatactaacttctaatggcctttcattattcactaacttgatcctgagcaatctgcccctctctttatcttctttatatttcttaaattgatgtgcaactctagtttcctttctccaatcctgattcccttcttcaactaatagtgagatacttccacaaacaaaacaatcacctgtaaatacccttctggttctgatctcatccctagaaattcccagggttgttgttccctgtaaataaccaagcagaactcacttagaaaatcaacctatgtaaaatcacatactcatttgtaatttaccctattttgtatacggaaagtatctcagcctatattcaaagtacaagggaagaggggctagggatgggaaggcaaaccagtcacctacgttgttcatgtactctgaaagcagatcctgaagagcctggcgaatggcgttgcattctgcgataatccgctctcggtgtaagtccctcgtacatgaagaatccgccagcagagcagccccactgataatggcttcaaggcgtttctctagtgatggtcgtatttcctcctcagttactgtgagtggattcaggacaattaaattctaagagaagaacacatttgtatggttagagctccatggcatttcacttttatgaaaaacaaatgttattttgtttttgcatttagaattcagatgtgataataaagagaactgtgttttactgcctcggctggttcacacataatgctatgtagtgattattattctgataaataatgaaagtgatgcaattatgagcttttgttctagcctcagacagacctggattcaaatcttacatttctccctcatgcaggtgtcatacacttgctgagcctcaacctcttgatctataaaagcagaatattaatgttgcgtgtgttgtaaaactgttgtaagaatgatataaatgcttaatacactgactggagcatattaactgttatttacaatagtaacttttatagactgcactgtttatacaatattttcatgtatctcatcctgacagcaccatgaggaagtaggcagcaaagtattaataactacacatttcagctgatgatgagtgaggctgaaaggctgtcttacccaaggtcatagagcaaataaacagtgacgttcagacaagtatccatgtctttcaataccagatttaatattattttcattatgcctcactttaaatcataaactttagttaactttaacactaacatatcaaagtaaattctgaattttaattatttaatttaaaacaaaactgcttcttcctgttgatctattataacttccagctatttccagctattagaacctgacacggtatttttaag

SEQ ID NO: 309 - DNA, 4850 bp, Homo sapiens
aagaggacaaggcagaaatccaggaaggaactaaggctccttaaagtgggcacagggccacgaacagggtcactcacccacactggcctcccccatggtgtatgtcttccctgagcccgtctgaccataggcaaagacagtggcattgaagccctcgaagaaggcctcaaggaggggctgaacgcaggcctggtacacggcctcctgccccgcatcctcggccagcaccacgtggaagccaaagtgtcggtcacggcccagagtgacgcggccaagccctggctccacctgcaggcagctctgatgcccgtgcagcagctccttgggcagcagtggtcgaactcgcagggcaacccgcactggggcctcctcagcccctggcagcctctgagcctccagccccatgccgagggaggactgctctgggccctgtggagagagagagaagccctggccatcagcacttgtactccaggagctggactcaccctgcaggggactcgagccagatcctgcagctcctgaccttggagggattgggggagggtggtcaaagttcacaatatccccatgtccaacctggtgctcaaaaattgcaagggccatgatatatatagtcccccacaggaacatgtcatggcttccggcactggcgaaatgaggccctaactcctgaactccagtgtttcagctgcactcttccctatggcccctatggccccatctcctagaagaacgcacacacacagcaccacaccacaccagggaactcctgtccctaacacccactgggtttaccacagtctttgtgtcaagtcactcacatcccctgccccaccttcttcaaaaaagtcaacagatccttcaagaccaagctctcaccaccaaatcctgccaattccatctcctaaatatctctcaagttcacctgctgcttcccattctgttgctaaagccctggtcctggccactgacatcgtgccaggatgactttgagcagccttccccctggcatcagtctccctgtcccctcccgcagggcaaccagggacatctttctttttcttcttgagacagggtctctctctttcacccagactggagtacagtggcatgatcactgcttactgtagccaaggcttcccaggttcaagtgatcctcccacctcagccttcagagtagccgggaccacagacatgtacctggctaattttattattagtattagtattagtattagtattagtattagtattagtattttgtagagacagtctggctatgttgcccaggctggtcttgaactcctgggctcaagggatccttccaaagtgcagtgactacaggcatcagccactgcgcctcagaggcatctctcaaaatgcaaatgcaattatttcactccctgcctaaccccaactcccccaaaaaaaggctctccactgcccttgggattcaaaatatttttgtttttgtttttgttttgttttgttttttatttgagacggagtcttgctctgttgcccaggctggactgcagtggcccgatctccgctcactgcaagctctgcctcctgggttcacaccattctcctgcctcagcctcccaagtagctgggactacaggcgcccgccaccacgcccggctaattttttgtatttttcatagagacagggtttcaccgtgttagccaggatggtctcgatctcctgacctcgtgatctgcccgcctcggcctcccaaagtgctgggattccaggcgtaagtcaccgtgcccggcctgggattcaaaatattaaggggaaaaaaaaaaaagacaagccttaaatcaggccctgcctccctggactactcacttcccacaccccaggcctttcctcgcctcctctctctgcctgcaacggctaggtgttacccaagcctcctcatccctcccggctgaggctgcagccaccttctaattcagggagccacggaagctcccctcctctgtaaccccaccacgacacgcacacaacccccagtgctgttccacccgcccgtgaccactccaactgcaggttactacccgcttctctccccgacctcccagaccaggagctggaaggcagggaccctctgggtccactttgcactttatcaccagcgcccaacacaaggtcccacgctgcccaacagatagtgatggataatcttcatccagggaactttccctgccctccctcctcctaccgcgttcctcacccccaccgccagcccggcacttcattctttacccttcaacctctctctcagcacagtaacctttcgttaattcaatcacccagcccctattgggctcccgaccctgggcacacagcggtaaactctgcctcgcaataccgtgtgggccttcgcgcacccctccgcgtgagcgttccgagcccggtgcagtcccggcttccgcgcgcccctgctctccgcacagcgctcccgctccgaaggtgctctgacaaccccgcaggcgctattcggagccggggcagggcagctggggctggaggcggcgggcgcgggacggagctccatgaaagttggaagaagtgattacaaatcgggacccgactctcgcagccttggcgctcgcccctccacgcaggcccgggatgccggcctcagcccccagatgtcgggaagacggcgccggccagtccaaggaagagcttccaggaggctggggagcaagggtgccgggctcctcatgccgggtcaggtctcccaggagtgccggctcccagggccactaggcccaggcctgcgcgaggagggagcgcgcgcctccctccacccacccggtcctcgcccctaacccgctctccggcccacactcacctgcctggctgcaagcgccgtcccgggccaggcagtcaggtttccatccccagtgcggcgcgctccgatgccgtcatcgggacccccgccccccaaaccagcccccccctcacccgcaactccgcccgccggggcgctcgggggcggaggcgcgagccggtcggcgtcgcggagtcggcccgcagacagggcgggcggggcccgtgctcaagggctgggcctggagagtgtgcagcatcctcatgatggcatcgccttattttctagaatttgtctccaaactggactccagaccatcctgtcctcagccccgagtcaccttcatccccggtctctgttttccactcccagtcccaaaccacgcctcctgcacgccactcacacagccggcagaaactttaatctccccacgtttaaaaaagttttctcagttataagactctctttttctcacattttagcattcctaaaattgagttccatcttacactcattgtcaagggaaacttggcaccaggaggggcaggagaggtgatctgggggtgtccacggcagcctcaaagagatggttggtgtcttcacctctgagacctctgatccattgtttgcactggaagcaccatgaatgggtgaattttaaaatctgaaaacatatttgtcacttaaaacgccattagaaaaagtaaactccagtgtagtttctagtgaaattttattatgtatatagaagattacctgtcatagacaggcaacataattaaaggccatagaaattgccaggctcgtcagatagatctatattaggaaaccctcagcctccagtaacagaaaccacaatttgaagtggcttgaaccataaggtcatgtgttatctcggggaacagtgaaacccagagggatgagggctcctgggcaggttgagtcagtggcaacattaccaaggaggtggcctttttaactctttttttttttttgccatcaacttcagacacaaaacgtccagaggaagaagacagcagtgtgtggtgaagcatgccctttggatcaagagcactccaagctgatttccttcccattccatgtaccacacagcttaggcctgtccacccccaaactaatcactgtcaaggggatggaactaccatgattggcttgcaataccagtgtgagacagcgtggatataggaaagtcatccacaatctccacaaccacatcctcgaagcttcatagaggagaggctggccaactgattcgtgtatcacaaaggaccatgattcaggtaccaagcatctatctgtcagatgccaggagctgtgccatttcctccaatagacaattcaattaaggagaaactaaaacctcgagcaattggaaagagcacatgaaaccccagtgttctttgacatgctgtagaatgacactgttgttcccaaatattctaaatcaattggggtcctgaacaagaacaacacagagcagcctgccgccgtgatgcccaaagagaatcattttagaccctgaaaatgtgaagaagctgaaaactgaacttggattttcatatgtgtaaaatgtaataaaaggtgatgatgattaatgaaacatcatgctttaagaggtacaattctgggccagccaaggtggctcatgcctgtaaacccatcactctaggaggctgaggcaggcagatcccttcagcccaggagtttgagaccaacctgggcaatagggcaaagctgtttccacaaaaaatgcaaaacataggcaggcgtagtggcatgggcctatagtcccagctacttgggaggttgaagtaggaagatacactggcttgagcctgggaggtggaggttgcagtgagccgagatggtgccactgcactccaacctgtgtgagagagtgagaccctgtctcaaaaaaaaaaaaaaaaaaagagagagagacagaggtacaattctaattacaattatagtaattaa

SEQ ID NO: 310 - DNA, 5846 bp, Homo sapiens
ctccaacaccaacacgctcaacaggaaaaccacgcctgtgtaggggcgcggcgggggagccgaggggcgtgtccggggcgcgtgcgcgggcgcgcgtgcatcgaggctgccggggtcgggggcgcccccgctttcccccgtgagcgcgctggagactgctgggcccgccccacgcccaccctccccgcccccctccccctccgaagcagggaccccgagggagggggcaggggagggagggggccgctgtgagggagcgtcgtgttttatttttttgggggatctatggggaggggggagggccatggtgttttttgcagtttcgagatgttttctttttcatgttttgctgtgtgcatggggggcggggcggggggaggggagggagggactcccagcccagcccaactcctggagaggggcccataatacacgaatacatagttacacccacaaactatatatatgccctatataaagagacacagcgaagggatgcagaaaggcagaaagaagggttggacgcgggcattcattcatttttttcattcattattccacaagggcttattaagcacctactgtgtaccaggcactggtacataagaaggcattggagcaggggacacgaacgaggcacagaaagggccttctcattcattcattcattaccggcaatttatttgtgcgccttaaaaagctaggcattgtgctccgtgctcagcgtgcaggaggcaggaaaacagccaggggccccgacgtctcatagagtaaacatcttgtgcatgagacaggcattaatcgatcatgtacatacacaataaattacagttaggctataggagaaacgagatgctatgaaatgctccatcaggggagcctaacccagttgtgaggaagagatttcagtggacagtgaaaggatgagaagaagccagcagggcggagctggggcaggagtgtggcaggcagagcagcacgtgcaaaggccccggggcaggaaggagcttgcagcgagggctgaagggtagtgaggcaggtgagcggggatcaaggtgaggccggagacacagacagggccagattgtgcaggggctcgtaggtcaggagttcagattttattctaggagtggtgagggccgtggaacgggtttaagcaggacgctaacgtgaatggtgtacaaagggaagacaggaactcggaggcaagagtaggaggcagagatgtgctgaaatacagcatcaaacatgggcacgggcccttggagctcacactcttgtgggaggaagcacgtaattacacagatgctgaagcatagtcatggtgtctggtgtgcaggagaaagccgtggggcttagagactcatgtgtctgtcactcgttcattcagccactcacccattgccatttttggccatctgctaaggtaccaggaagtgtgttaggatccagatccccaggggtgaaacagactctagccctgctctcaagcagtttattgtcatcaaacaccgccatccaggcagggcaatcggtgctggaacccggaccaccgtgggtaccgtggcacacggtggacagagtgaccaactgccaggagtgagcagcacttggggtaggcttcctggagaatatgatgcccattctgggtcttgaagaaatgagtgggcatcttctggttgatgaaaggcatgagaaaggcttgtggggccaaagaacaacttgggtgaaaacgggaggaagtgaacgagcatgatgtattggggtcagtgctaacagttctgggatgctgatgtacaaggtggggctgggagatgaggccgggaaagtagccacaagctagagtgtaaaggtaccagggtggccgggcgcggtggctcatgcctgtaatcccagcgctttgggaggctgaggctggagtatcacttgagcccaggagtttgagaccagcctggataacatggcgaaaccctgtctctacaaaacattaaaaaaaattagccgggcgtggtggagcacacctgtggacacagctactcaggaggctgagggaggaggaccatttgactccaagagttcgaggctgcagtgagctaggatcgcggcactacactccagcctgagcaacagactgagatcctgtctcagaaaaaaagagaaaaaggtgcctgagttccaggcagagggactgaggctcttctaaggatggtgagagaggatgacagctgcgcgggggcaagggctgtgcggtgattggaggggatgggtttgaagttcactgagaaggcagaggggacagcgcccagtaggcttcccttccatatttgctcagcaagtgtttcctgaggcctcccccgaagccttgtgctgggcggtgctgggagtggagaggtgattttgatcttgccctgctctcaaggggctcccagtctggcgggaaaacaggcacagacgcagcttgaggaggacgtggcagcggtggtgccatgctgccaggggctctgcgtgcccttctcttgacggaagggtacagatcagagctgggtgttcagaatttctctccgaggcctgtgtggaaggaccaggaagagagagactgaaggtccctaggaagaattctgccaaggcggtttcaggaagagatgctgggaaatgtaggaaaaggaatacaaatcagtgagacggagaagcgctgagtgagagagacggatacgtggagagaagagggatgccggagcgggtgttaaaagagacaaatctggccgggtgctgtggctcctaatcccagcactttgggagactgaggcaggcagattgagctcaggagttccagaccagccaacatattgaaatcttgtctctaccaaaaatacaaaaattagccgggtgtggtggtgcacgcctgtagtcccggctactcaggaggctgaggtgaaaggatctcgcttgggcctgggagggtgaggctgcagtgacccgtgatggcaccactgcgctccagcctgggcgaaagagcgagactctgtctcaaaaaaaaaaaaaaaattgagagacagcaaatatttgctggaagagggagagggaactggttaggggagaatggattctagagtctgaaggccaaacagaacgagagagagagagagagagagagaaagaatgaggttgagggtaggcaggaggaagagcaagatggggagggagggggagagcaggagagaccaaactagtagagtcacagacagagaaaaagtcaaagacaggaaggtgatacagaggagagagaagaggaagaggagagactgacaggtgcacaaatcagagaagtcccagagatagcagaaacacacacagagacagagatagagagggagaggtaagccggagacagactcagagattcgcacaaaaagcaacgtggagactcagaagcaagcgcagcgtcaaggaatgctccatttctggtgtgttgttttcccagtattcaagaaatatttattgagtgccaacctgttctagacccaatctcggccaggggatgtggtggcaaatagacggacaagggcctgctctcctgaaacacactggagagataaacaataaataatatcatttcagtaaccaaaaagtgctttaaaaattaagctgaaggccgggcgcagtggctcatgcctgtaatcccagcactttgggaggccgaggctggtggatcacttgaggtcaggagttcgagaccagcctggtcaacatggtgaaacttcatctctaccaataaataaataaagtagctgggtgtgctggtgtgcctgtagtcccagctacttgggaggctgagaaagaaggatcacttgaacccaggaggcagaggttgcagtgagctgagatcgcgccactgcactccagcctgggcgacagtgagtggtaacagaatgacagagcaaggatgactttagatgaggtccttggagtagaccttgtggcagaggtcacagagatgtggattgtgagtaggaaagagaggtgagaaagtctgggggccaggcattccacccaccagaggcagccccaaagcccagaaaagtagcaggtcttcgaggaggcctgtgcggtgagcagatccaccataggacagaggcacagggtaggggctgatcagttagggccttggatccttgggaagaaatctgaattttattctagatctgatgggaagtgcttggagggttttgagcacaggcatgccatgatcatatttttattttcttatttatatttattttgaaaaagagtcttgctctgtctcaggctggagtccagtgggctgatctcggctcactgccaacctccgcctcccaagttcaagtgattctcctgcctcagcctcctgagtagctgggattacaggcatgtgccaccacgcctggctaatttttttgtatttttagtaaagacgggatttcaccgtgttggccaggccaatctgaaattcctggcttcaaatgatccacctgcctcggcctcccaaaatgctgggattacaggagtgagccactgcgcccggcctcatatttttatttaaacaagaacagcagaattacattgctgtgctgagcatacgtagacttcaggagtcaaaggggaaggaaggaggtagcgggctgttgccttcctctggttgctggaggcctggaccaaggtggagttagtgggatggaggaagtggaagaaggcatgggattttggaggctagagcctgcattggtggtgaactggatgtcatagaggagggaaggaaaaggaaccaggaagagaagaactctctgaattgggcacgcacatctctgatgggcaccgatgaggattgttaccaggaacgaggagactgggatcaggaaagtggctttgggagggaggaaccaaggcttctcttttggatgtgtcaagatagatctgccttcgagaaatccgagttgtggtatcaaatagccagttggatatgtgagactggagtttgggggaaagagaggccgtggctcaaaaacgtaagttttggaaacgtcaacataaagccacaggattgggtgacgtggcctagcaggggggtggggacagagaagcgaccctggccagagccttggggacatctacatctgggggagaaggggatgtagcaaaacgagcttaggagtgatctcgaggtaggctgaaaccaggagggttacagagggcaaatgcacctttgtgtttcaagaaggagaggagacagccagctgtgccaagggctgctgagacttggacaaggatgcagagagcagagtgaccattaggtctgatgacatggacagggttggtgatcttgataagataagatgtcagttcagtgcagtggtggggacagaagccctgctggagtggaggggagagagaatttggggggaagacagaaggaaagggaattcaggcaagtgtgtgtgtgtgtgtgtgtgtgtgtgtgtgtgtaactgacacaaaggccaggtgcgatggctcacgtgtgtaatcccagcactttgggaggccgaagtgggtggatcacttgaggtcaggagttcgagaccagcctggccaatatggtgaaaccccgtctctactaaaaatacagaaattagacaggtgcggtggtgcacacctgtaatcccagctacttgagaggctgaagcaggagaatctcttgggcccaggaggcagaggttgcagtgagccaagatcacaccactgcactctagcctgggtgacagagcaagactctgtctcaaaaaagaaaaaaggtaaaaaaaaaaaaaaatgaccctgaaaggaagtaggga

SEQ ID NO: 311 - DNA, 6006 bp, Homo sapiens
tgttgttgttttttgttaccaaaaaccaaaagttcgtttgaaaagtcatctttgaagccagaagttttttcgaaacacttcctgccgttgcacagaaccctaatgagcagtatttctgcttcttgacaaagtcatggattctaaaggttgccttaccatgtgacggtcattctccaggaatctgcagcatagctgaggtttttcacaaagatggttttaaaaccttgcttacaagggtgattgaccttgccttactctttatgtaaattatggcattttgttattaaactacgattgggtcccactgctggtaaatcagtatgagtaactagatttttaagtgtttatagttagaaacttgagaaagtaaaagcaggagtaagatacaaattttctttctggtatcacctcttctttttttattaatcacagacctcgaatgacaggaaggggtcatatctagttttttatcagactctgataaacatctgcctagatgggatatccttgtacttttcactaaatccaaagcttgagttttgccaggaaggaaaacaaaagtttaagatctccaaaagggatttctggatgttagatattgtttcaacaggtattgttgtcccatacagcaagtacagaccagcaatttacaaaattagaggtaaatttatagaaattattaggctcacattataagtaagattttcagagatagaattttaatatctctgaatatgagggagaaaaatagcttagtgagagaccaaaaacaaaaaaaaaacaaaaaaaactgttttagagaccaaaaaaagcaaaacaaaacaaaaaatccttagcctaaagtttggagagctacattactaactgtttgatttgaatatttgagctactagtgaatctcagctcataccatttgaattaagtaatgatgatgtaatgaaggcaaactgatggctgctccacaaacttcccccagggctaagcatacttgccttatgtagtaacaaagttggatcatatttaattctcaaataatagaaatattctttgattgcacaatagtagatagagccagctacttgccataactaagttaaggtgtggtgtttttactagttaggttttttttttttttttttttttggttgcttcagtgagagggcgaggtagtgaagaaattatgacgaatctctatgcttgaaagctgtggcaagtatgataggctagaattatcaaatgttttctacacatgtagctaagcagattcagctgaactcttcaggttaagaaccactgtgatcctcagatacacaaatctgttcttacggcattgaaggaatctggctttaaaatacagatgcagtttagtgcagtttttgtgttagacaattgccatctcttaactcacacgtactttaggactgctgctcaaaacataactgaaatatactaaaatcttgaagtctttgataacactttacagagatcttaataaatgcatactcaagatatagcaagagatgtctctgatcttccttttaatgctcagtgtaggtaaagtagtatttggtttactattatatgcttattgcttattagtcactatagcatttttcaggcaaattgaaagactggtctaggttaaatcttaaaaaaacaagtttgtccatttaggtctagtatactttagccttcatgtattgactgagtgatttgctttttaggatcaacattttttaataaaaatctgaatgagtaactctcctttgggccaaaggacaaattgggaacagtctgctctgaagttcatataaataatatttacccaagcataaaatgtgtgcttggaagatataaactatataatttatgcctaaacttattttacattgttttgattcccatccaaaatagaatgtggatcctgattgccttgctgcatcttatactttgtcgattagtatacctagtaatatccctttgtcttttttttcacaactctcctatcatctttcatgagcacgagtaaaaggaaatacttgaaatttacagatgattcacaaaaaaaaaaaaaaaaaagcaacagtcactaaagtttaacaactctttgttaacttctaggtttctaactgttcttttactcatttgtcaccccactctcttttctaaattaaagatatagtccaaaggaatagtttattaccatgtaattatcttgaaatcttactttttcaatttcctaatttaagactgtcatatcttgttgcttagtcttttcatattcaataattaaaatatataaaaatggaagtggttggtaatgtgtgcactgcatttgaaattggagtctgaatcatttcaatgcatatagtctttctgcagaatagcgattttgaacagttggcatatcatgtaagtttttataaatgtcagcattatgagccaatgaactatataatggtcagatttacatcacaataaaatatgagcataatagtagggtttcatatgtgaccatttgttacagtaaaatttagacctttggactattacagtacagcttcagttaaaccatatgaggagtcatcacaaaacaaaccttaaatttatgcattcacgtttgaccattgttttattcttcttccattattccctaaaacaatatataaaattatattgcattgtagagtttggagaaggaagaattttatattttggggtatctttgcatctgtgcagagaaaatgtgtcaataaaatgtagataaagcctgttgctcatgtgtttcaagaagaaagtgtctttatcatagaacagagtgatacatcttagatgtgcattgattgccaatcatttttccttcacactgtagtcagtaactaagtcaaggcaactgcaagatagttcagaaaggctagcatcccacttctataggtgtgtgggagtcagaagacctggattctagtcctgtcttctttagtcagtgccactataatcctggccaagcatccattttcctgttgttacatctgtcagatgaaaagaagggtctttcctatgccaaagattagtacaatagcagatagtaagagaacgctttgcaaagtcctatataatgtacaaagcagatttttcccaaagtgtttgacataaattattttaaaagtacaatgacatttgaagaaccctggaattgattcttcttgtaacaacacaaccagttgtgccttttgttctgaaacagattttcatgtatctactacttacaggggtgaaatcttgcatattgagtcagaagtgggtatgggctagagatatgaaggagagatgagttgagaacatgaactactttatctcatgtccagccctaatctatttgactagcatgttacccactgcacttatctccttcctgcaggcttcatttcttctattcttgtctcttcttcctctacttccagctttatgttttcctttagtgcctctcttctcttagactaaggggagacgagtcggaataaatgacagactttgtagctttaaatattgtcatattggtttttatggagaatatgttgtacagaacataaaactaattcattatgtacttaaaccaaattatcagacacatctgctctatgggtcatggtctgtatggatagccttaatcacaccaggttatattgctgtggaatggaagacatttgttcatagtgttgctcttggggtaaaaggggttatacctaaatgtagactctgtctgaattacaagtttttaattttttcttatatttatgtctagggcaggagcgatttggcaacatgacccgagtatactacaaggaagctgttggtgcttttgtagtctttgatatatcaagaagttccacatttgaggcagtcttaaaatggaaaagtgatctggatagtaaagttcatcttccaaatggcagccctatccctgctgtcctcttggctaacaaatgtgaccagaacaaggacagtagccagagtccttcccaggtggaccaattctgcaaagaacatggctttgccggatggtttgaaacctctgcaaaggtgagatctgctttgcttatgcatcttttgctttctagctcataattctgagctgtaaatgtaaagtatttagatatatttatgtgagtggtgtttgaaagtctggaaaatgagaagtgtagcatggatgtgttatagcttctttcagtccacaacaggactgctttccaaattggctaatggctaatagaagggcagattttccatcaaaacaaaaagaattatttagggcaaaaagcaaatgacattttctgtgagtttgagtttttaactgaggtacttctcatgcaactagagtggttgggggtattgtcaagcacgagaatttttggtttttacaaaaggctaagtgaataggaagatgcctctggtgaagatgtgtgtcacatgcaggaccatgtgaaaagatcagagaggagatttattcagatgatgtttgaagagttttaggttaactgtgtacgaaagatttgaaacagccagaaagtatcaacatttgtggtatgcttcataaacagtagagtgagaattttttcttttgtctattatggaaagctgaataaaatattttctgaaggaaaaaataaaacactcagttgactttcaaaaatcttaacagtctagtgaccaggcacggtggctcatgcctgtaatcctagcagtctgggaggccgaggcagatggatcgggcagatcgcttgaactgggagttcgagaccagcctgggcaacgtggcgaaaccctgtctctgccaaaaatacacaaagtagctgagcatggtggtgcatgcctgtggtcctagcttctcgggaggctaaggcaggaggatcacttgagtctgggaggcagaggttgcagtgagccgagatcatgccactgcactccagcctgggtgacaaagtgagaccccatctcaaaaaaaaaaaaatcttaatagtctagatatagaaaaaaggtgaaaattatacatatataaaatgtttggggggggggttacgtgcattggaactttcacataagggggttagtgacaatcagatttatgtaagaatgatgaaatgtttgaaaaattctgtgatgacagataaacattataccataaatttgttgaaatcataacacagttctagcttttagtttatgttctgtggatttcttgtgtgtgtttacgggtgtttttatatatgtatgtatgtatgattgttcctccaaatcacccacctcattctggatatttactaatcagattaggtttagctctactagaaacttacccttagagtgaaaaactacttgatgccaatgatgatctgcgggataaaagcgaagcaatgagagactgcacaaaaggagaccgctccaaaaatattgcgcaatgatggagtcactgggaaaaaaaagactgtctactgcaggcagaaatgtacactcctaagctagaggctaattgtttgaataaatatagcatcttaaaatttcctttcataaataaaacatagtgatagaagaaagatgaagcccaggagtgctatgtgagcacttaatctgacacgaaggagaaaatcacagaaagaaagccttcttatagagaagtcacctcattctcccaagaagctaggaccacaggcatgtgccaccatgcccagctactttttgcatttttagtagagacagaattttgccgtgttgcccaggctggactcaaactcctgagctggagtgatctgcctgcctcagcctcccaaagcactaggattacaggcgtgttcttctggacactcatgccctctgtctgctctgtatgcctattgggtgatttgctctacttgccagctttgctgtaaaaagacgaaaaaaaaaaaaggggcagtaagtataactgcttatgcgagtgtgcattttggtggaggagttttataaatgata

SEQ ID NO: 312 - DNA, 6379 bp, Homo sapiens
cccactgtaaacactctgtgtaaatactgttacatgataaatatcagaagcgacatttcatcaatatgacagtatgtaaacctgtgtaaacactttggtatgacatatatcagagatgatatttcatcaatatcacagtgtgtaaacactctgtgtaaacactgtgatgtgacaaatatcagaagcgatacttcatcaatatcatatgtgtaaaccctctgtaaacaccatgataggacaaacatcagaagcgatatttcatcaatatcataatgtgtaaaccccctgtaatcactgtgatatgataaatatcaaaagcgatatttcatccatatcacagtgtgtataccccctctgtcaacactgtgatatgatgaatatgagaagcgatatttcatcaatatcacagtgtgtgaaagctctgtgtgagcactgtgatatgataattatcagaagtgatatttcatcaatactactgtgtgtaaacactgtgatatgataaatatcagaagggatatttcattaatatcacagtgtgcaaatattgtgatatggtaaatatctgaagcgatatttcattaatatcacagtatgtaaacactgtgatttgataaatatgagaagagatatttcattaatatcaccctgtgaaaacactttgatatgataaatattagaagtgttatttcattaatatcacagtctgtaaacgctctgtgtaaacactgtgatttgataaatatcagaagcgatatttcattaatatcacactgtgtaaacactctgtgtaaacactttgatacgataaatatcagaagcgttatttcattaatatcacagtgtgtaaacactgcgatatgataaatttcagaagcggtatttcattaatatcacggtgtgtaaactctgtaatatgataaatatcagaagcgatataccgttaatatcacagtgtgtaaacactctgtgtaaatgccgtgatataaaaaatatcagaagtgatatttcatttatatcacactgtgtaaacactgtgatatatcagcagcgatatttcatgaatatcactgtgtgtgaatggtctgtgtaaacactgtgatatgatatcagaagcgatatatcattaatatcaaagtgtgtaaacactgtgtaaacactatgatatgataaatagcgatatttcattaataacagtgtgtaaacactgtgtaaacacagtgatatgaaaaatattagaagcgatatttcattaatatcacagtgtgtaaatactctgtgtaaacaccatgatatgaaaaatatcagaaggggtatttcattaatatcacagtgtgtaaactgagaaatatcagaaccgatatttcattaatatcacagtgtgtaaacactggatattatacatcttacagtgatattttattcatatcacagtgcggaaacactggatattatacatatcacagggacatttcatttgtatctctatgtataaacagtggatattataaatatcatcgatatttcatttatagccctatgtggaaacactggatattatatatatcacagctatatctcatttatatctctgtgtggaaacgctggatattataaatatcacagcaggatttcaactttattcctgtgtgggaacagtggatattataaatatcacagcgatatttcatttatatccctttgtggaaacactggatattttagtatttcattcatatccctatgtggaaacactggatattttaatacttcattcatatccctgtttggaaacactggatattttaatatttcattcatagcacagtgcggaaacactgcgtaatataatatttcattcatatccctgtgtggaaacactgaatattataatacttcattcgtagcatagtgtggaaacactggatattataatatttgattcatagcacagtgtggaaacactgaatattatttcattcatagcacagtttggaaacactgcatagtataatatttcattcattgcacagtttggaaacaccggatattataatatttcattcatagcacggtatgaaaacactggatagtataatatttcattcatagcacagtgtggaaacactggatactatatttcatacatagcacagtgtggaaacactgtatattataaatgtaacagcgatatttcattaatatcacagtgtgaaacactggatgtcagtagtgatatcgatgatgttacaaacataacacagtgtgttaacactgcattatcaccctggatgtcagtagtaatatcatggatattatgaataatatcacagggtgctaacacagtgtgttcacaccctggatatcagtagtaacatcatagacattatgaataatatcacagggtgttaacacaatgtgttaacatcttgggtatcagtagtggatcagtatcaggatatcatcctggatatcacagggtgatattattcataatatcatggatattaattgtattaacaccctggatatcaatagtaatacactggatattatgaataatatcaccgtgtgttaacaacagtggatatcagtagtaatattgtggatattaggaataatatcacagtgtgttaacacagtgtgtcaacactggatattagtgatatcatgaaaaatatcacagtgtgttaacactggacattagtagtaatatcatgaatattctgagtaatataacagtgtgttaacactggatattagtattaatatctaatgtgtgttagtaataatatcacagatactatgaatagtatcacagtgtgttaacatagtgtgttaacactggatatcagcattaatatcatggatattatgaataatatggtatgataacacagtgtgctaacaaacactggatattatgaatatcatagataatattaatatcacagtgtgctaacactggacactatgaagatcatagatattaatatcacattttgctaacacagtgtgctaacactggatattatgaatatcatataaattattaatatcacaatgtgctaacactgtgttaacactggatattattatcacggtgtgctaacactggatattattaatatcattgatattaacacaacacagggtgcaaacactggatattattattagcaagtcacagggtgctaatactagattttattaatatcatattattattaacacatcacagggtgctaacacttgatattattaatatcatagacattattaacacaacacagggtgctaacactggatatttttagtatcatagatattattaacattgcagtgtgccaacattggaaattattaatgtcacaaatattggtaatagcacagtgtgctaacactggatattattaatatcacagatattagtaatatcacagtgtgttaatacagtgtgctaacactggatatcactaatatgatagataatatagatattagtaatatcacagtgtgttaacagtgtgctaacgctggatattattaatgtcacaaatattagtaatatcacagtgtgctaacactgaatactatgaatatcatagatgttagtaataccacagtgtgctaacactgaatatcattaacattacagatattagtaatatcacagtgtgctactattaatataataatgttaatactattgacactatattagtaatataatagtgttaacactgttattaatatgagagttaatactactaacactatatttttaatatgatagtgttaacactacattactaatatgtgttaacactatattattaatataataatgttaatactattaacactatattattaatataatggtgttagcactatattattaatataatagtgttaacactatattattattattatttgagacagagtcttgctctgtcgcccaggctggagtgcagtggtgccatctctgctcactgcaagctccgcctcccaggttcacaccattctcctgcctcagtctcccgagtaactgggactacaggcgcccccaccacgcccggctaattttttgtattttttagtagagacggggtttcaccgtgttagacaggatggtctcgatcttctgacctcgtgatccgcctgccttggcctcccaaaggactgggattacaggcgtgagccaccgcgcccggcctaacactatattatgaaacactatattattattatagtgtagatactattacattattaatagtgttaacactattatcattaatataatagtgttaatactattaacactttattattattaattataatattaatatacgagtgttattaattattaatataattataatactgttaacactatattattaacaattattattaatataatagtgttattaatataatatgtgttaacactataatagtgttaacactatattatattgttaatattatagtgttaacactattatatgattaatagtgttaatcatgtattattaatatagcagtgttaatagtaaccctatattattaatacaatagtgttaatgctattaacgctatattattaatataagtgttaacactcaacactatattactaatataatagtgttaatagtatatcattaatataatagtgttaatactattaacaccatattattaatactattattattcccattttacagattagaagcccaggacccaggaaggagacacaggaaatttattcaaagtccccacgctggtaatggcagagctaggatttgaattcagatccctcccgctctctgttcctccgcccccacacacccgtgagcgaagccggtactgtgggcagacgccagggcctggtttccccaccctccacccgccaggtttgcggtggccggggcggcaggtagggaggtgagcccgcgtctcctccgcagagctggagctggagctccgctcagaggcccaggctcagtgggctcctcccccgggtcggggcaaccccccgccggggcctctggggccaacggaagctccaggagcgcggtggagcctggagtggagggcgagggtcccaccgtgacccgcctggagggcagcccagctctgggacgcgaaaccgcctacgacggtgccgcaggtggagggaagggtagaggggagaccagtatgggggagagcaaggtggccccacaggttgggagaggatgtggggaagtccccctacccacccaaggccgaacatcgcctaactggctgtgggacgcccggggcaggggctgggggcggatggcctggttagggcccagcttggggtcttgaaaatatccctatggctttggggccacagaagggcggagtcctggcattcaggggaaagggccgaggacggttgtcaacgggaaggaacctctgaccctaccctgggtcaatgtgcagtccaagttgccacaaatgaccggaggaaacagtgggaagggaaggtctctttcccattccaaaccaggatgcccttcaggtcgcccacttccttcatccccagagcagctgccgactttcctgttaagtgccagggcctgggaggtgcggggctgcagctcaggcgctgaagggggcctagggtccaggaacctcctgccaagccagtggtcctcagacgctggtccaggcaccaccacggggtacacagcttttcttacctcctggtgttatgggtcctttctgttttttgagacggagtctcgctgtggctgtgtcgcccaggctggagtgcagtggcacgatctcgcctcactgcaagctccgcctcccgggttcacgccattctcctgcctcagcctcctgagtagctgggactacaggcgcccccaccacgcctggctaatttttttttttttttttttttttgtatttttagtagagacggggtttcaccgtgttagctaggatggtctcgatctcctgatctcgtgatccacctgcctcggcctcccaaagtgctgggattacaggcgtgagccaccgcacccggcccatgggtcctttaaaaaataataatttggccagacgtggggcctcatgcctgtaatttcagcactttgggaggtaaaggtgggaggatcacttgagcccaggggttgcctgggcaacatagcaagaccccatctcaaaaaaaaaattagccaggtgtaatggcatacacctgtagtcccagctactcgggaggctgaggcaggaggatcgcttgtgcccaggaggcatgaatgcaccactgcactccagcctgggtgacacaagaccctgtctcaaaaaagaacaacaacaaaaattt

SEQ ID NO: 313 - DNA, 8460 bp, Homo sapiens
cccactgtaaacactctgtgtaaatactgttacatgataaatatcagaagcgacatttcatcaatatgacagtatgtaaacctgtgtaaacactttggtatgacatatatcagagatgatatttcatcaatatcacagtgtgtaaacactctgtgtaaacactgtgatgtgacaaatatcagaagcgatacttcatcaatatcatatgtgtaaaccctctgtaaacaccatgataggacaaacatcagaagcgatatttcatcaatatcataatgtgtaaaccccctgtaatcactgtgatatgataaatatcaaaagcgatatttcatccatatcacagtgtgtataccccctctgtcaacactgtgatatgatgaatatgagaagcgatatttcatcaatatcacagtgtgtgaaagctctgtgtgagcactgtgatatgataattatcagaagtgatatttcatcaatactactgtgtgtaaacactgtgatatgataaatatcagaagggatatttcattaatatcacagtgtgcaaatattgtgatatggtaaatatctgaagcgatatttcattaatatcacagtatgtaaacactgtgatttgataaatatgagaagagatatttcattaatatcaccctgtgaaaacactttgatatgataaatattagaagtgttatttcattaatatcacagtctgtaaacgctctgtgtaaacactgtgatttgataaatatcagaagcgatatttcattaatatcacactgtgtaaacactctgtgtaaacactttgatacgataaatatcagaagcgttatttcattaatatcacagtgtgtaaacactgcgatatgataaatttcagaagcggtatttcattaatatcacggtgtgtaaactctgtaatatgataaatatcagaagcgatataccgttaatatcacagtgtgtaaacactctgtgtaaatgccgtgatataaaaaatatcagaagtgatatttcatttatatcacactgtgtaaacactgtgatatatcagcagcgatatttcatgaatatcactgtgtgtgaatggtctgtgtaaacactgtgatatgatatcagaagcgatatatcattaatatcaaagtgtgtaaacactgtgtaaacactatgatatgataaatagcgatatttcattaataacagtgtgtaaacactgtgtaaacacagtgatatgaaaaatattagaagcgatatttcattaatatcacagtgtgtaaatactctgtgtaaacaccatgatatgaaaaatatcagaaggggtatttcattaatatcacagtgtgtaaactgagaaatatcagaaccgatatttcattaatatcacagtgtgtaaacactggatattatacatcttacagtgatattttattcatatcacagtgcggaaacactggatattatacatatcacagggacatttcatttgtatctctatgtataaacagtggatattataaatatcatcgatatttcatttatagccctatgtggaaacactggatattatatatatcacagctatatctcatttatatctctgtgtggaaacgctggatattataaatatcacagcaggatttcaactttattcctgtgtgggaacagtggatattataaatatcacagcgatatttcatttatatccctttgtggaaacactggatattttagtatttcattcatatccctatgtggaaacactggatattttaatacttcattcatatccctgtttggaaacactggatattttaatatttcattcatagcacagtgcggaaacactgcgtaatataatatttcattcatatccctgtgtggaaacactgaatattataatacttcattcgtagcatagtgtggaaacactggatattataatatttgattcatagcacagtgtggaaacactgaatattatttcattcatagcacagtttggaaacactgcatagtataatatttcattcattgcacagtttggaaacaccggatattataatatttcattcatagcacggtatgaaaacactggatagtataatatttcattcatagcacagtgtggaaacactggatactatatttcatacatagcacagtgtggaaacactgtatattataaatgtaacagcgatatttcattaatatcacagtgtgaaacactggatgtcagtagtgatatcgatgatgttacaaacataacacagtgtgttaacactgcattatcaccctggatgtcagtagtaatatcatggatattatgaataatatcacagggtgctaacacagtgtgttcacaccctggatatcagtagtaacatcatagacattatgaataatatcacagggtgttaacacaatgtgttaacatcttgggtatcagtagtggatcagtatcaggatatcatcctggatatcacagggtgatattattcataatatcatggatattaattgtattaacaccctggatatcaatagtaatacactggatattatgaataatatcaccgtgtgttaacaacagtggatatcagtagtaatattgtggatattaggaataatatcacagtgtgttaacacagtgtgtcaacactggatattagtgatatcatgaaaaatatcacagtgtgttaacactggacattagtagtaatatcatgaatattctgagtaatataacagtgtgttaacactggatattagtattaatatctaatgtgtgttagtaataatatcacagatactatgaatagtatcacagtgtgttaacatagtgtgttaacactggatatcagcattaatatcatggatattatgaataatatggtatgataacacagtgtgctaacaaacactggatattatgaatatcatagataatattaatatcacagtgtgctaacactggacactatgaagatcatagatattaatatcacattttgctaacacagtgtgctaacactggatattatgaatatcatataaattattaatatcacaatgtgctaacactgtgttaacactggatattattatcacggtgtgctaacactggatattattaatatcattgatattaacacaacacagggtgcaaacactggatattattattagcaagtcacagggtgctaatactagattttattaatatcatattattattaacacatcacagggtgctaacacttgatattattaatatcatagacattattaacacaacacagggtgctaacactggatatttttagtatcatagatattattaacattgcagtgtgccaacattggaaattattaatgtcacaaatattggtaatagcacagtgtgctaacactggatattattaatatcacagatattagtaatatcacagtgtgttaatacagtgtgctaacactggatatcactaatatgatagataatatagatattagtaatatcacagtgtgttaacagtgtgctaacgctggatattattaatgtcacaaatattagtaatatcacagtgtgctaacactgaatactatgaatatcatagatgttagtaataccacagtgtgctaacactgaatatcattaacattacagatattagtaatatcacagtgtgctactattaatataataatgttaatactattgacactatattagtaatataatagtgttaacactgttattaatatgagagttaatactactaacactatatttttaatatgatagtgttaacactacattactaatatgtgttaacactatattattaatataataatgttaatactattaacactatattattaatataatggtgttagcactatattattaatataatagtgttaacactatattattattattatttgagacagagtcttgctctgtcgcccaggctggagtgcagtggtgccatctctgctcactgcaagctccgcctcccaggttcacaccattctcctgcctcagtctcccgagtaactgggactacaggcgcccccaccacgcccggctaattttttgtattttttagtagagacggggtttcaccgtgttagacaggatggtctcgatcttctgacctcgtgatccgcctgccttggcctcccaaaggactgggattacaggcgtgagccaccgcgcccggcctaacactatattatgaaacactatattattattatagtgtagatactattacattattaatagtgttaacactattatcattaatataatagtgttaatactattaacactttattattattaattataatattaatatacgagtgttattaattattaatataattataatactgttaacactatattattaacaattattattaatataatagtgttattaatataatatgtgttaacactataatagtgttaacactatattatattgttaatattatagtgttaacactattatatgattaatagtgttaatcatgtattattaatatagcagtgttaatagtaaccctatattattaatacaatagtgttaatgctattaacgctatattattaatataagtgttaacactcaacactatattactaatataatagtgttaatagtatatcattaatataatagtgttaatactattaacaccatattattaatactattattattcccattttacagattagaagcccaggacccaggaaggagacacaggaaatttattcaaagtccccacgctggtaatggcagagctaggatttgaattcagatccctcccgctctctgttcctccgcccccacacacccgtgagcgaagccggtactgtgggcagacgccagggcctggtttccccaccctccacccgccaggtttgcggtggccggggcggcaggtagggaggtgagcccgcgtctcctccgcagagctggagctggagctccgctcagaggcccaggctcagtgggctcctcccccgggtcggggcaaccccccgccggggcctctggggccaacggaagctccaggagcgcggtggagcctggagtggagggcgagggtcccaccgtgacccgcctggagggcagcccagctctgggacgcgaaaccgcctacgacggtgccgcaggtggagggaagggtagaggggagaccagtatgggggagagcaaggtggccccacaggttgggagaggatgtggggaagtccccctacccacccaaggccgaacatcgcctaactggctgtgggacgcccggggcaggggctgggggcggatggcctggttagggcccagcttggggtcttgaaaatatccctatggctttggggccacagaagggcggagtcctggcattcaggggaaagggccgaggacggttgtcaacgggaaggaacctctgaccctaccctgggtcaatgtgcagtccaagttgccacaaatgaccggaggaaacagtgggaagggaaggtctctttcccattccaaaccaggatgcccttcaggtcgcccacttccttcatccccagagcagctgccgactttcctgttaagtgccagggcctgggaggtgcggggctgcagctcaggcgctgaagggggcctagggtccaggaacctcctgccaagccagtggtcctcagacgctggtccaggcaccaccacggggtacacagcttttcttacctcctggtgttatgggtcctttctgttttttgagacggagtctcgctgtggctgtgtcgcccaggctggagtgcagtggcacgatctcgcctcactgcaagctccgcctcccgggttcacgccattctcctgcctcagcctcctgagtagctgggactacaggcgcccccaccacgcctggctaatttttttttttttttttttttttgtatttttagtagagacggggtttcaccgtgttagctaggatggtctcgatctcctgatctcgtgatccacctgcctcggcctcccaaagtgctgggattacaggcgtgagccaccgcacccggcccatgggtcctttaaaaaataataatttggccagacgtggggcctcatgcctgtaatttcagcactttgggaggtaaaggtgggaggatcacttgagcccaggggttgcctgggcaacatagcaagaccccatctcaaaaaaaaaattagccaggtgtaatggcatacacctgtagtcccagctactcgggaggctgaggcaggaggatcgcttgtgcccaggaggcatgaatgcaccactgcactccagcctgggtgacacaagaccctgtctcaaaaaagaacaacaacaaaaatttgaataaaaaccaaaccagtgacagtagataagttgctttgtttttaatgctcttggcaaaataaaaagttggcagtcgtatattcccccattctctctctctttctcacacatgcacatgcctataagaaagcattctctggatccacagaattccagatttgggaatcactgaattgaactgccggccattggtggctggtgagactgtcctggcagtgatgcagtattctggtccctgtgccagcactgatgggctgtggaatcctccaccagtcattccctctctccagctctccatctctgcttctgtacaaaaggatctaccaatcccctcttatattcaaatatctatgacctttcagtctggcctatatccgtgcggatctgaagttgtgtatccgaagatgtaaccttgtccagtgctggcactaagggctgcttcagggagggacctggactggtgcccagggaaaggaggacaaggtcctcatcactggagagtggagggggcagtgggaatgggacagataaggggtagtgccctggggtatacctggccccaaagtaaccccgggctgtgaagacaaaagcactgcatcacatgatgtgtttctgtgtctctctccctagcagttccaagagcctctgagttcctgccttttttcatctctgaatccccaccattggcctacattgggagtggggcgacctgtaagtgcacagtgaatttttgctgagggagtggctgggagggctgcgtggagtggacagcaccaagctgcacttttcaggggagtggggtttggaaaatctggggagcagaacaggcacccccgcccccaggaaggaacccaggtgtattagtctgttctcatgctgctaataaagacatacccaagactgggtaacttataaaggaaataggtttaattgactcgcaccacatggctgcagaggcctcacaatcatggctgaaggcgaatgaagagcagagtcacatctttcatggtggctggcaggagagagcttgagcaggggaacttccacttataaaaccatcagatcttgtgagacttattcactaccacgagaaccgtatgggggaaactgcccccgtgattcaattatctccacctggccctgctcttgacacatggggattattacaatgcaaggtgagatttgggtggggacacagccaaaccaaatcaccaggtacagaggccagaggagcctggggatgacggtgatgttccaggtgtggagggagacgtggcaggcgtggggacaggaaggttggaaggttggggaactttatgaagggaaaactgagaagatgaggaaggctgatgagatggaagtggggttggggagagggaagaaccagcatgagctcaaggctagggtttgggtgaaggagagaaaaaaaggtagaaaataaaggagacagagatcacttctagtcacatacaggtggagatggggtagacaggaagaggtgccccctatcaaatgagaatgcccagtgtactcccatctatacagaggacaggatcaagatgcagccatgactccttcccattgagttctaatactagaaggatgcctcaatgccctctggtccaacagacttcatcattttagatagaaggaagtggaagccctgaggttggggtgacttgtatgacctggagagtggatgggagatggaaaggggacatttaaagagagggaagggctgggtgtggtggttcaagcctgtaatcccaactctttgggaggccaaggcaggaagatcacttaagctcaggagtttaagacaccctgggcaacatagttagacccctgtctctacaaaaaattaaaaaattagctgggcgtggtggcacgcacctgtagtcccagctactcaggaggctgaggtgggaggatcacttgtgcccaggaggtttagcctgggtgacagagtgagaccctgtatctaaaaacaaaatataataaggaaagaagggaataattcaatttttcaagtgggaagaagagaaactagagaatgtcagaaaggaagagaaagtacaa

SEQ ID NO: 314 - DNA, 8934 bp, Homo sapiens
ctgcctttctcaaaagaaattctatagagaatctcccaatgtataaaacatatcaaagtagaattcttgggatgtggagggaatggggtacctggatcccacctgccagtctttaggcattcatgaggaacccttgaacctgctgaaccctgtaaaagggctttaagcagagagtgagatgacccaatacacattttagaaagatgcccgtggcagctaggtggagttgacattggacagggatgagattaggggcagggagcgagtttcaggaggctatgaaagtggtccagacatgagctgatgaggtctagacccagggcaacagcctaaggatgaaaagcaggttggattccagaaacatttctgagttagaatcagcaggaattgggggtcaattagatatgaaggatgaagtctgtgagggctggactgcctgggctgaaacataccgtaaagtgtgacagccatacaggagagaaactgctgggacaaaggataagagttgagtttggggccaggcacagtggctcatgcctgtaatcccaggactctgagactgaggtgggcggatcacctgaggtcaggagtttgagaccaccctggccaacatggtgaaatcccatctctactaaaaacacaaaaattagctgggcgtggtggtgggcgcctgtaattccagctacttgggaggttgaggcaggagaatcacttgaacctgggaggcagaggttgcagtgagctgagattgcgccactgctccagcctgggtgacagagcaagactgtctcaaaaaaaaagagagagagttgagtttgggatacatcatgttatggtgactctgggacatgtagcagttgattgaccagtagacagttaaaaatgcaagtctggatcttctctcgtggaagagaatgttggagctagaaattaaaattggggagttaccaactgattggtagacacaaaagacatgaagtagagaatgtgcatacaagagagaaagaggcctgaatcaagcacctgggtttgcaacaatttgatctttatttagctttttcattggtgtgattgttattaccattatgagataatattttatttttaaaattatttttatttttttaaagacggagtcacactctatcacacaggctgaagtgcaatggcgtgatcttggctcactgcagcctcaacctccctgtgctcaggtgatcctcccacctcagcctcccaaatagctgggactacaggtgcgtgccaccaggtctggctaagttttaaattttttgtacatatggagtctcagtatgttgcccaggctggtcttgcactcaggcggtccacctgccttggtctgccaaaatgctaggattacaagcctgagcctctgtgcccggccatgagtgaatattgtagaaagcagagacaatgtgccagatgtttggagtgaaaaggacttggctcctgttctcttaggatggacaatgctacacacaatcccaaatcacaggctataagagaggtgacccaatcctgcaggacagttcaacgtttcagatttgaaggggagtgagagagatcagaactggaggccccttgtctgagcccccgactatggtggtccacgtcactccacacgcagcaggcactgtaaatatttcaccttctctagacgacagtagttcctcgagaacaggagcgctggggtaatgcatatgaagctcttagcacagtgtctggcgctgcttcaatgatggctatatgatcaattattcttactcctttgaattcttggcaagagctggcagggaactttgtacacatcaggtacaaaaaaacccatccgcgcagtctaagatcaagaagctcttggcactctctgacagtcctcgacaaagcaattccccttctttctaacacagggtccgtaaaggagatgatccacaaggaccggctgagtggataagaagacagactggctgagcggctgaccctgccagacgacaggctgtgcctctttaccacggtgctgccgttcccaaagtcggcctcagcttggtccttggctggaagctcgtagcaaagtttctgggtcagcagacctcataggcaaggggcccctagctggccgcccccagccctgccaaggcaccaacgcaagaaagccgggggagcctcggtcgcattgctggaagatcgtctaaacatccccgctgctcggccgctaggccggcaggtgttcgggccccgctcccccggcccgccccacccccgcgcccgcgccgcgcttccctctaagaggccgggtctgagtgagcctgtgctgagtcgccgagcagcccgctctccatgtgacttcagtttccgtccgttccttccgctggtgctaaaataatctgatgccccacagcaaggaggtagcccagccccgcgttcggctgctctcgaggaggccggagcccccggagacgatgcgccccgcgcagccgcctgcgcctgcgggagccgtgagtatttcccgcgtgggggcgtccccggggcacagccggggcccttctccaggtgggcgagctcgagcgaggttgggtggtaggaggtcagcgtccgcggcccgcagctcagggctcacgaggaagctgtggcttgctgcgtccaagcgccgccgcttttgtgctgggcgtgggggctgcagctctgggtggaggtggaaatacctccctccaggagcacttagagctgagaaaggtggtgcgacgtagtggaaaccacgagggcttcagattcagacgtgggtttgagtcctggctctgcagggagcatgtgagcagacagttaaggtttctgagcctcagttttctcatctgcaaaatgggaacagagatgctccctccctgggctgggcgactggatatgatgagaccgctctgtgcacactcagcatgctgagcactgggctctcctttcctgtcccacaacgtggattgagaaccactatctcatagatgaagacactaagactggttaacagcaacacctatcacagatgccgtccacgtgccaggcctgtccaaggccctggggatacagctgtgaaaatgtgcaaagccccttctcccacagaacgtttgtccttgggagattcactggggctctgtgacttggatcttagcctagacttagatccatggcttatcagagggagactaacaggagggcgacgaagactcggacgctcttccgtagccctcgtggcccctgcatgtgggccggcttctgaaggggtcagcgtacttccccacgtacccaggagctagacggaaagaagtaaggagccactggtgtggctttgtgctgcctctgagagaaggtggacacgtgccagttggtggctgcgactggaggaggccggatcgggggtcctaggaatggagcctctccggacagggctggtcggggctgctgtgcttccctaggggctgaggggaccccaccggaggcttcttcatgatgggcacagcccgttaggagtctgggtgctagaaacattcagcgtctgtggccctccatgctttcctgtgtgctcctcacctgccggctgtgacacacagactgttctgtggatgctgagggtttgctgggctttacatttacaatacgtatttattctcctcacacacctcttaggtttgtgtgtgtgtgcccgagagtccctaaaggagattatagaatcatgggcccaggaaaaaaccttaactcctgcctttaggttaaaaaaacaaaacaaaacaaaacaaaacaaaacaaactcagcttcacaaagaaggcactttttaaaaatatatatatttatttatttatttttagagacaggctcttgctctgttgcccagactggagttctgtggcacgatcacagatcactgcagcctcaaactcttgggctcaaataatgctcctgcttcagtcacctgaggagctaggacaacaggtgcacaccaccatgccagctaatttttaaaatttttttgtagacacaggatcttgctgtgttgcccaggctggtctcaaactcctgggctcaagcaatcctcctgccttggcctcccaaagtgctgggagtgtgggcgtgagtcaccgcccccagctttcatgtaatgagtgccctcatgggaacttcatgaaaacacattctcttatagtttttaaattcatcatccaagagttcctgctctttgatgatgagacatacctggtagactccaaaacagagagcagacgcctagtatctttgttctggggtgtgcattaagagtacattgacctgtctgtctccagtcttgactcttttggaagagagatgctagtactgatgacaacctgcattctggctgcggtgtgcgtccacactgcacagtgtgcaccagactctcgtatggacaatgactgtccctcacatcaggcgcagatccattttagagcctcagaagtcaggagagggtggactttcaaccacgactgaaaacactgtctttcttaggacatgctgtgtgtatgacacacttacagatgtctgtgctcactgatgcttgttgatgtgtcatcgcacatcagtgacaaacatttgtcatgtttttgcctttggtggaacttctttattatactcactttcctcccaaaccatttttctcaacttcatcatgaagcaaatgtcatgtggtcattctgtgatggggctcagggctaggttaggtgatgatttctgaaagctcagagacgtgaaggaaaaaggacatcagtgcttggatcttagctcttataagcctcacgtgcaacaataaacccgagttcaagaatcagattcttagatagattggtttggtagcaaatgacaaaaaaccaacgtaaatatgcttcggcaaaaaagaaaaaaaaaaaggatttattgtttcaaataactgaaaagtgtatgggcaatagtttcaggcatggctgagtccagatgctcaaatggcattgccaggaatccatctgtctcctttcctcagctttgccttcctctctgtgggcctctttaccaggcaagtcccggagctggtggcaaagatggctgcctgcagctccaactatattcctactggtttggcatctgaaacagaaagagcaagtctcctttccatgagttctagcaactgcccgtggattgattctcatgggcttggcttttatgatgagcctgttaggaaaatggagtgctctcacgggcccagccttactcataggccccgccctggaaccaggagctgggatcagacccgaacacacagacttttgaagaaaggaagggggttggttgcacagccgcgtaagggtacttaacactactgaattgtacacctaaaaatggttaagatggtcactttcggccgggcgcggtggctcatccctgtaatcccagcactttgggaggccgaggcgggtggatcaggaggtcaggagtttgagaccagcctggccaaaatggtgaaaccccgtcactactaaaaatacaaaaattagctgggtgtggtggtgagtccctgtaatcccagctactcaggaggctgaggcaggagagtcgcttgaaccttggaggcggaggttgcagtgagccgagatgattgtgccattgcactccagcctgagccacaagagcaaaattctgtctcaaaaaaaaaaaaaaaaagataatcgctttcatgttttgtgtattttactacaattaaacattttctaaagaaaaaaaggaaagaaagggggtgattttctcaaaggggaattgaggggttgttaccagaaggagaaacgaatgtgagtgagtaggcgaaaccaaccaatttccagagcgaacggagtcaggtgctgaccccaagccaatgtgtcttttctcactttaatgcctgagggatttcagagtgaacagagtgaagaaaggaggaagtggaacctcgtcatggtcctcacccacgaggtgggcgcgaggagcaggctggtactggataggctcaatgtggccacaaagcctggtgaggtcacagggactcccctcctccagccccaacccaaaaggttgcctaaggcaggtgctgcgccatgtgcaccaagcaactttctgctgccacctccaagaaagagaaggaccgggaggggatttctcccaggagagagagcacataacgctccgtcttttcacctgtctgttctcaagcaggacctaagtgtctaaggcaaccccacacccacagtgcctggcaggggcccacccatgggtacacatcgtgttctcctaagctcatgtcactccatttcagatgtcaactggacatggactcctgctgatcctccctactgtcattcactcctctcctgctccagccctgatccctgaggtctcttctacccttgcagtgtctcccctctgtggtcctcaggcaccaaggctgagccctttccctcggccctgcagtgtctcccctctgtggtcgtcagacaccaaggctgagccttttcccttggccctgcaggctcagtggggagcagggctttccctgcctggccctggaccacctccttcaacttcagcaagttagcggtctccctgtcaccagccagcctgacaccctgagacctcctcatgggcctcggccgttctcttgttctaggttattgggcccttcctcaggtccttaaactgatgcttccattcagcttctcatctccttccaaatccccagttttcttctaggctctctggctagagaaggttagagccattttgaaggcctctgacagcccccgtcttgctttgtctccacagaaggccatggtcccatgatacactcaggggtgctgttcagaatatcaggcaccgcatggcacagctacttgggaggctgaggcaggagaattgcttgtaccctggaggcggaggttgcagtgagccaaggtcacgccgctgcactctagcctgggtaacagagtgagaccccgtctcaaaaaaaaaaaaaaaagttaaatcacttgatatgcattctgaaatatttaaaggaaagtatatcaatgactgcaatgtactttgaaatgcacgatcaggctgggtgcagtggctcacacctgtaatcccagcactttgggaggccagggcgggagtttgagaccagtctggccaacatggtgaaaccccatctctattaaaaatacaaaaattacccgggtgtgatggtgatctgtagtgatctggtgcctgtgatcccagctacttgggaggctgaggcaggagaatctcttgaaccccggaggcagagatctcagcgagcagagatcgcaccattgcactccagtctggcgacagagtgagactctgtcaaaaaaaaaaaaaaaaaaaaaagaaagaaagaaaggtggcatgggtggtgctgtgtgcctgtagccccagctactcggtagccctaggtgggaggactacttgaggctgggagcttgaggctgtagtgtgctacaatcccatctgtgaataactactgcactccagcctgggcaacatagcaagacctctaaaaaaaaaggagaaagaaagatggacagaaggatagatagatggatagatgtatgttgttggggaaaagttaaatgactaacagtacctagtaactgttcacattccttgtcatgatcataaaaatcaaataataagaaattagaaaacttccataggaaatgtagctacctataatacactgccatatgaattactgggttattgctccactcaacttttagcttgtgatgaggaggtgataccagcactgagcctgcaggatgagtaagagctttgcaggtgaacaagaccagcaaaagagcctttcccacagaggacagagcgtgtgggcatgcgtgatttagtcaagggtcgcaggcatcccagggtggctggggcttgtggtattgaggttgagctgatgcagaagtcacagacctgggtttgaattgtggctctaacattctctagctgtacagcctaaacctatgtgagccgccattgaccaagtgtgaaatggagatgacaacatttacctgctaggatttttgtgggaattatatgtaaagtacccggtatagcccgtgttccaaggtgagcactcagtaagcatgagctgtcacagtgaagagcccggacagaatctgggagtgattatgcagacctcgaacaccactgaattgacctttgaatcggcctcttgtcaggaatccatatgctttcgttcttcaatcgtacactttctcaaggaaaccaagtagtcggggtggggggatatattttcattgttttcccactggggccactaagccgctgtcatcacccataaaaaacccctgcccacagtctaccgtggaccctgggtgctcgcttctcccctggacatcccagggtccacacgctgcagctcccaggggtgggagaagggacgaaagctccttctccttcactgtatttccctcaacaccagcttgctgtttgcacagaggaactctgctttccctttgattaatacacctctttgtctcactatggaaagcgtctgtccccctccagtgggggcgtgtcctcctgcaggccttggaaggcttggtggggtcccccgcccactaaacgtgaagtccgaacattcccttacatcgacaaagccttttcacacacactgtcccattcagtctcgacacaaccctgtgaggccatcaaggcaagtgctgtcctccgtggtcaccaccagagtgaaggagccaggcttgggcccaggcctccttccccagcccagggtcccttcctctacacaggtcccacctgctccttcttatcgagaagggcggtggcaggtagccactccctcagaagtg

SEQ ID NO: 315 - DNA, 9234 bp, Homo sapiens
ataaacaattaactttaggacagacaagattgagcacttcataaaaccaagccaagccagcattcctacactcgctccttctctagccacatccttaggaacagaaaagaaaacaaaaaaaaagcggggcgggggggggggggggcggtctttacctggttctacaaagcctttaataactccaaagatgttaagaatttttatctctttcagcacattgctcacagtgagcttcacattcttgctttctgaggttaccatcctacatgtagagtctgttttccagtcagagggacagtctccttccatattcctagaatcagaaagcaggcgtaagttctgagttattgttccttgcccagggtttactcctgtccagtgaagttacagattaagaggacatataaacaaaacttactctcagcccggcgaagtggctcacccctgtaatcccagcactttgggaggctgaggcaggtggatcacaaggtcaggagttcaagaccagcctgaccgacatggtgaaaccccgactctactaaaaatacaaaaattaactgggcatggtggcatgcgcctgtaatcccagctactaaggaggatgaggaggagaatcgcttgaacctgggaggcggaggctgcagtgagccgagatcacgccactgcactccagcctgggcaacagagcacaagtcctgtctcaaaaaaaaacaaaacaaaacaaaacaaaataaaaacaaaaaaaaacttactctctagtggtgaaccatttgcgtcttactttgatctgcaggcagccaattggaaaccattaattaagcaatattttaaaacacttctctaactatgcgcctttctgccagacatacttacgtagtttatatttggaatacataccaagatggactcaaaatgaagttcttctaatatataaaagaatattaatacacttttatgtttcccaactgtcaccactaacaaggatagtacacattcttagctcagttataaaaaatattcctcagctgggtgcggtggctcacgcctgtaatcccagcactttggaaggccgaggcagaattccttgaacccaggaggtggaggttgcagtgagccaggatcatgccactgcactcctgcctgggcaacagagtgagactgtcaaaataaaaaaaaaatcttgtgcttcccctatctaattcctctgtgttacccaaataatagctgctcctaagggggcttacttacataaatataggttgaaacattattactcccctactacataaggataagatgggacgctggcttcacaggttggttacgatttgtaggtggtaggtagaatgagtcaaaaaaatcacctatgctaaatgcctcttagcgttatcaatagtcatggtatgttacacactcccctatgctaaaggcctctcagcatgatcaacagtcatggtatttcatatactccttatatacagatgttcttcatttgagactatcaagtagaatatattttcactatccaattatgttaaagaaacaggatcagagaacctatgtcatacaggagataaatgctttcataaaggcctgaaactagatctccatcctgtaataacaggaaatgataaatatgtccacatccaaatcaaaattaatgctacgtactctaatggaactgggctctgtttttaaagagagacactaacgttacagggaggatatccagaggagcgagccacaaccataaatggtttctctggaaaccatcataagaagcaaggcttctcaatctatagacaaggtaactggaatcataccgtattgcttagaagaaaaatccagacaaatggatgtttcggggaataggattttatcccaatatgaattctaacagattctctctactaactgaatgggctgctataggcatcgtgcttcagcacagaagtacttgagcagaagctatgccaggaatcttgcacaaggaattcactgggtttataagtctccttattctcctgtgtttataagtccaaagtccattattaagatctctttatagagaaaaattcatttatatctgtaccaaggtaacagctaaccatcctccaaattcccaaatgtggaaaattatcatcatgtttaacattttaatcaacatattaccgttcttccctaatcataaaacctcactatgcaagaccgctttcaaataaaaacttacccaaacagcttttctgcagcagctctggagattgtctggacaggtatattaggcaatcctgatgaccgagatggtggaaactgagtgtgattgaaggaagggaatccaggtgtgtaagggtcacctgtccccagatgagcctaggaaaacaaaagagcaattcactccatcacatacttcctcaaaacttctctgtaagattcaggtttggtataaggctgcagcccaaccttagtttaccaacttgaagcctcaaaaatctgagtggctctacaatgtgactcctgttttcatggcatatggaaattctcaaattcaaggcactattgacaaagtacttttagcaacaaataataaagcctcaaagtcaatgtaatctatcttcttgcttactgctaacgccctcccagaaaaaagagcagttaaggaagacacagtgctatttctgctaatacaggaatccaagaacaactcaaggaactcaaaacggtgatttactcaagaaataactcacatgtccaaagaatgaaagttctgcgttaacaatgggaaatttagtctggtccatgtatatcaacacaccaattgcatttaagctttcagcatttgcaacctaaaagaaaacatataaagctcagaaaatgaagatctgatcatacgaaatgagaatacatcctggacattatgctaaaggccaaatggttacagaggactaaacttataatacttccaaatatttcaaattgtttatctggtaatttattaattgcttcctgaaaaattaactcacttgtttgcaaaataagagtaacgggccaggagtggtggctcacgcctgtaatcccaacaccttgcaaggctgaggcagggggatcacaagctcaggagttcgagaccagcctggccaacatggtgaaaccctgtctctactaaaaatacaaaaattaactgggcgcagtggctggcgcctgtattcccagctatttgggaagctgaggcaggagaatcgcttgaaaccataaggcagaggttgcagtgagccaaaattgcgccactgcactccagcctggacaaaagagcaaaactccctctcaaaaaaaaaaaaaaaaaaaaaaaaagaataacaaaggccaggagtggtggctcacacctgtaatcccagcaatctgggaggccaaggcaggtggatcacctgacgtcaggagttcaagaccagccaggccaacgtcgtgaaaccctgtctctactaaaaatgcaaaaattagccaggcatggtggtggtgggcacctgtaatcccagctactcagaaggctgaggcaggagcatcacttgaacctgggaggcggaggttgcagtgagctgagatcacgccactgcactccagccagggtgacaagagactccgtctcaaaaaaaaaaaaaaaaaagaaaagaaaaataacaaaaacccatctaagacaaccacttttttgagtctcactgtcactcaggctggagtggcacgagtcacatctcacaacctccagggctcaagcagtcctcccacctcagcctcctaaagtgttgggattacaggtgtgagccctgccactttttttaaaaatgcagaaatcaccactgtcttttgatatgttccactctagttccttgtgtatgtttggctattaattttcctttttataaaacatgcttttagctgaattctgtatatgcgtaaaactgagttatacagagaaatagctttcacttaagcacttctgattaggtaagtggaacttacttcatttgttgagcattttaataaattatattatctggtatgagagtttaagattgctgattttcagaatgtaagaatattaacaagaaatatcacttacctgaagagtaagataccaaaagtactgtatttaatattataataactcatactcaccttttctgcaaaggtgattttccctgctctgacaatcactatagatccattcacaggagtgtataaatcctcaaaatcttttttagtaccaaaattagcatggaccagtttaccctagaacaaagacattagatttaatgagcattatggtatcggaacagctctaaaatcttgagacagaagagtgttatagatcaaacctaagacaggcaacccaagtaagagataaaaggaggccaaggcctaaaaaagacatgagttctaaaaaactttacaacttttaggtcagagctattggaataaaatcaagatttttggcctcctatgtctttcatgcttttatcccatgctgcctttcatctgaagggcatttagattaaagaggcctatgtaggctggtcatgggactggaggcctggaacaatcttagccttgaggacatcatagaaataggttttaactgaaaggtctgataataaatctgtcccaaaattaaaacaccatctattacaacaaagtgacttgcatacaccaactttagatgtgtcatgatgttcctaagctcataagagtccagatgaacagccataaactgacactaacaaccaagccctcaatacagaaagcttgaagttgaacaaaaatcttcaatgttctttaacagaacaacctacccatctctaaactcctggcttataggcagccaggcaaagggataaagcacaagtatccagaaaggcaaggaatcaacacagaactgcaccagccccgaaaggtatccactagagatacgcctgacttacaaatgtgattttttttttttttttgagatggaatttcgcttttgttgctcaggctggagtgcaatggcgcaatatccgctcactgcaacctccacctcctggcttcaagcgattctcctgccccagcctcccaagtagctgggattacaggcacccaccaccacgcctggctaatttttgtatttttaatagagttcaccatgttggccaggctggtagctctgaccttaggtgatccacccaccttggactcccaaagtgctgggattacaggcgtgagccaccacgcccagccacaaatgtgatttttaagctgaaaattattctatctatctgttctctatttctgtgttaatttgactatatttgcctaaatttaaaaagatcaagggctgggcgaagcagcttcctcctgtaatcccagcactttgggaggctgagggtggtgaatcacctgagcccaggagtttcaattgaagaccagcctggccaacatggcaaaaccctgtctctaccaaataataataataataataataataataataataaaataaaaaataaaaattaactggacatctcagctactcaagaggctcacttgagcctgggtggtggtggagaatgcagtgagccaagctcacgccactgcactccagctagggcaacagagtgacaccctgtctcaaaacaaaaatagaaaaagatcaagcattaacgaatcaagctaagactaggccccagccaagatggatatttacatctgtccccacagggaggatatgcatttgtttagcaaatactactatgtatgtcaggcattctccaaagctctgcaacatggcagtaaatagaactaacccatgattcttcatctggctcacattctaatggaaacaaaggcatagataatgtcagctgctagcagtactataaagaaaaaataaaacaggacatggggaaagtgattagagagagaagacaatgcatgttgactgtgtcattagagggttgaaaaccaaaatatctcatgatcatttacattttacaggtaaatttataactcctaagaacagaaaagatgagttttgaatgattcaatagggaagagtctcatgcactgttttgctttacttacagtaactgttgcagccttactatacgccacataacccccaggattctccaccaggtaaacaagtctaccgttcttatcaactatgatcaccgagttttgagcgctgttaaaaagattaagttaaaataagcctaaggtcatccttccaaaaaacacaatagcttacatttagtatgtcttgcattatttggcttgaggaaatttacctctaaatcttaagcttgatttttattttaaaagcctttgggccgcatgcggtggctcacgcctgtaatcccagcactttgggaggcccaggcgggctgatcacctgaggtcaaaagttcgagaccatcccacctctactaaaaatacaaaaattagctgggcgtggtggcgtgcgcctgtaatcccagctgctctggaggctaaggcaggagaatcacttgaacccagaaggcaaaggctgcagtgagcagagattgtgccactgcactccagcctgggcaacagagcgagactccatttcaaaaaaaagccaacaacactaacaaaaagtctttgctatatttagcacacctgaaaatagctacttgtataaaaataagtttaccatctttcaacatacctgtctttgacctgaatcttaacaaaatgttgatcacgccagactttgctgagtttaaattcacgaaattgattttcaacatacaacgcaagattttcatctttttgagatccagcctcacgagggacatatgaattttcattcagcagcctggaggagaaaatgccttttaaatgaacttaagtttactttaaaataaacatttaagtcaaggattaaacaaattgttttgaaagcaaaatattatccctcatagttcagataaatgaactgtgacccaaaacttctagactgaccagaatatcacaaaagaaaaaaaattttgccccaaatcttgtaacttcaaagcttctttacccactacaaagcactccttcaagagcctcatcataacacaatgtatctgcttaggatagttttaggggaaatgagtagcttccagatctactataaaatctaagatagtaatactgtgctgaacagagtgcatagtttcaattctcacctacttgtgaagcatctgaataccctgaagcagaactgctccttggtccgatctcccatacttctttctatttactcagcatattagttcttacatttttgtggggtggactatactctcactttaaccataaggtctggtgtacagtaaataaacacaaaagcatcaactagatgaagtagaaaatgccataacttaagactaaagaattatagtaccactgtaagtgtaggaagcttgcaaaaaggaaaagataaatttattctttgcacagaggcatgtatgtgcaaagatagtaaaactctatggacaagtgttacagctcttttagaatttgtctagcatgctttctagtttttgccagaaagcccattacaaataaaataaataaataaatataaaatagaaatttggccaggtgcagtgcctcatcctgtaattccagcactttgggagccaagacaggaggatcatctgaggtcaggagttagacaccagcctggccaacatggtgaaatcccgtttctgcaaaaaaaaaaaaaaaaaaaaaaaacccacaaaaattagcagagcatggtggtacaagcctgtgatctcagctactcaggagactgaggtaggagaattgcttaaacctgggagacagaggttgcactgagctgaaatcgtgccactgcactccagcctgggcaacacgtaagactccatctcaaaataaataagtaaataaataaaaatctaagaacagaccggcctgggagacatggtgagactccatctcttaaaaaaaaaaaaaaaaaaattagctgggtgtggtgctgcgtgcttatagtcccagctactcaggaggctatggtagggggatgaagctgcggtgagatgagagcacgccaccgtattccagcctccaccagagggagacattgtctctggatactgactggcctaggggttaatgggtgagtatcacagaaattaagaagcactagagacttaaggcaggcagttacccatgatcaaggagatgaaaaaggctacttctggcatgtgttgcttcctaaaacagagaaaagctactgatgtccttgtcagcaaagcagagcttagtacaacgttacaagaggttaagaagaaaaatcagagccagagaatgacagcaagcaataagctacaaagatggggaaaacatcaagggcctattaattttttaagaaaaaggagactccccagagaagttctaccttttcccctaccagtatagtttcagttttttacaggccccttcccctctttagctaaacatgacaagtcttgtcttctctaacaagccattccccacagtgtcaccattattgtttccccgtggcctatcataattcttgaattacttgtctagatacttgcacagcagctggcactcacttgatggtgccggtgaagtctgtgctgtccagtttctccgacaactttctcttcaggtcatcccaatataagcgacgtgctgcagggaagtcctctcctggctcctccctcactggagactcggttcctgccagtctctcacactcagtttttggttctacccctttacaatagcccaagtagccaatcataaatcctaaagagacaaagttccagagctgaactcagaatttcatttgtaatctatccctgttaatctgttaatattttcaggtaagccttgaaaatactggttttcatcaaattctaagtagttttaaagtatataatgcatctcagttttgtatactttaaaccacttaataaattatatactagctttatttcaaatagctacctattcaaaacataggtagttttttccaaaagacccccttgaaacatgagactgagctgctgcaccgccagtgtcctgcggatattttctagcgtagcatttgcttcctggtggagtgggagcaaacaaaaaaatacataaataaaaagaaaacacttgcacgtcgtattgaaataattcatgggtctctctttc

SEQ ID NO: 316 - DNA, 9400 bp, Homo sapiens
aaggtttcctcacatacacccatcttctcctcacagtgtggaaactccccctcctctccacaccttcattttcattagcgggaaactctcacctggagtcagtttaatcttattaccagaaaggggtaccaatccagaccccaaaagagagttcttggacctcatgtaagaacaaattcagggtgagtccataaagtaaaagcaagtttattacagaagtaaagaaacaaaagaatggctactccatagacagagcagcagcatggtctgcctgacaatgtatacttatagttatttcttgattatgtgctaaacaaggggtggattattcatgagtgttctgggaaaggggcaggcaattcccagaactgagggttcctacctcttgttataccacatagggtaacgtctggatattgccatggtatttgtaaactgccatggcgcttgtgggagtgtttgttagcatgttaatgctttataattagtgtataataagtagtgaggaccacataaggtcactttcttttcttttctttttttttttgagacagagtctcactccctcgcccaggctggagtgcagcagcgcaatcatagctcgctgcagcctctctgccttcctgcagcccctgcctcccaggctcaagcaatcctcccagctcagcctcctgagtagctgagactacagccacaggccaccacaatcagctaatttttgtattttttgtagagatggggtatcactgtgttgcccagggtggcagaggtcactttcgtcgccaacttggttttggtgggctttggctggtttcttcagcgcattctgttttatcagtggggtctttatgacctgtatcttgtgataccagtcctgccgacctcctagctcatcctgtgactaagaacgcctaatcacctgggaatgcagcccagtaggtctcacccttattttacccagcccctattcaagatggtttcactctgcttcaaacacccctgacattatgacttaaataaagtcaactttataaaccctttgttcataacacaacccaaacaatttgttctctgaggctgaccttcacagatttgcttcatatatatcaattacagtctgtccccagcgaccctgtgcatgccaaaaccaaaacactgcccagaaaatagctccaggcctgaaggtacctctgaaaggtacaaccccagataggacagaacccccgagcgcatctgcacgtgggtcttctgccatccagggctctgcagcttcccagaatccacactccttctggagctggaggccaccttcaagggagggcgggctccgggggaagcccccaggagtttgcaaaaggagccccctttccctccttttgcaaactccagactagcctcagcggggagtcattggcctccggctctgctgccccctacaggttattaagccgcttcttaccccattgatcagttcctagaaacaaacaccctcaatcccagtgtgtgaataagacgccagcagagtctctgctttcctcctgtggtgcttttttttattttgttttgtttgtttgtttgtgacggagtctcgctctgtcgcccaggctggagtgcagtggcgcgatctcggctcactgcaagctcctcctcccgggttcaggccattctcctgcctcagtctcctgagtagctgggactacacaggcgcccgccaccacgcgcggctaattttttttttttttttttttggagactgagtttcactcttgttgcccaggccggagtgcagtggcgcgatctcggctcactacaagctccgcctcccgggttctcgccattctcctgccgcagcctcccgagtaactgggactacaggtgccggccaccgcgcccggctaattttttgtatttttagtagagacggggtttcactgtgttagccaggatgctctcgatctcctgacctcgtgatccgcccgcgtcggcctcccaaagtgttggaattacaggcgtgagccaccgcgcccggcctcctcctgtgcgttatgtatgacataaggaaaaacaggctgggtgcggtggctcatgcctgtaatcccagcactttgggaggccaaggcgggcagatcatgaggtcaggagttcgagaccagcagcctggccaacatagtgaaacctcgtctcttctaaaaatacaaaaaattagccaggcgtggtggcaggcgcctgtagtcccagctacttggggggctgaggaaggagaatcgcttgaacccgggagggagaggttgtggtgagccgagatcgcgccactgcactccagcctgggcaacaagagtgaaactcagtctcaaaaaaaaaaaaaaaaaaaaattagccaggcgaatagcttgaacctgagaggtggaggttgcagtgagccgagatggcaccactgcactccatcctgggcgacagaacgagactccatcagaaagaaaagaaaggaaggaaaaaaagaagggaagggaaagggacaggaggggacgataggggaggggaggcggtcgggagggatgtgcagcccaggaggagaaggaagggggccagggaggcttagtcagtgggcggtgggtgtgtgggtgtgtgtcctgtcagcttcacattgtccaaaggatcagaattcagttgtgagtttatgaaagtgaaaagcagggaatggcctttctggaaaacacatacttcaaagaaatgggctcagttctttcttactcagattttgaacaactcattttcacaaccccaaaccctctgcaggtcacatttcctcctctcattttggtcttggcctgaaccctacctgctctccttgcacccttgttcccagcaaaccgaggattgggctgcttattctctgtgcccaataatgagatgcagatgaactgggaaagaagagttgcttgctttatttattttttttatttttttgaaatggaggcttgctctgtctcccaggctggagtgcagtggcgcgatcttggctcactgaacctccacctctctggttcaagcgattcttgtgcctcactcagcctctcgagtaactgagattacaggcatgcaccaccacgcctggctaatttttgtatttttagtagagacggggtttcaccatgctggcctccaactcctggcctcaagtgatgtgcccgcctgggcagcccaaagtgctgggattacaggcgtgagccaccgtgcctggcctaggtttttaacggtattcctaaggaaacacaaatcatggcatgagtgtgtcctctctagaaaaagaattaaatacaatggttgaagtaagagtagaaactccaccttggagtcttctcccttaatgtgacacaaacatcataggtgagtcttccagacacgattccgccacaactttttttttttgaggcagagttttgcttttgttgtccatgctggagtgcaatggcacgatttccactcaccgcaacctctgcctcctgggttcaagcgattctcctgcctcagcctcccaagtatctgggattacaggcatgcaccaccatgcccagctaatttttgtatttttagtagagacagggtttctcgatgttggtcaggctggtcttgaactcccgacctcaggtgatctgcctgccttggcctcccaaagtgctaagattacaggcgtgagccactgcacccggcctcccccacaacttattacaggctgccaaagagtcaggcaaaacagtgctggcatcctctttttctctgaaaaatgtgtgctatccctccccttggcctctcgcccaccctactccccgtctttgctttcttcctgtcccctcattgtgtccagccagtgccattgtgtccagaccgtgggttcctcagtggccattgcctccaccaccatgatatggaaattttttcttaattaatagagatgtgggctcactattttgcccaggcatttcttgaactcctgggttcaagtgatcctctggcctcagcctcccaaaccgatagaattatgggcgcaagccaccatgcccagcctagaagtcttttaatgcatttacattttcttagaattttccttctttactttacatacacacacaggaggaaagcagggactctgttggtttcttgggttttttgtttgtttgtttgtttgtttgtttgtttgtttgagacagagtcttgctcagtcgcccaggctggagtgcagtggcgcaatctcggctcactgcaagttccagcttccgggttcacgccattctcccgcctcagcctcccgagtagctgggactacaggcacacaccaccacacctggattttttttgtatttttagtagagacagggtttcaccgtgttagccaggtcgatcttctgaccttgtgatccgcccgcctcggcctcccaaagagctgggattgagcactttgccaggtgtgagccactgcgcccggccggtttcttgtttttaaaagatgaggttgaagatctttttgtctgatcatggaggtgaaatgcaggtgaataacctgcagggggcagcagagtctgaggccggtgactccacgctgaggccagcctggagcctacaaagggaagaaaacggagctcccctgagggcttcccaggcagccctccctccccagcaggtggcatccagctgcgcagagcagctgcagaacggctgtggattctgagaaggtgcagaggcctgaaaagctggaaaccttagtgcagatcccctgggggttctgtcctttctgggtttgcctgtctggagcctggggccattttccggacaatgctttggttttgatatgtgtagggtcactagggtcaatagtgtaatttgtatatatgaagaaaatgcgtccaggcaccctggctcttgtctctaatcccaacactttgggagggcgaggtgggtgattaggttgagcaccggagttcaagaccagcctgggcaatatggtgagaccccatcactacaaaaaatacaaaaattagctggttgtggtggtgaatgcatgtatccccagctactcaggaggctgaggtgggaggaacgattgagccctggaggctgcagtgagctgtgatcgcaccaccacacttaagcctaggtgacagtgagactctgtctccaaaaaaaatgtgtggtaagtcaggctcagagacagaattgtttgggatgttgagaaagagttaatgaagttgacagtttattcaggtcacaaacttaaactcaccgcaggtgagagtttcctgacagtgaaaataaagttctggaaggagagagcattttcacactgtgacgaggaatgtggatgtgagaaggccttggccttgcctcattccaaattatcttgacctgcagaacatctgtctctccctcctgatgtagtcttgcctggcctcatctgggctcctctcctactctgaggcaaggggatagctttgatggagcgataggctcttgacccccaaaacatttgctaaaatatcgttgacataaagctgattaatatgagaaaggcatatgaatttatttaccatgtatacagggctgcctttagtaagaagacccacccaacaataagatagaaaagcttatataccatcttgaggctgttactaagggaggagaccacccgtcatattgtcgtatgcccaatttctgcctccaaagaaagaagaagtaaaaactaaaaggcagaaatgaaatccacaagcagacagcccggcgcctcaccctgggcctggtagttaaagatggacccctgacctaatcagttatgttatctatagagtacgcacattgtatagaaaagcactgtgaaaatccctgtcctgttctgttccggtctaattaccggtgtatgtagcccccagtcacgtaccccctgcttgctgaatcgatcacgaccctctcaagtagacccccttagagttgtgagcccttaaaagagacaggaattgctcactcagggagctcggctcttgagacaggagtcttgccgatgctccctgcccagtaaaacgcgtccttctttaactccgtgtctgaggggttttgtctgcggtttgtcctgctacattaccagaaaggggtcctaattcagactccgggagagagttcttggttctcatgaaagaactcagggtgagtccttagagtaaagtgaaagcaagtttattagagaagtaaaatctcaggccaggagcggtggctcatgcctgtaatcctagcactttgggaggctgaggctgccagatcacctgaggtcaggagttcaaaactagcctgggcaacacggtgaaaccctgtctgtactaaaaatacaaaaaaaattagccaggcatggctgcatgtgcctgtagtcccagctactcgggaggctggggcagtgaggtggaggttgcagtgagctgagattgcaccaccacaatccagcctgggcaatagagggatactccatctccaataaaaaaaaatgaattgggtttaacattaataaaatatcagtaataattataatttttatgtgaaattactgtgtgtcacagaaatgaccagaccttaataatggatgttcttcgccgggtgcagtggctcaaagtgctgtaatcccagcactttgggaggaagaagtgggtggatcacgacgtcagggattcaagaccagcctggccaacatggtgaaaccctgtctgtactaaaaatacaaaaaattagctgggtgtagtggtacatacctgtaatcccagctactcaggaggctgtggcaggagaattgcttgaacccaggaggcagaggagatctagaccatcctggctaacacggtgaaaccccctctctactaaaaatacaaaaaaaaaattagccgggcgtggtggcaggcgcctgtagtcccagctactcgggaggctgaggcaggagaatggcgtgaacccaggaggcggagcttgcagtgagctaaaatcgcaccactggactccagcctgggtgacagagcgagactccgtctcaaaaaaataaaaataaaaataaaaacccgggtggacaagaaacaaaaaataaaaagaattttaaaactgtaaaactgttgttgagtactaatgtgctcataactattgagcagaacagaagtttatgacatagactgaactaagggaagactaaaataatctttttatagctttttgtttaaaatattgctaattcttttgtttttcaaagtccagaaaaacttttttttttttttttttgagatggaatctcactttgtcacccaggctggagtgcagtcactcaatctcagcatctcgctcactgcaacctccacctcccaggttcaagtaattctcctgcctcagcctccagagtagctgggattacaggcacccgccaccaggcctggctaatttctgtattttttagtagagactgggtttcgccatgttggccagctggtcttgagctcctgaccttaggtgatctgcccgccttggcctcccaaagtgctgggattacaggcgtgagccaccgtgcctggccataggtatcactttctttacggcccagaacaaatagccctcctaaacaaataatgtacataactcacaaatttcttgcttaccatcaaaaaccttgatttatcaaacatttcaggtgacaaaacaatgcaagttcccaagttgcattctataaaatctctagcaaacctttgtttctttgcagccggctcccttctgctggttctgcctgttgccttcttgcaaggtactttcatattttccttaataaatctgcctttttttttttttttttttttttttttacctacaactgtcttggtaaatccctttttttttttttttttttttttgagatggagtcttgctctgttgcccaggctggagtgcagtggcacaatctcgactcactgcagcctttgcctcccgattctccagcgattctcctgcctcagcctcctgggtagttgggattacaggcgcccaccaccaagcccggctaatttttgtatttttagtagagatggggtttcgccacattggccaggctggtttcaaactcctgacctcaggtgatccgcccgcctcggtctcccaaagtgctgggattacaggtgtgagccacatcgcccggccagtcttgataaattcttttacccttgcgccactggcccagatagtagccactcacccacaacatagatgaagactcccacagagagaatggatgcaaaatgcttcttttaagaatttctggccgggcacggttgctcacgcctgtaatcccagcactttgggaggccgagacgggcggatcacgaggtcaggagatcgagaccatcgtggctaacacggtgaaaccccgtctctactaaaagcacaaaaaattagccaggcatggtggcaggcgcctgtggtcccagctactcgggaggctgagacaggagaatggcgtgaacccgggaggcggagcttgcggtgagccgagatcgcgtcactcactccagcctgggcaacagagcaagacaccatctcaaaaaaaaaaaaaaaaaaaagcaaaaccagaatttcttacttattttgttttttggtctcactctgttgcccaggctggagtgtactggtgcaatcacagctcactgcagccctcgactcctgggccaaagtgattctcctgccctggcctcctaaagtgctggtattacaggccccagccaccttgcctggcctctttccagactttttttgtttttgttttttttgagacggagtttcattcttgttgcccaggctggagtccagtggcatgatctcggctcactgcaacctccgcctcccagcttcaagtgattctcctgcctcagcctcccacatagctaggattacaggcgtccgccaccacgactggctaatattttgtattttagtagagatgtggtttcaccatgttggccaggctggtctcgaactcccgaccacaggtgatatacccgcctcggcctcccaaagtgctgaaattacaggcgtgagccgccgcgcccggctttccagacttttaaaagtgtcagactctcaatttctcccggatcagggaaagggaaaaggggagagggggcatggcttcactaatggaaatactccatagacgcaaatttcaccccccagaagacagttgtgcaagggcaaagctgcagccattcgaaattgccaaataaatatattttggaataaaatattttaattgctttcacctctattaaacatagagtctggaactccctgcacacacttatgacactgtgcaggacgaagaagcagggacagaccattgaca

SEQ ID NO: 317 - DNA, 9538 bp, Homo sapiens
tggaaaaatttatatttaggagaatttaaaatttttccttaccattttagggaggtttgaatttttcccctgaagttttggtaatctgaatctataaaacaaacataatacatagattaacaagggaaaaggatgtacaaattttattgtgtgcatacgtgtgcacaggagtcatgactataaaaaaaacgcaaaggcaagatggttaacgcttttgtatcatcttgatgttacagagagaatggggggctcagattgtggcaaagcaggatattgtggaaagacagttatgagtgggggagaagaggagaaacctgggcaaaggcagtcttgttatgcagatgaaacctcacaggtggtagccccacagggcctctggtaaatgtttctgtcagacctttaaagttttagagctgagttgatctttcctagatccagacaagggcgggattcagagaaagcctgtttatatctgttgtttacttcactttatttcctctgcagatgcaaatcatcctcacaaaagacagctttgctggccgtttgtaagatgttcaaaatacttaataagttttgtgccaccctctggcttgttttttcattcttttaagagtgtgttttgaagaggagacattttttattctggagagggcccatttaacaaattattctttctagatcatggttttgttgttgtagataagatgtctttgcctagctgagggttcttcttctagaagttgtataattcttgattttatatttgaatttatgttctatttcttgttaattttagggatagtcagtttttccaacattgtttgttgaaaagactgtcttttctctattcagtttcctttctactatcttgaaaatcagttggtcatatatgtacgtgggtctgtttctggtctttattccattgatctgtgtgtcctttcaccagtactacactaccttgatcactaccttgtgataagtcttgaaatcacatagtgagaattctccaacctcatttttcattttcataactcttttggctgttgtaatttctttgctttttcttatacaaagtaattaatcattgctagaaacataaaaatacagtttatgtttgtttactgaccccatatattgtgattttattaaactcactgtttatgtccagttcattttaaaaaatagattcattggtgttttctatatagacagtgattttttcttctaaataaagacacttatttcttcttttcaatctctatgacctttcttttttttttttttttttttttggctgccattgcactgcctaggacctccaatatcatgctgaaaaggagtgttgagagcagatattcttgccctgtttctgatcttacagggaaggtattcagtctttcatcattaagtaggaaattagctgtagtttctttgtagttatctgtttttaggttgagagtgtttccttcagttcatagtttactgagagttgttataaacggatgttatatttttgtaaagcttttttcacatctaataacatcatcatatggtttttcttagaacattgctttagtgaattttttttattggctttgaatatactgaattagccttgtattcccaggataaatccattgctgcatatatatatatatagagagagagagagagagtgcatgcaagagaatgagcatgcgagagagtgagcaagcgtgtgtgcaagatgtttatatattgctggatttgatttgctaacattttgtcatggatttttacatctttgttcattagaaatactcatctgtcattttcttgtttgctttttttttgtcttgatattagagccttatcaaatgagttgaaaaatatttcttcctatttgtttttctggaaggatttgtatatgatcagtattatttcttaaatatttgatagaatttaccagtaaagccatttgggcctggagttttccttaaaaaaaaaaaaaaattaggagagtttttttagagttatgattaaatttttctttaatggatagaggagtatatttatttcttcttcagtgagttttgatattctttctttgcaaaactttggctatttctacagagttgttgggcttatatgcatagagttaaatctaaaattttcccattattctttgttttttgagacagagtcttgctttgtcatttgttagaaataaattttcggtgccaccaaagaaatagcactcaaacataaattttctcagcaaggcaattttacttctatagaagggtgtgtctcgcggatggagcaatggcaagagtacacctgaacaaaggaggggaaggggttcttatccctgacgcaggtagcctctactgctgtgtcgttcccctattggctagggttggaccacacaatctaagctaattccaactggctattttaaacagagcagggatatgagccagagtggcggggtgagcagtttcggcaggaaagacggttatggaataggtgactaaaggtgactcaggtcagagtaggtgaccaggggtgactcaggacggagcaggtgaccaggggaacagatgtgaactactgattagaactggcgggaaggttgtttactgaaactaggggcaaagagatgaagagaacaaggaagttaaacttgaaaatggagaacaaagaactgaacatactgacatactgattctttgaagagaaacttagaactcgctgtgtttaacacccaggctggagtgcagtggcgcaatcttggctcactgcaacctctgtctcccaggttcaagtgattctcctgtctcagcctcccaagtagctgggattacaccaccatgcccagctaattttttgtatttttagtagagatgtggtttcactatgttggctgggctggtctcaatctcctggcctcaagtgatccacctgcctcagcctcccaaagtgctgggagtaccagcatgagccactgcacccagcctcttattattctttcaatgtctgttagatctatagtgctgtaccatcttttattcctgatgtttcagtgtatgtatttatgaattatattgatcttttcaaagagcctgcgtttggctgcattgattttatttttctgttttcagtatcattgattctgttcttattacagcacccctttgtttgctttgagtttaatttactgttctattttctaaaggtaaaagtttagataacttttttgtttaatataatttgtaatcatgtattaaaataaatttctcaaggacttctttagctccgttttgtaaattttgatgcattttcattgtcattcaatcaaaatattttctttttgtgtgtgtgaattcctctttgatctgtgggttatttagaagtgttttattttctaaatatttgagcattttctagatattttctgttattgattttttgttaatttcactgtggcaagatgatatatactttatataaatttcagggttttttcttttttttttcatacaaagtttcactcttgtcgcccaggctggagtgcaatggcacaatctcagctcactgcaacctccgcctcttgggttcaagcaattctcctgcctcagcctctcaagtagctgagattgcagatgtgctcccccatgcccagctaattttttttgtattattagtagggacggggtttcaccatgttggccaggctagtctcaaactcctgacctcaggtgatccacccacctcgccctcccaaagtgctgggattataggcgtgagccacggcacccggccagttttttcttttttaaaatatgttgaggttggtttcatggcccagaatatggtctgtcttagagaatgttccatgtatacttgaagacaatgtattgctcttgtatagagtgttctaaaattgtcattttggctgataacgttcatacagaataagtacctcacgatccttataataatatacttccaattcctcccggccaattttgtattattgttgtcatacattttacttttacatattctataaatccataatatatttccactattttgcctgtagactctcaattctattctgatgacctatatacgtctattcttatgtcagtactacacagtctgggttactgtaggtttgtagtgtgttttgaaatcaatacatgtgaatcctcacattttattgttccttttcaagattgttttggctatcctgggtgcctagaatttctgtatgaactttaggattagcttgtcaatttctgcaaaaaaagccagctggaattttaatagagagttcattgagtctgtagatcagtttggggagtattgctatcttctcaatattctcaatattaagtcttttttttttttttcctgagatggagtcccactcttgcccaggctgaagtactgtggcacatctcccaggcatgccaccacacccagctaaatttgtgtatttttagtagagatggggtttcaccatgttggccagactggtctcaaactcctgatctcaggtgatctgcccgcctcagcctcccaaactggtgggattacaggcctgagcactactcccggcctacaatattaagtcttttcatataaaatatgggatgtctttccgtatagttaggtctttagtttctttcagtgatgttttgtaattttcagtgtattggtcttgcacttcttttattggatttattcctttattctttggtagattgtttcttggtagtgtatagaaatacagttgagttttgtatattgatcttgttttaacacatttttaatgacactttaaaaaattttaagagtggataaatatccagcagttttattctgcagctgtaaactgttatttagaaatgtgatataattaatttagagtgacataagataaacacctgaaattgaaacctaggaattttgatttcttaggctttttaactatacatttagacacatcttattttatcaaataagtctgaaataaacataaataagttaacattttattttttattttagtgttaaatgtttacaaaagacagtgaaggattcttatcacataatgtgcaggccatgtgcctgtgaacttgaagtttgcgcaaaatgtggaaagaaagaagacattgttattccgtgagtgtttccttttatgtttgaattttactcttagtgattgatacatgaatttcttttaagagatgatccttgctaggcgcagtggctcacgcctgtaatcccagtactttgggaggccaaggcaggtggatcacgaggtcaggagttcaagaccagactggccaagatggtgaaacctcatctctactaaaaatacaaaaaaattagccgggcacagtggcaggcgcctgtaatcccaattactcgggagtctaaggcaggagaatcgcttgaacttggggggcagaggttgcagtaagctgagatggtgccactgcactccagcctgggtaacatatagtgggactccatctcaaaaaaaaaaaaaaaaaaaagagatgatccgtgatccataacccttagacttaagttgtatgtcaaactaatatagacttttaaaattatttttctatcattacaataaaagtgaaactatatttttaagaaaataaaatatttatgtgtgagattcatattcattacaaaagaattacacattatttaacaacttttcttttaatagacatcatatattaatttatttgagcctactttagtgacaatagtattataattggttggatctcaagttagcgttcaatgattttttttttttgagaaggagtttcgctcttgttgtccaggctagagtgcaatggcacgatcttggctcactgcaacctccgcctcccaagttcaagcgattctcctgcctcagcctcccaagtagttgggattacaggcttgcaccaccacacccagctaattttgtatttttagtagagacggggttttgccacgttggccaggctggtttcgaacccctggcctcaggtgatctgcacgccttggtctcccaaagtgctgggattacaggcatgagccaccactcccaggtggatctttttctttatacttacttcattaggtttctgttattcaagaagtgtagtggtaaaagtcttttcaatctacatggttaaataatgatagcctgggaaataaatagaaattttttctttcatctttaggttgaataaagaaacagaaaaaatagaacatactgaaaataatctaagttccaaccatagaagaagctgcagaagaaatgaagaaagtgatgatgatttagattttgatattgatttagaagacacaggaggagaccatcaaatgaattaatatcactgtattaaaagtctgccgggcacagtggctcacgcctgtaatcccaacactttgggaggccaaggagggtggatcacctgaggtcaggagttcgagaccagcctggccaacatggcggaaccccatctccactaaaagtacaaaaaattagctgggcgtggtggctcatgcctgtaatcccagctactcaggaggctgaggcaggaggattgcttgaaccctggaggcggagattgaagtgagctgagttcgtgccattacactccagcctgggtgacagagtgagactctgtctcaaaaaaaataaaataaaaagtcaatttagaatgtgaaattctgaccaccttttggctttgagtattttccaaaagatatttgaaatcctaatgaggaaatcagaaaaagctatggaaaaatagacaaatttcatacatgaacaatataaattgtgtatattacttaacatcaaactaaacaagattcagaattgatggttgtataagaactagctcatgtaaaaataaaataacattattacattgcctcaaaaattggtcctcggtaagtgccttttgataaatgatctcaaataaatgactcatagcaaaagccctgtcgcttatgtttaatttttacaaagtaaaagcaattttttccaaataataatgtttaacaagcgtatagcaattctgctttgtatttttatatatttcatcacattttaacttttttctcgtgaaatgtacatacagaaaaagtgcatataatttatacactttataagtgtatgcattttttataataattataaaggaaagttcatgcatttacacacctcggtgaggaaactgccagcatcaggacaccccagtgaggctctccctcagcaaaagttcatctttcttcccatagttggcactattctgaattttgatcattattgtcttaatttttttactacccatgtttgtactcctaaacaatataaattagcttggtctgggttttgttgttttttttttttaactcttctttttttattacgtttcttattttatttctttaattttatttattttattaatttatttttctgagacagagtttcactcttgttgcacaggctggagtgcaatggcgcaatctcagctcactgcaacctccacctcctgggttcaagcgattctcctgcctcagcctcccaagtagctgagattacaggtgcccgccaccacgcccagctgatctttgtctttttagtagagacggggtttcaccatgttggccaggctggtcttgaactcctgacctcaggtgatccacctgcctcggcctcccacagtgctgggattacaggtgtgagccaccatgccaggccatattttttattttttattttactttttttttttttgagatggagtctcgctctgttgcccaggtagagtgcagtggcatgatctcggttcactgcagcctccacctcccgggttcaagtgattctcctgccttagcctccctagtagcggggactgcaggcctgcaccaccacacctgggtaatttttgtatttttagtagagacgaagtttcaccatgttggccaggtggtctcgaactcctggcctcaagcgatccacccaccttggcctcccgaaatgctggaattacagacatgagcctccacatctggcccatagtttgttttttctaacattgagagacatttgagttatctcacatttttcctgttacatcaatactagcatgagcattgttacatgtgtctgttggtagacctgtgcatttctgttaggtatgtatctagcagtggtagagggaatcaggtcgatgcatcttcacttttgctatgtaaaacaaaactttgccggagagattttatccccttgttcatagaaatggattagaatttcagcactctgcatcttctaatacttggtatcagacttttaaatttctgccagttgaatatgtgtgcaatagtatctctttgtcttaataattgtatttctaattacaaataagcttgagcccctttttgtgtttattggctatttcacttttgataataggtgatattagggaataatttaagtggaatgttattttagaaatccatactgaaatacttaaggatgtaatactaatttactgtaaaatatttcagcataaaaaaagtgcagacatagataacatttcactgacatcagaaaatattacctgggaatacatcaaaaagtattcaagaactctgtcaacaaaaatataaaatcttatcaagacattaaagaaagtggaggctgggtgagttggctcatgcctgtaatcccagcactttgggaggccaaggcaggcagatcacctgaggtcaggagtttgagaccaacctgcccaacatggtgaaaccctactaaaaataacaaaaactagccgggtgtggtaggtgcctgcaatcccagctactccggaggctgaggcaggagaatcgcttgaacccggtaagcaaaggttgcagtgagccaagatcgcgccattgcactacagcctgggtgacaagagcaagactccatctcaaaaaaaaaaaaaaaacgtggagacaaaaatgaatagaaatactatcttcacaatttgaaagtctcagtattctaaacatatagcctgactgaaagaaatgttctgtcccgctgggcgtgttgcctcacgcctgtaatcctagcacttttggaggccaaggcggacggatcacctgaggtcgggagttcgagaccagcctgaccaacacagagaaaccccatctctactaaaaacacaaaattaaccacgcctggtggcgcatccctgtaatcccagctagtccggaggctgaggcaggagaatcacttcaacccaagaggcagaggttgtggtgagccaagatagcgctattgcactccagcctggggaacaagagtgaaactctgtctcaaaagaaataaattttctgtccataaatttgtgtggctttccttttttgcatataaacttcttttctggactatttaacttttgtgattaaggagccaactaaagtcttactggacctaccataaattctttcccatgtgaatgaatac

SEQ ID NO: 318 - DNA, 9591 bp, Homo sapiens
gaaacagtaatcccacaatttagtgctgataccaaatcctagagagggagacaaacggggagaagatgaggcattgaaggagcaggcgtgcgctggcttgggaagggtgccagggtagggataagaggtggagacaatgtcaatatctgtccccttggccttcccaactcccgaggccattctggcagaagtcaagggtggggaacctgtgtcttttattgtccccagcatgaagctggaataaaccctaattccttatctggccttcgtttctaggctacgtggccccctcccaccccccacctccatctccttccccttccttggggcccaagttcattcctgcctcagggctttgcaccagtcgctcttgggacgccagatgctgatttctcttcattagggtcttagctctaatggcacctctgcaatgacacctggaccatttaatctctttgctgtccaactagcccttagccacacatggctactgagcactagaaatgtggctagagctccagagaaactgaatttctaacttcatttaattctgatgaattaacatgtcaatgtaaaaactgatgcttgattgagttactggaatttttttttttttttttttgagatggagtttcgttcttgttgctcaggctggagtgcactggtgtgatcttggctcactgcaagctccgcctcctgggtccaagagattctccttcctcagcctcctgagtagctgggattacaggcgcgcaccaccatatccagctaattttttgtgtttttagtagagagggggtttcaacatgttggccaggctggtcttgaactcctgacctcaggtgatctgcccgtctcggcctcctcaagtgtgttaccggaaaatgtttaagcatgtttggagcaacttacctatgtgaactactgtttgcaaattttataaaatctagatatggatctagtatttctaatgaaactttagtatctgaattgagatgtgctgtaagtacaaaatacaccttagatttcaaagacttagtataagagttgctaattatttttttttaaagagactttacaaaaagggtctcactctgtcacccaggctggggtgcagtggcatgatcatagctcattgctgcctcaaactcctgggctcaaatgatcctcttgcctcagccttctaggtagctgagattacaggtgcatatcaccacacatggataattaaaacttttttatgtagagacaaggtcttgctatgtttcccagactggtctggaactcctggcttcaagcaatcccctgcctccgcctcctatagtgctgggattataggcctgagccactgcgctcagccattaatgattttttaatgttgattacatgttgaaataataatttgcttatgttaagtaaatgttattaaaattcttttcatctgtttattttcatgtcttagtgtggccactagaaaatttaaaatcacatatgtggcccacataatatgtcagtggaaatcgctggaccctcccccacctatgtgatattccatcaccttgctttactttcttcttcttcttctttttttttttttttttatagacagagccttgctctgttgcccaggctggagtgcagtggtgcaatcttagctcactgtagcttctgcctcctggattcaagctattctcatgcctcagcctcccaagtagctgagattataggtgggcacaaccacaccccgctaatttttgtatttctagtggagacaggtttcaccatgttggccaggctggtcccaaactcctgacctcaagtgatctacctgcctcggcttcccaatcccctcggctgggattacaggtgtgagccaccacacccagcccctttattttctttatggcatttatcacagtttgaaatctttgccatttattgatgtccttgcctgtctctgcacagctgtctgcaccagggaagagagtagagggaaccctctgtatatgccccgtacatggaacagtgccttgccgttcccaggagctcgatggtagttggcaaataaatcaatgaacacacatagggggctgggaagcacaggcccatcctcacctgacttctgatgtgcaaagtggtgcttgacgtggtgggccttcaggctgtacaggtaggagcccttgtgcggcgagccaaagtgcaggtagtaatgggtcatgtcatagaggacgtagcccaggaggccccccgcaaacacagtgccccctactgcctcgggcaggatgagctgcatgcacaagtagaagacgccgatcaccagggaggctggcacaggggggaagaccaggcgggagccgtcgaagggtgcctgcagatggagaggcttgggcatcaggaggcagccaggggccccggcagctggccaaaccctggccactccctgcagaggacaggggcacagcggcccagacattccactgcgtaggcttggcacctttggtggctttggggagggcgggccaccacgtctggaagatctggagagactgtcttacttcccatttgtgagccaggaagggacctggcagattgcaaaggaacatgggatgggcgggatgggcaggatgggcaggatgggtggggtgtgctggcggctcagagcccatcttatagaggccactgtgactctggaatttgtcaggtgctagacaggtatcccatccctaaatgccgtgcccctggctagaggggcattctggagacagggcacctagactgaggcctgatgttgtctgggagagcaaggcactgagggcaactgaggttaatgcagcctctgtggcgggatgacccggaagtgtcactagaggtgtcctccccacccccatgtccaaacaggaggccttttttgttccaagggggtgtcgccacagtgaaccagagaacaccgcttcaccgtggccctcgagcttcagaagccaagggcctggcatagaggtgagatcttagctatggcttggtgaggagtctgagaagagaatcctgcagcctctctgggctggaggagagagagagaaagcaggtgacagtgacacaatgagatgctggcgtgggcctccctcccttcagaccaggaacaacaggaccagtgatgtgctggaaaaccagctctcaggaaaaggaggaagggagagagctggggaatgagggagggggaaataaagggagggagggagagccctgattggtagtgtttgccaattcctgcagtgtgaaaactgccctggcgctttcaagcgctgaggtggcgtcactggaacagaaacaggaaaggatgtgcatgggtgctcttgtgagctggtatgggccagatccgggtcacagctggatcaggatccttagatggataggtctggggatctgagaacacgttcctgattggagcccacgtggctacaggccatacagtctcctcgggtcctcatggtgtggcagcaggggactggacagactggggtggaagtgtctcaaaagagggagcctgagacagcccctggggccccagaatggcctgagcaggttcccagaaggttctggtgtcccctgtggatgggaaagatagcggacagggcagtggatctgaaaaggcttcacaaacagggcaagggacacagaagcagatgcagtgagctctgcagagcagaggccaggtgaggctggaggacacaggccaggcctgggctgcgctacctctgagagcatacctgagagacaggttggcccaggactgggcacccaccctgatactggcccctaggaaagccccctaggatgcagatcaactctggggagagccgggaggaccacagccaaccaacctgagaactgtcccaggcggccgatcaaaccccgaatcggctcatcgagatgaaccggattaagttgctgctgggaaaccaaggtgaaacccacgttcagtatcagcgacatcagggtctaaactggtgtcccgaaagtatcatatctgccatattttctctgatttatgcccagcagagaacagagtgtggagacgggctggggaacagcctgggatgggccaaggacagcacaatgcagggacagagaagcagcggggggtacaggggaggtagcttcctttgggcagacctatcttctcgggccagcttctgggactgtcgtggagtccttgaagggcctcaggggaagggtgattgagagcgcagactctggaatccccagaatggggtacgacatcctggctgtgccaagtgtgacctggggcaagttccttagtcctcctaggcctcagtctcctgctctgtggaacggggagaaccatggggctgttttcagcacaagctccaggagcgcaaggctttttgttgttttgttcaatgatgtctagaacagtgtctcgcacacaggaggcactcactgggcatttgctgaatgaatgaacgaatgaatgagttgttttgaggattaaaggtgatgcgtaaacaagggtgcagagggcctggggtcagcttgatgctgcacacccacgctgtccccgcctggcttaggttcggatgcccaacccagttgccccgtgagtcacatcaaacgtcccgtccctcccaacccacagccagactcccaggaggctccgcagcacctgaagctgcggctggctgccgggccctctcgggctgcacatgctaggtccgggctgggaccccgccccgctcaccttgtggtgctggccgtgcatgacgaagtgcagcatgatgaggtaatagctgtcgctggggggcttcatgtggaacaggaagcggtggatgaggtactcgatgaggctccagaggaatgtccccagcatgaagagcccggggaacatggacttgggcactgccaccgtgtactctgcagggtggcagggagagcgaggtgaggaccggtgcatagcagcctggtagctccaggtgtccctgcctcaccatccccatcagctcgggagctgctgccctctgttggacagctacagggccaggccatactgctggggtccttgagtcaaaatgggaaggaggctgtaggactctggtctgggtctgggaagtcctttacaggagtgatgggccactggctggaggcctgacatcctccttacagaggctgtgggaggagtggctgtggctggggctgggcctttacctggaagggtgaccttgccccaaggacattggagaagagaaggcgacactcctgagccagggcgttgttattattatcttgagacaaggtatctctgtgtcgcccaggttggaagactggagtgctggagtgctggagggcagtggtgtgattacagcttactgcagccttcccttcctgggctcaagcgatccttccacctcagcttctcaagtagctgggaccacaggtgcatgccaccgcacccagctaattttaaatttattttttatttttattttttttgtagagacgagatcttgctatgttgcccaggctggtctcaaactcccagactcaagcaattctctcgccttggcctcccaaagtgctgagataacagaagggagccactgtgcctggcctccagggtgttaatgatgggaagtgtgacccaccagggaccatggggcaggaaggacaagaaaaaacaagcaccgagatctcaacagacaagacctgaaatcatagcacaggaggaagatgtgaaaacactgaagatgatcagcctaggtggagaggagaagactggagacagggcaccatcttcaagcacatgcttcccaccaccctccggagacagcctgcagtcctagcggctttcagctctttcctccacctcattcattctttgacctcatggagatttcagctctcattcctgtttgctccatatattcatcctcatcctttttttttttttttttttttttttttttttgtgagatagagtcttgctctgttgcctaggctggagtgcagtggtgtgatctcagctcactgcaacctccacctcccgggttcaagtgattctcctgcctcagtctcctgagtagccgggattacaggtgtgtgccaccacacctggctaatttttatatttttagtagagagggggtttcaccatattatccaggctggtcttgaaatcctgacctcaagtgatctgccctcctcagcctcccaaagtgctgggattacagatatgagccaccgtgcccagcccatcctcatcctcttatctttgtttcttttctctacaaaccatagctttggccatatcttctctcttcttaacggctttatctaaatctaattcacatccatataattcatccaaataaaatatataattcagtgctttttagtacactcacaaagttgttaaaccgtcaccccagtcaattttacaacatttttatcacttccccgccaagcccctgtacccattagcagccactccccatttcttctcagaccctcccaaccctaggaagctacaggtctacttcctctttgttggatttgcctattctggacatttcacgtcaattgaatcatatgacatatggtcttttatgaccggcttctcttaccgaatatgttcaacattcacccatgttgtaacatgtattacaactccattcctttttaagactgaatgatattcaaactttattcatccatccatcagttgagggacacctgggctgtttgtagctcttggctattgtgaatagtgctgctatgcacattcgtgtagaggtttcagtgtgaaaagatgttgtcctttctcttgggtacaagcccaggagtggtactgttggttcatatcataactctatgtttaaccttttgaagaatagccagactgttttccaaagctagccattctctctctcttttttttttgtgaggcagagtttcgctcttgtcacccaggctggagtgcaatgggacgatctcggctcactgcagcctccacctcacgggttcaagtgattctcctgcctcagcctcccgggtagctgggattataggtgtgcgccaccatgcccaactaatttttgtatttttagtagagacagagtttcaacatgttggtcaggctggtcttgagctcctgacctcaaatgatccacccaccttggcctcccaaagggctgggattacaggagtgagccatcatgcttggcctagccgttctcttttaacccttactccatctccctcacctgcacccatgaaccctcacccctgggtcagcgcaggaacctgcctttgtaccccatacccaagctgctgagcatggagactcacacagctgtgggtctggcacctttaacctctgcaagaccctagacacagcctgatggatgatccctgtgcatcttcaagttcagctccctccccactgcccttgaacacgctctactcccctttactgcctctccttccacccagcttcctacttcacagagaagagaggccctggggttggggaggaactatcccctccacatacttcccccaacttccaagcacaccacattctgccggtaccctggcgcatcctccttgcttctcagggaagaggtgtgcaccggcacgcgggcgctggatgatcagagcaacagtaacggcagatgtgtcctgactgattcctgtgtgccaggcaccgcccaagggccttccatggattacttcctatttcatctcaccacagccttacaagggaagccctgcattgcctgcatgattgaggacgtggaggcccaaagtccatgacttgccaggctccccctgctcggcagtgcaaagccctcagccgcctcctcccaccctccctcccaagggactcctctgggctccttcagtctctccttttctcctggctcttctgctcatctttctgaggtaggcaagactttcccatcatggactcagccccttcatcatcaaggctcctaaaaagtcaggctaggctgaacatgggggctcatgcctgtaatcccagcactttgagaggctgaggtgggaggatcgtttgagcccaggagtttgaggccagcctgggcaacacagtgagaccccgcctcaacaaaaagtaaaaaaattagctgggcatggtggctcatgcctatagtcccagctactgaggaggctgaggcagggggatcacttgagcccagcagttcaagcctgcagtgagctgtgattgcaccattgcactccagcctggatgacagagcaagaccctgtctcaaaaagaaaaaaagaaaagaaaacgtaggttggactcatggctccactttgccacttcccattggcttgtcaagtccttaaaaatctgtcttctgggccggatgcagtggctcatgcctgtaattgcagcactttgggaggctgaggtgggcggatcagctgaggtcaggagttcgagaccagcctgaccaacatggagaaacttccgtctctaaaaatacaaaaattagccggtcatggtggtgcatgcctgtaatcccagttacctgggaggctgaggcaggagaatcgcttgaacccgagaggcagaggttgtggtgagccaagatcgtgccattgcactccagcatgggcaataagagtgaaactccatctcaaaaaaaaaaaaaaaaaaaaaaatctgtcttctgccccaaaccaccagaacttcaaaggctattcatgatgtctttcttgccaaatctaagcatattttttagtccacctctaagctggctgtggcatatgacattagctctactctcttcttcaatctgcagctgcctaggcgtttaacctgaggcttatgaatatccgagggtactacgttggattgcagagtgtctgtgaacttgctaatatatcaaattgtacacctatgggcattttttctctgtactgtgtccacagtttctcaaattctcaaaggatccgggagcaataaggttggaatccatagctcccccttctgcctgccgccacacttggcttttctcctcttccctggatctccctgctcaggctccatcttggaaactctgccctttgtccccagggtccaaacctggaccctctgcctctcagctcaatcccttcctctcccacatgctgacgaccgaagctctacaccaactccaccctgggtggccacgccctactggacagctccatgtggttgtccacagtccccaccgtgaacacctcccaaatgaggccaaccgtcttcctccttcttcccgcccacctcctcttgggtttccttcctgggaggctgtggttactgacatccacatattaccaaaggagtcaggttcaagtgacccctctcccatggagtcttagctgggctggtctggttggtgagagaccctgcttccagagaaaccctgatacctctggggtccataaggtcattccggtgaagtgcagagagcacaggcattggatttgcagacctggattcaaatcctggctcagcaccgcctaggtgttacagtttcctcagggaaacaccctacccatcttgga

SEQ ID NO: 319 - DNA, 9631 bp, Homo sapiens
aaaagaaggcaaaactatcatcattttgacatttctgaagttttcttagcaatggactcataaaatacaatatagccatttttaagggaaatttggaaaaatttatatttaggagaatttaaaatttttccttaccattttagggaggtttgaatttttcccctgaagttttggtaatctgaatctataaaacaaacataatacatagattaacaagggaaaaggatgtacaaattttattgtgtgcatacgtgtgcacaggagtcatgactataaaaaaaacgcaaaggcaagatggttaacgcttttgtatcatcttgatgttacagagagaatggggggctcagattgtggcaaagcaggatattgtggaaagacagttatgagtgggggagaagaggagaaacctgggcaaaggcagtcttgttatgcagatgaaacctcacaggtggtagccccacagggcctctggtaaatgtttctgtcagacctttaaagttttagagctgagttgatctttcctagatccagacaagggcgggattcagagaaagcctgtttatatctgttgtttacttcactttatttcctctgcagatgcaaatcatcctcacaaaagacagctttgctggccgtttgtaagatgttcaaaatacttaataagttttgtgccaccctctggcttgttttttcattcttttaagagtgtgttttgaagaggagacattttttattctggagagggcccatttaacaaattattctttctagatcatggttttgttgttgtagataagatgtctttgcctagctgagggttcttcttctagaagttgtataattcttgattttatatttgaatttatgttctatttcttgttaattttagggatagtcagtttttccaacattgtttgttgaaaagactgtcttttctctattcagtttcctttctactatcttgaaaatcagttggtcatatatgtacgtgggtctgtttctggtctttattccattgatctgtgtgtcctttcaccagtactacactaccttgatcactaccttgtgataagtcttgaaatcacatagtgagaattctccaacctcatttttcattttcataactcttttggctgttgtaatttctttgctttttcttatacaaagtaattaatcattgctagaaacataaaaatacagtttatgtttgtttactgaccccatatattgtgattttattaaactcactgtttatgtccagttcattttaaaaaatagattcattggtgttttctatatagacagtgattttttcttctaaataaagacacttatttcttcttttcaatctctatgacctttcttttttttttttttttttttttggctgccattgcactgcctaggacctccaatatcatgctgaaaaggagtgttgagagcagatattcttgccctgtttctgatcttacagggaaggtattcagtctttcatcattaagtaggaaattagctgtagtttctttgtagttatctgtttttaggttgagagtgtttccttcagttcatagtttactgagagttgttataaacggatgttatatttttgtaaagcttttttcacatctaataacatcatcatatggtttttcttagaacattgctttagtgaattttttttattggctttgaatatactgaattagccttgtattcccaggataaatccattgctgcatatatatatatatagagagagagagagagagtgcatgcaagagaatgagcatgcgagagagtgagcaagcgtgtgtgcaagatgtttatatattgctggatttgatttgctaacattttgtcatggatttttacatctttgttcattagaaatactcatctgtcattttcttgtttgctttttttttgtcttgatattagagccttatcaaatgagttgaaaaatatttcttcctatttgtttttctggaaggatttgtatatgatcagtattatttcttaaatatttgatagaatttaccagtaaagccatttgggcctggagttttccttaaaaaaaaaaaaaaattaggagagtttttttagagttatgattaaatttttctttaatggatagaggagtatatttatttcttcttcagtgagttttgatattctttctttgcaaaactttggctatttctacagagttgttgggcttatatgcatagagttaaatctaaaattttcccattattctttgttttttgagacagagtcttgctttgtcatttgttagaaataaattttcggtgccaccaaagaaatagcactcaaacataaattttctcagcaaggcaattttacttctatagaagggtgtgtctcgcggatggagcaatggcaagagtacacctgaacaaaggaggggaaggggttcttatccctgacgcaggtagcctctactgctgtgtcgttcccctattggctagggttggaccacacaatctaagctaattccaactggctattttaaacagagcagggatatgagccagagtggcggggtgagcagtttcggcaggaaagacggttatggaataggtgactaaaggtgactcaggtcagagtaggtgaccaggggtgactcaggacggagcaggtgaccaggggaacagatgtgaactactgattagaactggcgggaaggttgtttactgaaactaggggcaaagagatgaagagaacaaggaagttaaacttgaaaatggagaacaaagaactgaacatactgacatactgattctttgaagagaaacttagaactcgctgtgtttaacacccaggctggagtgcagtggcgcaatcttggctcactgcaacctctgtctcccaggttcaagtgattctcctgtctcagcctcccaagtagctgggattacaccaccatgcccagctaattttttgtatttttagtagagatgtggtttcactatgttggctgggctggtctcaatctcctggcctcaagtgatccacctgcctcagcctcccaaagtgctgggagtaccagcatgagccactgcacccagcctcttattattctttcaatgtctgttagatctatagtgctgtaccatcttttattcctgatgtttcagtgtatgtatttatgaattatattgatcttttcaaagagcctgcgtttggctgcattgattttatttttctgttttcagtatcattgattctgttcttattacagcacccctttgtttgctttgagtttaatttactgttctattttctaaaggtaaaagtttagataacttttttgtttaatataatttgtaatcatgtattaaaataaatttctcaaggacttctttagctccgttttgtaaattttgatgcattttcattgtcattcaatcaaaatattttctttttgtgtgtgtgaattcctctttgatctgtgggttatttagaagtgttttattttctaaatatttgagcattttctagatattttctgttattgattttttgttaatttcactgtggcaagatgatatatactttatataaatttcagggttttttcttttttttttcatacaaagtttcactcttgtcgcccaggctggagtgcaatggcacaatctcagctcactgcaacctccgcctcttgggttcaagcaattctcctgcctcagcctctcaagtagctgagattgcagatgtgctcccccatgcccagctaattttttttgtattattagtagggacggggtttcaccatgttggccaggctagtctcaaactcctgacctcaggtgatccacccacctcgccctcccaaagtgctgggattataggcgtgagccacggcacccggccagttttttcttttttaaaatatgttgaggttggtttcatggcccagaatatggtctgtcttagagaatgttccatgtatacttgaagacaatgtattgctcttgtatagagtgttctaaaattgtcattttggctgataacgttcatacagaataagtacctcacgatccttataataatatacttccaattcctcccggccaattttgtattattgttgtcatacattttacttttacatattctataaatccataatatatttccactattttgcctgtagactctcaattctattctgatgacctatatacgtctattcttatgtcagtactacacagtctgggttactgtaggtttgtagtgtgttttgaaatcaatacatgtgaatcctcacattttattgttccttttcaagattgttttggctatcctgggtgcctagaatttctgtatgaactttaggattagcttgtcaatttctgcaaaaaaagccagctggaattttaatagagagttcattgagtctgtagatcagtttggggagtattgctatcttctcaatattctcaatattaagtcttttttttttttttcctgagatggagtcccactcttgcccaggctgaagtactgtggcacatctcccaggcatgccaccacacccagctaaatttgtgtatttttagtagagatggggtttcaccatgttggccagactggtctcaaactcctgatctcaggtgatctgcccgcctcagcctcccaaactggtgggattacaggcctgagcactactcccggcctacaatattaagtcttttcatataaaatatgggatgtctttccgtatagttaggtctttagtttctttcagtgatgttttgtaattttcagtgtattggtcttgcacttcttttattggatttattcctttattctttggtagattgtttcttggtagtgtatagaaatacagttgagttttgtatattgatcttgttttaacacatttttaatgacactttaaaaaattttaagagtggataaatatccagcagttttattctgcagctgtaaactgttatttagaaatgtgatataattaatttagagtgacataagataaacacctgaaattgaaacctaggaattttgatttcttaggctttttaactatacatttagacacatcttattttatcaaataagtctgaaataaacataaataagttaacattttattttttattttagtgttaaatgtttacaaaagacagtgaaggattcttatcacataatgtgcaggccatgtgcctgtgaacttgaagtttgcgcaaaatgtggaaagaaagaagacattgttattccgtgagtgtttccttttatgtttgaattttactcttagtgattgatacatgaatttcttttaagagatgatccttgctaggcgcagtggctcacgcctgtaatcccagtactttgggaggccaaggcaggtggatcacgaggtcaggagttcaagaccagactggccaagatggtgaaacctcatctctactaaaaatacaaaaaaattagccgggcacagtggcaggcgcctgtaatcccaattactcgggagtctaaggcaggagaatcgcttgaacttggggggcagaggttgcagtaagctgagatggtgccactgcactccagcctgggtaacatatagtgggactccatctcaaaaaaaaaaaaaaaaaaaagagatgatccgtgatccataacccttagacttaagttgtatgtcaaactaatatagacttttaaaattatttttctatcattacaataaaagtgaaactatatttttaagaaaataaaatatttatgtgtgagattcatattcattacaaaagaattacacattatttaacaacttttcttttaatagacatcatatattaatttatttgagcctactttagtgacaatagtattataattggttggatctcaagttagcgttcaatgattttttttttttgagaaggagtttcgctcttgttgtccaggctagagtgcaatggcacgatcttggctcactgcaacctccgcctcccaagttcaagcgattctcctgcctcagcctcccaagtagttgggattacaggcttgcaccaccacacccagctaattttgtatttttagtagagacggggttttgccacgttggccaggctggtttcgaacccctggcctcaggtgatctgcacgccttggtctcccaaagtgctgggattacaggcatgagccaccactcccaggtggatctttttctttatacttacttcattaggtttctgttattcaagaagtgtagtggtaaaagtcttttcaatctacatggttaaataatgatagcctgggaaataaatagaaattttttctttcatctttaggttgaataaagaaacagaaaaaatagaacatactgaaaataatctaagttccaaccatagaagaagctgcagaagaaatgaagaaagtgatgatgatttagattttgatattgatttagaagacacaggaggagaccatcaaatgaattaatatcactgtattaaaagtctgccgggcacagtggctcacgcctgtaatcccaacactttgggaggccaaggagggtggatcacctgaggtcaggagttcgagaccagcctggccaacatggcggaaccccatctccactaaaagtacaaaaaattagctgggcgtggtggctcatgcctgtaatcccagctactcaggaggctgaggcaggaggattgcttgaaccctggaggcggagattgaagtgagctgagttcgtgccattacactccagcctgggtgacagagtgagactctgtctcaaaaaaaataaaataaaaagtcaatttagaatgtgaaattctgaccaccttttggctttgagtattttccaaaagatatttgaaatcctaatgaggaaatcagaaaaagctatggaaaaatagacaaatttcatacatgaacaatataaattgtgtatattacttaacatcaaactaaacaagattcagaattgatggttgtataagaactagctcatgtaaaaataaaataacattattacattgcctcaaaaattggtcctcggtaagtgccttttgataaatgatctcaaataaatgactcatagcaaaagccctgtcgcttatgtttaatttttacaaagtaaaagcaattttttccaaataataatgtttaacaagcgtatagcaattctgctttgtatttttatatatttcatcacattttaacttttttctcgtgaaatgtacatacagaaaaagtgcatataatttatacactttataagtgtatgcattttttataataattataaaggaaagttcatgcatttacacacctcggtgaggaaactgccagcatcaggacaccccagtgaggctctccctcagcaaaagttcatctttcttcccatagttggcactattctgaattttgatcattattgtcttaatttttttactacccatgtttgtactcctaaacaatataaattagcttggtctgggttttgttgttttttttttttaactcttctttttttattacgtttcttattttatttctttaattttatttattttattaatttatttttctgagacagagtttcactcttgttgcacaggctggagtgcaatggcgcaatctcagctcactgcaacctccacctcctgggttcaagcgattctcctgcctcagcctcccaagtagctgagattacaggtgcccgccaccacgcccagctgatctttgtctttttagtagagacggggtttcaccatgttggccaggctggtcttgaactcctgacctcaggtgatccacctgcctcggcctcccacagtgctgggattacaggtgtgagccaccatgccaggccatattttttattttttattttactttttttttttttgagatggagtctcgctctgttgcccaggtagagtgcagtggcatgatctcggttcactgcagcctccacctcccgggttcaagtgattctcctgccttagcctccctagtagcggggactgcaggcctgcaccaccacacctgggtaatttttgtatttttagtagagacgaagtttcaccatgttggccaggtggtctcgaactcctggcctcaagcgatccacccaccttggcctcccgaaatgctggaattacagacatgagcctccacatctggcccatagtttgttttttctaacattgagagacatttgagttatctcacatttttcctgttacatcaatactagcatgagcattgttacatgtgtctgttggtagacctgtgcatttctgttaggtatgtatctagcagtggtagagggaatcaggtcgatgcatcttcacttttgctatgtaaaacaaaactttgccggagagattttatccccttgttcatagaaatggattagaatttcagcactctgcatcttctaatacttggtatcagacttttaaatttctgccagttgaatatgtgtgcaatagtatctctttgtcttaataattgtatttctaattacaaataagcttgagcccctttttgtgtttattggctatttcacttttgataataggtgatattagggaataatttaagtggaatgttattttagaaatccatactgaaatacttaaggatgtaatactaatttactgtaaaatatttcagcataaaaaaagtgcagacatagataacatttcactgacatcagaaaatattacctgggaatacatcaaaaagtattcaagaactctgtcaacaaaaatataaaatcttatcaagacattaaagaaagtggaggctgggtgagttggctcatgcctgtaatcccagcactttgggaggccaaggcaggcagatcacctgaggtcaggagtttgagaccaacctgcccaacatggtgaaaccctactaaaaataacaaaaactagccgggtgtggtaggtgcctgcaatcccagctactccggaggctgaggcaggagaatcgcttgaacccggtaagcaaaggttgcagtgagccaagatcgcgccattgcactacagcctgggtgacaagagcaagactccatctcaaaaaaaaaaaaaaaacgtggagacaaaaatgaatagaaatactatcttcacaatttgaaagtctcagtattctaaacatatagcctgactgaaagaaatgttctgtcccgctgggcgtgttgcctcacgcctgtaatcctagcacttttggaggccaaggcggacggatcacctgaggtcgggagttcgagaccagcctgaccaacacagagaaaccccatctctactaaaaacacaaaattaaccacgcctggtggcgcatccctgtaatcccagctagtccggaggctgaggcaggagaatcacttcaacccaagaggcagaggttgtggtgagccaagatagcgctattgcactccagcctggggaacaagagtgaaactctgtctcaaaagaaataaattttctgtccataaatttgtgtggctttccttttttgcatataaacttcttttctggactatttaacttttgtgattaaggagccaactaaagtcttactggacctaccataaattctttcccatgtgaatgaatac

SEQ ID NO: 320 - DNA, 9831 bp, Homo sapiens
gcagatttagcaaaagggatacttagggctgaagaaaggccttaaagaatgctgtaagtggtggtagcctgcacatgcccttcctcctccccctccctggagaggtactcatcccactcagggaccagagcctgcccctgctagatgggaattcgtctgacacagcagtcctcacctccgccttccagcggtgtttcacgtccgtgtagacctcaaccaactcatcgatctccttaacggatgtctctggggtggtgtgcagggggataatcacgaagtctttgacagctgagaaacaggaaagaggcgggggtcacacacttcccctgtcaaggtctcataaacactgctggagggaaaccagctgtcccctccagaaggcacaggctgcattatctgggtccccagttcccagagggtccagccagtggccgagattttaatgatcttggggtcattaggctgcctatttttagtacacgaaagactcatttctcccagttgcccttcatggctaagagaaagctggtagactgttgtagaaagtaaaaaagtttcctcttcaaagtttcccttcttattaaagaataaatcataagtgttagaaataatagtttcctttaaagactaacttccttcaagtctccttgctttgtgctaataactctttgttaagctctatcctatgtagctgttagacatgctcacaggcacatagtacattctatgtccttgtaccttaaccaagatatttgtgctggacattccagctcgcaggcacattccagctcacagcctttgccccttccctatttggcataagcaacttcctcttttcctttgttctcccttgcctttacctatttaagaaaggtttaaattattagccagtcgggttagcttagattgtgtggtctggctccagccaatagagagacaggacacagtagcagggacaagctgagtaaaggataaaaattgcttccctcctttattcaggtgtgctctcgccattgttccatctgcaaggagcaccctttctgcagaaagtaaaattggcttgctgagaaaactttttatctgaatgttgatttttccttgcagtaccagggaacaagcattctgtttctaaataaacattttacttataacaactgtgttccatgctggcattgtgagtgcttttattttcccctttttgtgtgtgtggcaaatctgtattttcttttgtttctgatgtattttatccctcttctttctttttttaattgacaggaaaaattgcatatatttatggttgtattttcttcttttttttaaaggtttcctttttttttttttgagacggagtttcgttcttgttgcccaggctggagtgcaatggcacaatttcggctcactgcaacctctgcctcccaggttcaagtgattctcctgcctcagcctcccaagtaactgggattacaggcatgcaccatcatgcctggctagctttgtttttttttttttttttttttttttggtagagacaggatttctccatgttggtcaggctgctctcaaactcccaacctcaggtgatccacccatctcagcctcccaaagtgctgggattacaggtgtgagccaccacacccagctgggagttacaaaaagagtataaactgacccatctcagcctcccaaagtgctgggattacaggcatgagccaccgagcccagtcgcacattttctagttaaaaaaaaattggccaggcgtgttggcttacttctgtaatcccaccactttgggaggctgaggctgatggatcacctgaggtcgggagttccagatcagcctgaccatcatggagaaaacctgtctctactaaaaatacaaaattagctgggggtggtggcgcatgcctgtaatcccagctacttgggagactgaggcaggagaatcgtttgaacttgggaggcagaggttgtggtgagcctagatcacgccactgcactccagcctgggcaagaagagtgaaactctgtctaaaaaaaaaaaaatgaggcttgtcagtttatactcctttgtaattaagaacaaaagttccaaaaagctatttaaaaattagcatggtcttcacgaaagacttttgtgaagtgtctgaaaaccttcccccaccgttggaggactgagagcctgagtgtggcaatgtgcgcgagcctcagaagccgttcctggcccacctgctaacagcagctgtcgccttctgagcagctcctcctgggacttcccctcattctcagcctggattcccactcttacctcaacagacacgggctgtggggcggtcactgctcaagtcacacagagaggagccagaactcagcccagcaggctgcatccagggccccacgtgtcctcattgccagctctcctcctcaggcctccactgcactcctccatcctctttttggtccccctaaatattccagcttccttcccacttctgagcttttgtgctcactgtgccctccatgtggaatgccctttctccagccctctgtatggctgacttcttcaggtcacagcccaatgtcacctcctctgtcttgtccagtgccctcaacagagcctggtacatagtaggtactgaaaaaatatttgattcttgactccatcgagcattgcataacactgcatgttaaccactggctgggcacagtggcttacacctgtaatcccagcactttgggaagccaaggcaggcagatggcttgagctcaggggttcaagaacagcctaggcaacatagcgagacctatctcgctatttaaaaattttaaaattagctgagtgtggtggtgcatgcctatagtctgagctacttgcgaggctgaggtgcgaagattgcttgagcccaggaggtggaggttgcagtgagccaagatcatgccactgcattccagactggatgacagagcaaggccctatctcaaaaacagaagaaaaaaaaaagaacatgagctcctgaggtggtggcctgggttacaaccctggcctgtccatttcagtagctgggtgactccatgcctttttaaacctcagtttcctgaaatgtaaagtggagataatcctactccctaccttgtagtcattgcaaggattacaggaggctggcacttaatcaggggccagtacaagtactgttgttagagttcagggagcaatccatttggatttcctcacccgctgcggcctgtggaggagtctgcgatgcagtgactggagggagagtgagcctctaggctaggggttcacctaagccattgcttaggattttttttttttttttgagacaagagtctcactctatcgcccaagctggagtgcagtggtacgatctcggctcactgcaacctctgcctccctggttcaagtgattctcctacctcagcctcccgagtagctgggattacaggtgcgcaccaccatgcccagctaatttttgtatttttagtagagacggggtttcaccatgttggccagtctggtctcaagttcctgacctcaggtgatccacctgcctcagcctcccaaagtgctgggattacagccatgcgccaccgcacccagccaggatttttaaaaaggaaggaagagttgtacttgacaggtaccaaggaattgcagaaaacaatttccatgagcctaaactctccaaagagagtggactaccattgcttccagaaagtgggttctgggctggggaagtcttgagtcatggcattctgagaagcaagcctggtgccatcacactgaactgcatcgtctacattgaagtattagaagcaatgcactgtcacatccagcctaatgcctccttaatgggctcatgctcaaggctgctgcgcattcatgggccgttggggaggtcccagacagaaaggcctgtgtgggtcttaccagtgtggggagattggaaccagaccacaaagggctccctggaaaacacatctgcgtctccatcctgatagtcatggtagtgataactcctcttcacagacaccagcttttccctataagaaggaaaaggaagtcctcccagctgagtcagcccttttcttactactttcatgaagcagagatgtaggttcccatggctttctcagaagccagagcaggctcaagcacaggatcgttttcctgagaacaaggctaagtcaactcttctcaacagccagggagctgttgcgaatctgggagctgaagatctgagccatactagttatctgtggcacccaaaagttaatgttcagacttaagaaattactagcaggaagaggaaaagaatacgaagttcaggaatcagctgtgctgagaacctcagctttccagccctgggccaggacttgactatgaggagtaaagaacacctggcctgccaaccatggagccaaccaacaaattaggtgtttggagaccccttgtgttttcagcttgaagagtcaatactttgcataggcccctagttttgacagcaattattttgatgaacactgagaattggttagaaatcaaaatttggttttgaagaaaagacatgcattttgattcaattcacgatttattggtggccatgttccagggagcataggtgatacttacttgtagagaaaggcatattgttctttatatgtgtttcttccaagccgagagctaatcacatagttgtacgttatgcctctccttgaatttctagaaaacaaagatttaacactgcatcttgaagagtaaacattcccctactgtacatgttcctttctttccaatctgcctccatacgcccaatggcatcatgtggaagggccactgttcatcataacctttgagtccaatgagaggagccaccattgattggctggaatgtggcatctgccacgatctttacagccattatttcttgccttatgaggagagtgttatcattaccccctttctatggtttgcaagcccaaagctgggatttgaacctagatccaactcaccccaaaacccgcatgctttggcctgtacctgtgggaggccactgagaccctagaagacaatcttggccagaatcagcccctgaccccgctcatgcccatggctgcagctgcagctcatgctttctggtggaataaatgtcatcaggccacctgtccgtgtccacgaaccactcctgagcatttatgataagcaggaatattctctcctctgaaagccatcaggcatttttttacaagctttgggaccacgatttcaattcactgttgtttatatcctgggtgctggggatacagccatgaagtcccattgaccttgcccctcacctgcaccagggaaagcggactctttctgtgtgtttaccaaacctgctgataactccactctgggcagagcctaacataatttcactctatctgctcacaaaaagatctagggcatgtctaaagctgcagcatattctcagattcagttggaaaaaaagcagaaggggtatttaggggccaacttagaccttacagaaattcctgggacttcagatgcagtatgctaaggcagacttagcccctggggccccaggagtgtgaacagtaggttctgccgggcttccactttggggagactggccctattttgaacatagcctgccaagtcctgagttagcaaactgcttgtggtgactcagttgcaaagtgactaaggcccatcctggcttgtgggggataaagagacaaacaggcttggctctgcttggagtccgcgacagtctagataggttggggtgtgccaagaccactggtggtgaaaagactcgccccagactgactgtggaggagatgactggagcctacctgtcccctcagtcccccacaaacctgtcccctcagtctcccataaacctgactggggacactccaaggaaggctgagatgacaaagaatagagcactggctatgagatcagatgtgacgcaagttcaaaggtaggcttggccacttcctggctgggtaactcaggcaggtcccccactcagttcccttactataagggaagcccttaggcagactgacatggattcttgcctgtccctacaattgtcctacacatgccttccctatgatggataagcccagagcctgggggatgatggcaccaggatctaccatctcatcttgctcctgcccaagacccagacatggcttttgttcaaaagtccctattaagtgtttcttgctgagatggccaggtgcagcggctcacacctgtaatcccagcactttgggaggctgagaggggcagatcacttgaggtcaggaatttaaggccagcctgggcaacatagcaaaaccccgactccactaaaaatacaaaaattagctaggcatagtgggtgtgtgactgtaatcccagctacttgggaggctgaggcaggagaatcacttgaacccaggaggcaaaggttgcagtgagccgagatcttgctgctgcataccagcctgggcaacagagtctcagatttaaaaagtactaaaataagaagcaagtgcccctcactccttcactaacccctttcaccacagctctctgatcacaccccccccccccccaccagaagtaaccactattaatagtttggagagcatccttccagtctttcatctctatgcacatggaaacacaaacacacccttattcatgtaacatgatgactcaaatgggctattttacctgcaattctcaacttgctttttttcaatatattgtggccattattccgtgctggaatatttagctctaacttattctgtagcaagcatgattttttttttaagagatagggtcttgctctgtggcccaggctggagtgcagtggtgtgatcatggctcactatagcctaaacctcatgggctcaagcgatcctcccacctcagcctcccaggtaggtgagactataggcacgtgccaccacacctggccaccagcatgacttttaacagctgcataatattcctgtgtgtgagcatgttgtaattttattatctttcttctactattggtttctaatcttttctcttttctccaacattttcttcataactgtactttttagctcagcctcatctgcttttttcatttctttctgtgtccagacccctcatctatttcccctattctattttatcacagtaaaatcaactggttgaaagttctcaggaccgtggctaagggagctggactcctgggcaacactggctgtgtgaactggtggtcaagtgcgggatctcacattactttcagttcccaggggttttcagatgcccttgcacttgaccttgagccctagagggcccacccttccccatgttacctgttcagcttctccatcagtatggggcagatcctgttgttgctgtccttgatttccatcacgagtatgatgtcacagcgtttgatgacctgcaagaaagagaattcccaggggtttgaggtcatttaccacagataaataaaaccttttattggacacttactgtttttaagtattgcactgagtgcttattaaaataatttcttctctgaactaaatgaaggactccctgaggtaggtaggtgcttttgttatgtacattttaaagaggagcgtgagactcagagaaagttgagtaaattacactcccaatcaccctactagaaaatggcggaggcagaatttgaacctatgtaattcaagcccagagccccttgctcatgacctccccacaatatcctgcctcttggctttgcttgaataattacaataataataataaatatttattaagcccttagtaagcaaagataacagactggattagaaataaagaggtataattataatgataataattataaaagctgacatttactgcaaacctactccgagccttacaacaaccctgtggggtaactatgcttattagcccattaaacataggcagaaaccaagctcagagtggttgagtgactagcttaaagtcatacagccaggataggtggtagagtcaggatttgaacttaggtctgcgtgactacaaagcccaccatgttgaactgttaaaatacagtcccagccgggcacggtggcttacgcctgtaataccagcactttgggaggccaagatgggcagatcacctgaggtcaggagttcgagaccagcctggccaacatggtgaaacccgcctctactaaaaatacaaaaattagcacctataggaggtgcttggtcaatgggcgctagggataatcctattctgaatgcctggcattctcgggtgactgtgagtgccctgtagggtagctcttgcagtgttttggggatggcctcttggtaggatggggagggtgaggcagccttgacaaggacttcggacatgctctgcaggacacagctgctcaggggagatgcagagttcaagcccccatgatggactcaccaaggaacaaaaagacagccgggtttcatcagtgaggaaggagatgggaactcagtggctacccaggctccacgggccatgtgtgaagtggggaaaatcattgccttgcatgtcagggtttcccattgaacaatcttgtcatggctcccacaggcttggcattgctatcctggctaaacaacaccatctagaaggccttggttacctcccaaagggcagggccacctgggtctgagaggctcgtccaaggaagaacagagcctgccagtcctcactccaatcctccttcccagtgacagcaacagcagcggctctggctcatgaatacccaccttgctgcaggctctgctgggtgcctcaggcaccctgagttctcttcaccagccagtgctacaggtggtatttggatgtggtcgccattttactaggggagctggtggttcagggaggggcagggcctcccaagctcacaagtctggtaggtggaatctggacccagggctcctggcccccctaccacaccatggtgtctcaggtttcctaaggtaataagtacctttccagagtcctgggaaagggttaagttgccagcatcaaaaattaattaacctgtaggataaagggagtcaattgactccagagaaagcaagcagtgtccccggacattgggtatatcacccaaggaaagcgtaagcgaaagtggaaggagtggggaagtagaggagagggagagaggaaggaaggaggagaagaagaaagaaagacaaagagagggagggatgatgaggatgggagagagaaggaaggaaggaaaaaagtaaggaagggaaaggaagaaagaaacaaagaaaaagagaaaggaagaagaaagaaaagacagaaagaagaaagaaaaaggaagaaagaaaaaggaagaaagaaaaagaaagaaagaaagagagaaagaaagaaaagaaagaaagaagaaaaggaaagagagagaaaggagctgggctttgctggtgaaaaggagtagctgtataaggttacttcatctttctttgttcatcacctctacatggggagtaatagtccctcttcataaagattatgaagtgaaaccatgtgcttatagtgcctgatacaggcattcaataaatagcaataaaaatcataatggctaacccttatctggaacgtataatgagccagatactacattaagagctttccatttgccaactcctgtagtccccccagcaaccctggagggaaccattgttatcacccctgttttaagatgacggcaggaggtacagagagttgaagtggttattgttccaagccagc

SEQ ID NO: 321 - DNA, 10112 bp, Homo sapiens
ataattgggaagtatggacagttttttcaaacagtggtgagattttacttgtaacagggagggcaagattactaattaggaaaagcagagattagaaaacacagacatcacggttgagggactacattttcagtgtccttcggtgttatcaatcacaagccctgtaacatttttccctgcagagtggctcagacttagcatacctgctccttattaacactgcctccaccctgtgttaaacccctcatagctaaaatcaaccatgtcgtgggctgcaccccaggcctgcctgcctgcttgcctgctctggcccctgtctgcctgggcagcctcatggctgtaattttgttttcacactccaacaataccatccttctttgcattcctagaatactgcctgctcttggctgccgcaggacctctgcacacactgctcctcctagaacacgctctctcctatgacttccctgttaactcctacataagccgtccattctcagctcacttttgattcctcaacaaaacaaacgtacctgattgctctcactcaggagttcctggcatagttctcatgcattccttttcctcacaccagtttgtaatttaaccttcatttccaattcatgcccacctcaccatcttggccagtgggtctcaaagtggtgtcaggtcacagcaacagcatacagaacaacctattagtgatgcagattctcaggccacatcccagaccaactgaatcagaaacttgaggtgggagacaagcagtctgtgttttttaaaaaaaaccctactgattctgatgcatgcttaagtctgagaatcaacgtgctacactatgtggtatagggtctgtaccatcacagcacagaccagttaagttttagcaccccatggtgtctcctagtgccaaattcagggacaacagtaaggacttggtaagatttcctggtcagatgaatgattggttaaaaaactttcctgctgggagcggtggcttacgcctgtaatcccagcactttgggaggccgaggcaggcggatcacgaggtcaggagatcgagaccatcctggctaacatggtgaaaccccgtctctactaaaaatacaaaaaattagccgggcgtggtggcgggtgcctgtagtcccagttacttgggaggctgaggcaggagaatggcgtgaacccgggaggtggagcgtgcagtgagccgagatcgcgcccctgcactccagcctgggctgaacagagcgagactccgtctcaaaaaaaaaaaaaaaacttcccatggctccataaatcccctactttattaattctaaacccttgcagcgactatagaatacccccaaaataaacattgaaactgctgttcgaagacctgggttctagctcctgctcccaggcctttctgggttcaaattttggccctccttctcttactatctgtgtgatcatccataaatttcctaatctctcttggccttaacttcctcacctctaaaataggaatcattatagtaccgatttcccagggttgctcaatgattgagacaatggcactaagaatcatgactcacacagttaagcactcaacaaatgtaggtagtattactgccataataatagttattcaactttaaatggtctttcctcttgggtctcagctttcttactcaagattgaccacacacacactttagactagttcttcctcccttgcaaaactacacacatctaacacccatccgacgcctgaaacctcccctagcaacccggagtcctgctggggttttccagctccacctcctgaacagctgggctgtagcacacaggctggatctactcatacttgccttcctagagctcaactgaagtcacttcagacaagtgaagtacccactcacctctggaatcagatcttggtaacgccaacaggttagcaggtgatttcatttcagtgtgtgtctgggtggctagcattcaaacgcagctcacactgggagctatttctagtccaattttgctacttggtaacgtattaatagcatcaattaaaacattcccaacgaatagatctttaaaaggacggtttctgacttccctaacaagcagagggccgaccacctgcctgcgaagtgcccctcctgccctgtctccaggcagcatgctgtgagcgatgacagaaactggacccgcgcacagagaagctgcaggcacgccctgcccggccacccagctgcctgcctgcttcgcccggccgccgagccccgggggaaaacctagaatggggatgccggtgcgccccgacacctgggcacggccgcgggccggggagccgcccacacttggctccccaagagttaaacgctgagtaattttcctgaggagcaaacagtcggagcgggggctctgccaatggccacagtatttttatccgacttaaccgacaccgcggcgcgacctcggctgtccccaagggtatccccacgcggcacgctccggagtccccgaccgggaccctcgccggctcccagcgcgacatggacgacagcgccgccgccgagtcccccgcgcccgggcaggaggcagagacctggggccgcccgaggactgctaggggcccctccgcccggggtccgcgcccgggcctaagcggtagggggtgtgcgcccaagttggcccgctttgctgcaagagtggaaaggggtgggagcagaaagcgccggccccgcccggggcggggagcaacgcggggctgcagggccgcctcggggccccgaaccaccgccgcccggcccaccgcggcgccggggaatgaatggggctccccagctggcagcgggcgcgcactcacaggcgacgtaggccagcaaggcgatgcccagcagcagcttcatcctcctgcggttgacggcagacacgaggcgcagcagcgccttgctcaccatccccgggagccgcgcgggtccagggccctaccgcgcgggggcccgcctgctgcacaatgcgcggcggcggcggcggcagcggccccgagagccccgcctcctgccgccgcgcgcccccgcccccgcgcgcctgcttcctgctggcgggatcaccgcgcaggcgcgcctccacccccttcctccggctccgcccccgcccctccggcttctctacccgcaggcgcagttgccgcctttcttgccttggttttcgaagaatgtgacctggagggctggtgggcggtgcggcgcgccgcggcgcatgcgcgttccggtctgttttccctgagttaaagcgcgcgggtgccagccgggaggtgcggctggattcgtttcgctgaggtgcgtccccaacccaagggcacgactgcagtggccagtttccgagccccgcccggaggggggcacgcggtgggcattccggtgttgcagtgaaacgaaacttatttgctaaacttggccgagccttagaagttgaatgcctgcctcagaaagttgcctcgttctctgggctgtttagttggctttttttagttagaatatcggcagcgaaaatgataaatcccctaaaccttgccgaagtaaaaactggctgcgttttttttccttggctatgatcaactggggtgcctttgttttaataatagtcttttattattattttaaaaagcagtgctaagtatattaatttaggatagacttggaaaagaaaagatgaaattgcgctgtctctgcctagagaaaaaccctgaccatgttgtcgtgtgtgtttcattcaatctttttgttgagtatatctgttttatgagtgctgtactgattgcataggaggtacctgtgtttaaaaagcatttactgaatgatgattacaagcaaggagatgtatcagaagatccacagataatcggaagcttgtcattggatctggagagagctggtcccatggaggaaaaaaagacaggtacacacagatgtgtgtgatgccacattaagagagatcccggatttgggatctgcaggcttcaagaggtcatcttcagctatacggagaagttgaagtcagcagcggctctcctacctcttggaacctcaggccattttgcaaaacttaatagatcaccctcctttagatttattagaaacctccaagaaaaggaaatatggcagctggtactaaagcagcagctttatgttacatctttcaaactatagtgcaaatgatgtgattctgataaaacctacctccatcctacccctcccctaaacctgttgagaatccctgactaggaggaaacactgagcggtttgctaaggcggattgcccctgctatgcatgctgcccatagatggagtggacttctttcgagaagcccagctccctgactctgacgtgtccaaggaggctgccaagtgacaaaacacctggcatgggagcctgagtcctgggttcccagaggggccaggcccccagagcacaccagtttggaacaaatcgattttgtttgtaagtctgcatttcctcgtggctttctggctatggtttttgaaaagagaactagagcaagtggagctctaggcctttcccattccatgactccgtggtttttagattaaagatgaggagcagaaatggaagaaaataatagttcattaacatttgacctatgggcaaaatcagactgaagcttctaggcggatttcaagcattttaggttttaggtagggtttagttgataggtatcctattagacgacaaaggtcagaaattgtggggtatttgccatttctgtactaaactccttaagcccagcattcccagttagcatttttttctgctgctggacactactgccaacttctgccctgtgggattaagtatatggaaataccgttagcagctgcagttgaaatagctgctgctgtcattattgccacccagaaggcggttggtgtcccaggacactggtgtcttgctcagccgcagccagaattaaaaagtaagcaatagtaagtgtgcacccagtggaggtaagaaggcctgagggagggagatgccaaagagaccctccaagctcctccggggatcttgggcgtaggcagcaccatttccctgtgctccttgcctctcttgtttcttcccagacccccttgtttcttcccagcccatccccacttcccccgcaggttctgggctcatccctccctgctccctccccttactgtcaaccccctcatatttccagtggataggttaacaacaatatttttgagcgattacatatttttgaacaagttacaaaggtagtgtttttgacactcagggtaattaaaaaatgaattgtaatatgacttctaaagtgtttaaagcctaaggagtggagaaaattaacatttataaacctctacaatgtgccagggactgttatgcaatgcactttcattgttacctcattgatatggtttggctctatgtccccacccaaattgtaatccccacatgtcaagggaaggacctgatgagaggtgattggatcatggaggtggttttccctatgctgttctcatgatggtaagggagttctcatgacagccaatggcatttttttttttgagacggggtctcactctgttgcccaggctggagtgcaatggcacaatctcagcttactgcaacctctgcctcccgggttcaagtgatcatcctgcctcagcctcccaagtagctgggattacaggcgcccgccaccacgcctggctaatttttgtatttttagtagagatggggtttcaccatgttggtcaggctggtcttgaactcctgacctcaggtaatccacccgccttggcctcccaatgtgctgggattacaggtgtgagccaccacacccggccggttttaaaagtgtttggaagtttctccttcacggcatttctctcctctcccctgccgccatatgaggaaggtccttgcttccccttcaccctctgccatgattgtaagtttcctgaggcctccccagccatgcggaactgtgagtccattaaacctctttcctttataaattagctagtctccagcagttctttatagcagtgtgaaaactactaacacactcatttaattcttgcaacagccctgtggggcagggttgccattgttgctgctctttaaaaaaaaaaaaaaaaaaaaaaattttaaattaatttttaaatcaacaaaaattgtatatatttatgatgtatcatatgaggttttaatatatgtatagatggtggaatagctaaaactagtttgcttccaccttttgggtattgtgaataatgctgctgtgaacacaggtgtacaaatatctctttaagaccccactttcagttcttttgggtacattacccagaagtggaatttttggctcataaggtagttgtgtgtttaatttttttgggaacttctatacggtcttccttaagggctgtactgatttacattgctgctgtcattaatagatgaggaaactgaggctctgaacatttgataagtgtcccaacacttggtaggtggcagggttaccagttacttggcttggtaagtaacagggttaccagtcacagagctgggagtgtagggctggaattttaagccatgattttccctgtgtgaggatgcttttctggagttgagtgcagacttgcacagaaatgactatcactcatagcaaaatgtggtgagtggtcactgtgggacagggtcgcatgaatggctaaggaatttcacaacaggaaggtatgcttccaggtcatggactgtggtttgccatgccgggaccagctgacaggctcacaagagctgacagttagcaactgttcctctgggattatttgcaccatggaaataacgcaattgctacataccagggattctttttttttttttttcttttaactagcatacttctgcttgcagatgagaacagtgagagagagaaagctttgcagagcaggacctacgtgagctgaatttgaaaggatgtagtataggatttggactcatacatcttgggcaggggcatccctaaggaaatagcaaaggcaaggatgctggggagtgaaaggttgccataggaaatagtggggatctctggcaggaggagcagagaacaagaaacgaaggtatattggccaggcgtggtggctcacacctgcaatcccaacactttgggaggctgaggcaggtggatcatctgaggtcaggagttcgagaccagcctggccaacatggtgaaaccccatctctactaaaaatacaaaaattagctgggcatggtggtgggcacctgtaatcccagttgctagggaggctgaggcaggagaatcacttgaatctgggaggcagaggttgcagtgagccgagatcgcatcactgcactccagccatgttggtagagtgagactccatcacaaaaaaaaaaaaaaaaaaaaaaaaaagaagtgaaggtgtaaataatgttggaaaggaaggccataagggttagtataaactaggcatcaatcacaccctcatcaagggttactttctttcctggctactcactagcagtgtcagcctccatcttcatctttgcactctactctgaacactgctgggcctagcttgtgtcactgcatcttccaggcttcgcattatgctctgccaagaaagggccccggaggaagatcaatggggagaggagagatgcttctgtgtcagttcttctagcgtggccatggctagtggctgctgatagttgctggcacttgctgcagtgaggatggggtgattctggactcagcagccccagggaggcaacatcttttcagaagttgacccctgttatcaaggcccctcttctcagctgatctgcagctgacagcttctgatctctgggcatcacttctttcatttttgcttcttcagaatctctcttctccctttggtgcttcttaaccctgccagcatctttggaaccaaacccctatattaaatttttcctgtttgaaatacttaacaatagttttcctgactagatctcaattgatacatcctcacatcctcctctgatgaaggtgagaaagaaggcttggtctcagacctcctcctgaggtgcctgccatgaagctgctcctccctgccatgccagctgtgccatggccacataagttttcctgttggtagtgacaaccctgcgtgtattggagtccctttctggagcatatgtttctctttcctagggtctcaggagaaggatagatgcaaggccttgctgccctgttgctttatttcccaacataccatcaccccaggatgagtgagtatgctagatcttcttactggtttaggcagacagatgggtttaatatagcatcataaataacttaaaattgcttatctaacattcccattcttgagtcttttttaaaaatatactttattttttagaaggctttatattatggaaaaattgagaagatggtgcaaagagttcccacataccccataccatttttcccctattattaatatcttgcatctgtatgggacttttatcacttcataccaacagttcacactatcaacatgatttgtgactgctgatgtggaccttgatcagatcaatgccaactgaggtagtatttatcaagtttctccactggaaaattattctttaacccctttccatactgtactctttggaaggaattcactatatgcagcccacaatcagggagtggggcatcatgctttccttccttgagggtggagaatctgcataaattctttggaattctactgcacaggagtttgtctcttctctccctttgttaatttgttccgtcatttatttatatcagtatagactcatggatatttattttatacttggagttataatacagtactactttattaattttatcactcaaattctgccagtgtatgttataggaagctcttttgtttggcttctgtgcccctttgacatactcccatcattgtggagtttctaggttattgtttttgtcttagcattttcttactttctggcactcacaagaaactccagactcatcttgtatatttcctgccccagtcctagaatcggccatttctccaagatccctgttttcttttattggagaatagtattggaaaccaagatttgggtactaggtgtgctagtgctactggagtgttgttgcttctaggtgttcttagctcatagagcaaagaaatatgtgtatgtgcactaacctttttatatacacatagcaacaaatatatctatagataatctatatctataaacaggagttcctactgaggtctccaactctaatacattgccacatggatcattttaggatcatctccctaaacctggctcccaccatctgccatccgtttactaaatcattcgattccagtacacacgtatagcagtgtcatttgtttctttgaccacgggatggcatctatgcagatttctatcctttcccttcacacacacacacacacacacacacacacacacacacccctttcctctcctctgctctccccacaaccttgcatcccaccccaactctggaactcctattcattcctgtgctgtgcagtttgtcttcccttgttttgtccatacccatgaaggacttaccttcctcatctatacctgctaataaaagtgttttctaacaaaatccagttccctccctaagacgcaccaaagacccttaaaatattttcttaaacctgaccaggataagagactggccttttgtctacagacagtggggtgtgactgtctgtctcaagcagtagctcccatcatccaggcaggttttccagcagcatcggctggagtgggagcggtctcaggagaagctcatgcatagaaggctgctgcagcaattcaagtggacaagagcgagaaaagctagtagttgtggtggaaagggcataggaataactttgagggttattttagaagttgaatgacagatattctggttgattgtatagatcaacagggagaaagagtaatcaaatgagactctcatgtcatatgctggggtgacaggtcctcc

SEQ ID NO: 322 - DNA, 10684 bp, Homo sapiens
ctgcctttctcaaaagaaattctatagagaatctcccaatgtataaaacatatcaaagtagaattcttgggatgtggagggaatggggtacctggatcccacctgccagtctttaggcattcatgaggaacccttgaacctgctgaaccctgtaaaagggctttaagcagagagtgagatgacccaatacacattttagaaagatgcccgtggcagctaggtggagttgacattggacagggatgagattaggggcagggagcgagtttcaggaggctatgaaagtggtccagacatgagctgatgaggtctagacccagggcaacagcctaaggatgaaaagcaggttggattccagaaacatttctgagttagaatcagcaggaattgggggtcaattagatatgaaggatgaagtctgtgagggctggactgcctgggctgaaacataccgtaaagtgtgacagccatacaggagagaaactgctgggacaaaggataagagttgagtttggggccaggcacagtggctcatgcctgtaatcccaggactctgagactgaggtgggcggatcacctgaggtcaggagtttgagaccaccctggccaacatggtgaaatcccatctctactaaaaacacaaaaattagctgggcgtggtggtgggcgcctgtaattccagctacttgggaggttgaggcaggagaatcacttgaacctgggaggcagaggttgcagtgagctgagattgcgccactgctccagcctgggtgacagagcaagactgtctcaaaaaaaaagagagagagttgagtttgggatacatcatgttatggtgactctgggacatgtagcagttgattgaccagtagacagttaaaaatgcaagtctggatcttctctcgtggaagagaatgttggagctagaaattaaaattggggagttaccaactgattggtagacacaaaagacatgaagtagagaatgtgcatacaagagagaaagaggcctgaatcaagcacctgggtttgcaacaatttgatctttatttagctttttcattggtgtgattgttattaccattatgagataatattttatttttaaaattatttttatttttttaaagacggagtcacactctatcacacaggctgaagtgcaatggcgtgatcttggctcactgcagcctcaacctccctgtgctcaggtgatcctcccacctcagcctcccaaatagctgggactacaggtgcgtgccaccaggtctggctaagttttaaattttttgtacatatggagtctcagtatgttgcccaggctggtcttgcactcaggcggtccacctgccttggtctgccaaaatgctaggattacaagcctgagcctctgtgcccggccatgagtgaatattgtagaaagcagagacaatgtgccagatgtttggagtgaaaaggacttggctcctgttctcttaggatggacaatgctacacacaatcccaaatcacaggctataagagaggtgacccaatcctgcaggacagttcaacgtttcagatttgaaggggagtgagagagatcagaactggaggccccttgtctgagcccccgactatggtggtccacgtcactccacacgcagcaggcactgtaaatatttcaccttctctagacgacagtagttcctcgagaacaggagcgctggggtaatgcatatgaagctcttagcacagtgtctggcgctgcttcaatgatggctatatgatcaattattcttactcctttgaattcttggcaagagctggcagggaactttgtacacatcaggtacaaaaaaacccatccgcgcagtctaagatcaagaagctcttggcactctctgacagtcctcgacaaagcaattccccttctttctaacacagggtccgtaaaggagatgatccacaaggaccggctgagtggataagaagacagactggctgagcggctgaccctgccagacgacaggctgtgcctctttaccacggtgctgccgttcccaaagtcggcctcagcttggtccttggctggaagctcgtagcaaagtttctgggtcagcagacctcataggcaaggggcccctagctggccgcccccagccctgccaaggcaccaacgcaagaaagccgggggagcctcggtcgcattgctggaagatcgtctaaacatccccgctgctcggccgctaggccggcaggtgttcgggccccgctcccccggcccgccccacccccgcgcccgcgccgcgcttccctctaagaggccgggtctgagtgagcctgtgctgagtcgccgagcagcccgctctccatgtgacttcagtttccgtccgttccttccgctggtgctaaaataatctgatgccccacagcaaggaggtagcccagccccgcgttcggctgctctcgaggaggccggagcccccggagacgatgcgccccgcgcagccgcctgcgcctgcgggagccgtgagtatttcccgcgtgggggcgtccccggggcacagccggggcccttctccaggtgggcgagctcgagcgaggttgggtggtaggaggtcagcgtccgcggcccgcagctcagggctcacgaggaagctgtggcttgctgcgtccaagcgccgccgcttttgtgctgggcgtgggggctgcagctctgggtggaggtggaaatacctccctccaggagcacttagagctgagaaaggtggtgcgacgtagtggaaaccacgagggcttcagattcagacgtgggtttgagtcctggctctgcagggagcatgtgagcagacagttaaggtttctgagcctcagttttctcatctgcaaaatgggaacagagatgctccctccctgggctgggcgactggatatgatgagaccgctctgtgcacactcagcatgctgagcactgggctctcctttcctgtcccacaacgtggattgagaaccactatctcatagatgaagacactaagactggttaacagcaacacctatcacagatgccgtccacgtgccaggcctgtccaaggccctggggatacagctgtgaaaatgtgcaaagccccttctcccacagaacgtttgtccttgggagattcactggggctctgtgacttggatcttagcctagacttagatccatggcttatcagagggagactaacaggagggcgacgaagactcggacgctcttccgtagccctcgtggcccctgcatgtgggccggcttctgaaggggtcagcgtacttccccacgtacccaggagctagacggaaagaagtaaggagccactggtgtggctttgtgctgcctctgagagaaggtggacacgtgccagttggtggctgcgactggaggaggccggatcgggggtcctaggaatggagcctctccggacagggctggtcggggctgctgtgcttccctaggggctgaggggaccccaccggaggcttcttcatgatgggcacagcccgttaggagtctgggtgctagaaacattcagcgtctgtggccctccatgctttcctgtgtgctcctcacctgccggctgtgacacacagactgttctgtggatgctgagggtttgctgggctttacatttacaatacgtatttattctcctcacacacctcttaggtttgtgtgtgtgtgcccgagagtccctaaaggagattatagaatcatgggcccaggaaaaaaccttaactcctgcctttaggttaaaaaaacaaaacaaaacaaaacaaaacaaaacaaactcagcttcacaaagaaggcactttttaaaaatatatatatttatttatttatttttagagacaggctcttgctctgttgcccagactggagttctgtggcacgatcacagatcactgcagcctcaaactcttgggctcaaataatgctcctgcttcagtcacctgaggagctaggacaacaggtgcacaccaccatgccagctaatttttaaaatttttttgtagacacaggatcttgctgtgttgcccaggctggtctcaaactcctgggctcaagcaatcctcctgccttggcctcccaaagtgctgggagtgtgggcgtgagtcaccgcccccagctttcatgtaatgagtgccctcatgggaacttcatgaaaacacattctcttatagtttttaaattcatcatccaagagttcctgctctttgatgatgagacatacctggtagactccaaaacagagagcagacgcctagtatctttgttctggggtgtgcattaagagtacattgacctgtctgtctccagtcttgactcttttggaagagagatgctagtactgatgacaacctgcattctggctgcggtgtgcgtccacactgcacagtgtgcaccagactctcgtatggacaatgactgtccctcacatcaggcgcagatccattttagagcctcagaagtcaggagagggtggactttcaaccacgactgaaaacactgtctttcttaggacatgctgtgtgtatgacacacttacagatgtctgtgctcactgatgcttgttgatgtgtcatcgcacatcagtgacaaacatttgtcatgtttttgcctttggtggaacttctttattatactcactttcctcccaaaccatttttctcaacttcatcatgaagcaaatgtcatgtggtcattctgtgatggggctcagggctaggttaggtgatgatttctgaaagctcagagacgtgaaggaaaaaggacatcagtgcttggatcttagctcttataagcctcacgtgcaacaataaacccgagttcaagaatcagattcttagatagattggtttggtagcaaatgacaaaaaaccaacgtaaatatgcttcggcaaaaaagaaaaaaaaaaaggatttattgtttcaaataactgaaaagtgtatgggcaatagtttcaggcatggctgagtccagatgctcaaatggcattgccaggaatccatctgtctcctttcctcagctttgccttcctctctgtgggcctctttaccaggcaagtcccggagctggtggcaaagatggctgcctgcagctccaactatattcctactggtttggcatctgaaacagaaagagcaagtctcctttccatgagttctagcaactgcccgtggattgattctcatgggcttggcttttatgatgagcctgttaggaaaatggagtgctctcacgggcccagccttactcataggccccgccctggaaccaggagctgggatcagacccgaacacacagacttttgaagaaaggaagggggttggttgcacagccgcgtaagggtacttaacactactgaattgtacacctaaaaatggttaagatggtcactttcggccgggcgcggtggctcatccctgtaatcccagcactttgggaggccgaggcgggtggatcaggaggtcaggagtttgagaccagcctggccaaaatggtgaaaccccgtcactactaaaaatacaaaaattagctgggtgtggtggtgagtccctgtaatcccagctactcaggaggctgaggcaggagagtcgcttgaaccttggaggcggaggttgcagtgagccgagatgattgtgccattgcactccagcctgagccacaagagcaaaattctgtctcaaaaaaaaaaaaaaaaagataatcgctttcatgttttgtgtattttactacaattaaacattttctaaagaaaaaaaggaaagaaagggggtgattttctcaaaggggaattgaggggttgttaccagaaggagaaacgaatgtgagtgagtaggcgaaaccaaccaatttccagagcgaacggagtcaggtgctgaccccaagccaatgtgtcttttctcactttaatgcctgagggatttcagagtgaacagagtgaagaaaggaggaagtggaacctcgtcatggtcctcacccacgaggtgggcgcgaggagcaggctggtactggataggctcaatgtggccacaaagcctggtgaggtcacagggactcccctcctccagccccaacccaaaaggttgcctaaggcaggtgctgcgccatgtgcaccaagcaactttctgctgccacctccaagaaagagaaggaccgggaggggatttctcccaggagagagagcacataacgctccgtcttttcacctgtctgttctcaagcaggacctaagtgtctaaggcaaccccacacccacagtgcctggcaggggcccacccatgggtacacatcgtgttctcctaagctcatgtcactccatttcagatgtcaactggacatggactcctgctgatcctccctactgtcattcactcctctcctgctccagccctgatccctgaggtctcttctacccttgcagtgtctcccctctgtggtcctcaggcaccaaggctgagccctttccctcggccctgcagtgtctcccctctgtggtcgtcagacaccaaggctgagccttttcccttggccctgcaggctcagtggggagcagggctttccctgcctggccctggaccacctccttcaacttcagcaagttagcggtctccctgtcaccagccagcctgacaccctgagacctcctcatgggcctcggccgttctcttgttctaggttattgggcccttcctcaggtccttaaactgatgcttccattcagcttctcatctccttccaaatccccagttttcttctaggctctctggctagagaaggttagagccattttgaaggcctctgacagcccccgtcttgctttgtctccacagaaggccatggtcccatgatacactcaggggtgctgttcagaatatcaggcaccgcatggcacagctacttgggaggctgaggcaggagaattgcttgtaccctggaggcggaggttgcagtgagccaaggtcacgccgctgcactctagcctgggtaacagagtgagaccccgtctcaaaaaaaaaaaaaaaagttaaatcacttgatatgcattctgaaatatttaaaggaaagtatatcaatgactgcaatgtactttgaaatgcacgatcaggctgggtgcagtggctcacacctgtaatcccagcactttgggaggccagggcgggagtttgagaccagtctggccaacatggtgaaaccccatctctattaaaaatacaaaaattacccgggtgtgatggtgatctgtagtgatctggtgcctgtgatcccagctacttgggaggctgaggcaggagaatctcttgaaccccggaggcagagatctcagcgagcagagatcgcaccattgcactccagtctggcgacagagtgagactctgtcaaaaaaaaaaaaaaaaaaaaaagaaagaaagaaaggtggcatgggtggtgctgtgtgcctgtagccccagctactcggtagccctaggtgggaggactacttgaggctgggagcttgaggctgtagtgtgctacaatcccatctgtgaataactactgcactccagcctgggcaacatagcaagacctctaaaaaaaaaggagaaagaaagatggacagaaggatagatagatggatagatgtatgttgttggggaaaagttaaatgactaacagtacctagtaactgttcacattccttgtcatgatcataaaaatcaaataataagaaattagaaaacttccataggaaatgtagctacctataatacactgccatatgaattactgggttattgctccactcaacttttagcttgtgatgaggaggtgataccagcactgagcctgcaggatgagtaagagctttgcaggtgaacaagaccagcaaaagagcctttcccacagaggacagagcgtgtgggcatgcgtgatttagtcaagggtcgcaggcatcccagggtggctggggcttgtggtattgaggttgagctgatgcagaagtcacagacctgggtttgaattgtggctctaacattctctagctgtacagcctaaacctatgtgagccgccattgaccaagtgtgaaatggagatgacaacatttacctgctaggatttttgtgggaattatatgtaaagtacccggtatagcccgtgttccaaggtgagcactcagtaagcatgagctgtcacagtgaagagcccggacagaatctgggagtgattatgcagacctcgaacaccactgaattgacctttgaatcggcctcttgtcaggaatccatatgctttcgttcttcaatcgtacactttctcaaggaaaccaagtagtcggggtggggggatatattttcattgttttcccactggggccactaagccgctgtcatcacccataaaaaacccctgcccacagtctaccgtggaccctgggtgctcgcttctcccctggacatcccagggtccacacgctgcagctcccaggggtgggagaagggacgaaagctccttctccttcactgtatttccctcaacaccagcttgctgtttgcacagaggaactctgctttccctttgattaatacacctctttgtctcactatggaaagcgtctgtccccctccagtgggggcgtgtcctcctgcaggccttggaaggcttggtggggtcccccgcccactaaacgtgaagtccgaacattcccttacatcgacaaagccttttcacacacactgtcccattcagtctcgacacaaccctgtgaggccatcaaggcaagtgctgtcctccgtggtcaccaccagagtgaaggagccaggcttgggcccaggcctccttccccagcccagggtcccttcctctacacaggtcccacctgctccttcttatcgagaagggcggtggcaggtagccactccctcagaagtgaccagagggaacaaacttgtgatactgaagggaaatcagatgctaatgcgttatgcggttgagcgcctatcagcagagattatgtgggtctctcctatagaaaggtgacaccgaggacctaccaccagccaccaccagcatgcaagggcgaggtgtcacctcccagtgggagcaggtttgcatttattaagacctgtggccagatggcagcctgtgggcatggaacaggacgaggtgggctgacctctgatggctctaccaggccgacgctgaccacgtagggaagccagttggcttattcgtggccctaaggaagtgagggctgagcagggaggtgctcaaagcgggctcctcacactggctgtctggagtcgctgtgggaagggcccaggggaagaagggttgctggggcctctgaatccccccccgatggaggcagagcctcatccattcccagagagtctctcgccacgagccccggtacagcgcaggctgaccagagaaccggagaaccgggtgggaaccggagatctgagttgaaccagtgctgggaaccatggcactgccttcgccgagccgccgcgtgcctctcttttcacctctctggcctgcatattcttttagcaaacttggggattatactacacattctgctttacactttcctttccttgatattattttattatgaacgtctttctgcgtcaatcaatatattgctaccaaagcatttttttatcataccacgtcattcctatcatgtagttttaccataacttatttagccagtgcttccattattggacttttgatggtttccacttttttattattcttactaatgttacaatgaatatttcttttaaaatatttttatgtacattgtatttccttaggataaattcctagaacttgagtcattgaatcaaaaagaatccagactttcaaggtctttgataaattggctaaattgttcttcagaaaaagtgtgccaattttctgttctacctgcagggtgtgagacagttcttagggggggagaagtcaaaacaattgtattgtctatattttgacaaattcattattaagagaaagctagagaagcaaatcacaagctctgaattcacacatcacaattctaaatgtttgttgttctaatcctcaatttcaagttcttgttaatgcatccaccatttgaatatttactttttcaaaatataggaatgtgttaatttaccaaagatcacaatcggttctttgctttttgcttattttttgagacagagtcccacttcgttgtccaggctggagtgcaatggcatgatctcggctcactgcaacctctgcctcccaggttcaaatgacactcttggctcagcctcccgagtagctggaattacaggtgcctgccactatgctcggctaatttttgtatttttagtagagacggggtttcaccatgttggtcaggctggtctcaaattcctgacctcaggtgatctgctggccttggcctcccaaagtgctgggattacaagcgtgagccactgcgcccagccacctggctaatttttgtatttttagtagagacggggtttctctatgttggccaggctggtctcgaacccctgatctcaggtgatccacccacctcggactcccaaagtgctgggattgcaggtgtgagccactgtgcccagcctgtatttccatttttaacataacaaatgtttcctgagcacctttctga

SEQ ID NO: 323 - DNA, 11956 bp, Homo sapiens
caattttttttttttttttgctaaatcttgctcaccttaggctttttctcctgctgtggccatgtgtgtttacacttgcggagctcctcctgtgttcttcctctgcctccctccccctgggtgtgatggtctagggtgagctgctcagctccatcagtaaatgaaggttatgagttctgctgcttggacgggctgggttccggtgacaggcttcagggactcgagtgatgggtggctccgacgggtcctacttatcttcgggctgggagctgcaggcataaagctgcccctatgactgccagagcagggagacacagcagagttctgggctccctccgaggctccccaacatcagcttgcttccgcttccgtgtcctcagacaggtgagtccagggcctacccccctggacctactgaactagaccctgagtgcgaggccctggagctgcacttcgacagcttcctaggtggttccgatagggcagcagagaaagacaagcaacagtttcaccgagactgagctgcttgaggttctagttcccactatgggcatttgttgctggagcctttctccctctgttttaggaaagtcgactggaagctcagttggggttagataaactccagaagagatccctccccattggcggatcaaagtggtttgtgggcacaatgcatcccaggtgcaggcaataagaggagatgctgtctgcagagaatttagaaacagaataaagctgagtgagagaataagagtcagtcagctttctccttttgttttgttttcttttgtcttgttttcttttatttttagagatggagttttgctattttgggcaggttcgtcttgaacatctggcctcaagcgatcctcccaccttggcctcccaaaatcttgggattacaggcatgcaccatcgcgcccagctgagagttggtcagcttttaatcatcaccatgccccagcaattctacccaccctggtcagggctagaatctccctccctggggaccaatcctctgcccctctatccctccccacaccactgccccttcccaaccacgagggagtctgatgaacaactcatttttgttggtttcttttcagtgttttatttttcaaaatatacaatttaagtttttatttcacaaccgtagttttgtatatttattccaaaatctttaaatagctccgcagcaaacagtacaaatcacaaggtccgtcaaactgcttctctttagcctttacacttggcgagttttttaagtttcaagtagtaatggtttgtgggtaagaaaggaaccaaaaacaggaggaaacaacattttttacataagctcaacatgtaggattagaaagggccgtctgaccagctccttggtctgggaccagactaagaacatgtatctggtttataaataagaccgtcctgggagcagtgagggttttggttacgaggaggaaggggcaggaacctcatctgcggaggctgggaggcagggggaggtgaggcactgagaggtggctccttctgggagcgcccgagtaggggcctgagcggggtggaggccaagaatggccagggacggggtggggctgccactggtggagaagcctcctcagcctcccttggggagaagggctgtgattctggaggcaggggagggacggcaagaaaagctgccaggtcctaaagcaagcagctgggactcctgccagccaccctgggcccaacgacgcaggcagctggcagggccagaggggctgccccagggtctggggtggactgtgggaggcatcacgctgtctcttcttgcgagagctctttgtccacctcagagccaccaaagcctccccagaagggacagcagggaggacagggaccacagatcccacagacccacttctgactgtgaaagcgagctgtgccgtgcaggcagctcctaggcagcccatgaggctaaggcacaagggtgacacaggtggccacgagggctcagttttcttcatttccccttgcggctgctacctgtggccacggcctgaagcagtcctgtgggctgagctctaggcagggacgctccaggaagaagtgggtcaccaagggccacctggccaccaagtggatgtgaccctcctaccaggggtcaggagggcggtcctgcctcagggccccctcagcaccttccactaggctgcagggccggacacagcccatcctgcctggccaagccaaccttcttaatggggtctgaatggcgggtgggggtcgggaaggggccagggccgggctgagggcaggacggagggggtgggagttgtcactgcgtcttcaggtggggtttctctggagtgagggtgtggaaacagtaatcccacaatttagtgctgataccaaatcctagagagggagacaaacggggagaagatgaggcattgaaggagcaggcgtgcgctggcttgggaagggtgccagggtagggataagaggtggagacaatgtcaatatctgtccccttggccttcccaactcccgaggccattctggcagaagtcaagggtggggaacctgtgtcttttattgtccccagcatgaagctggaataaaccctaattccttatctggccttcgtttctaggctacgtggccccctcccaccccccacctccatctccttccccttccttggggcccaagttcattcctgcctcagggctttgcaccagtcgctcttgggacgccagatgctgatttctcttcattagggtcttagctctaatggcacctctgcaatgacacctggaccatttaatctctttgctgtccaactagcccttagccacacatggctactgagcactagaaatgtggctagagctccagagaaactgaatttctaacttcatttaattctgatgaattaacatgtcaatgtaaaaactgatgcttgattgagttactggaatttttttttttttttttttgagatggagtttcgttcttgttgctcaggctggagtgcactggtgtgatcttggctcactgcaagctccgcctcctgggtccaagagattctccttcctcagcctcctgagtagctgggattacaggcgcgcaccaccatatccagctaattttttgtgtttttagtagagagggggtttcaacatgttggccaggctggtcttgaactcctgacctcaggtgatctgcccgtctcggcctcctcaagtgtgttaccggaaaatgtttaagcatgtttggagcaacttacctatgtgaactactgtttgcaaattttataaaatctagatatggatctagtatttctaatgaaactttagtatctgaattgagatgtgctgtaagtacaaaatacaccttagatttcaaagacttagtataagagttgctaattatttttttttaaagagactttacaaaaagggtctcactctgtcacccaggctggggtgcagtggcatgatcatagctcattgctgcctcaaactcctgggctcaaatgatcctcttgcctcagccttctaggtagctgagattacaggtgcatatcaccacacatggataattaaaacttttttatgtagagacaaggtcttgctatgtttcccagactggtctggaactcctggcttcaagcaatcccctgcctccgcctcctatagtgctgggattataggcctgagccactgcgctcagccattaatgattttttaatgttgattacatgttgaaataataatttgcttatgttaagtaaatgttattaaaattcttttcatctgtttattttcatgtcttagtgtggccactagaaaatttaaaatcacatatgtggcccacataatatgtcagtggaaatcgctggaccctcccccacctatgtgatattccatcaccttgctttactttcttcttcttcttctttttttttttttttttatagacagagccttgctctgttgcccaggctggagtgcagtggtgcaatcttagctcactgtagcttctgcctcctggattcaagctattctcatgcctcagcctcccaagtagctgagattataggtgggcacaaccacaccccgctaatttttgtatttctagtggagacaggtttcaccatgttggccaggctggtcccaaactcctgacctcaagtgatctacctgcctcggcttcccaatcccctcggctgggattacaggtgtgagccaccacacccagcccctttattttctttatggcatttatcacagtttgaaatctttgccatttattgatgtccttgcctgtctctgcacagctgtctgcaccagggaagagagtagagggaaccctctgtatatgccccgtacatggaacagtgccttgccgttcccaggagctcgatggtagttggcaaataaatcaatgaacacacatagggggctgggaagcacaggcccatcctcacctgacttctgatgtgcaaagtggtgcttgacgtggtgggccttcaggctgtacaggtaggagcccttgtgcggcgagccaaagtgcaggtagtaatgggtcatgtcatagaggacgtagcccaggaggccccccgcaaacacagtgccccctactgcctcgggcaggatgagctgcatgcacaagtagaagacgccgatcaccagggaggctggcacaggggggaagaccaggcgggagccgtcgaagggtgcctgcagatggagaggcttgggcatcaggaggcagccaggggccccggcagctggccaaaccctggccactccctgcagaggacaggggcacagcggcccagacattccactgcgtaggcttggcacctttggtggctttggggagggcgggccaccacgtctggaagatctggagagactgtcttacttcccatttgtgagccaggaagggacctggcagattgcaaaggaacatgggatgggcgggatgggcaggatgggcaggatgggtggggtgtgctggcggctcagagcccatcttatagaggccactgtgactctggaatttgtcaggtgctagacaggtatcccatccctaaatgccgtgcccctggctagaggggcattctggagacagggcacctagactgaggcctgatgttgtctgggagagcaaggcactgagggcaactgaggttaatgcagcctctgtggcgggatgacccggaagtgtcactagaggtgtcctccccacccccatgtccaaacaggaggccttttttgttccaagggggtgtcgccacagtgaaccagagaacaccgcttcaccgtggccctcgagcttcagaagccaagggcctggcatagaggtgagatcttagctatggcttggtgaggagtctgagaagagaatcctgcagcctctctgggctggaggagagagagagaaagcaggtgacagtgacacaatgagatgctggcgtgggcctccctcccttcagaccaggaacaacaggaccagtgatgtgctggaaaaccagctctcaggaaaaggaggaagggagagagctggggaatgagggagggggaaataaagggagggagggagagccctgattggtagtgtttgccaattcctgcagtgtgaaaactgccctggcgctttcaagcgctgaggtggcgtcactggaacagaaacaggaaaggatgtgcatgggtgctcttgtgagctggtatgggccagatccgggtcacagctggatcaggatccttagatggataggtctggggatctgagaacacgttcctgattggagcccacgtggctacaggccatacagtctcctcgggtcctcatggtgtggcagcaggggactggacagactggggtggaagtgtctcaaaagagggagcctgagacagcccctggggccccagaatggcctgagcaggttcccagaaggttctggtgtcccctgtggatgggaaagatagcggacagggcagtggatctgaaaaggcttcacaaacagggcaagggacacagaagcagatgcagtgagctctgcagagcagaggccaggtgaggctggaggacacaggccaggcctgggctgcgctacctctgagagcatacctgagagacaggttggcccaggactgggcacccaccctgatactggcccctaggaaagccccctaggatgcagatcaactctggggagagccgggaggaccacagccaaccaacctgagaactgtcccaggcggccgatcaaaccccgaatcggctcatcgagatgaaccggattaagttgctgctgggaaaccaaggtgaaacccacgttcagtatcagcgacatcagggtctaaactggtgtcccgaaagtatcatatctgccatattttctctgatttatgcccagcagagaacagagtgtggagacgggctggggaacagcctgggatgggccaaggacagcacaatgcagggacagagaagcagcggggggtacaggggaggtagcttcctttgggcagacctatcttctcgggccagcttctgggactgtcgtggagtccttgaagggcctcaggggaagggtgattgagagcgcagactctggaatccccagaatggggtacgacatcctggctgtgccaagtgtgacctggggcaagttccttagtcctcctaggcctcagtctcctgctctgtggaacggggagaaccatggggctgttttcagcacaagctccaggagcgcaaggctttttgttgttttgttcaatgatgtctagaacagtgtctcgcacacaggaggcactcactgggcatttgctgaatgaatgaacgaatgaatgagttgttttgaggattaaaggtgatgcgtaaacaagggtgcagagggcctggggtcagcttgatgctgcacacccacgctgtccccgcctggcttaggttcggatgcccaacccagttgccccgtgagtcacatcaaacgtcccgtccctcccaacccacagccagactcccaggaggctccgcagcacctgaagctgcggctggctgccgggccctctcgggctgcacatgctaggtccgggctgggaccccgccccgctcaccttgtggtgctggccgtgcatgacgaagtgcagcatgatgaggtaatagctgtcgctggggggcttcatgtggaacaggaagcggtggatgaggtactcgatgaggctccagaggaatgtccccagcatgaagagcccggggaacatggacttgggcactgccaccgtgtactctgcagggtggcagggagagcgaggtgaggaccggtgcatagcagcctggtagctccaggtgtccctgcctcaccatccccatcagctcgggagctgctgccctctgttggacagctacagggccaggccatactgctggggtccttgagtcaaaatgggaaggaggctgtaggactctggtctgggtctgggaagtcctttacaggagtgatgggccactggctggaggcctgacatcctccttacagaggctgtgggaggagtggctgtggctggggctgggcctttacctggaagggtgaccttgccccaaggacattggagaagagaaggcgacactcctgagccagggcgttgttattattatcttgagacaaggtatctctgtgtcgcccaggttggaagactggagtgctggagtgctggagggcagtggtgtgattacagcttactgcagccttcccttcctgggctcaagcgatccttccacctcagcttctcaagtagctgggaccacaggtgcatgccaccgcacccagctaattttaaatttattttttatttttattttttttgtagagacgagatcttgctatgttgcccaggctggtctcaaactcccagactcaagcaattctctcgccttggcctcccaaagtgctgagataacagaagggagccactgtgcctggcctccagggtgttaatgatgggaagtgtgacccaccagggaccatggggcaggaaggacaagaaaaaacaagcaccgagatctcaacagacaagacctgaaatcatagcacaggaggaagatgtgaaaacactgaagatgatcagcctaggtggagaggagaagactggagacagggcaccatcttcaagcacatgcttcccaccaccctccggagacagcctgcagtcctagcggctttcagctctttcctccacctcattcattctttgacctcatggagatttcagctctcattcctgtttgctccatatattcatcctcatcctttttttttttttttttttttttttttttttgtgagatagagtcttgctctgttgcctaggctggagtgcagtggtgtgatctcagctcactgcaacctccacctcccgggttcaagtgattctcctgcctcagtctcctgagtagccgggattacaggtgtgtgccaccacacctggctaatttttatatttttagtagagagggggtttcaccatattatccaggctggtcttgaaatcctgacctcaagtgatctgccctcctcagcctcccaaagtgctgggattacagatatgagccaccgtgcccagcccatcctcatcctcttatctttgtttcttttctctacaaaccatagctttggccatatcttctctcttcttaacggctttatctaaatctaattcacatccatataattcatccaaataaaatatataattcagtgctttttagtacactcacaaagttgttaaaccgtcaccccagtcaattttacaacatttttatcacttccccgccaagcccctgtacccattagcagccactccccatttcttctcagaccctcccaaccctaggaagctacaggtctacttcctctttgttggatttgcctattctggacatttcacgtcaattgaatcatatgacatatggtcttttatgaccggcttctcttaccgaatatgttcaacattcacccatgttgtaacatgtattacaactccattcctttttaagactgaatgatattcaaactttattcatccatccatcagttgagggacacctgggctgtttgtagctcttggctattgtgaatagtgctgctatgcacattcgtgtagaggtttcagtgtgaaaagatgttgtcctttctcttgggtacaagcccaggagtggtactgttggttcatatcataactctatgtttaaccttttgaagaatagccagactgttttccaaagctagccattctctctctcttttttttttgtgaggcagagtttcgctcttgtcacccaggctggagtgcaatgggacgatctcggctcactgcagcctccacctcacgggttcaagtgattctcctgcctcagcctcccgggtagctgggattataggtgtgcgccaccatgcccaactaatttttgtatttttagtagagacagagtttcaacatgttggtcaggctggtcttgagctcctgacctcaaatgatccacccaccttggcctcccaaagggctgggattacaggagtgagccatcatgcttggcctagccgttctcttttaacccttactccatctccctcacctgcacccatgaaccctcacccctgggtcagcgcaggaacctgcctttgtaccccatacccaagctgctgagcatggagactcacacagctgtgggtctggcacctttaacctctgcaagaccctagacacagcctgatggatgatccctgtgcatcttcaagttcagctccctccccactgcccttgaacacgctctactcccctttactgcctctccttccacccagcttcctacttcacagagaagagaggccctggggttggggaggaactatcccctccacatacttcccccaacttccaagcacaccacattctgccggtaccctggcgcatcctccttgcttctcagggaagaggtgtgcaccggcacgcgggcgctggatgatcagagcaacagtaacggcagatgtgtcctgactgattcctgtgtgccaggcaccgcccaagggccttccatggattacttcctatttcatctcaccacagccttacaagggaagccctgcattgcctgcatgattgaggacgtggaggcccaaagtccatgacttgccaggctccccctgctcggcagtgcaaagccctcagccgcctcctcccaccctccctcccaagggactcctctgggctccttcagtctctccttttctcctggctcttctgctcatctttctgaggtaggcaagactttcccatcatggactcagccccttcatcatcaaggctcctaaaaagtcaggctaggctgaacatgggggctcatgcctgtaatcccagcactttgagaggctgaggtgggaggatcgtttgagcccaggagtttgaggccagcctgggcaacacagtgagaccccgcctcaacaaaaagtaaaaaaattagctgggcatggtggctcatgcctatagtcccagctactgaggaggctgaggcagggggatcacttgagcccagcagttcaagcctgcagtgagctgtgattgcaccattgcactccagcctggatgacagagcaagaccctgtctcaaaaagaaaaaaagaaaagaaaacgtaggttggactcatggctccactttgccacttcccattggcttgtcaagtccttaaaaatctgtcttctgggccggatgcagtggctcatgcctgtaattgcagcactttgggaggctgaggtgggcggatcagctgaggtcaggagttcgagaccagcctgaccaacatggagaaacttccgtctctaaaaatacaaaaattagccggtcatggtggtgcatgcctgtaatcccagttacctgggaggctgaggcaggagaatcgcttgaacccgagaggcagaggttgtggtgagccaagatcgtgccattgcactccagcatgggcaataagagtgaaactccatctcaaaaaaaaaaaaaaaaaaaaaaatctgtcttctgccccaaaccaccagaacttcaaaggctattcatgatgtctttcttgccaaatctaagcatattttttagtccacctctaagctggctgtggcatatgacattagctctactctcttcttcaatctgcagctgcctaggcgtttaacctgaggcttatgaatatccgagggtactacgttggattgcagagtgtctgtgaacttgctaatatatcaaattgtacacctatgggcattttttctctgtactgtgtccacagtttctcaaattctcaaaggatccgggagcaataaggttggaatccatagctcccccttctgcctgccgccacacttggcttttctcctcttccctggatctccctgctcaggctccatcttggaaactctgccctttgtccccagggtccaaacctggaccctctgcctctcagctcaatcccttcctctcccacatgctgacgaccgaagctctacaccaactccaccctgggtggccacgccctactggacagctccatgtggttgtccacagtccccaccgtgaacacctcccaaatgaggccaaccgtcttcctccttcttcccgcccacctcctcttgggtttccttcctgggaggctgtggttactgacatccacatattaccaaaggagtcaggttcaagtgacccctctcccatggagtcttagctgggctggtctggttggtgagagaccctgcttccagagaaaccctgatacctctggggtccataaggtcattccggtgaagtgcagagagcacaggcattggatttgcagacctggattcaaatcctggctcagcaccgcctaggtgttacagtttcctcagggaaacaccctacccatcttgga
